United States Patent 7,745,391 (HUMAN THROMBOSPONDIN POLYPEPTIDE) - sequence listing, part 178

SEQ ID NO: 440064 - DNA, 5600 bp, Homo sapiens
aggtccagagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtatccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacctctctccagtgatacataggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcgcctgtggacctgctcggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacagtgagtcatctggtcccctcagtctcttgtcctccccatgcctcgccacctaggccttgcccctcagaagccagatgcctgtgctctccgtttccacctgccatcctcccgagccctgctgactgcccctttgccccctgcagcccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtca

SEQ ID NO: 440065 - DNA, 5863 bp, Homo sapiens
aggtccagagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtatccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacctctctccagtgatacataggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcgcctgtggacctgctcggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcagtatgaagcaaaccggagaggcgggcagggctggggggagacagggaggctgaggtgtggccgaggacctgaccatctggaagtgtgaaaatccccttgggctcgtcagaagccttgggcttggccataaatagggaggcagtggcacctctccatgggggtggcgaaggtggaatgagaggatctacacagagtccccagcctgggctcaccctgcaccttctcttcccctctgaccacttttgcgcacgtcatccccgcagccaaggatgtcaaggccgctgctaatcagatgcgcaacttcctggttcgagcctcctgccgccttcgcttggaacctgggaaagaatatttgatcatgggtctggatggggccacctatgacctcgagggacagtgagtcatctggtcccctcagtctcttgtcctccccatgcctcgccacctaggccttgcccctcagaagccagatgcctgtgctctccgtttccacctgccatcctcccgagccctgctgactgcccctttgccccctgcagcccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtca

SEQ ID NO: 440066 - DNA, 756 bp, Homo sapiens
gtacagatataagttgaacgtcggtacccgcatgtgctgtaggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtca

SEQ ID NO: 440067 - DNA, 643 bp, Homo sapiens
gcgtttgtgtgctgtgtgctcgtgtgtgtgctgtgtgtgcgtgtgtgctgtggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtca

SEQ ID NO: 440068 - DNA, 3388 bp, Homo sapiens
aggtccagagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtatccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggttctgggtgcaagggcaagcaggaggggggccaggaaaggacagttactggaagatggacagcccaggaggctacagagggaaagaaagggggcccctgatgaggatggggagcatggccttgggctcaaacagcagaagggt

SEQ ID NO: 440069 - DNA, 823 bp, Homo sapiens
aggtccagagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatggtgagagctggaaactggagggac

SEQ ID NO: 440070 - DNA, 2372 bp, Homo sapiens
  misc_feature (25)..(25): n is a, c, g, or t
  misc_feature (28)..(28): n is a, c, g, or t
  misc_feature (30)..(30): n is a, c, g, or t
tgcacgccggtttttgtccgaggcncgngncgagtccgagcgccgccatggctctgctgtccgagggcctggacgagctgcccgccgcctgcctgtcgccgtgcgggccgcccaacccgaccgagctgttcagcgagtcacggcgcctggctctggaggagctggtggcgggcggccccgaagccttcgcggccttcctgcgacgcgagcgcctggctcgtttcctgaaccccgatgaggtgcacgccattctgcgcgcggcggagaggccgggagaggagggcgcggcggcggcggcggcggccgaggactcgttcggctcctcgcacgactgctcttcgggcacctacttccccgagcagtcggacctggagccaccgctgttggagcttggctggcccgccttctaccagggcgcctaccgcggcgccacgcgtgtcgagacgcacttccagccccgcggcgctggcgaaggtggcccctacggctgcaaggacgctctgcgccagcagctccgctcggcgcgagaggtgattgcagtggtcatggacgtgttcacagacatcgacatcttcagagacctgcaagaaatatgcaggaaacagggagttgctgtgtatatccttctggaccaggctctcctctctcaatttttggatatgtgcatggatctgaaagttcatcctgaacaggaaaagttaatgacagttcggactatcacaggaaatatctactatgcaaggtcaggaactaagattattgggaaggttcacgaaaagttcacgttgattgatggcatccgcgtggcaacaggctcctacagttttacatggacggatggcaaattaaacagcagtaacttggtaattctgtctggccaagtggttgaacactttgatctggagttccgaatcctgtatgcccagtccaagcccatcagccccaaactcctgtctcacttccagagcagcaacaagtttgatcacctcaccaaccgaaaaccacagtccaaggagctcaccctgggcaacctgctgcggatgcggctggctaggctgtcaagtactcccaggaaggcggacctggacccagagatgcccgcagagggcaaggcagagcgcaagccccatgactgtgagtcctctactgttagtgaggaagactacttcagcagccacagggacgagctccagagcagaaaggccattgacgctgccactcaaacagagccaggagaggagatgccagggctgagtgtgagtgaggtgggaacacaaaccagcatcaccacagcatgtgctggtacccagactgcagtcatcaccaggatagcaagctctcaaaccacgatttggtccagatcgaccactactcagactgacatggatgagaacattctctttcctcgaggaactcaatctacagaagggtcaccagtctcaaaaatgtctgtatcgagatcttccagtttgaagtcttcctcctctgtgtcttcccaaggctctgtggcaagctccactggttctcccgcttccatcagaaccactgacttccacaatcctggctatcccaagtacctgggcaccccccacctggaactgtacttgagtgactcacttagaaacttgaacaaagagcggcaattccacttcgctggtatcaggtcccggctcaaccacatgctggctatgctgtcaaggagaacactctttactgaaaaccaccttggccttcattctggcaatttcagcagagttaatttgcttgctgttagagatgtagcactttatccttcctatcagtaactgctccgtgttcagactcctggtttcttccaggcttacagtggacatcatcagcttcctgctttaaaaaatatcttatgtccctaattgcctttcttttacctgactttgtcacctttgttgtctttgaattctttaggctgcatattattttacatgctttgttttgtcatgtatataccaggtattggttttatggtttaaacactatggatacaggggtttgttttgcacaattttaatagtcatgcactacataatgatgttttggtcaatgacagaccacgtatatgttggcagtctcataagattataatactgtatttttactataccttttctgtgtttagatacaaataccattatgttacagttgcctacagtattcagtgcagtaacatgatgtacaggtttgtagcctgttttgcatttttcttaggttgtatgctcttctgttttaaaggtttgaatcaccagcatttttgtgatcaaaatcctatttagaaaaaataaaactactttctgtttaaaaaaaaaaaaaaactgtgttcttagcattaaataaat

SEQ ID NO: 440071 - DNA, 2372 bp, Homo sapiens
  misc_feature (25)..(25): n is a, c, g, or t
  misc_feature (28)..(28): n is a, c, g, or t
  misc_feature (30)..(30): n is a, c, g, or t
  misc_feature (1734)..(1734): n is a, c, g, or t
  misc_feature (1736)..(1736): n is a, c, g, or t
  misc_feature (1740)..(1740): n is a, c, g, or t
  misc_feature (1742)..(1742): n is a, c, g, or t
  misc_feature (1783)..(1783): n is a, c, g, or t
  misc_feature (1785)..(1785): n is a, c, g, or t
  misc_feature (1796)..(1796): n is a, c, g, or t
  misc_feature (1800)..(1800): n is a, c, g, or t
  misc_feature (1806)..(1806): n is a, c, g, or t
  misc_feature (1809)..(1809): n is a, c, g, or t
  misc_feature (1811)..(1812): n is a, c, g, or t
  misc_feature (1818)..(1818): n is a, c, g, or t
  misc_feature (1820)..(1820): n is a, c, g, or t
  misc_feature (1823)..(1825): n is a, c, g, or t
  misc_feature (1830)..(1830): n is a, c, g, or t
  misc_feature (1832)..(1832): n is a, c, g, or t
  misc_feature (1834)..(1836): n is a, c, g, or t
  misc_feature (1844)..(1844): n is a, c, g, or t
  misc_feature (1849)..(1849): n is a, c, g, or t
  misc_feature (1869)..(1869): n is a, c, g, or t
  misc_feature (1880)..(1880): n is a, c, g, or t
  misc_feature (1887)..(1887): n is a, c, g, or t
  misc_feature (1895)..(1896): n is a, c, g, or t
  misc_feature (1899)..(1899): n is a, c, g, or t
  misc_feature (1901)..(1901): n is a, c, g, or t
  misc_feature (1908)..(1908): n is a, c, g, or t
  misc_feature (1910)..(1910): n is a, c, g, or t
  misc_feature (1914)..(1914): n is a, c, g, or t
  misc_feature (1918)..(1918): n is a, c, g, or t
  misc_feature (1920)..(1921): n is a, c, g, or t
  misc_feature (1923)..(1923): n is a, c, g, or t
  misc_feature (1928)..(1929): n is a, c, g, or t
  misc_feature (1931)..(1932): n is a, c, g, or t
  misc_feature (1934)..(1934): n is a, c, g, or t
  misc_feature (1937)..(1938): n is a, c, g, or t
  misc_feature (1940)..(1940): n is a, c, g, or t
  misc_feature (1944)..(1944): n is a, c, g, or t
tgcacgccggtttttgtccgaggcncgngncgagtccgagcgccgccatggctctgctgtccgagggcctggacgagctgcccgccgcctgcctgtcgccgtgcgggccgcccaacccgaccgagctgttcagcgagtcacggcgcctggctctggaggagctggtggcgggcggccccgaagccttcgcggccttcctgcgacgcgagcgcctggctcgtttcctgaaccccgatgaggtgcacgccattctgcgcgcggcggagaggccgggagaggagggcgcggcggcggcggcggcggccgaggactcgttcggctcctcgcacgactgctcttcgggcacctacttccccgagcagtcggacctggagccaccgctgttggagcttggctggcccgccttctaccagggcgcctaccgcggcgccacgcgtgtcgagacgcacttccagccccgcggcgctggcgaaggtggcccctacggctgcaaggacgctctgcgccagcagctccgctcggcgcgagaggtgattgcagtggtcatggacgtgttcacagacatcgacatcttcagagacctgcaagaaatatgcaggaaacagggagttgctgtgtatatccttctggaccaggctctcctctctcaatttttggatatgtgcatggatctgaaagttcatcctgaacaggaaaagttaatgacagttcggactatcacaggaaatatctactatgcaaggtcaggaactaagattattgggaaggttcacgaaaagttcacgttgattgatggcatccgcgtggcaacaggctcctacagttttacatggacggatggcaaattaaacagcagtaacttggtaattctgtctggccaagtggttgaacactttgatctggagttccgaatcctgtatgcccagtccaagcccatcagccccaaactcctgtctcacttccagagcagcaacaagtttgatcacctcaccaaccgaaaaccacagtccaaggagctcaccctgggcaacctgctgcggatgcggctggctaggctgtcaagtactcccaggaaggcggacctggacccagagatgcccgcagagggcaaggcagagcgcaagccccatgactgtgagtcctctactgttagtgaggaagactacttcagcagccacagggacgagctccagagcagaaaggccattgacgctgccactcaaacagagccaggagaggagatgccagggctgagtgtgagtgaggtgggaacacaaaccagcatcaccacagcatgtgctggtacccagactgcagtcatcaccaggatagcaagctctcaaaccacgatttggtccagatcgaccactactcagactgacatggatgagaacattctctttcctcgaggaactcaatctacagaagggtcaccagtctcaaaaatgtctgtatcgagatcttccagtttgaagtcttcctcctctgtgtcttcccaaggctctgtggcaagctccactggttctcccgcttccatcagaaccactgacttccacaatcctggctatcccaagtacctgggcaccccccacctggaactgtacttgagtgactcacttagaaacttgaacaaagagcggcaattccacttcgctggtatcaggtcccggctcaaccacatgctggctatgctgtcaaggagaacactctttactgaaaaccaccttggccggnantcgnanaagggcagcaaaaaaaattaacgtactgtaaaaaagataanangggaaccgacngatnagtaangantnngtggananacnnnggggngngnnnacgcgganagggnacatcaccaccccccaccanaaaaaaatatnggagcgnccaaaggnncgngnggggacngnaccngcananngnggggnncnngnaanncngtangctgcatattattttacatgctttgttttgtcatgtatataccaggtattggttttatggtttaaacactatggatacaggggtttgttttgcacaattttaatagtcatgcactacataatgatgttttggtcaatgacagaccacgtatatgttggcagtctcataagattataatactgtatttttactataccttttctgtgtttagatacaaataccattatgttacagttgcctacagtattcagtgcagtaacatgatgtacaggtttgtagcctgttttgcatttttcttaggttgtatgctcttctgttttaaaggtttgaatcaccagcatttttgtgatcaaaatcctatttagaaaaaataaaactactttctgtttaaaaaaaaaaaaaaactgtgttcttagcattaaataaat

SEQ ID NO: 440072 - DNA, 1222 bp, Homo sapiens
caggatccttagaacggagctggaactcagggacgagctccagagcagaaaggccattgacgctgccactcaaacagagccaggagaggagatgccagggctgagtgtgagtgaggtgggaacacaaaccagcatcaccacagcatgtgctggtacccagactgcagtcatcaccaggatagcaagctctcaaaccacgatttggtccagatcgaccactactcagactgacatggatgagaacattctctttcctcgaggaactcaatctacagaagggtcaccagtctcaaaaatgtctgtatcgagatcttccagtttgaagtcttcctcctctgtgtcttcccaaggctctgtggcaagctccactggttctcccgcttccatcagaaccactgacttccacaatcctggctatcccaagtacctgggcaccccccacctggaactgtacttgagtgactcacttagaaacttgaacaaagagcggcaattccacttcgctggtatcaggtcccggctcaaccacatgctggctatgctgtcaaggagaacactctttactgaaaaccaccttggccttcattctggcaatttcagcagagttaatttgcttgctgttagagatgtagcactttatccttcctatcagtaactgctccgtgttcagactcctggtttcttccaggcttacagtggacatcatcagcttcctgctttaaaaaatatcttatgtccctaattgcctttcttttacctgactttgtcacctttgttgtctttgaattctttaggctgcatattattttacatgctttgttttgtcatgtatataccaggtattggttttatggtttaaacactatggatacaggggtttgttttgcacaattttaatagtcatgcactacataatgatgttttggtcaatgacagaccacgtatatgttggcagtctcataagattataatactgtatttttactataccttttctgtgtttagatacaaataccattatgttacagttgcctacagtattcagtgcagtaacatgatgtacaggtttgtagcctgttttgcatttttcttaggttgtatgctcttctgttttaaaggtttgaatcaccagcatttttgtgatcaaaatcctatttagaaaaaataaaactactttctgtttaaaaaaaaaaaaaaactgtgttcttagcattaaataaat

SEQ ID NO: 440073 - DNA, 2333 bp, Homo sapiens
  misc_feature (25)..(25): n is a, c, g, or t
  misc_feature (28)..(28): n is a, c, g, or t
  misc_feature (30)..(30): n is a, c, g, or t
tgcacgccggtttttgtccgaggcncgngncgagtccgagcgccgccatggctctgctgtccgagggcctggacgagctgcccgccgcctgcctgtcgccgtgcgggccgcccaacccgaccgagctgttcagcgagtcacggcgcctggctctggaggagctggtggcgggcggccccgaagccttcgcggccttcctgcgacgcgagcgcctggctcgtttcctgaaccccgatgaggtgcacgccattctgcgcgcggcggagaggccgggagaggagggcgcggcggcggcggcggcggccgaggactcgttcggctcctcgcacgactgctcttcgggcacctacttccccgagcagtcggacctggagccaccgctgttggagcttggctggcccgccttctaccagggcgcctaccgcggcgccacgcgtgtcgagacgcacttccagccccgcggcgctggcgaaggtggcccctacggctgcaaggacgctctgcgccagcagctccgctcggcgcgagaggtgattgcagtggtcatggacgtgttcacagacatcgacatcttcagagacctgcaagaaatatgcaggaaacagggagttgctgtgtatatccttctggaccaggctctcctctctcaatttttggatatgtgcatggatctgaaagttcatcctgaacaggaaaagttaatgacagttcggactatcacaggaaatatctactatgcaaggtcaggaactaagattattgggaaggttcacgaaaagttcacgttgattgatggcatccgcgtggcaacaggctcctacagttttacatggacggatggcaaattaaacagcagtaacttggtaattctgtctggccaagtggttgaacactttgatctggagttccgaatcctgtatgcccagtccaagcccatcagccccaaactcctgtctcacttccagagcagcaacaagtttgatcacctcaccaaccgaaaaccacagtccaaggagctcaccctgggcaacctgctgcggatgcggctggctaggctgtcaagtactcccaggaaggcggacctggacccagagatgcccgcagagggcaaggcagagcgcaagccccatgactgtgagtcctctactgttagtgaggaagactacttcagcagccacagggacgagctccagagcagaaaggccattgacgctgccactcaaacagagccaggagaggagatgccagggctgagtgtgagtgaggtgggaacacaaaccagcatcaccacagcatgtgctggtacccagactgcagtcatcaccaggatagcaagctctcaaaccacgatttggtccagatcgaccactactcagactgacatggatgagaacattctctttcctcgaggaactcaatctacagaagggtcaccagtctcaaaaatgtctgtatcgagatcttccagtttgaagtcttcctcctctgtgtcttcccaaggctctgtggcaagctccactggttctcccgcttccatcagaaccactgacttccacaatcctggctatcccaagtacctgggcaccccccacctggaactgtacttgagtgactcacttagaaacttgaacaaagagcggcaattccacttcgctggtatcaggtcccggctcaaccacatgctggctatgctgtcaaggagaacactctttactgaaaaccaccttggccttcattctggcaatttcagcagagttaatttgcttgctgttagagatgtagcactttatccttcctatcagtaactgctccgtgttcagactcctggtttcttccaggcttacagtggacatcatcagcttcctgctttaaaaaatatcttatgtccctaattgcctttcttttacctgactttgtcacctttgttgtctttgaattctttaggctgcatattattttacatgctttgttttgtcatgtatataccaggtattggttttatggtttaaacactatggatacaggggtttgttttgcacaattttaatagtcatgcactacataatgatgttttggtcaatgacagaccacgtatatgttggcagtctcataagattataatactgtatttttactataccttttctgtgtttagatacaaataccattatgttacagttgcctacagtattcagtgcagtaacatgatgtacaggtttgtagcctgttttgcatttttcttaggttgtatgctcttctgttttaaaggtttgaatcaccagcatttttgtgatcaaaatcctatttagaaaaaataaaactactttctgttt

SEQ ID NO: 440074 - DNA, 2522 bp, Homo sapiens
  misc_feature (25)..(25): n is a, c, g, or t
  misc_feature (28)..(28): n is a, c, g, or t
  misc_feature (30)..(30): n is a, c, g, or t
tgcacgccggtttttgtccgaggcncgngncgagtccgagcgccgccatggctctgctgtccgagggcctggacgagctgcccgccgcctgcctgtcgccgtgcgggccgcccaacccgaccgagctgttcagcgagtcacggcgcctggctctggaggagctggtggcgggcggccccgaagccttcgcggccttccttgctgacctgctgatgctgccttgtgcttctggtttcacttgagcaccacctggattgatgtgttgcactggccaatattcttgctgccgctgtgctgtgactgatggccctgtggaggatgggatgggtggctgctgtgcttgtgctgtgctgtgctgtgctgtgcctgatgtgaccatctgtatctgtgcatcctctggcactgacgttgcgtctatctgtggcaccgtacttacccctgatgccacgtctgtgacccttgtgaagcacaccatgcgtagttttggatgctttgtgattggccctgcacttcttaccatgtggctgccgtacctgctgggctgccgacgctgttgtacgatggactgcgactctcgcatgaccctctgagctgggactggctgggccgaccgtgttgtggccctaccgggttgcaacggactgctcttgctgccaggcagctccgctcgggtgcgagaggtgattgcagtggtcatggacgtgttcacagacatcgacatcttcagagacctgcaagaaatatgcaggaaacagggagttgctgtgtatatccttctggaccaggctctcctctctcaatttttggatatgtgcatggatctgaaagttcatcctgaacaggaaaagttaatgacagttcggactatcacaggaaatatctactatgcaaggtcaggaactaagattattgggaaggttcacgaaaagttcacgttgattgatggcatccgcgtggcaacaggctcctacagttttacatggacggatggcaaattaaacagcagtaacttggtaattctgtctggccaagtggttgaacactttgatctggagttccgaatcctgtatgcccagtccaagcccatcagccccaaactcctgtctcacttccagagcagcaacaagtttgatcacctcaccaaccgaaaaccacagtccaaggagctcaccctgggcaacctgctgcggatgcggctggctaggctgtcaagtactcccaggaaggcggacctggacccagagatgcccgcagagggcaaggcagagcgcaagccccatgactgtgagtcctctactgttagtgaggaagactacttcagcagccacagggacgagctccagagcagaaaggccattgacgctgccactcaaacagagccaggagaggagatgccagggctgagtgtgagtgaggtgggaacacaaaccagcatcaccacagcatgtgctggtacccagactgcagtcatcaccaggatagcaagctctcaaaccacgatttggtccagatcgaccactactcagactgacatggatgagaacattctctttcctcgaggaactcaatctacagaagggtcaccagtctcaaaaatgtctgtatcgagatcttccagtttgaagtcttcctcctctgtgtcttcccaaggctctgtggcaagctccactggttctcccgcttccatcagaaccactgacttccacaatcctggctatcccaagtacctgggcaccccccacctggaactgtacttgagtgactcacttagaaacttgaacaaagagcggcaattccacttcgctggtatcaggtcccggctcaaccacatgctggctatgctgtcaaggagaacactctttactgaaaaccaccttggccttcattctggcaatttcagcagagttaatttgcttgctgttagagatgtagcactttatccttcctatcagtaactgctccgtgttcagactcctggtttcttccaggcttacagtggacatcatcagcttcctgctttaaaaaatatcttatgtccctaattgcctttcttttacctgactttgtcacctttgttgtctttgaattctttaggctgcatattattttacatgctttgttttgtcatgtatataccaggtattggttttatggtttaaacactatggatacaggggtttgttttgcacaattttaatagtcatgcactacataatgatgttttggtcaatgacagaccacgtatatgttggcagtctcataagattataatactgtatttttactataccttttctgtgtttagatacaaataccattatgttacagttgcctacagtattcagtgcagtaacatgatgtacaggtttgtagcctgttttgcatttttcttaggttgtatgctcttctgttttaaaggtttgaatcaccagcatttttgtgatcaaaatcctatttagaaaaaataaaactactttctgtttaaaaaaaaaaaaaaactgtgttcttagcattaaataaat

SEQ ID NO: 440075 - DNA, 425 bp, Homo sapiens
ccggatccaacgttggatccgaatttggatccgaattcggatccaacggccgccctttttttttcccttgctcagaaagtacctgtaatttaacaaacagactgcctgtaggtatagtgcaattacaaatgctctaatcattgtacatacatctctcttgatattgcagcatccatactggctttgtaatcattaattttttggcagattgaatgtgctgtattgatatgtatctatgtaattgtattgtatgtctatagctaattcacgttttgaataatgttattttatttacttttttaagagaggagaatgtaaatttgtcagtttatttctgactagggatattttctttccatttagaaaagaaaatatccctagtcagaaataaactgacaaatttacattctcctctcttaaaaaaa

SEQ ID NO: 440076 - DNA, 6757 bp, Homo sapiens
cggccgctcgctgcggggacaccccggtgaatgagctctcgccgccaggcgcacggcgtaggggagcctcgcaggcggcggcggcggcggcggctcggggggcgaggcgggccgcctgttcccggggaaggaggcgcgggcgtctgagcgaggccgggcgcggcggccttctctcacgcgccccccgagccagcgcccgcctcccgcgcccgcctctcttctcccgtcggcccagactatccgctcccaccgcgcccccggcccacctggtggccccggccctggccgccgcccccgcggctgtgcccgggagctcgtcccggacgcgcgaccgggcggcgggggctcggcggccaccgctgcctcaagggagcgagggcgggagggtgtgtgtgcgcggctgtgagcaggggtgccggcggggctgcagcggaggcactttggaagaatgactctggagtccatcatggcgtgctgcctgagcgaggaggccaaggaagcccggcggatcaacgacgagatcgagcggcagctccgcagggacaagcgggacgcccgccgggagctcaagctgctgctgctcgggacaggagagagtggcaagagtacgtttatcaagcagatgagaatcatccatgggtcaggatactctgatgaagataaaaggggcttcaccaagctggtgtatcagaacatcttcacggccatgcaggccatgatcagagccatggacacactcaagatcccatacaagtatgagcacaataaggctcatgcacaattagttcgagaagttgatgtggagaaggtgtctgcttttgagaatccatatgtagatgcaataaagagtttatggaatgatcctggaatccaggaatgctatgatagacgacgagaatatcaattatctgactctaccaaatactatcttaatgacttggaccgcgtagctgaccctgcctacctgcctacgcaacaagatgtgcttagagttcgagtccccaccacagggatcatcgaatacccctttgacttacaaagtgtcattttcagaatggtcgatgtagggggccaaaggtcagagagaagaaaatggatacactgctttgaaaatgtcacctctatcatgtttctagtagcgcttagtgaatatgatcaagttctcgtggagtcagacaatgagaaccgaatggaggaaagcaaggctctctttagaacaattatcacatacccctggttccagaactcctcggttattctgttcttaaacaagaaagatcttctagaggagaaaatcatgtattcccatctagtcgactacttcccagaatatgatggaccccagagagatgcccaggcagcccgagaattcattctgaagatgttcgtggacctgaacccagacagtgacaaaattatctactcccacttcacgtgcgccacagacaccgagaatatccgctttgtctttgctgccgtcaaggacaccatcctccagttgaacctgaaggagtacaatctggtctaattgtgcctcctagacacccgccctgcccttccctggtgggctattgaagatacacaagagggactgtatttctgtggaaaacaatttgcataatactaatttattgccgtcctggactctgtgtgagcgtgtccacagagtttgtagtaaatattatgattttatttaaactattcagaggaaaaacagaggatgctgaagtacagtcccagcacatttcctctctatcttttttttaggcaaaaccttgtgactcagtgtattttaaattctcagtcatgcactcacaaagataagacttgtttctttctgtctctctctctttttcttttctatggagcaaaacaaagctgatttcccttttttcttcccccgctaattcatacctccctcctgatgtttttcccaggttacaatggcctttatcctagttccattcttggtcaagtttttctctcaaatgatacagtcaggacacatcgttcgatttaagccatcatcagcttaatttaagtttgtagtttttgctgaaggattatatgtattaatacttacggttttaaatgtgttgctttggatacacacatagtttcttttttaatagaatatactgtcttgtctcactttggactgggacagtggatgcccatctaaaagttaagtgtcatttcttttagatgtttaccttcagccatagcttgattgctcagagaaatatgcagaaggcaggatcaaagacacacaggagtcctttcttttgaaatgccacgtgccattgtctttcctcccttctttgcttctttttcttaccctctctttcaattgcagatgccaaaaaagatgccaacagacactacattaccctaatggctgctacccagaacctttttataggttgttcttaatttttttgttgttgttgttcaagcttttcctttcttttttttcttagtgtttgggccacgattttaaaatgacttttattatgggtatgtgttgccaaagctggctttttgtcaaataaaatgaatacgaacttaaaaaataaaagctggtatcttaaaatgtaagagagtaagactgtgaagcctaaaatgactggctgagaatgaaccagaaatgccatttgccaaacagttgtaactagaaatttgattctcacagtccattcttttctttgtccttaagatgacattgttagtgttcacgtcccatgttcagtgtccaaaccggcaatgtaaaaagtatcctgtgtggcttaacaggaaatctgtttatgtctctttatttgaaaccagttttactctcagtggttctttaagttcaatgaagtctgccaggaacattggttggtagtattattccgacacctttaatttccaaaatctgaagttcctgctagtttaccaccttcatgatcttcttgaactggtaactgattaggttgaacttatggaagatttgtggacttaactcaaaagtaacctctcagtgttctatagaacatgtatttgtgtaactgaacctaccaggagaaatgtttggaattctatatgtgcaatttttcaacaaatgcaaaaaaaatacagcacatgtattgacaagcttctgtcaagcagcttgagttgaaatttgatttaagaaaataaatcatgattgttcaaagctgctgggacgttagaattaggccatgatactggtctcattttaactacagtggtatttggcactagtgtaaacttccatataaatcactcttttggaacaacaaagggggagggagaaaaatcacggcctgttaaatgagtaccaaagccgcccaacagtaatgagatgttctcatccttgattctcccagcctcaaacaacacagcttactttttttttcccttgctcagaaagtacctgtaatttaacaaacagactgcctgtaggtatagtgcaattacaaatgctctaatcattgtacatacatctctcttgatattgcagcatccatactggctttgtaatcattaattttttggcagattgaatgtgctgtattgatatgtatctatgtaattgtattgtatgtctatagctaattcacgttttgaataatgttattttatttacttttttaagagaggagaatgtaaatttgtcagtttatttctgactagggatattttctttccatttagaaaagaagaaaaaaaaaaaaccttactgtcatacagagcggtactagcgtcgtgctgtataaaatcatttgcacattcctgagtagaggtatactgattataagacccaaaggtaatttcatagcaaaatacataaaatcagtcggagcttttatacaaacatggaaaccaactttgtagaacttttgccatttgatctaggattggaatatgagcttttatacaattcatattcttatttggcaaatgcacagtttagtattacctctctgatggcctttactagaaaggcagttttagaagctattgtgatccactaaggaaatgttttaacagctagagaccactgcttgcctgaaagggcgttcttaaatttggtgcagcaaaaaaaaaaaaaaaaaaaaaaaaaaaattaaacaacaacatttgaaggcctacagtgtgtatagagaaaacctcatcacaagatcataagtgttacagttttagggaatcaagatattctatttaatagagctatagtaaatgtagtcaattaaacctgatctcaaagcttgaagaagctgagcaaaacagggaaagattgttatatttgtctttatgaaattgggatggaatttgctatgcagaattgaggtttgtggctttgctgttcctgtagggtgcatgacaagatcccttctcttgagaaaggaaaaaattgatcaccctagcagcagtgatgcatagaaacctaattttagccacaccagtcaatcgaagctaaaggattttcttttttgtttcttcggggttttattgaaggggctaggggcgggacgggattcttttcagttttgtataaaaacaaagtttactcatgctttatattatattgtgattgcaagcgttataagcgtgtgccactggcctcctattgttgatgcttaggtaatggaggcctgtggtgagttttatggtgacttgggcatgtcttattcaaaaacaaaaacataaaacacagaaacctttcttcagcataccaaggcaagcagccatttcatgactcacttaacacattgcagtgtaccagtttacagatgatttttccctttttgcgtgacatggcagttctaacccccagagaattccttatttgtaaattggaagtttctactatgccttacagagcttaaattcaggaagtttgtgcctcatatctggaaacaaagggaaataacacacccattcaaaagtaaataaatctcctagaagtttttgtttttaacatttccatataaagagctctgttgaatgtcatgaatagactggaaaaaaaaattttaagaacctgcatatgttgtttactagcagatgacaactacaaaaggaatctgaagaacacgtaaaacttgtatttttttttttttggtagattaactagcaggcctattttaaaaaggtaattcagctaaagggcaatttacttttttgtacttcagactatcttgattgtcaaagtgtacgaactgtaattttaaaatttatactgccacatgattgtaaattttagttgtcttaagttaggaattggtgaaaagctatttatgctggatttgggtcaaaatgacttatttgcaaaaaaataaataatgggaagaaagggctgtataatgaaatactgcaagactcacatattggttggaaatttccctcaaatcacctaccgattacccttgatttccctttgttttcagtttctcaaaacgaatgaaatgaaatatagcagaatgttaacccatataaaaataaagtgtacccaaatattgtaatgtatattgctgctcttcttcaaattaaataagggtttaaaaccacttaattggtaatcaacatctcaattgatacaaataaggtgtgcttggtatacattaatattttcttccaaagatatatctttggttagaaacacaaaaaaataaaactagtaatattgtatgtttatctatctctacatatttccagcatatgtagcgttaatagatctgtcctggtaactgtgtctttgggatttcattttggttccatcaaattaggaaaagaaatggcttagttgtatatgattagctagagatttttggagccagacacctgctgtttagtagataacttagtacagaccctaaacttgtcatttgtttttctcacagaatagccatttcctgctgtcttcccaatgatcactgccctttcaataacactcttgcctctagaatcatatgttcaaagtatgaatacacacctagcacatagtaggtgctcaaatattaatttcctccttgccttccttatctaccctgtgtcctccatttccccgtatgattccaacccaatatagcaaatgacatttacatgttatgaaaacatctattgggtaaaatcagatcttggataaagaaattctgacttttatataagcttttggtagacagaaaaaacagaaaggtattcgttggtagaacatttttaagttcaggaaagaaagctggaataatactacgtaactttgtccaggttactttgactgaaacacgtttttggtggatttcttttcctcaaagaactctctaaatgcaactccttgctggattcctcacccatcatcctgttggaaacccttactagacctatgtatttagggagttttgtcagaaaacatttttaacttgcagtatttaaaagaatatttactgttcctaaaatgtcattcaaatgcatgtactgtctattgtttggggatgggaactagttttgcaaaaaacacctaatgttgtataataatgccccaatgatcttgctggttaaaaatacagtatttttggccataattttgtactatagtattcttcattgttgagttttgcttccattaaagttgcccgagcccctctcagaatgttttgtattagtaggagtactgaaatacatctttccttccttaacacaccttgtgcatattgcattttccaaaataaacaagtttaatggtttcaaaaaaaaaaaa

SEQ ID NO: 440077 - DNA, 6703 bp, Homo sapiens
cggccgctcgctgcggggacaccccggtgaatgagctctcgccgccaggcgcacggcgtaggggagcctcgcaggcggcggcggcggcggcggctcggggggcgaggcgggccgcctgttcccggggaaggaggcgcgggcgtctgagcgaggccgggcgcggcggccttctctcacgcgccccccgagccagcgcccgcctcccgcgcccgcctctcttctcccgtcggcccagactatccgctcccaccgcgcccccggcccacctggtggccccggccctggccgccgcccccgcggctgtgcccgggagctcgtcccggacgcgcgaccgggcggcgggggctcggcggccaccgctgcctcaagggagcgagggcgggagggtgtgtgtgcgcggctgtgagcaggggtgccggcggggctgcagcggaggcactttggaagaatgactctggagtccatcatggcgtgctgcctgagcgaggaggccaaggaagcccggcggatcaacgacgagatcgagcggcagctccgcagggacaagcgggacgcccgccgggagctcaagctgctgctgctcgggacaggagagagtggcaagagtacgtttatcaagcagatgagaatcatccatgggtcaggatactctgatgaagataaaaggggcttcaccaagctggtgtatcagaacatcttcacggccatgcaggccatgatcagagccatggacacactcaagatcccatacaagtatgagcacaataaggctcatgcacaattagttcgagaagttgatgtggagaaggtgtctgcttttgagaatccatatgtagatgcaataaagagtttatggaatgatcctggaatccaggaatgctatgatagacgacgagaatatcaattatctgactctaccaaatactatcttaatgacttggaccgcgtagctgaccctgcctacctgcctacgcaacaagatgtgcttagagttcgagtccccaccacagggatcatcgaatacccctttgacttacaaagtgtcattttcagaatggtcgatgtagggggccaaaggtcagagagaagaaaatggatacactgctttgaaaatgtcacctctatcatgtttctagtagcgcttagtgaatatgatcaagttctcgtggagtcagacaatgagaaccgaatggaggaaagcaaggctctctttagaacaattatcacatacccctggttccagaactcctcggttattctgttcttaaacaagaaagatcttctagaggagaaaatcatgtattcccatctagtcgactacttcccagaatatgatggaccccagagagatgcccaggcagcccgagaattcattctgaagatgttcgtggacctgaacccagacagtgacaaaattatctactcccacttcacgtgcgccacagacaccgagaatatccgctttgtctttgctgccgtcaaggacaccatcctccagttgaacctgaaggagtacaatctggtctaattgtgcctcctagacacccgccctgcccttccctggtgggctattgaagatacacaagagggactgtatttctgtggaaaacaatttgcataatactaatttattgccgtcctggactctgtgtgagcgtgtccacagagtttgtagtaaatattatgattttatttaaactattcagaggaaaaacagaggatgctgaagtacagtcccagcacatttcctctctatcttttttttaggcaaaaccttgtgactcagtgtattttaaattctcagtcatgcactcacaaagataagacttgtttctttctgtctctctctctttttcttttctatggagcaaaacaaagctgatttcccttttttcttcccccgctaattcatacctccctcctgatgtttttcccaggttacaatggcctttatcctagttccattcttggtcaagtttttctctcaaatgatacagtcaggacacatcgttcgatttaagccatcatcagcttaatttaagtttgtagtttttgctgaaggattatatgtattaatacttacggttttaaatgtgttgctttggatacacacatagtttcttttttaatagaatatactgtcttgtctcactttggactgggacagtggatgcccatctaaaagttaagtgtcatttcttttagatgtttaccttcagccatagcttgattgctcagagaaatatgcagaaggcaggatcaaagacacacaggagtcctttcttttgaaatgccacgtgccattgtctttcctcccttctttgcttctttttcttaccctctctttcaattgcagatgccaatataggttgttcttaatttttttgttgttgttgttcaagcttttcctttcttttttttcttagtgtttgggccacgattttaaaatgacttttattatgggtatgtgttgccaaagctggctttttgtcaaataaaatgaatacgaacttaaaaaataaaagctggtatcttaaaatgtaagagagtaagactgtgaagcctaaaatgactggctgagaatgaaccagaaatgccatttgccaaacagttgtaactagaaatttgattctcacagtccattcttttctttgtccttaagatgacattgttagtgttcacgtcccatgttcagtgtccaaaccggcaatgtaaaaagtatcctgtgtggcttaacaggaaatctgtttatgtctctttatttgaaaccagttttactctcagtggttctttaagttcaatgaagtctgccaggaacattggttggtagtattattccgacacctttaatttccaaaatctgaagttcctgctagtttaccaccttcatgatcttcttgaactggtaactgattaggttgaacttatggaagatttgtggacttaactcaaaagtaacctctcagtgttctatagaacatgtatttgtgtaactgaacctaccaggagaaatgtttggaattctatatgtgcaatttttcaacaaatgcaaaaaaaatacagcacatgtattgacaagcttctgtcaagcagcttgagttgaaatttgatttaagaaaataaatcatgattgttcaaagctgctgggacgttagaattaggccatgatactggtctcattttaactacagtggtatttggcactagtgtaaacttccatataaatcactcttttggaacaacaaagggggagggagaaaaatcacggcctgttaaatgagtaccaaagccgcccaacagtaatgagatgttctcatccttgattctcccagcctcaaacaacacagcttactttttttttcccttgctcagaaagtacctgtaatttaacaaacagactgcctgtaggtatagtgcaattacaaatgctctaatcattgtacatacatctctcttgatattgcagcatccatactggctttgtaatcattaattttttggcagattgaatgtgctgtattgatatgtatctatgtaattgtattgtatgtctatagctaattcacgttttgaataatgttattttatttacttttttaagagaggagaatgtaaatttgtcagtttatttctgactagggatattttctttccatttagaaaagaagaaaaaaaaaaaaccttactgtcatacagagcggtactagcgtcgtgctgtataaaatcatttgcacattcctgagtagaggtatactgattataagacccaaaggtaatttcatagcaaaatacataaaatcagtcggagcttttatacaaacatggaaaccaactttgtagaacttttgccatttgatctaggattggaatatgagcttttatacaattcatattcttatttggcaaatgcacagtttagtattacctctctgatggcctttactagaaaggcagttttagaagctattgtgatccactaaggaaatgttttaacagctagagaccactgcttgcctgaaagggcgttcttaaatttggtgcagcaaaaaaaaaaaaaaaaaaaaaaaaaaaattaaacaacaacatttgaaggcctacagtgtgtatagagaaaacctcatcacaagatcataagtgttacagttttagggaatcaagatattctatttaatagagctatagtaaatgtagtcaattaaacctgatctcaaagcttgaagaagctgagcaaaacagggaaagattgttatatttgtctttatgaaattgggatggaatttgctatgcagaattgaggtttgtggctttgctgttcctgtagggtgcatgacaagatcccttctcttgagaaaggaaaaaattgatcaccctagcagcagtgatgcatagaaacctaattttagccacaccagtcaatcgaagctaaaggattttcttttttgtttcttcggggttttattgaaggggctaggggcgggacgggattcttttcagttttgtataaaaacaaagtttactcatgctttatattatattgtgattgcaagcgttataagcgtgtgccactggcctcctattgttgatgcttaggtaatggaggcctgtggtgagttttatggtgacttgggcatgtcttattcaaaaacaaaaacataaaacacagaaacctttcttcagcataccaaggcaagcagccatttcatgactcacttaacacattgcagtgtaccagtttacagatgatttttccctttttgcgtgacatggcagttctaacccccagagaattccttatttgtaaattggaagtttctactatgccttacagagcttaaattcaggaagtttgtgcctcatatctggaaacaaagggaaataacacacccattcaaaagtaaataaatctcctagaagtttttgtttttaacatttccatataaagagctctgttgaatgtcatgaatagactggaaaaaaaaattttaagaacctgcatatgttgtttactagcagatgacaactacaaaaggaatctgaagaacacgtaaaacttgtatttttttttttttggtagattaactagcaggcctattttaaaaaggtaattcagctaaagggcaatttacttttttgtacttcagactatcttgattgtcaaagtgtacgaactgtaattttaaaatttatactgccacatgattgtaaattttagttgtcttaagttaggaattggtgaaaagctatttatgctggatttgggtcaaaatgacttatttgcaaaaaaataaataatgggaagaaagggctgtataatgaaatactgcaagactcacatattggttggaaatttccctcaaatcacctaccgattacccttgatttccctttgttttcagtttctcaaaacgaatgaaatgaaatatagcagaatgttaacccatataaaaataaagtgtacccaaatattgtaatgtatattgctgctcttcttcaaattaaataagggtttaaaaccacttaattggtaatcaacatctcaattgatacaaataaggtgtgcttggtatacattaatattttcttccaaagatatatctttggttagaaacacaaaaaaataaaactagtaatattgtatgtttatctatctctacatatttccagcatatgtagcgttaatagatctgtcctggtaactgtgtctttgggatttcattttggttccatcaaattaggaaaagaaatggcttagttgtatatgattagctagagatttttggagccagacacctgctgtttagtagataacttagtacagaccctaaacttgtcatttgtttttctcacagaatagccatttcctgctgtcttcccaatgatcactgccctttcaataacactcttgcctctagaatcatatgttcaaagtatgaatacacacctagcacatagtaggtgctcaaatattaatttcctccttgccttccttatctaccctgtgtcctccatttccccgtatgattccaacccaatatagcaaatgacatttacatgttatgaaaacatctattgggtaaaatcagatcttggataaagaaattctgacttttatataagcttttggtagacagaaaaaacagaaaggtattcgttggtagaacatttttaagttcaggaaagaaagctggaataatactacgtaactttgtccaggttactttgactgaaacacgtttttggtggatttcttttcctcaaagaactctctaaatgcaactccttgctggattcctcacccatcatcctgttggaaacccttactagacctatgtatttagggagttttgtcagaaaacatttttaacttgcagtatttaaaagaatatttactgttcctaaaatgtcattcaaatgcatgtactgtctattgtttggggatgggaactagttttgcaaaaaacacctaatgttgtataataatgccccaatgatcttgctggttaaaaatacagtatttttggccataattttgtactatagtattcttcattgttgagttttgcttccattaaagttgcccgagcccctctcagaatgttttgtattagtaggagtactgaaatacatctttccttccttaacacaccttgtgcatattgcattttccaaaataaacaagtttaatggtttcaaaaaaaaaaaa

SEQ ID NO: 440078 - DNA, 6711 bp, Homo sapiens
cggccgctcgctgcggggacaccccggtgaatgagctctcgccgccaggcgcacggcgtaggggagcctcgcaggcggcggcggcggcggcggctcggggggcgaggcgggccgcctgttcccggggaaggaggcgcgggcgtctgagcgaggccgggcgcggcggccttctctcacgcgccccccgagccagcgcccgcctcccgcgcccgcctctcttctcccgtcggcccagactatccgctcccaccgcgcccccggcccacctggtggccccggccctggccgccgcccccgcggctgtgcccgggagctcgtcccggacgcgcgaccgggcggcgggggctcggcggccaccgctgcctcaagggagcgagggcgggagggtgtgtgtgcgcggctgtgagcaggggtgccggcggggctgcagcggaggcactttggaagaatgactctggagtccatcatggcgtgctgcctgagcgaggaggccaaggaagcccggcggatcaacgacgagatcgagcggcagctccgcagggacaagcgggacgcccgccgggagctcaagctgctgctgctcgggacaggagagagtggcaagagtacgtttatcaagcagatgagaatcatccatgggtcaggatactctgatgaagataaaaggggcttcaccaagctggtgtatcagaacatcttcacggccatgcaggccatgatcagagccatggacacactcaagatcccatacaagtatgagcacaataaggctcatgcacaattagttcgagaagttgatgtggagaaggtgtctgcttttgagaatccatatgtagatgcaataaagagtttatggaatgatcctggaatccaggaatgctatgatagacgacgagaatatcaattatctgactctaccaaatactatcttaatgacttggaccgcgtagctgaccctgcctacctgcctacgcaacaagatgtgcttagagttcgagtccccaccacagggatcatcgaatacccctttgacttacaaagtgtcattttcagaatggtcgatgtagggggccaaaggtcagagagaagaaaatggatacactgctttgaaaatgtcacctctatcatgtttctagtagcgcttagtgaatatgatcaagttctcgtggagtcagacaatgagaaccgaatggaggaaagcaaggctctctttagaacaattatcacatacccctggttccagaactcctcggttattctgttcttaaacaagaaagatcttctagaggagaaaatcatgtattcccatctagtcgactacttcccagaatatgatggaccccagagagatgcccaggcagcccgagaattcattctgaagatgttcgtggacctgaacccagacagtgacaaaattatctactcccacttcacgtgcgccacagacaccgagaatatccgctttgtctttgctgccgtcaaggacaccatcctccagttgaacctgaaggagtacaatctggtctaattgtgcctcctagacacccgccctgcccttccctggtgggctattgaagatacacaagagggactgtatttctgtggaaaacaatttgcataatactaatttattgccgtcctggatatttaaactattcagaggaaaaacagaggatgctgaagtacagtcccagcacatttcctctctatcttttttttaggcaaaaccttgtgactcagtgtattttaaattctcagtcatgcactcacaaagataagacttgtttctttctgtctctctctctttttcttttctatggagcaaaacaaagctgatttcccttttttcttcccccgctaattcatacctccctcctgatgtttttcccaggttacaatggcctttatcctagttccattcttggtcaagtttttctctcaaatgatacagtcaggacacatcgttcgatttaagccatcatcagcttaatttaagtttgtagtttttgctgaaggattatatgtattaatacttacggttttaaatgtgttgctttggatacacacatagtttcttttttaatagaatatactgtcttgtctcactttggactgggacagtggatgcccatctaaaagttaagtgtcatttcttttagatgtttaccttcagccatagcttgattgctcagagaaatatgcagaaggcaggatcaaagacacacaggagtcctttcttttgaaatgccacgtgccattgtctttcctcccttctttgcttctttttcttaccctctctttcaattgcagatgccaaaaaagatgccaacagacactacattaccctaatggctgctacccagaacctttttataggttgttcttaatttttttgttgttgttgttcaagcttttcctttcttttttttcttagtgtttgggccacgattttaaaatgacttttattatgggtatgtgttgccaaagctggctttttgtcaaataaaatgaatacgaacttaaaaaataaaagctggtatcttaaaatgtaagagagtaagactgtgaagcctaaaatgactggctgagaatgaaccagaaatgccatttgccaaacagttgtaactagaaatttgattctcacagtccattcttttctttgtccttaagatgacattgttagtgttcacgtcccatgttcagtgtccaaaccggcaatgtaaaaagtatcctgtgtggcttaacaggaaatctgtttatgtctctttatttgaaaccagttttactctcagtggttctttaagttcaatgaagtctgccaggaacattggttggtagtattattccgacacctttaatttccaaaatctgaagttcctgctagtttaccaccttcatgatcttcttgaactggtaactgattaggttgaacttatggaagatttgtggacttaactcaaaagtaacctctcagtgttctatagaacatgtatttgtgtaactgaacctaccaggagaaatgtttggaattctatatgtgcaatttttcaacaaatgcaaaaaaaatacagcacatgtattgacaagcttctgtcaagcagcttgagttgaaatttgatttaagaaaataaatcatgattgttcaaagctgctgggacgttagaattaggccatgatactggtctcattttaactacagtggtatttggcactagtgtaaacttccatataaatcactcttttggaacaacaaagggggagggagaaaaatcacggcctgttaaatgagtaccaaagccgcccaacagtaatgagatgttctcatccttgattctcccagcctcaaacaacacagcttactttttttttcccttgctcagaaagtacctgtaatttaacaaacagactgcctgtaggtatagtgcaattacaaatgctctaatcattgtacatacatctctcttgatattgcagcatccatactggctttgtaatcattaattttttggcagattgaatgtgctgtattgatatgtatctatgtaattgtattgtatgtctatagctaattcacgttttgaataatgttattttatttacttttttaagagaggagaatgtaaatttgtcagtttatttctgactagggatattttctttccatttagaaaagaagaaaaaaaaaaaaccttactgtcatacagagcggtactagcgtcgtgctgtataaaatcatttgcacattcctgagtagaggtatactgattataagacccaaaggtaatttcatagcaaaatacataaaatcagtcggagcttttatacaaacatggaaaccaactttgtagaacttttgccatttgatctaggattggaatatgagcttttatacaattcatattcttatttggcaaatgcacagtttagtattacctctctgatggcctttactagaaaggcagttttagaagctattgtgatccactaaggaaatgttttaacagctagagaccactgcttgcctgaaagggcgttcttaaatttggtgcagcaaaaaaaaaaaaaaaaaaaaaaaaaaaattaaacaacaacatttgaaggcctacagtgtgtatagagaaaacctcatcacaagatcataagtgttacagttttagggaatcaagatattctatttaatagagctatagtaaatgtagtcaattaaacctgatctcaaagcttgaagaagctgagcaaaacagggaaagattgttatatttgtctttatgaaattgggatggaatttgctatgcagaattgaggtttgtggctttgctgttcctgtagggtgcatgacaagatcccttctcttgagaaaggaaaaaattgatcaccctagcagcagtgatgcatagaaacctaattttagccacaccagtcaatcgaagctaaaggattttcttttttgtttcttcggggttttattgaaggggctaggggcgggacgggattcttttcagttttgtataaaaacaaagtttactcatgctttatattatattgtgattgcaagcgttataagcgtgtgccactggcctcctattgttgatgcttaggtaatggaggcctgtggtgagttttatggtgacttgggcatgtcttattcaaaaacaaaaacataaaacacagaaacctttcttcagcataccaaggcaagcagccatttcatgactcacttaacacattgcagtgtaccagtttacagatgatttttccctttttgcgtgacatggcagttctaacccccagagaattccttatttgtaaattggaagtttctactatgccttacagagcttaaattcaggaagtttgtgcctcatatctggaaacaaagggaaataacacacccattcaaaagtaaataaatctcctagaagtttttgtttttaacatttccatataaagagctctgttgaatgtcatgaatagactggaaaaaaaaattttaagaacctgcatatgttgtttactagcagatgacaactacaaaaggaatctgaagaacacgtaaaacttgtatttttttttttttggtagattaactagcaggcctattttaaaaaggtaattcagctaaagggcaatttacttttttgtacttcagactatcttgattgtcaaagtgtacgaactgtaattttaaaatttatactgccacatgattgtaaattttagttgtcttaagttaggaattggtgaaaagctatttatgctggatttgggtcaaaatgacttatttgcaaaaaaataaataatgggaagaaagggctgtataatgaaatactgcaagactcacatattggttggaaatttccctcaaatcacctaccgattacccttgatttccctttgttttcagtttctcaaaacgaatgaaatgaaatatagcagaatgttaacccatataaaaataaagtgtacccaaatattgtaatgtatattgctgctcttcttcaaattaaataagggtttaaaaccacttaattggtaatcaacatctcaattgatacaaataaggtgtgcttggtatacattaatattttcttccaaagatatatctttggttagaaacacaaaaaaataaaactagtaatattgtatgtttatctatctctacatatttccagcatatgtagcgttaatagatctgtcctggtaactgtgtctttgggatttcattttggttccatcaaattaggaaaagaaatggcttagttgtatatgattagctagagatttttggagccagacacctgctgtttagtagataacttagtacagaccctaaacttgtcatttgtttttctcacagaatagccatttcctgctgtcttcccaatgatcactgccctttcaataacactcttgcctctagaatcatatgttcaaagtatgaatacacacctagcacatagtaggtgctcaaatattaatttcctccttgccttccttatctaccctgtgtcctccatttccccgtatgattccaacccaatatagcaaatgacatttacatgttatgaaaacatctattgggtaaaatcagatcttggataaagaaattctgacttttatataagcttttggtagacagaaaaaacagaaaggtattcgttggtagaacatttttaagttcaggaaagaaagctggaataatactacgtaactttgtccaggttactttgactgaaacacgtttttggtggatttcttttcctcaaagaactctctaaatgcaactccttgctggattcctcacccatcatcctgttggaaacccttactagacctatgtatttagggagttttgtcagaaaacatttttaacttgcagtatttaaaagaatatttactgttcctaaaatgtcattcaaatgcatgtactgtctattgtttggggatgggaactagttttgcaaaaaacacctaatgttgtataataatgccccaatgatcttgctggttaaaaatacagtatttttggccataattttgtactatagtattcttcattgttgagttttgcttccattaaagttgcccgagcccctctcagaatgttttgtattagtaggagtactgaaatacatctttccttccttaacacaccttgtgcatattgcattttccaaaataaacaagtttaatggtttcaaaaaaaaaaaa

SEQ ID NO: 440079 - DNA, 6720 bp, Homo sapiens
cggccgctcgctgcggggacaccccggtgaatgagctctcgccgccaggcgcacggcgtaggggagcctcgcaggcggcggcggcggcggcggctcggggggcgaggcgggccgcctgttcccggggaaggaggcgcgggcgtctgagcgaggccgggcgcggcggccttctctcacgcgccccccgagccagcgcccgcctcccgcgcccgcctctcttctcccgtcggcccagactatccgctcccaccgcgcccccggcccacctggtggccccggccctggccgccgcccccgcggctgtgcccgggagctcgtcccggacgcgcgaccgggcggcgggggctcggcggccaccgctgcctcaagggagcgagggcgggagggtgtgtgtgcgcggctgtgagcaggggtgccggcggggctgcagcggaggcactttggaagaatgactctggagtccatcatggcgtgctgcctgagcgaggaggccaaggaagcccggcggatcaacgacgagatcgagcggcagctccgcagggacaagcgggacgcccgccgggagctcaagctgctgctgctcgggacaggagagagtggcaagagtacgtttatcaagcagatgagaatcatccatgggtcaggatactctgatgaagataaaaggggcttcaccaagctggtgtatcagaacatcttcacggccatgcaggccatgatcagagccatggacacactcaagatcccatacaagtatgagcacaataaggctcatgcacaattagttcgagaagttgatgtggagaaggtgtctgcttttgagaatccatatgtagatgcaataaagagtttatggaatgatcctggaatccaggaatgctatgatagacgacgagaatatcaattatctgactctaccaaatactatcttaatgacttggaccgcgtagctgaccctgcctacctgcctacgcaacaagatgtgcttagagttcgagtccccaccacagggatcatcgaatacccctttgacttacaaagtgtcattttcagaatggtcgatgtagggggccaaaggtcagagagaagaaaatggatacactgctttgaaaatgtcacctctatcatgtttctagtagcgcttagtgaatatgatcaagttctcgtggagtcagacaatgagaaccgaatggaggaaagcaaggctctctttagaacaattatcacatacccctggttccagaactcctcggttattctgttcttaaacaagaaagatcttctagaggagaaaatcatgtattcccatctagtcgactacttcccagaatatgatggaccccagagagatgcccaggcagcccgagaattcattctgaagatgttcgtggacctgaacccagacagtgacaaaattatctactcccacttcacgtgcgccacagacaccgagaatatccgctttgtctttgctgccgtcaaggacaccatcctccagttgaacctgaaggagtacaatctggtctaattgtgcctcctagacacccgccctgcccttccctggtgggctattgaagatacacaagagggactgtatttctgtggaaaacaatttgcataatactaatttattgccgtcctggactctgtgtgagcgtgtccacagagtttgtagtaaatattatgattttatttaaactattcagaggaaaaacagaggatgctgaagtacagtcccagcacatttcctctctatcttttttttaggcaaaaccttgtgactcagtgtattttaaattctcagtcatgcactcacaaagataagacttgtttctttctgtctctctctctttttcttttctatggagcaaaacaaagctgatttcgatgtttttcccaggttacaatggcctttatcctagttccattcttggtcaagtttttctctcaaatgatacagtcaggacacatcgttcgatttaagccatcatcagcttaatttaagtttgtagtttttgctgaaggattatatgtattaatacttacggttttaaatgtgttgctttggatacacacatagtttcttttttaatagaatatactgtcttgtctcactttggactgggacagtggatgcccatctaaaagttaagtgtcatttcttttagatgtttaccttcagccatagcttgattgctcagagaaatatgcagaaggcaggatcaaagacacacaggagtcctttcttttgaaatgccacgtgccattgtctttcctcccttctttgcttctttttcttaccctctctttcaattgcagatgccaaaaaagatgccaacagacactacattaccctaatggctgctacccagaacctttttataggttgttcttaatttttttgttgttgttgttcaagcttttcctttcttttttttcttagtgtttgggccacgattttaaaatgacttttattatgggtatgtgttgccaaagctggctttttgtcaaataaaatgaatacgaacttaaaaaataaaagctggtatcttaaaatgtaagagagtaagactgtgaagcctaaaatgactggctgagaatgaaccagaaatgccatttgccaaacagttgtaactagaaatttgattctcacagtccattcttttctttgtccttaagatgacattgttagtgttcacgtcccatgttcagtgtccaaaccggcaatgtaaaaagtatcctgtgtggcttaacaggaaatctgtttatgtctctttatttgaaaccagttttactctcagtggttctttaagttcaatgaagtctgccaggaacattggttggtagtattattccgacacctttaatttccaaaatctgaagttcctgctagtttaccaccttcatgatcttcttgaactggtaactgattaggttgaacttatggaagatttgtggacttaactcaaaagtaacctctcagtgttctatagaacatgtatttgtgtaactgaacctaccaggagaaatgtttggaattctatatgtgcaatttttcaacaaatgcaaaaaaaatacagcacatgtattgacaagcttctgtcaagcagcttgagttgaaatttgatttaagaaaataaatcatgattgttcaaagctgctgggacgttagaattaggccatgatactggtctcattttaactacagtggtatttggcactagtgtaaacttccatataaatcactcttttggaacaacaaagggggagggagaaaaatcacggcctgttaaatgagtaccaaagccgcccaacagtaatgagatgttctcatccttgattctcccagcctcaaacaacacagcttactttttttttcccttgctcagaaagtacctgtaatttaacaaacagactgcctgtaggtatagtgcaattacaaatgctctaatcattgtacatacatctctcttgatattgcagcatccatactggctttgtaatcattaattttttggcagattgaatgtgctgtattgatatgtatctatgtaattgtattgtatgtctatagctaattcacgttttgaataatgttattttatttacttttttaagagaggagaatgtaaatttgtcagtttatttctgactagggatattttctttccatttagaaaagaagaaaaaaaaaaaaccttactgtcatacagagcggtactagcgtcgtgctgtataaaatcatttgcacattcctgagtagaggtatactgattataagacccaaaggtaatttcatagcaaaatacataaaatcagtcggagcttttatacaaacatggaaaccaactttgtagaacttttgccatttgatctaggattggaatatgagcttttatacaattcatattcttatttggcaaatgcacagtttagtattacctctctgatggcctttactagaaaggcagttttagaagctattgtgatccactaaggaaatgttttaacagctagagaccactgcttgcctgaaagggcgttcttaaatttggtgcagcaaaaaaaaaaaaaaaaaaaaaaaaaaaattaaacaacaacatttgaaggcctacagtgtgtatagagaaaacctcatcacaagatcataagtgttacagttttagggaatcaagatattctatttaatagagctatagtaaatgtagtcaattaaacctgatctcaaagcttgaagaagctgagcaaaacagggaaagattgttatatttgtctttatgaaattgggatggaatttgctatgcagaattgaggtttgtggctttgctgttcctgtagggtgcatgacaagatcccttctcttgagaaaggaaaaaattgatcaccctagcagcagtgatgcatagaaacctaattttagccacaccagtcaatcgaagctaaaggattttcttttttgtttcttcggggttttattgaaggggctaggggcgggacgggattcttttcagttttgtataaaaacaaagtttactcatgctttatattatattgtgattgcaagcgttataagcgtgtgccactggcctcctattgttgatgcttaggtaatggaggcctgtggtgagttttatggtgacttgggcatgtcttattcaaaaacaaaaacataaaacacagaaacctttcttcagcataccaaggcaagcagccatttcatgactcacttaacacattgcagtgtaccagtttacagatgatttttccctttttgcgtgacatggcagttctaacccccagagaattccttatttgtaaattggaagtttctactatgccttacagagcttaaattcaggaagtttgtgcctcatatctggaaacaaagggaaataacacacccattcaaaagtaaataaatctcctagaagtttttgtttttaacatttccatataaagagctctgttgaatgtcatgaatagactggaaaaaaaaattttaagaacctgcatatgttgtttactagcagatgacaactacaaaaggaatctgaagaacacgtaaaacttgtatttttttttttttggtagattaactagcaggcctattttaaaaaggtaattcagctaaagggcaatttacttttttgtacttcagactatcttgattgtcaaagtgtacgaactgtaattttaaaatttatactgccacatgattgtaaattttagttgtcttaagttaggaattggtgaaaagctatttatgctggatttgggtcaaaatgacttatttgcaaaaaaataaataatgggaagaaagggctgtataatgaaatactgcaagactcacatattggttggaaatttccctcaaatcacctaccgattacccttgatttccctttgttttcagtttctcaaaacgaatgaaatgaaatatagcagaatgttaacccatataaaaataaagtgtacccaaatattgtaatgtatattgctgctcttcttcaaattaaataagggtttaaaaccacttaattggtaatcaacatctcaattgatacaaataaggtgtgcttggtatacattaatattttcttccaaagatatatctttggttagaaacacaaaaaaataaaactagtaatattgtatgtttatctatctctacatatttccagcatatgtagcgttaatagatctgtcctggtaactgtgtctttgggatttcattttggttccatcaaattaggaaaagaaatggcttagttgtatatgattagctagagatttttggagccagacacctgctgtttagtagataacttagtacagaccctaaacttgtcatttgtttttctcacagaatagccatttcctgctgtcttcccaatgatcactgccctttcaataacactcttgcctctagaatcatatgttcaaagtatgaatacacacctagcacatagtaggtgctcaaatattaatttcctccttgccttccttatctaccctgtgtcctccatttccccgtatgattccaacccaatatagcaaatgacatttacatgttatgaaaacatctattgggtaaaatcagatcttggataaagaaattctgacttttatataagcttttggtagacagaaaaaacagaaaggtattcgttggtagaacatttttaagttcaggaaagaaagctggaataatactacgtaactttgtccaggttactttgactgaaacacgtttttggtggatttcttttcctcaaagaactctctaaatgcaactccttgctggattcctcacccatcatcctgttggaaacccttactagacctatgtatttagggagttttgtcagaaaacatttttaacttgcagtatttaaaagaatatttactgttcctaaaatgtcattcaaatgcatgtactgtctattgtttggggatgggaactagttttgcaaaaaacacctaatgttgtataataatgccccaatgatcttgctggttaaaaatacagtatttttggccataattttgtactatagtattcttcattgttgagttttgcttccattaaagttgcccgagcccctctcagaatgttttgtattagtaggagtactgaaatacatctttccttccttaacacaccttgtgcatattgcattttccaaaataaacaagtttaatggtttcaaaaaaaaaaaa

SEQ ID NO: 440080 - DNA, 6703 bp, Homo sapiens
cggccgctcgctgcggggacaccccggtgaatgagctctcgccgccaggcgcacggcgtaggggagcctcgcaggcggcggcggcggcggcggctcggggggcgaggcgggccgcctgttcccggggaaggaggcgcgggcgtctgagcgaggccgggcgcggcggccttctctcacgcgccccccgagccagcgcccgcctcccgcgcccgcctctcttctcccgtcggcccagactatccgctcccaccgcgcccccggcccacctggtggccccggccctggccgccgcccccgcggctgtgcccgggagctcgtcccggacgcgcgaccgggcggcgggggctcggcggccaccgctgcctcaagggagcgagggcgggagggtgtgtgtgcgcggctgtgagcaggggtgccggcggggctgcagcggaggcactttggaagaatgactctggagtccatcatggcgtgctgcctgagcgaggaggccaaggaagcccggcggatcaacgacgagatcgagcggcagctccgcagggacaagcgggacgcccgccgggagctcaagctgctgctgctcgggacaggagagagtggcaagagtacgtttatcaagcagatgagaatcatccatgggtcaggatactctgatgaagatatgatcagagccatggacacactcaagatcccatacaagtatgagcacaataaggctcatgcacaattagttcgagaagttgatgtggagaaggtgtctgcttttgagaatccatatgtagatgcaataaagagtttatggaatgatcctggaatccaggaatgctatgatagacgacgagaatatcaattatctgactctaccaaatactatcttaatgacttggaccgcgtagctgaccctgcctacctgcctacgcaacaagatgtgcttagagttcgagtccccaccacagggatcatcgaatacccctttgacttacaaagtgtcattttcagaatggtcgatgtagggggccaaaggtcagagagaagaaaatggatacactgctttgaaaatgtcacctctatcatgtttctagtagcgcttagtgaatatgatcaagttctcgtggagtcagacaatgagaaccgaatggaggaaagcaaggctctctttagaacaattatcacatacccctggttccagaactcctcggttattctgttcttaaacaagaaagatcttctagaggagaaaatcatgtattcccatctagtcgactacttcccagaatatgatggaccccagagagatgcccaggcagcccgagaattcattctgaagatgttcgtggacctgaacccagacagtgacaaaattatctactcccacttcacgtgcgccacagacaccgagaatatccgctttgtctttgctgccgtcaaggacaccatcctccagttgaacctgaaggagtacaatctggtctaattgtgcctcctagacacccgccctgcccttccctggtgggctattgaagatacacaagagggactgtatttctgtggaaaacaatttgcataatactaatttattgccgtcctggactctgtgtgagcgtgtccacagagtttgtagtaaatattatgattttatttaaactattcagaggaaaaacagaggatgctgaagtacagtcccagcacatttcctctctatcttttttttaggcaaaaccttgtgactcagtgtattttaaattctcagtcatgcactcacaaagataagacttgtttctttctgtctctctctctttttcttttctatggagcaaaacaaagctgatttcccttttttcttcccccgctaattcatacctccctcctgatgtttttcccaggttacaatggcctttatcctagttccattcttggtcaagtttttctctcaaatgatacagtcaggacacatcgttcgatttaagccatcatcagcttaatttaagtttgtagtttttgctgaaggattatatgtattaatacttacggttttaaatgtgttgctttggatacacacatagtttcttttttaatagaatatactgtcttgtctcactttggactgggacagtggatgcccatctaaaagttaagtgtcatttcttttagatgtttaccttcagccatagcttgattgctcagagaaatatgcagaaggcaggatcaaagacacacaggagtcctttcttttgaaatgccacgtgccattgtctttcctcccttctttgcttctttttcttaccctctctttcaattgcagatgccaaaaaagatgccaacagacactacattaccctaatggctgctacccagaacctttttataggttgttcttaatttttttgttgttgttgttcaagcttttcctttcttttttttcttagtgtttgggccacgattttaaaatgacttttattatgggtatgtgttgccaaagctggctttttgtcaaataaaatgaatacgaacttaaaaaataaaagctggtatcttaaaatgtaagagagtaagactgtgaagcctaaaatgactggctgagaatgaaccagaaatgccatttgccaaacagttgtaactagaaatttgattctcacagtccattcttttctttgtccttaagatgacattgttagtgttcacgtcccatgttcagtgtccaaaccggcaatgtaaaaagtatcctgtgtggcttaacaggaaatctgtttatgtctctttatttgaaaccagttttactctcagtggttctttaagttcaatgaagtctgccaggaacattggttggtagtattattccgacacctttaatttccaaaatctgaagttcctgctagtttaccaccttcatgatcttcttgaactggtaactgattaggttgaacttatggaagatttgtggacttaactcaaaagtaacctctcagtgttctatagaacatgtatttgtgtaactgaacctaccaggagaaatgtttggaattctatatgtgcaatttttcaacaaatgcaaaaaaaatacagcacatgtattgacaagcttctgtcaagcagcttgagttgaaatttgatttaagaaaataaatcatgattgttcaaagctgctgggacgttagaattaggccatgatactggtctcattttaactacagtggtatttggcactagtgtaaacttccatataaatcactcttttggaacaacaaagggggagggagaaaaatcacggcctgttaaatgagtaccaaagccgcccaacagtaatgagatgttctcatccttgattctcccagcctcaaacaacacagcttactttttttttcccttgctcagaaagtacctgtaatttaacaaacagactgcctgtaggtatagtgcaattacaaatgctctaatcattgtacatacatctctcttgatattgcagcatccatactggctttgtaatcattaattttttggcagattgaatgtgctgtattgatatgtatctatgtaattgtattgtatgtctatagctaattcacgttttgaataatgttattttatttacttttttaagagaggagaatgtaaatttgtcagtttatttctgactagggatattttctttccatttagaaaagaagaaaaaaaaaaaaccttactgtcatacagagcggtactagcgtcgtgctgtataaaatcatttgcacattcctgagtagaggtatactgattataagacccaaaggtaatttcatagcaaaatacataaaatcagtcggagcttttatacaaacatggaaaccaactttgtagaacttttgccatttgatctaggattggaatatgagcttttatacaattcatattcttatttggcaaatgcacagtttagtattacctctctgatggcctttactagaaaggcagttttagaagctattgtgatccactaaggaaatgttttaacagctagagaccactgcttgcctgaaagggcgttcttaaatttggtgcagcaaaaaaaaaaaaaaaaaaaaaaaaaaaattaaacaacaacatttgaaggcctacagtgtgtatagagaaaacctcatcacaagatcataagtgttacagttttagggaatcaagatattctatttaatagagctatagtaaatgtagtcaattaaacctgatctcaaagcttgaagaagctgagcaaaacagggaaagattgttatatttgtctttatgaaattgggatggaatttgctatgcagaattgaggtttgtggctttgctgttcctgtagggtgcatgacaagatcccttctcttgagaaaggaaaaaattgatcaccctagcagcagtgatgcatagaaacctaattttagccacaccagtcaatcgaagctaaaggattttcttttttgtttcttcggggttttattgaaggggctaggggcgggacgggattcttttcagttttgtataaaaacaaagtttactcatgctttatattatattgtgattgcaagcgttataagcgtgtgccactggcctcctattgttgatgcttaggtaatggaggcctgtggtgagttttatggtgacttgggcatgtcttattcaaaaacaaaaacataaaacacagaaacctttcttcagcataccaaggcaagcagccatttcatgactcacttaacacattgcagtgtaccagtttacagatgatttttccctttttgcgtgacatggcagttctaacccccagagaattccttatttgtaaattggaagtttctactatgccttacagagcttaaattcaggaagtttgtgcctcatatctggaaacaaagggaaataacacacccattcaaaagtaaataaatctcctagaagtttttgtttttaacatttccatataaagagctctgttgaatgtcatgaatagactggaaaaaaaaattttaagaacctgcatatgttgtttactagcagatgacaactacaaaaggaatctgaagaacacgtaaaacttgtatttttttttttttggtagattaactagcaggcctattttaaaaaggtaattcagctaaagggcaatttacttttttgtacttcagactatcttgattgtcaaagtgtacgaactgtaattttaaaatttatactgccacatgattgtaaattttagttgtcttaagttaggaattggtgaaaagctatttatgctggatttgggtcaaaatgacttatttgcaaaaaaataaataatgggaagaaagggctgtataatgaaatactgcaagactcacatattggttggaaatttccctcaaatcacctaccgattacccttgatttccctttgttttcagtttctcaaaacgaatgaaatgaaatatagcagaatgttaacccatataaaaataaagtgtacccaaatattgtaatgtatattgctgctcttcttcaaattaaataagggtttaaaaccacttaattggtaatcaacatctcaattgatacaaataaggtgtgcttggtatacattaatattttcttccaaagatatatctttggttagaaacacaaaaaaataaaactagtaatattgtatgtttatctatctctacatatttccagcatatgtagcgttaatagatctgtcctggtaactgtgtctttgggatttcattttggttccatcaaattaggaaaagaaatggcttagttgtatatgattagctagagatttttggagccagacacctgctgtttagtagataacttagtacagaccctaaacttgtcatttgtttttctcacagaatagccatttcctgctgtcttcccaatgatcactgccctttcaataacactcttgcctctagaatcatatgttcaaagtatgaatacacacctagcacatagtaggtgctcaaatattaatttcctccttgccttccttatctaccctgtgtcctccatttccccgtatgattccaacccaatatagcaaatgacatttacatgttatgaaaacatctattgggtaaaatcagatcttggataaagaaattctgacttttatataagcttttggtagacagaaaaaacagaaaggtattcgttggtagaacatttttaagttcaggaaagaaagctggaataatactacgtaactttgtccaggttactttgactgaaacacgtttttggtggatttcttttcctcaaagaactctctaaatgcaactccttgctggattcctcacccatcatcctgttggaaacccttactagacctatgtatttagggagttttgtcagaaaacatttttaacttgcagtatttaaaagaatatttactgttcctaaaatgtcattcaaatgcatgtactgtctattgtttggggatgggaactagttttgcaaaaaacacctaatgttgtataataatgccccaatgatcttgctggttaaaaatacagtatttttggccataattttgtactatagtattcttcattgttgagttttgcttccattaaagttgcccgagcccctctcagaatgttttgtattagtaggagtactgaaatacatctttccttccttaacacaccttgtgcatattgcattttccaaaataaacaagtttaatggtttcaaaaaaaaaaaa

SEQ ID NO: 440081 - DNA, 6272 bp, Homo sapiens
ggagtggccggtgtgcatccattatcagtgccctatggggtcaggagggaatgggggaacggtgggcagactcgcagctggattcccggagcactcatgggacaggagagagtggcaagagtacgtttatcaagcagatgagaatcatccatgggtcaggatactctgatgaagataaaaggggcttcaccaagctggtgtatcagaacatcttcacggccatgcaggccatgatcagagccatggacacactcaagatcccatacaagtatgagcacaataaggctcatgcacaattagttcgagaagttgatgtggagaaggtgtctgcttttgagaatccatatgtagatgcaataaagagtttatggaatgatcctggaatccaggaatgctatgatagacgacgagaatatcaattatctgactctaccaaatactatcttaatgacttggaccgcgtagctgaccctgcctacctgcctacgcaacaagatgtgcttagagttcgagtccccaccacagggatcatcgaatacccctttgacttacaaagtgtcattttcagaatggtcgatgtagggggccaaaggtcagagagaagaaaatggatacactgctttgaaaatgtcacctctatcatgtttctagtagcgcttagtgaatatgatcaagttctcgtggagtcagacaatgagaaccgaatggaggaaagcaaggctctctttagaacaattatcacatacccctggttccagaactcctcggttattctgttcttaaacaagaaagatcttctagaggagaaaatcatgtattcccatctagtcgactacttcccagaatatgatggaccccagagagatgcccaggcagcccgagaattcattctgaagatgttcgtggacctgaacccagacagtgacaaaattatctactcccacttcacgtgcgccacagacaccgagaatatccgctttgtctttgctgccgtcaaggacaccatcctccagttgaacctgaaggagtacaatctggtctaattgtgcctcctagacacccgccctgcccttccctggtgggctattgaagatacacaagagggactgtatttctgtggaaaacaatttgcataatactaatttattgccgtcctggactctgtgtgagcgtgtccacagagtttgtagtaaatattatgattttatttaaactattcagaggaaaaacagaggatgctgaagtacagtcccagcacatttcctctctatcttttttttaggcaaaaccttgtgactcagtgtattttaaattctcagtcatgcactcacaaagataagacttgtttctttctgtctctctctctttttcttttctatggagcaaaacaaagctgatttcccttttttcttcccccgctaattcatacctccctcctgatgtttttcccaggttacaatggcctttatcctagttccattcttggtcaagtttttctctcaaatgatacagtcaggacacatcgttcgatttaagccatcatcagcttaatttaagtttgtagtttttgctgaaggattatatgtattaatacttacggttttaaatgtgttgctttggatacacacatagtttcttttttaatagaatatactgtcttgtctcactttggactgggacagtggatgcccatctaaaagttaagtgtcatttcttttagatgtttaccttcagccatagcttgattgctcagagaaatatgcagaaggcaggatcaaagacacacaggagtcctttcttttgaaatgccacgtgccattgtctttcctcccttctttgcttctttttcttaccctctctttcaattgcagatgccaaaaaagatgccaacagacactacattaccctaatggctgctacccagaacctttttataggttgttcttaatttttttgttgttgttgttcaagcttttcctttcttttttttcttagtgtttgggccacgattttaaaatgacttttattatgggtatgtgttgccaaagctggctttttgtcaaataaaatgaatacgaacttaaaaaataaaagctggtatcttaaaatgtaagagagtaagactgtgaagcctaaaatgactggctgagaatgaaccagaaatgccatttgccaaacagttgtaactagaaatttgattctcacagtccattcttttctttgtccttaagatgacattgttagtgttcacgtcccatgttcagtgtccaaaccggcaatgtaaaaagtatcctgtgtggcttaacaggaaatctgtttatgtctctttatttgaaaccagttttactctcagtggttctttaagttcaatgaagtctgccaggaacattggttggtagtattattccgacacctttaatttccaaaatctgaagttcctgctagtttaccaccttcatgatcttcttgaactggtaactgattaggttgaacttatggaagatttgtggacttaactcaaaagtaacctctcagtgttctatagaacatgtatttgtgtaactgaacctaccaggagaaatgtttggaattctatatgtgcaatttttcaacaaatgcaaaaaaaatacagcacatgtattgacaagcttctgtcaagcagcttgagttgaaatttgatttaagaaaataaatcatgattgttcaaagctgctgggacgttagaattaggccatgatactggtctcattttaactacagtggtatttggcactagtgtaaacttccatataaatcactcttttggaacaacaaagggggagggagaaaaatcacggcctgttaaatgagtaccaaagccgcccaacagtaatgagatgttctcatccttgattctcccagcctcaaacaacacagcttactttttttttcccttgctcagaaagtacctgtaatttaacaaacagactgcctgtaggtatagtgcaattacaaatgctctaatcattgtacatacatctctcttgatattgcagcatccatactggctttgtaatcattaattttttggcagattgaatgtgctgtattgatatgtatctatgtaattgtattgtatgtctatagctaattcacgttttgaataatgttattttatttacttttttaagagaggagaatgtaaatttgtcagtttatttctgactagggatattttctttccatttagaaaagaagaaaaaaaaaaaaccttactgtcatacagagcggtactagcgtcgtgctgtataaaatcatttgcacattcctgagtagaggtatactgattataagacccaaaggtaatttcatagcaaaatacataaaatcagtcggagcttttatacaaacatggaaaccaactttgtagaacttttgccatttgatctaggattggaatatgagcttttatacaattcatattcttatttggcaaatgcacagtttagtattacctctctgatggcctttactagaaaggcagttttagaagctattgtgatccactaaggaaatgttttaacagctagagaccactgcttgcctgaaagggcgttcttaaatttggtgcagcaaaaaaaaaaaaaaaaaaaaaaaaaaaattaaacaacaacatttgaaggcctacagtgtgtatagagaaaacctcatcacaagatcataagtgttacagttttagggaatcaagatattctatttaatagagctatagtaaatgtagtcaattaaacctgatctcaaagcttgaagaagctgagcaaaacagggaaagattgttatatttgtctttatgaaattgggatggaatttgctatgcagaattgaggtttgtggctttgctgttcctgtagggtgcatgacaagatcccttctcttgagaaaggaaaaaattgatcaccctagcagcagtgatgcatagaaacctaattttagccacaccagtcaatcgaagctaaaggattttcttttttgtttcttcggggttttattgaaggggctaggggcgggacgggattcttttcagttttgtataaaaacaaagtttactcatgctttatattatattgtgattgcaagcgttataagcgtgtgccactggcctcctattgttgatgcttaggtaatggaggcctgtggtgagttttatggtgacttgggcatgtcttattcaaaaacaaaaacataaaacacagaaacctttcttcagcataccaaggcaagcagccatttcatgactcacttaacacattgcagtgtaccagtttacagatgatttttccctttttgcgtgacatggcagttctaacccccagagaattccttatttgtaaattggaagtttctactatgccttacagagcttaaattcaggaagtttgtgcctcatatctggaaacaaagggaaataacacacccattcaaaagtaaataaatctcctagaagtttttgtttttaacatttccatataaagagctctgttgaatgtcatgaatagactggaaaaaaaaattttaagaacctgcatatgttgtttactagcagatgacaactacaaaaggaatctgaagaacacgtaaaacttgtatttttttttttttggtagattaactagcaggcctattttaaaaaggtaattcagctaaagggcaatttacttttttgtacttcagactatcttgattgtcaaagtgtacgaactgtaattttaaaatttatactgccacatgattgtaaattttagttgtcttaagttaggaattggtgaaaagctatttatgctggatttgggtcaaaatgacttatttgcaaaaaaataaataatgggaagaaagggctgtataatgaaatactgcaagactcacatattggttggaaatttccctcaaatcacctaccgattacccttgatttccctttgttttcagtttctcaaaacgaatgaaatgaaatatagcagaatgttaacccatataaaaataaagtgtacccaaatattgtaatgtatattgctgctcttcttcaaattaaataagggtttaaaaccacttaattggtaatcaacatctcaattgatacaaataaggtgtgcttggtatacattaatattttcttccaaagatatatctttggttagaaacacaaaaaaataaaactagtaatattgtatgtttatctatctctacatatttccagcatatgtagcgttaatagatctgtcctggtaactgtgtctttgggatttcattttggttccatcaaattaggaaaagaaatggcttagttgtatatgattagctagagatttttggagccagacacctgctgtttagtagataacttagtacagaccctaaacttgtcatttgtttttctcacagaatagccatttcctgctgtcttcccaatgatcactgccctttcaataacactcttgcctctagaatcatatgttcaaagtatgaatacacacctagcacatagtaggtgctcaaatattaatttcctccttgccttccttatctaccctgtgtcctccatttccccgtatgattccaacccaatatagcaaatgacatttacatgttatgaaaacatctattgggtaaaatcagatcttggataaagaaattctgacttttatataagcttttggtagacagaaaaaacagaaaggtattcgttggtagaacatttttaagttcaggaaagaaagctggaataatactacgtaactttgtccaggttactttgactgaaacacgtttttggtggatttcttttcctcaaagaactctctaaatgcaactccttgctggattcctcacccatcatcctgttggaaacccttactagacctatgtatttagggagttttgtcagaaaacatttttaacttgcagtatttaaaagaatatttactgttcctaaaatgtcattcaaatgcatgtactgtctattgtttggggatgggaactagttttgcaaaaaacacctaatgttgtataataatgccccaatgatcttgctggttaaaaatacagtatttttggccataattttgtactatagtattcttcattgttgagttttgcttccattaaagttgcccgagcccctctcagaatgttttgtattagtaggagtactgaaatacatctttccttccttaacacaccttgtgcatattgcattttccaaaataaacaagtttaatggtttcaaaaaaaaaaaa

SEQ ID NO: 440082 - DNA, 5859 bp, Homo sapiens
aaaagatgtaagtgagggcgtgtactggttgtactttggtcgcggggcctgggcgctgtcatagctagtttatggtacgtggatgtgcttagagttcgagtccccaccacagggatcatcgaatacccctttgacttacaaagtgtcattttcagaatggtcgatgtagggggccaaaggtcagagagaagaaaatggatacactgctttgaaaatgtcacctctatcatgtttctagtagcgcttagtgaatatgatcaagttctcgtggagtcagacaatgagaaccgaatggaggaaagcaaggctctctttagaacaattatcacatacccctggttccagaactcctcggttattctgttcttaaacaagaaagatcttctagaggagaaaatcatgtattcccatctagtcgactacttcccagaatatgatggaccccagagagatgcccaggcagcccgagaattcattctgaagatgttcgtggacctgaacccagacagtgacaaaattatctactcccacttcacgtgcgccacagacaccgagaatatccgctttgtctttgctgccgtcaaggacaccatcctccagttgaacctgaaggagtacaatctggtctaattgtgcctcctagacacccgccctgcccttccctggtgggctattgaagatacacaagagggactgtatttctgtggaaaacaatttgcataatactaatttattgccgtcctggactctgtgtgagcgtgtccacagagtttgtagtaaatattatgattttatttaaactattcagaggaaaaacagaggatgctgaagtacagtcccagcacatttcctctctatcttttttttaggcaaaaccttgtgactcagtgtattttaaattctcagtcatgcactcacaaagataagacttgtttctttctgtctctctctctttttcttttctatggagcaaaacaaagctgatttcccttttttcttcccccgctaattcatacctccctcctgatgtttttcccaggttacaatggcctttatcctagttccattcttggtcaagtttttctctcaaatgatacagtcaggacacatcgttcgatttaagccatcatcagcttaatttaagtttgtagtttttgctgaaggattatatgtattaatacttacggttttaaatgtgttgctttggatacacacatagtttcttttttaatagaatatactgtcttgtctcactttggactgggacagtggatgcccatctaaaagttaagtgtcatttcttttagatgtttaccttcagccatagcttgattgctcagagaaatatgcagaaggcaggatcaaagacacacaggagtcctttcttttgaaatgccacgtgccattgtctttcctcccttctttgcttctttttcttaccctctctttcaattgcagatgccaaaaaagatgccaacagacactacattaccctaatggctgctacccagaacctttttataggttgttcttaatttttttgttgttgttgttcaagcttttcctttcttttttttcttagtgtttgggccacgattttaaaatgacttttattatgggtatgtgttgccaaagctggctttttgtcaaataaaatgaatacgaacttaaaaaataaaagctggtatcttaaaatgtaagagagtaagactgtgaagcctaaaatgactggctgagaatgaaccagaaatgccatttgccaaacagttgtaactagaaatttgattctcacagtccattcttttctttgtccttaagatgacattgttagtgttcacgtcccatgttcagtgtccaaaccggcaatgtaaaaagtatcctgtgtggcttaacaggaaatctgtttatgtctctttatttgaaaccagttttactctcagtggttctttaagttcaatgaagtctgccaggaacattggttggtagtattattccgacacctttaatttccaaaatctgaagttcctgctagtttaccaccttcatgatcttcttgaactggtaactgattaggttgaacttatggaagatttgtggacttaactcaaaagtaacctctcagtgttctatagaacatgtatttgtgtaactgaacctaccaggagaaatgtttggaattctatatgtgcaatttttcaacaaatgcaaaaaaaatacagcacatgtattgacaagcttctgtcaagcagcttgagttgaaatttgatttaagaaaataaatcatgattgttcaaagctgctgggacgttagaattaggccatgatactggtctcattttaactacagtggtatttggcactagtgtaaacttccatataaatcactcttttggaacaacaaagggggagggagaaaaatcacggcctgttaaatgagtaccaaagccgcccaacagtaatgagatgttctcatccttgattctcccagcctcaaacaacacagcttactttttttttcccttgctcagaaagtacctgtaatttaacaaacagactgcctgtaggtatagtgcaattacaaatgctctaatcattgtacatacatctctcttgatattgcagcatccatactggctttgtaatcattaattttttggcagattgaatgtgctgtattgatatgtatctatgtaattgtattgtatgtctatagctaattcacgttttgaataatgttattttatttacttttttaagagaggagaatgtaaatttgtcagtttatttctgactagggatattttctttccatttagaaaagaagaaaaaaaaaaaaccttactgtcatacagagcggtactagcgtcgtgctgtataaaatcatttgcacattcctgagtagaggtatactgattataagacccaaaggtaatttcatagcaaaatacataaaatcagtcggagcttttatacaaacatggaaaccaactttgtagaacttttgccatttgatctaggattggaatatgagcttttatacaattcatattcttatttggcaaatgcacagtttagtattacctctctgatggcctttactagaaaggcagttttagaagctattgtgatccactaaggaaatgttttaacagctagagaccactgcttgcctgaaagggcgttcttaaatttggtgcagcaaaaaaaaaaaaaaaaaaaaaaaaaaaattaaacaacaacatttgaaggcctacagtgtgtatagagaaaacctcatcacaagatcataagtgttacagttttagggaatcaagatattctatttaatagagctatagtaaatgtagtcaattaaacctgatctcaaagcttgaagaagctgagcaaaacagggaaagattgttatatttgtctttatgaaattgggatggaatttgctatgcagaattgaggtttgtggctttgctgttcctgtagggtgcatgacaagatcccttctcttgagaaaggaaaaaattgatcaccctagcagcagtgatgcatagaaacctaattttagccacaccagtcaatcgaagctaaaggattttcttttttgtttcttcggggttttattgaaggggctaggggcgggacgggattcttttcagttttgtataaaaacaaagtttactcatgctttatattatattgtgattgcaagcgttataagcgtgtgccactggcctcctattgttgatgcttaggtaatggaggcctgtggtgagttttatggtgacttgggcatgtcttattcaaaaacaaaaacataaaacacagaaacctttcttcagcataccaaggcaagcagccatttcatgactcacttaacacattgcagtgtaccagtttacagatgatttttccctttttgcgtgacatggcagttctaacccccagagaattccttatttgtaaattggaagtttctactatgccttacagagcttaaattcaggaagtttgtgcctcatatctggaaacaaagggaaataacacacccattcaaaagtaaataaatctcctagaagtttttgtttttaacatttccatataaagagctctgttgaatgtcatgaatagactggaaaaaaaaattttaagaacctgcatatgttgtttactagcagatgacaactacaaaaggaatctgaagaacacgtaaaacttgtatttttttttttttggtagattaactagcaggcctattttaaaaaggtaattcagctaaagggcaatttacttttttgtacttcagactatcttgattgtcaaagtgtacgaactgtaattttaaaatttatactgccacatgattgtaaattttagttgtcttaagttaggaattggtgaaaagctatttatgctggatttgggtcaaaatgacttatttgcaaaaaaataaataatgggaagaaagggctgtataatgaaatactgcaagactcacatattggttggaaatttccctcaaatcacctaccgattacccttgatttccctttgttttcagtttctcaaaacgaatgaaatgaaatatagcagaatgttaacccatataaaaataaagtgtacccaaatattgtaatgtatattgctgctcttcttcaaattaaataagggtttaaaaccacttaattggtaatcaacatctcaattgatacaaataaggtgtgcttggtatacattaatattttcttccaaagatatatctttggttagaaacacaaaaaaataaaactagtaatattgtatgtttatctatctctacatatttccagcatatgtagcgttaatagatctgtcctggtaactgtgtctttgggatttcattttggttccatcaaattaggaaaagaaatggcttagttgtatatgattagctagagatttttggagccagacacctgctgtttagtagataacttagtacagaccctaaacttgtcatttgtttttctcacagaatagccatttcctgctgtcttcccaatgatcactgccctttcaataacactcttgcctctagaatcatatgttcaaagtatgaatacacacctagcacatagtaggtgctcaaatattaatttcctccttgccttccttatctaccctgtgtcctccatttccccgtatgattccaacccaatatagcaaatgacatttacatgttatgaaaacatctattgggtaaaatcagatcttggataaagaaattctgacttttatataagcttttggtagacagaaaaaacagaaaggtattcgttggtagaacatttttaagttcaggaaagaaagctggaataatactacgtaactttgtccaggttactttgactgaaacacgtttttggtggatttcttttcctcaaagaactctctaaatgcaactccttgctggattcctcacccatcatcctgttggaaacccttactagacctatgtatttagggagttttgtcagaaaacatttttaacttgcagtatttaaaagaatatttactgttcctaaaatgtcattcaaatgcatgtactgtctattgtttggggatgggaactagttttgcaaaaaacacctaatgttgtataataatgccccaatgatcttgctggttaaaaatacagtatttttggccataattttgtactatagtattcttcattgttgagttttgcttccattaaagttgcccgagcccctctcagaatgttttgtattagtaggagtactgaaatacatctttccttccttaacacaccttgtgcatattgcattttccaaaataaacaagtttaatggtttcaaaaaaaaaaaa

SEQ ID NO: 440083 - DNA, 5323 bp, Homo sapiens
cggccgctcgctgcggggacaccccggtgaatgagctctcgccgccaggcgcacggcgtaggggagcctcgcaggcggcggcggcggcggcggctcggggggcgaggcgggccgcctgttcccggggaaggaggcgcgggcgtctgagcgaggccgggcgcggcggccttctctcacgcgccccccgagccagcgcccgcctcccgcgcccgcctctcttctcccgtcggcccagactatccgctcccaccgcgcccccggcccacctggtggccccggccctggccgccgcccccgcggctgtgcccgggagctcgtcccggacgcgcgaccgggcggcgggggctcggcggccaccgctgcctcaagggagcgagggcgggagggtgtgtgtgcgcggctgtgagcaggggtgccggcggggctgcagcggaggcactttggaagaatgactctggagtccatcatggcgtgctgcctgagcgaggaggccaaggaagcccggcggatcaacgacgagatcgagcggcagctccgcagggacaagcgggacgcccgccgggagctcaagctgctgctgctcgggacaggagagagtggcaagagtacgtttatcaagcagatgagaatcatccatgggtcaggatactctgatgaagataaaaggggcttcaccaagctggtgtatcagaacatcttcacggccatgcaggccatgatcagagccatggacacactcaagatcccatacaagtatgagcacaataaggctcatgcacaattagttcgagaagttgatgtggagaaggtgtctgcttttgagaatccatatgtagatgcaataaagagtttatggaatgatcctggaatccaggaatgctatgatagacgacgagaatatcaattatctgactctaccaaatactatcttaatgacttggaccgcgtagctgaccctgcctacctgcctacgcaacaagatgtgcttagagttcgagtccccaccacagggatcatcgaatacccctttgacttacaaagtgtcattttcagaatggtcgatgtagggggccaaaggtcagagagaagaaaatggatacactgctttgaaaatgtcacctctatcatgtttctagtagcgcttagtgaatatgatcaagttctcgtggagtcagacaatgagaaccgaatggaggaaagcaaggctctctttagaacaattatcacatacccctggttccagaactcctcggttattctgttcttaaacaagaaagatcttctagaggagaaaatcatgtattcccatctagtcgactacttcccagaatatgatggaccccagagagatgcccaggcagcccgagaattcattctgaagatgttcgtggacctgaacccagacagtgacaaaattatctactcccacttcacgtgcgccacagacaccgagaatatccgctttgtctttgctgccgtcaaggacaccatcctccagttgaacctgaaggagtacaatctggtctaattgtgcctcctagacacccgccctgcccttccctggtgggctattgaagatacacaagagggactgtatttctgtggaaaacaatttgcataatactaatttattgccgtcctggatatatgtgcaatttttcaacaaatgcaaaaaaaatacagcacatgtattgacaagcttctgtcaagcagcttgagttgaaatttgatttaagaaaataaatcatgattgttcaaagctgctgggacgttagaattaggccatgatactggtctcattttaactacagtggtatttggcactagtgtaaacttccatataaatcactcttttggaacaacaaagggggagggagaaaaatcacggcctgttaaatgagtaccaaagccgcccaacagtaatgagatgttctcatccttgattctcccagcctcaaacaacacagcttactttttttttcccttgctcagaaagtacctgtaatttaacaaacagactgcctgtaggtatagtgcaattacaaatgctctaatcattgtacatacatctctcttgatattgcagcatccatactggctttgtaatcattaattttttggcagattgaatgtgctgtattgatatgtatctatgtaattgtattgtatgtctatagctaattcacgttttgaataatgttattttatttacttttttaagagaggagaatgtaaatttgtcagtttatttctgactagggatattttctttccatttagaaaagaagaaaaaaaaaaaaccttactgtcatacagagcggtactagcgtcgtgctgtataaaatcatttgcacattcctgagtagaggtatactgattataagacccaaaggtaatttcatagcaaaatacataaaatcagtcggagcttttatacaaacatggaaaccaactttgtagaacttttgccatttgatctaggattggaatatgagcttttatacaattcatattcttatttggcaaatgcacagtttagtattacctctctgatggcctttactagaaaggcagttttagaagctattgtgatccactaaggaaatgttttaacagctagagaccactgcttgcctgaaagggcgttcttaaatttggtgcagcaaaaaaaaaaaaaaaaaaaaaaaaaaaattaaacaacaacatttgaaggcctacagtgtgtatagagaaaacctcatcacaagatcataagtgttacagttttagggaatcaagatattctatttaatagagctatagtaaatgtagtcaattaaacctgatctcaaagcttgaagaagctgagcaaaacagggaaagattgttatatttgtctttatgaaattgggatggaatttgctatgcagaattgaggtttgtggctttgctgttcctgtagggtgcatgacaagatcccttctcttgagaaaggaaaaaattgatcaccctagcagcagtgatgcatagaaacctaattttagccacaccagtcaatcgaagctaaaggattttcttttttgtttcttcggggttttattgaaggggctaggggcgggacgggattcttttcagttttgtataaaaacaaagtttactcatgctttatattatattgtgattgcaagcgttataagcgtgtgccactggcctcctattgttgatgcttaggtaatggaggcctgtggtgagttttatggtgacttgggcatgtcttattcaaaaacaaaaacataaaacacagaaacctttcttcagcataccaaggcaagcagccatttcatgactcacttaacacattgcagtgtaccagtttacagatgatttttccctttttgcgtgacatggcagttctaacccccagagaattccttatttgtaaattggaagtttctactatgccttacagagcttaaattcaggaagtttgtgcctcatatctggaaacaaagggaaataacacacccattcaaaagtaaataaatctcctagaagtttttgtttttaacatttccatataaagagctctgttgaatgtcatgaatagactggaaaaaaaaattttaagaacctgcatatgttgtttactagcagatgacaactacaaaaggaatctgaagaacacgtaaaacttgtatttttttttttttggtagattaactagcaggcctattttaaaaaggtaattcagctaaagggcaatttacttttttgtacttcagactatcttgattgtcaaagtgtacgaactgtaattttaaaatttatactgccacatgattgtaaattttagttgtcttaagttaggaattggtgaaaagctatttatgctggatttgggtcaaaatgacttatttgcaaaaaaataaataatgggaagaaagggctgtataatgaaatactgcaagactcacatattggttggaaatttccctcaaatcacctaccgattacccttgatttccctttgttttcagtttctcaaaacgaatgaaatgaaatatagcagaatgttaacccatataaaaataaagtgtacccaaatattgtaatgtatattgctgctcttcttcaaattaaataagggtttaaaaccacttaattggtaatcaacatctcaattgatacaaataaggtgtgcttggtatacattaatattttcttccaaagatatatctttggttagaaacacaaaaaaataaaactagtaatattgtatgtttatctatctctacatatttccagcatatgtagcgttaatagatctgtcctggtaactgtgtctttgggatttcattttggttccatcaaattaggaaaagaaatggcttagttgtatatgattagctagagatttttggagccagacacctgctgtttagtagataacttagtacagaccctaaacttgtcatttgtttttctcacagaatagccatttcctgctgtcttcccaatgatcactgccctttcaataacactcttgcctctagaatcatatgttcaaagtatgaatacacacctagcacatagtaggtgctcaaatattaatttcctccttgccttccttatctaccctgtgtcctccatttccccgtatgattccaacccaatatagcaaatgacatttacatgttatgaaaacatctattgggtaaaatcagatcttggataaagaaattctgacttttatataagcttttggtagacagaaaaaacagaaaggtattcgttggtagaacatttttaagttcaggaaagaaagctggaataatactacgtaactttgtccaggttactttgactgaaacacgtttttggtggatttcttttcctcaaagaactctctaaatgcaactccttgctggattcctcacccatcatcctgttggaaacccttactagacctatgtatttagggagttttgtcagaaaacatttttaacttgcagtatttaaaagaatatttactgttcctaaaatgtcattcaaatgcatgtactgtctattgtttggggatgggaactagttttgcaaaaaacacctaatgttgtataataatgccccaatgatcttgctggttaaaaatacagtatttttggccataattttgtactatagtattcttcattgttgagttttgcttccattaaagttgcccgagcccctctcagaatgttttgtattagtaggagtactgaaatacatctttccttccttaacacaccttgtgcatattgcattttccaaaataaacaagtttaatggtttcaaaaaaaaaaaa

SEQ ID NO: 440084 - DNA, 4024 bp, Homo sapiens
gctaagtgacatgatggtcacgtcagtcaggtcaacgcagtaaagatcgtgtgtgctacagaaatctgtttatgtctctttatttgaaaccagttttactctcagtggttctttaagttcaatgaagtctgccaggaacattggttggtagtattattccgacacctttaatttccaaaatctgaagttcctgctagtttaccaccttcatgatcttcttgaactggtaactgattaggttgaacttatggaagatttgtggacttaactcaaaagtaacctctcagtgttctatagaacatgtatttgtgtaactgaacctaccaggagaaatgtttggaattctatatgtgcaatttttcaacaaatgcaaaaaaaatacagcacatgtattgacaagcttctgtcaagcagcttgagttgaaatttgatttaagaaaataaatcatgattgttcaaagctgctgggacgttagaattaggccatgatactggtctcattttaactacagtggtatttggcactagtgtaaacttccatataaatcactcttttggaacaacaaagggggagggagaaaaatcacggcctgttaaatgagtaccaaagccgcccaacagtaatgagatgttctcatccttgattctcccagcctcaaacaacacagcttactttttttttcccttgctcagaaagtacctgtaatttaacaaacagactgcctgtaggtatagtgcaattacaaatgctctaatcattgtacatacatctctcttgatattgcagcatccatactggctttgtaatcattaattttttggcagattgaatgtgctgtattgatatgtatctatgtaattgtattgtatgtctatagctaattcacgttttgaataatgttattttatttacttttttaagagaggagaatgtaaatttgtcagtttatttctgactagggatattttctttccatttagaaaagaagaaaaaaaaaaaaccttactgtcatacagagcggtactagcgtcgtgctgtataaaatcatttgcacattcctgagtagaggtatactgattataagacccaaaggtaatttcatagcaaaatacataaaatcagtcggagcttttatacaaacatggaaaccaactttgtagaacttttgccatttgatctaggattggaatatgagcttttatacaattcatattcttatttggcaaatgcacagtttagtattacctctctgatggcctttactagaaaggcagttttagaagctattgtgatccactaaggaaatgttttaacagctagagaccactgcttgcctgaaagggcgttcttaaatttggtgcagcaaaaaaaaaaaaaaaaaaaaaaaaaaaattaaacaacaacatttgaaggcctacagtgtgtatagagaaaacctcatcacaagatcataagtgttacagttttagggaatcaagatattctatttaatagagctatagtaaatgtagtcaattaaacctgatctcaaagcttgaagaagctgagcaaaacagggaaagattgttatatttgtctttatgaaattgggatggaatttgctatgcagaattgaggtttgtggctttgctgttcctgtagggtgcatgacaagatcccttctcttgagaaaggaaaaaattgatcaccctagcagcagtgatgcatagaaacctaattttagccacaccagtcaatcgaagctaaaggattttcttttttgtttcttcggggttttattgaaggggctaggggcgggacgggattcttttcagttttgtataaaaacaaagtttactcatgctttatattatattgtgattgcaagcgttataagcgtgtgccactggcctcctattgttgatgcttaggtaatggaggcctgtggtgagttttatggtgacttgggcatgtcttattcaaaaacaaaaacataaaacacagaaacctttcttcagcataccaaggcaagcagccatttcatgactcacttaacacattgcagtgtaccagtttacagatgatttttccctttttgcgtgacatggcagttctaacccccagagaattccttatttgtaaattggaagtttctactatgccttacagagcttaaattcaggaagtttgtgcctcatatctggaaacaaagggaaataacacacccattcaaaagtaaataaatctcctagaagtttttgtttttaacatttccatataaagagctctgttgaatgtcatgaatagactggaaaaaaaaattttaagaacctgcatatgttgtttactagcagatgacaactacaaaaggaatctgaagaacacgtaaaacttgtatttttttttttttggtagattaactagcaggcctattttaaaaaggtaattcagctaaagggcaatttacttttttgtacttcagactatcttgattgtcaaagtgtacgaactgtaattttaaaatttatactgccacatgattgtaaattttagttgtcttaagttaggaattggtgaaaagctatttatgctggatttgggtcaaaatgacttatttgcaaaaaaataaataatgggaagaaagggctgtataatgaaatactgcaagactcacatattggttggaaatttccctcaaatcacctaccgattacccttgatttccctttgttttcagtttctcaaaacgaatgaaatgaaatatagcagaatgttaacccatataaaaataaagtgtacccaaatattgtaatgtatattgctgctcttcttcaaattaaataagggtttaaaaccacttaattggtaatcaacatctcaattgatacaaataaggtgtgcttggtatacattaatattttcttccaaagatatatctttggttagaaacacaaaaaaataaaactagtaatattgtatgtttatctatctctacatatttccagcatatgtagcgttaatagatctgtcctggtaactgtgtctttgggatttcattttggttccatcaaattaggaaaagaaatggcttagttgtatatgattagctagagatttttggagccagacacctgctgtttagtagataacttagtacagaccctaaacttgtcatttgtttttctcacagaatagccatttcctgctgtcttcccaatgatcactgccctttcaataacactcttgcctctagaatcatatgttcaaagtatgaatacacacctagcacatagtaggtgctcaaatattaatttcctccttgccttccttatctaccctgtgtcctccatttccccgtatgattccaacccaatatagcaaatgacatttacatgttatgaaaacatctattgggtaaaatcagatcttggataaagaaattctgacttttatataagcttttggtagacagaaaaaacagaaaggtattcgttggtagaacatttttaagttcaggaaagaaagctggaataatactacgtaactttgtccaggttactttgactgaaacacgtttttggtggatttcttttcctcaaagaactctctaaatgcaactccttgctggattcctcacccatcatcctgttggaaacccttactagacctatgtatttagggagttttgtcagaaaacatttttaacttgcagtatttaaaagaatatttactgttcctaaaatgtcattcaaatgcatgtactgtctattgtttggggatgggaactagttttgcaaaaaacacctaatgttgtataataatgccccaatgatcttgctggttaaaaatacagtatttttggccataattttgtactatagtattcttcattgttgagttttgcttccattaaagttgcccgagcccctctcagaatgttttgtattagtaggagtactgaaatacatctttccttccttaacacaccttgtgcatattgcattttccaaaataaacaagtttaatggtttcaaaaaaaaaaaa

SEQ ID NO: 440085 - DNA, 3406 bp, Homo sapiens
ccggatccaacgttggatccgaatttggatccgaattcggatccaacggccgccctttttttttcccttgctcagaaagtacctgtaatttaacaaacagactgcctgtaggtatagtgcaattacaaatgctctaatcattgtacatacatctctcttgatattgcagcatccatactggctttgtaatcattaattttttggcagattgaatgtgctgtattgatatgtatctatgtaattgtattgtatgtctatagctaattcacgttttgaataatgttattttatttacttttttaagagaggagaatgtaaatttgtcagtttatttctgactagggatattttctttccatttagaaaagaagaaaaaaaaaaaaccttactgtcatacagagcggtactagcgtcgtgctgtataaaatcatttgcacattcctgagtagaggtatactgattataagacccaaaggtaatttcatagcaaaatacataaaatcagtcggagcttttatacaaacatggaaaccaactttgtagaacttttgccatttgatctaggattggaatatgagcttttatacaattcatattcttatttggcaaatgcacagtttagtattacctctctgatggcctttactagaaaggcagttttagaagctattgtgatccactaaggaaatgttttaacagctagagaccactgcttgcctgaaagggcgttcttaaatttggtgcagcaaaaaaaaaaaaaaaaaaaaaaaaaaaattaaacaacaacatttgaaggcctacagtgtgtatagagaaaacctcatcacaagatcataagtgttacagttttagggaatcaagatattctatttaatagagctatagtaaatgtagtcaattaaacctgatctcaaagcttgaagaagctgagcaaaacagggaaagattgttatatttgtctttatgaaattgggatggaatttgctatgcagaattgaggtttgtggctttgctgttcctgtagggtgcatgacaagatcccttctcttgagaaaggaaaaaattgatcaccctagcagcagtgatgcatagaaacctaattttagccacaccagtcaatcgaagctaaaggattttcttttttgtttcttcggggttttattgaaggggctaggggcgggacgggattcttttcagttttgtataaaaacaaagtttactcatgctttatattatattgtgattgcaagcgttataagcgtgtgccactggcctcctattgttgatgcttaggtaatggaggcctgtggtgagttttatggtgacttgggcatgtcttattcaaaaacaaaaacataaaacacagaaacctttcttcagcataccaaggcaagcagccatttcatgactcacttaacacattgcagtgtaccagtttacagatgatttttccctttttgcgtgacatggcagttctaacccccagagaattccttatttgtaaattggaagtttctactatgccttacagagcttaaattcaggaagtttgtgcctcatatctggaaacaaagggaaataacacacccattcaaaagtaaataaatctcctagaagtttttgtttttaacatttccatataaagagctctgttgaatgtcatgaatagactggaaaaaaaaattttaagaacctgcatatgttgtttactagcagatgacaactacaaaaggaatctgaagaacacgtaaaacttgtatttttttttttttggtagattaactagcaggcctattttaaaaaggtaattcagctaaagggcaatttacttttttgtacttcagactatcttgattgtcaaagtgtacgaactgtaattttaaaatttatactgccacatgattgtaaattttagttgtcttaagttaggaattggtgaaaagctatttatgctggatttgggtcaaaatgacttatttgcaaaaaaataaataatgggaagaaagggctgtataatgaaatactgcaagactcacatattggttggaaatttccctcaaatcacctaccgattacccttgatttccctttgttttcagtttctcaaaacgaatgaaatgaaatatagcagaatgttaacccatataaaaataaagtgtacccaaatattgtaatgtatattgctgctcttcttcaaattaaataagggtttaaaaccacttaattggtaatcaacatctcaattgatacaaataaggtgtgcttggtatacattaatattttcttccaaagatatatctttggttagaaacacaaaaaaataaaactagtaatattgtatgtttatctatctctacatatttccagcatatgtagcgttaatagatctgtcctggtaactgtgtctttgggatttcattttggttccatcaaattaggaaaagaaatggcttagttgtatatgattagctagagatttttggagccagacacctgctgtttagtagataacttagtacagaccctaaacttgtcatttgtttttctcacagaatagccatttcctgctgtcttcccaatgatcactgccctttcaataacactcttgcctctagaatcatatgttcaaagtatgaatacacacctagcacatagtaggtgctcaaatattaatttcctccttgccttccttatctaccctgtgtcctccatttccccgtatgattccaacccaatatagcaaatgacatttacatgttatgaaaacatctattgggtaaaatcagatcttggataaagaaattctgacttttatataagcttttggtagacagaaaaaacagaaaggtattcgttggtagaacatttttaagttcaggaaagaaagctggaataatactacgtaactttgtccaggttactttgactgaaacacgtttttggtggatttcttttcctcaaagaactctctaaatgcaactccttgctggattcctcacccatcatcctgttggaaacccttactagacctatgtatttagggagttttgtcagaaaacatttttaacttgcagtatttaaaagaatatttactgttcctaaaatgtcattcaaatgcatgtactgtctattgtttggggatgggaactagttttgcaaaaaacacctaatgttgtataataatgccccaatgatcttgctggttaaaaatacagtatttttggccataattttgtactatagtattcttcattgttgagttttgcttccattaaagttgcccgagcccctctcagaatgttttgtattagtaggagtactgaaatacatctttccttccttaacacaccttgtgcatattgcattttccaaaataaacaagtttaatggtttcaaaaaaaaaaaa

SEQ ID NO: 440086 - DNA, 1890 bp, Homo sapiens
cggccgctcgctgcggggacaccccggtgaatgagctctcgccgccaggcgcacggcgtaggggagcctcgcaggcggcggcggcggcggcggctcggggggcgaggcgggccgcctgttcccggggaaggaggcgcgggcgtctgagcgaggccgggcgcggcggccttctctcacgcgccccccgagccagcgcccgcctcccgcgcccgcctctcttctcccgtcggcccagactatccgctcccaccgcgcccccggcccacctggtggccccggccctggccgccgcccccgcggctgtgcccgggagctcgtcccggacgcgcgaccgggcggcgggggctcggcggccaccgctgcctcaagggagcgagggcgggagggtgtgtgtgcgcggctgtgagcaggggtgccggcggggctgcagcggaggcactttggaagaatgactctggagtccatcatggcgtgctgcctgagcgaggaggccaaggaagcccggcggatcaacgacgagatcgagcggcagctccgcagggacaagcgggacgcccgccgggagctcaagctgctgctgctcgggacaggagagagtggcaagagtacgtttatcaagcagatgagaatcatccatgggtcaggatactctgatgaagataaaaggggcttcaccaagctggtgtatcagaacatcttcacggccatgcaggccatgatcagagccatggacacactcaagatcccatacaagtatgagcacaataaggctcatgcacaattagttcgagaagttgatgtggagaaggtgtctgcttttgagaatccatatgtagatgcaataaagagtttatggaatgatcctggaatccaggaatgctatgatagacgacgagaatatcaattatctgactctaccaaatactatcttaatgacttggaccgcgtagctgaccctgcctacctgcctacgcaacaagatgtgcttagagttcgagtccccaccacagggatcatcgaatacccctttgacttacaaagtgtcattttcagaatggtcgatgtagggggccaaaggtcagagagaagaaaatggatacactgctttgaaaatgtcacctctatcatgtttctagtagcgcttagtgaatatgatcaagttctcgtggagtcagacaatgagaaccgaatggaggaaagcaaggctctctttagaacaattatcacatacccctggttccagaactcctcggttattctgttcttaaacaagaaagatcttctagaggagaaaatcatgtattcccatctagtcgactacttcccagaatatgatggaccccagagagatgcccaggcagcccgagaattcattctgaagatgttcgtggacctgaacccagacagtgacaaaattatctactcccacttcacgtgcgccacagacaccgagaatatccgctttgtctttgctgccgtcaaggacaccatcctccagttgaacctgaaggagtacaatctggtctaattgtgcctcctagacacccgccctgcccttccctggtgggctattgaagatacacaagagggactgtatttctgtggaaaacaatttgcataatactaatttattgccgtcctggactctgtgtgagcgtgtccacagagtttgtagtaaatattatgattttatttaaactattcagaggaaaaacagaggatgctgaagtacagtcccagcacatttcctctctatcttttttttaggcaaaacctgggaacccagggtttcaaattccccagcctggcccccaaagatagactggtcttcggtcccccttccttcaggggccaacacatcggtcctcttttcccgaaaacccccggggt

SEQ ID NO: 440087 - DNA, 6580 bp, Homo sapiens
cggccgctcgctgcggggacaccccggtgaatgagctctcgccgccaggcgcacggcgtaggggagcctcgcaggcggcggcggcggcggcggctcggggggcgaggcgggccgcctgttcccggggaaggaggcgcgggcgtctgagcgaggccgggcgcggcggccttctctcacgcgccccccgagccagcgcccgcctcccgcgcccgcctctcttctcccgtcggcccagactatccgctcccaccgcgcccccggcccacctggtggccccggccctggccgccgcccccgcggctgtgcccgggagctcgtcccggacgcgcgaccgggcggcgggggctcggcggccaccgctgcctcaagggagcgagggcgggagggtgtgtgtgcgcggctgtgagcaggggtgccggcggggctgcagcggaggcactttggaagaatgactctggagtccatcatggcgtgctgcctgagcgaggaggccaaggaagcccggcggatcaacgacgagatcgagcggcagctccgcagggacaagcgggacgcccgccgggagctcaagctgctgctgctcgggacaggagagagtggcaagagtacgtttatcaagcagatgagaatcatccatgggtcaggatactctgatgaagataaaaggggcttcaccaagctggtgtatcagaacatcttcacggccatgcaggccatgatcagagccatggacacactcaagatcccatacaagtatgagcacaataaggctcatgcacaattagttcgagaagttgatgtggagaaggtgtctgcttttgagaatccatatgtagatgcaataaagagtttatggaatgatcctggaatccaggaatgctatgatagacgacgagaatatcaattatctgactctaccaaatactatcttaatgacttggaccgcgtagctgaccctgcctacctgcctacgcaacaagatgtgcttagagttcgagtccccaccacagggatcatcgaatacccctttgacttacaaagtgtcattttcagaatggtcgatgtagggggccaaaggtcagagagaagaaaatggatacactgctttgaaaatgtcacctctatcatgtttctagtagcgcttagtgaatatgatcaagttctcgtggagtcagacaatgagaaccgaatggaggaaagcaaggctctctttagaacaattatcacatacccctggttccagaactcctcggttattctgttcttaaacaagaaagatcttctagaggagaaaatcatgtattcccatctagtcgactacttcccagaatatgatggaccccagagagatgcccaggcagcccgagaattcattctgaagatgttcgtggacctgaacccagacagtgacaaaattatctactcccacttcacgtgcgccacagacaccgagaatatccgctttgtctttgctgccgtcaaggacaccatcctccagttgaacctgaaggagtacaatctggtctaattgtgcctcctagacacccgccctgcccttccctggtgggctattgaagatacacaagagggactgtatttctgtggaaaacaatttgcataatactaatttattgccgtcctggactctgtgtgagcgtgtccacagagtttgtagtaaatattatgattttatttaaactattcagaggaaaaacagaggatgctgaagtacagtcccagcacatttcctctctatcttttttttaggcaaaaccttgtgactcagtgtattttaaattctcagtcatgcactcacaaagataagacttgtttctttctgtctctctctctttttcttttctatggagcaaaacaaagctgatttcccttttttcttcccccgctaattcatacctccctcctgatgtttttcccaggttacaatggcctttatcctagttccattcttggtcaagtttttctctcaaatgatacagtcaggacacatcgttcgatttaagccatcatcagcttaatttaagtttgtagtttttgctgaaggattatatgtattaatacttacggttttaaatgtgttgctttggatacacacatagtttcttttttaatagaatatactgtcttgtctcactttggactgggacagtggatgcccatctaaaagttaagtgtcatttcttttagatgtttaccttcagccatagcttgattgctcagagaaatatgcagaaggcaggatcaaagacacacaggagtcctttcttttgaaatgccacgtgccattgtctttcctcccttctttgcttctttttcttaccctctctttcaattgcagatgccaaaaaagatgccaacagacactacattaccctaatggctgctacccagaacctttttataggttgttcttaatttttttgttgttgttgttcaagcttttcctttcttttttttcttagtgtttgggccacgattttaaaatgacttttattatgggtatgtgttgccaaagctggctttttgtcaaataaaatgaatacgaacttaaaaaataaaagctggtatcttaaaatgtaagagagtaagactgtgaagcctaaaatgactggctgagaatgaaccagaaatgccatttgccaaacagttgtaactagaaatttgattctcacagtccattcttttctttgtccttaagatgacattgttagtgttcacgtcccatgttcagtgtccaaaccggcaatgtaaaaagtatcctgtgtggcttaacaggaaatctgtttatgtctctttatttgaaaccagttttactctcagtggttctttaagttcaatgaagtctgccaggaacattggttggtagtattattccgacacctttaatttccaaaatctgaagttcctgctagtttaccaccttcatgatcttcttgaactggtaactgattaggttgaacttatggaagatttgtggacttaactcaaaagtaacctctcagtgttctatagaacatgtatttgtgtaactgaacctaccaggagaaatgtttggaattctatatgtgcaatttttcaacaaatgcaaaaaaaatacagcacatgtattgacaagcttctgtcaagcagcttgagttgaaatttgatttaagaaaataaatcatgattgttcaaagctgctgggacgttagaattaggccatgatactggtctcattttaactacagtggtatttggcactagtgtaaacttccatataaatcactcttttggaacaacaaagggggagggagaaaaatcacggcctgttaaatgagtaccaaagccgcccaacagtaatgagatgttctcatccttgattctcccagcctcaaacaacacagcttactttttttttcccttgctcagaaagtacctgtaatttaacaaacagactgcctgtaggtatagtgcaattacaaatgctctaatcattgtacatacatctctcttgatattgcagcatccatactggctttgtaatcattaattttttggcagattgaatgtgctgtattgatatgtatctatgtaattgtattgtatgtctatagctaattcacgttttgaataatgttattttatttacttttttaagagaggagaatgtaaatttgtcagtttatttctgactagggatattttctttccatttagaaaagaagaaaaaaaaaaaaccttactgtcatacagagcggtactagcgtcgtgctgtataaaatcatttgcacattcctgagtagaggtatactgattataagacccaaaggtaatttcatagcaaaatacataaaatcagtcggagcttttatacaaacatggaaaccaactttgtagaacttttgccatttgatctaggattggaatatgagcttttatacaattcatattcttatttggcaaatgcacagtttagtattacctctctgatggcctttactagaaaggcagttttagaagctattgtgatccactaaggaaatgttttaacagctagagaccactgcttgcctgaaagggcgttcttaaatttggtgcagcaaaaaaaaaaaaaaaaaaaaaaaaaaaattaaacaacaacatttgaaggcctacagtgtgtatagagaaaacctcatcacaagatcataagtgttacagttttagggaatcaagatattctatttaatagagctatagtaaatgtagtcaattaaacctgatctcaaagcttgaagaagctgagcaaaacagggaaagattgttatatttgtctttatgaaattgggatggaatttgctatgcagaattgaggtttgtggctttgctgttcctgtagggtgcatgacaagatcccttctcttgagaaaggaaaaaattgatcaccctagcagcagtgatgcatagaaacctaattttagccacaccagtcaatcgaagctaaaggattttcttttttgtttcttcggggttttattgaaggggctaggggcgggacgggattcttttcagttttgtataaaaacaaagtttactcatgctttatattatattgtgattgcaagcgttataagcgtgtgccactggcctcctattgttgatgcttaggtaatggaggcctgtggtgagttttatggtgacttgggcatgtcttattcaaaaacaaaaacataaaacacagaaacctttcttcagcataccaaggcaagcagccatttcatgactcacttaacacattgcagtgtaccagtttacagatgatttttccctttttgcgtgacatggcagttctaacccccagagaattccttatttgtaaattggaagtttctactatgccttacagagcttaaattcaggaagtttgtgcctcatatctggaaacaaagggaaataacacacccattcaaaagtaaataaatctcctagaagtttttgtttttaacatttccatataaagagctctgttgaatgtcatgaatagactggaaaaaaaaattttaagaacctgcatatgttgtttactagcagatgacaactacaaaaggaatctgaagaacacgtaaaacttgtatttttttttttttggtagattaactagcaggcctattttaaaaaggtaattcagctaaagggcaatttacttttttgtacttcagactatcttgattgtcaaagtgtacgaactgtaattttaaaatttatactgccacatgattgtaaattttagttgtcttaagttaggaattggtgaaaagctatttatgctggatttgggtcaaaatgacttatttgcaaaaaaataaataatgggaagaaagggctgtataatgaaatactgcaagactcacatattggttggaaatttccctcaaatcacctaccgattacccttgatttccctttgttttcagtttctcaaaacgaatgaaatgaaatatagcagaatgttaacccatataaaaataaagtgtacccaaatattgtaatgtatattgctgctcttcttcaaattaaataagggtttaaaaccacttaattggtaatcaacatctcaattgatacaaataaggtgtgcttggtatacattaatattttcttccaaagatatatctttggttagaaacacaaaaaaataaaactagtaatattgtatgtttatctatctctacatatttccagcatatgtagcgttaatagatctgtcctggtaactgtgtctttgggatttcattttggttccatcaaattaggaaaagaaatggcttagttgtatatgattagctagagatttttggagccagacacctgctgtttagtagataacttagtacagaccctaaacttgtcatttgtttttctcacagaatagccatttcctgctgtcttcccaatgatcactgccctttcaataacactcttgcctctagaatcatatgttcaaagtatgaatacacacctagcacatagtaggtgctcaaatattaatttcctccttgccttccttatctaccctgtgtcctccatttccccgtatgattccaacccaatatagcaaatgacatttacatgttatgaaaacatctattgggtaaaatcagatcttggataaagaaattctgacttttatataagcttttggtagacagaaaaaacagaaaggtattcgttggtagaacatttttaagttcaggaaagaaagctggaataatactacgtaactttgtccaggttactttgactgaaacacgtttttggtggatttcttttcctcaaagaactctctaaatgcaactccttgctggattcctcacccatcatcctgttggaaacccttactagacctatgtatttagggagttttgtcagaaaacatttttaacttgcagtatttaaaagaatatttactgttcctaaaatgtcattcaaatgcatgtactgtctattgtttggggatgggaactagttttgcaaaaaacacctaatgttgtataataatgccccaatgatcttgctggttaaaaatacagtatttttggccata

SEQ ID NO: 440088 - DNA, 3776 bp, Homo sapiens
cggccgctcgctgcggggacaccccggtgaatgagctctcgccgccaggcgcacggcgtaggggagcctcgcaggcggcggcggcggcggcggctcggggggcgaggcgggccgcctgttcccggggaaggaggcgcgggcgtctgagcgaggccgggcgcggcggccttctctcacgcgccccccgagccagcgcccgcctcccgcgcccgcctctcttctcccgtcggcccagactatccgctcccaccgcgcccccggcccacctggtggccccggccctggccgccgcccccgcggctgtgcccgggagctcgtcccggacgcgcgaccgggcggcgggggctcggcggccaccgctgcctcaagggagcgagggcgggagggtgtgtgtgcgcggctgtgagcaggggtgccggcggggctgcagcggaggcactttggaagaatgactctggagtccatcatggcgtgctgcctgagcgaggaggccaaggaagcccggcggatcaacgacgagatcgagcggcagctccgcagggacaagcgggacgcccgccgggagctcaagctgctgctgctcgggacaggagagagtggcaagagtacgtttatcaagcagatgagaatcatccatgggtcaggatactctgatgaagataaaaggggcttcaccaagctggtgtatcagaacatcttcacggccatgcaggccatgatcagagccatggacacactcaagatcccatacaagtatgagcacaataaggctcatgcacaattagttcgagaagttgatgtggagaaggtgtctgcttttgagaatccatatgtagatgcaataaagagtttatggaatgatcctggaatccaggaatgctatgatagacgacgagaatatcaattatctgactctaccaaatactatcttaatgacttggaccgcgtagctgaccctgcctacctgcctacgcaacaagatgtgcttagagttcgagtccccaccacagggatcatcgaatacccctttgacttacaaagtgtcattttcagaatggtcgatgtagggggccaaaggtcagagagaagaaaatggatacactgctttgaaaatgtcacctctatcatgtttctagtagcgcttagtgaatatgatcaagttctcgtggagtcagacaatgagaaccgaatggaggaaagcaaggctctctttagaacaattatcacatacccctggttccagaactcctcggttattctgttcttaaacaagaaagatcttctagaggagaaaatcatgtattcccatctagtcgactacttcccagaatatgatggaccccagagagatgcccaggcagcccgagaattcattctgaagatgttcgtggacctgaacccagacagtgacaaaattatctactcccacttcacgtgcgccacagacaccgagaatatccgctttgtctttgctgccgtcaaggacaccatcctccagttgaacctgaaggagtacaatctggtctaattgtgcctcctagacacccgccctgcccttccctggtgggctattgaagatacacaagagggactgtatttctgtggaaaacaatttgcataatactaatttattgccgtcctggactctgtgtgagcgtgtccacagagtttgtagtaaatattatgattttatttaaactattcagaggaaaaacagaggatgctgaagtacagtcccagcacatttcctctctatcttttttttaggcaaaaccttgtgactcagtgtattttaaattctcagtcatgcactcacaaagataagacttgtttctttctgtctctctctctttttcttttctatggagcaaaacaaagctgatttcccttttttcttcccccgctaattcatacctccctcctgatgtttttcccaggttacaatggcctttatcctagttccattcttggtcaagtttttctctcaaatgatacagtcaggacacatcgttcgatttaagccatcatcagcttaatttaagtttgtagtttttgctgaaggattatatgtattaatacttacggttttaaatgtgttgctttggatacacacatagtttcttttttaatagaatatactgtcttgtctcactttggactgggacagtggatgcccatctaaaagttaagtgtcatttcttttagatgtttaccttcagccatagcttgattgctcagagaaatatgcagaaggcaggatcaaagacacacaggagtcctttcttttgaaatgccacgtgccattgtctttcctcccttctttgcttctttttcttaccctctctttcaattgcagatgccaaaaaagatgccaacagacactacattaccctaatggctgctacccagaacctttttataggttgttcttaatttttttgttgttgttgttcaagcttttcctttcttttttttcttagtgtttgggccacgattttaaaatgacttttattatgggtatgtgttgccaaagctggctttttgtcaaataaaatgaatacgaacttaaaaaataaaagctggtatcttaaaatgtaagagagtaagactgtgaagcctaaaatgactggctgagaatgaaccagaaatgccatttgccaaacagttgtaactagaaatttgattctcacagtccattcttttctttgtccttaagatgacattgttagtgttcacgtcccatgttcagtgtccaaaccggcaatgtaaaaagtatcctgtgtggcttaacaggaaatctgtttatgtctctttatttgaaaccagttttactctcagtggttctttaagttcaatgaagtctgccaggaacattggttggtagtattattccgacacctttaatttccaaaatctgaagttcctgctagtttaccaccttcatgatcttcttgaactggtaactgattaggttgaacttatggaagatttgtggacttaactcaaaagtaacctctcagtgttctatagaacatgtatttgtgtaactgaacctaccaggagaaatgtttggaattctatatgtgcaatttttcaacaaatgcaaaaaaaatacagcacatgtattgacaagcttctgtcaagcagcttgagttgaaatttgatttaagaaaataaatcatgattgttcaaagctgctgggacgttagaattaggccatgatactggtctcattttaactacagtggtatttggcactagtgtaaacttccatataaatcactcttttggaacaacaaagggggagggagaaaaatcacggcctgttaaatgagtaccaaagccgcccaacagtaatgagatgttctcatccttgattctcccagcctcaaacaacacagcttactttttttttcccttgctcagaaagtacctgtaatttaacaaacagactgcctgtaggtatagtgcaattacaaatgctctaatcattgtacatacatctctcttgatattgcagcatccatactggctttgtaatcattaattttttggcagattgaatgtgctgtattgatatgtatctatgtaattgtattgtatgtctatagctaattcacgttttgaataatgttattttatttacttttttaagagaggagaatgtaaatttgtcagtttatttctgactagggatattttctttccatttagaaaagaaaatatccctagtcagaaataaactgacaaatttacattctcctctcttaaaaaaa

SEQ ID NO: 440089 - DNA, 2427 bp, Homo sapiens
gtgcttttggcatttaaacagatttaacttggatacattggaatacaggtgaggacagaaggttctagacctgtatttccccttactgcatttctaccatggtaggaagacattcctaggtcaaaggaagaatgagaaacatgagggaatatcaacacttagagtgagagatactatgaaaatatgacatggtaggaagacattcctaggtcaaaagaagaatgagaaacacaagggaatatcaacacttagagtcagagatactatgaaaatatgaaattccacagcaaggtcttccgagcctctaactctgcaaacttcctgacctggagagccttagccagctccatctgctgtgtacatgccttgcacacttgcacctctggcactgtcctctcacgaacggctgtctgttacctttctggacctaatcgccctgctctgtagtggcccttgcccctcactcacaggcttactgaagcaaaggcaagaatagaaaacaaagcatattttccatagctagatctctctgggaaacattgctgaatatttaatttggtctccaaatttgtttatttccccagtactcttagggaattaaaattttctaggcaagacaatggcagagaagttgatataaacatgcgtaccccccttagtttccggtcaaaacatcagagttggcatgcccatctctggttttgaagagcagcagataaactccatttcagtaaaagggtttggcaacatcagtgtataaaccactttcctcaatgtagcgtttgagagagtatttactccctcatagaaacttcataggaacatggcatttctccaagggtccttaatcatcaagggcctggagactaaccagctactttggaataatacttttaaaattatgaatagatataaggtgtgtttacttaatatagtgtgtggtattcgctacatttttttcaatttgcataatagcttattgggcagaagatttgtagactttgggatcatcctatgagttctaacatcatttcgcggaaccacgtgacgcgactgcttcagaactataagaaacaggtgagtttctctgaaagcacagccaactaaatgtttttaggatcctgtttgcccgtgacaacatatctgtatggacagcaattacagttcttatcactttattttaaaattgtgcttattgtggagaatcagcttacaccagaagtggtttcccttttagcctcggaattctatgattaacaagtcatcgttcagtgtagaatttctgcctctgaactacttcattgaaattctgacagatatagagtcctccaatcaaggtaatttactcccctgttctcagggtcttaccacttttcccttgacacatcagtccttccctattcacttctttgtcttctttccaaaatccttttaacatacaagtagacccttatagcaattggtttacattagcagtaccaaatttactacctagagtaaattaccaaataatcacctctgaagttttaaaagagtcaagaggtttaaagcccatttggttgatgcaaatgttcttggtgctgaagtttaaatttaagaacacattcttaaaaaattcattttactaaaatacaattatgattttaatgagctgtgagcacaaagttataaatgtttcacggacccatggtaaccctttttccctgccctctccccatttttttccagccctgtatccttttgaaggacatgacaatgtggatgcagaatttgtagaggaagcagctctgaaacacaccgcgatgcttttaggcttatgaaaaagaaaacgcaattggatctgctgctgccattttaatcttgctcattaaccttactcctttgagaattctttaacaatatttaaaattggtaacaaaaatagtttagccataattgtttagccatgtgagtttcaggttggtacacgttcagacagaactgctgtatcacattccaattttgaatagccagtgagcaatcaagtgtagagaaatgataaatggcctaagaaggcatacagtggcataaacgatgctcttcctagtagcttaataggccacaagctagtttctgttgcactctgaaataaaatatgctttaaaaatgtagggaacagtgcttagaaaagcaaaaactaggtgtgtcattgaaataataggcataaaaattaaatgttacataagaacactatttggaaagagggtccttttaaaaactgaatttgtactaaatcagatttgccatgtccagtacagaataatttgtacttagtatttgcagcagggtttgtctttgtgaattcagatgaaacatatttatttttttttatttataaaaggttgatttaggaatattttgtcagtcattaaaaaacctgaaaacata

SEQ ID NO: 440090 - DNA, 752 bp, Homo sapiens
  misc_feature (1)..(2): n is a, c, g, or t
nnacagagcctgggctcactgaccagcccaggaggaaccagcctctgccttaccaggccatcaatccctgaagccaggggatctgccctgccagacacgggcatgtgtgtgtgtgtttcaggcttatcatccttgcattgctgggggtttcgcaacacggggaacgttgctggtctggctgaggtttctgtcgtgccacccctcctgccctgcttatggagctactgtatgtgtcagggccgtttgcatcctgttactagtcagtctatcttaatgcactttaggaaactcttccctttccttgcacgtgctttgcgtatactagttccccataaagaatgtcactgcctgaaacagaacattctgtgaaatgcagggctgttggattcacatgttaaattgtttcatctcaatcacgagggttgtgtaggatccagggaagatttatcccggggggtcaagagatatcgatgccctcccagaaggagttgccagcccactgagcagggtggttctgccctcttgcctggcactggatctcaagtatttaagaagaaaagaatggaatacaaagaagttagaagcgctttggggcagattttccagcaagactgggtttgtctgcccctagggccactacactgtagtgtggcttgtcctccggggggcacagtccccttggttacatatcattttccctttatataaacccttgtagctctgtgccccaacatcttgtgcgcttgggcccc

SEQ ID NO: 440091 - DNA, 3640 bp, Homo sapiens
  misc_feature (2121)..(2121): n is a, c, g, or t
  misc_feature (2231)..(2231): n is a, c, g, or t
tgactttgttggttgaaatccaccctgttaacaatgtgaaggttctaaaggctgtggatagctatatttgggttcagtttctctacccacatattgaaagtcatcctcttccagagaaccatctgttactgatttcagaagagaaatatattgaacaatttcgtatccatgtcgcccaagaagatggaaatagagtggtgattaaaaattctggccatctcccaagagacagaatagctgaggatttcgtttgggctcagtgggatatgtcagaacagagattatattacattgacctgaagaaatcaaggagtatcttaaaatgtatccagttttatgctgatgagagctataacttaatgtttgaagtacccttggacatatcattaagcaactcaggatttaaacttgtcaactttggatgtgattatcatcaataccgagataaattttccaaacacctgactctgtgtgtttttaccaaccatacaggaagtttgtgtgtatgttacagcccgaagtgtgcctcttggggacaaatcacatattcagtgttttacattcataaaggacacagcaagaccttcaccacttctcttgagaatgttgggtcacacatgacaaagggcattacttttctcaaccttgactattatgtggctgtttacttacctggtcatttcttccacctacttaatgttcaacatccagacctgatctgccacaatctctttctgacaggaaataatgaaatgattgatatgctacctcattgccctttacagtcattgtcagggtccctggtattggattgttgttctggaaagctctatagagcactgctcagccagtcgtctttattacagcttctgcagaacacttgcttagactgtgagaagatggctgcgttgcactgcgcgctctactgcggtcaaggtgcgcagttcctggaagcccagattattcagtggatttctgagaatgtctctgcctgccattcatttgacctcattcaggaatttataattgcttcttcatactggagtgtatattcagagacaagtaacatggacaaactattgccacattcctcagtgctcacttggaatacagaaattcctggaataactcttgtgacagaagacattgcattgcctcttatgaaggtgctcagctttaagggctactgggaaaaactgaactccaacctagaatatgttaagtacgccaagccacacttccactataacaacagtgtggtcaggagagagtggcacaacctgatctctgaagaggtatgagtgggtcagtgagaacaaagccagcagcgaggcatagtggactggatccaggtgatgcctttaaatcataaggctggcttccatgtgcagcactcttcccaattgccagggacttgatcattgtcattactgatctcaatgggcagagatgcttctatgatctctgttctcctagggaggaaactgaaaagcagaaagtttaaggggacacacagcacattcatagtagaagtatgattaatatccatgtctcagatgtgttctcaggttacttatgtagttaaaaattgatattaaaaaatctaggtgttcccaacttagtggtcattaggggttggggtagttggagggagaatagtggacgtgactcactgtccaggggtgacccagggaaatctttgggggtgatcgaagacttctatgtgttgattgtggtggtacattgtgggacatgaatctaaacatgataaaatgacatagaatgacacacacacattgtgccaatgtcaatttttgattttgatattgtgctctagttaggtaagatataagcactgaggagactgggtggagggtacattgcatctctctctagtatcgctgcatgtagattagtgttgttgtgtgtagtatatagttgactcgcagtttcctgtgaatctgtaattgtttcagaataaaatatttcttaaaactttaaaaaaaatctaggtgttctgattacctggaaagtatatttcttctctctgatgctcttaactgtattgcattatatccttgacgtgaaaagtcaccgataaaacctttaccttccacattnctgacgtgttctcactcctagaaaacaggaaaaagaaggtctgcggcatacgtgaggaatattcttgataatgcagtaaaggtgatttctaacctagaagcaagaaattnggggccaagattaacacccctcctgcaggaggaagacagccaccagcggctgctcatggggctgatggtgtctgagctaaaagaccattttttgagacacctacagggtgtagaaaagaagaaaattgaacagatggttctggactacatttcaaaactgctggatctcatttgccacatcgtagaaaccaattggaggaaacataatcttcattcctgggttctccacttcaatagtcgtggcagtgctgctgaatttgcagtttttcacatcatgaccaggattctggaagctacaaacagtttgtttttacctctgcctcctggttttcatactctgcacaccatcctcggggtccagtgtctccctttgcataacctgctgcattgcattgacagtggagtgttgcttctcactgaaacagctgtcataaggctcatgaaagatctggataatacagagaaaaatgaaaaactgaaattcagtatcattgtgcggcttcctccgcttattgggcagaagatttgtagactttgggatcatcctatgagttctaacatcatttcgcggaaccacgtgacgcgactgcttcagaactataagaaacagcctcggaattctatgattaacaagtcatcgttcagtgtagaatttctgcctctgaactacttcattgaaattctgacagatatagagtcctccaatcaagccctgtatccttttgaaggacatgacaatgtggatgcagaatttgtagaggaagcagctctgaaacacaccgcgatgcttttaggcttatgaaaaagaaaacgcaattggatctgctgctgccattttaatcttgctcattaaccttactcctttgagaattctttaacaatatttaaaattggtaacaaaaatagtttagccataattgtttagccatgtgagtttcaggttggtacacgttcagacagaactgctgtatcacattccaattttgaatagccagtgagcaatcaagtgtagagaaatgataaatggcctaagaaggcatacagtggcataaacgatgctcttcctagtagcttaataggccacaagctagtttctgttgcactctgaaataaaatatgctttaaaaatgtagggaacagtgcttagaaaagcaaaaactaggtgtgtcattgaaataataggcataaaaattaaatgttacataagaacactatttggaaagagggtccttttaaaaactgaatttgtactaaatcagatttgccatgtccagtacagaataatttgtacttagtatttgcagcagggtttgtctttgtgaattcagatgaaacatatttatttttttttatttataaaaggttgatttaggaatattttgtcagtcattaaaaaacctgaaaacata

SEQ ID NO: 440092 - DNA, 3171 bp, Homo sapiens
  misc_feature (1)..(2): n is a, c, g, or t
nnacagagcctgggctcactgaccagcccaggaggaaccagcctctgccttaccaggccatcaatccctgaagccaggggatctgccctgccagacacgggcatgtgtgtgtgtgtttcaggcttatcatccttgcattgctgggggtttcgcaacacggggaacgttgctggtctggctgaggtttctgtcgtgccacccctcctgccctgcttatggagctactgtatgtgtcagggccgtttgcatcctgttactagtcagtctatcttaatgcactttaggaaactcttccctttccttgcacgtgctttgcgtatactagttccccataaagaatgtcactgcctgaaacagaacattctgtgaaatgcagggctgttggattcacatgttaaattgtttcatctcaatcacgagggttgtgtaggatccagggaagatttatcccggggggtcaagagatatcgatgccctcccagaaggagttgccagcccactgagcagggtggttctgccctcttgcctggcactggatctcaagtatttaagaagaaaagaatggaatacaaagaagttagaagcgctttggggcagattttccagcaagactgggtttgtctgcccctagggccactacactgtagtgtgcattgcaaatcatggtggagaaggtaccatttgatttaacatatcacttttccacctttacctaactacctttgtagtctgataacttgtgccagttagtattatttgctgcagtaattgactggccccctcagctcagtaactcccaaggctactgaactacagggttcagaaagtagaagggagccatgcagtccttccaccgagcgctgttccctcaatttatgaccccagaagggttaagagaaggcccaagtccctctgtttccagtggagcagaggttcttagcagtgagttttagtgttgaacaaaaatcaaagctagagcctactggggttgaggaatgtgttggtttctttctttctcggtcattccctgtttcacacagctctgataagttcaccttgtaggactaggtcacacttaggtgatgaaaaattttcatcctgtgttatgttttctcaatgactcagagaagggaaacccaggctgattcttcttccttctaacccatctcctgaaaactgctcagagcctaactattgctctgtttcatttcagggccaagattaacacccctcctgcaggaggaagacagccaccagcggctgctcatggggctgatggtgtctgagctaaaagaccattttttgagacacctacagggtgtagaaaagaagaaaattgaacagatggttctggactacatttcaaaactgctggatctcatttgccacatcgtagaaaccaattggaggaaacataatcttcattcctgggttctccacttcaatagtcgtggcagtgctgctgaatttgcagtttttcacatcatgaccaggattctggaagctacaaacagtttgtttttacctctgcctcctggttttcatactctgcacaccatcctcggggtccagtgtctccctttgcataacctgctgcattgcattgacagtggagtgttgcttctcactgaaacagctgtcataaggctcatgaaagatctggataatacagagaaaaatgaaaaactgaaattcagtatcattgtgcggcttcctccgcttattgggcagaagatttgtagactttgggatcatcctatgagttctaacatcatttcgcggaaccacgtgacgcgactgcttcagaactataagaaacaggtgagtttctctgaaagcacagccaactaaatgtttttaggatcctgtttgcccgtgacaacatatctgtatggacagcaattacagttcttatcactttattttaaaattgtgcttattgtggagaatcagcttacaccagaagtggtttcccttttagcctcggaattctatgattaacaagtcatcgttcagtgtagaatttctgcctctgaactacttcattgaaattctgacagatatagagtcctccaatcaaggtaatttactcccctgttctcagggtcttaccacttttcccttgacacatcagtccttccctattcacttctttgtcttctttccaaaatccttttaacatacaagtagacccttatagcaattggtttacattagcagtaccaaatttactacctagagtaaattaccaaataatcacctctgaagttttaaaagagtcaagaggtttaaagcccatttggttgatgcaaatgttcttggtgctgaagtttaaatttaagaacacattcttaaaaaattcattttactaaaatacaattatgattttaatgagctgtgagcacaaagttataaatgtttcacggacccatggtaaccctttttccctgccctctccccatttttttccagccctgtatccttttgaaggacatgacaatgtggatgcagaatttgtagaggaagcagctctgaaacacaccgcgatgcttttaggcttatgaaaaagaaaacgcaattggatctgctgctgccattttaatcttgctcattaaccttactcctttgagaattctttaacaatatttaaaattggtaacaaaaatagtttagccataattgtttagccatgtgagtttcaggttggtacacgttcagacagaactgctgtatcacattccaattttgaatagccagtgagcaatcaagtgtagagaaatgataaatggcctaagaaggcatacagtggcataaacgatgctcttcctagtagcttaataggccacaagctagtttctgttgcactctgaaataaaatatgctttaaaaatgtagggaacagtgcttagaaaagcaaaaactaggtgtgtcattgaaataataggcataaaaattaaatgttacataagaacactatttggaaagagggtccttttaaaaactgaatttgtactaaatcagatttgccatgtccagtacagaataatttgtacttagtatttgcagcagggtttgtctttgtgaattcagatgaaacatatttatttttttttatttataaaaggttgatttaggaatattttgtcagtcattaaaaaacctgaaaacata

SEQ ID NO: 440093 - DNA, 1867 bp, Homo sapiens
gctgctcatgccaaacctggctttttctactgtccgcactcatttccactgataggaattgcatctgtcctttgaagctccccgcaaatgccatcacttccaagagagctgttttgattctctcctggtctgataccttctcccatgcatgatgtttttatctgttgtcagtagtagtatacttagagatctgggtttctgtgggtagctctacccgtgagacaggcttgagaatgcctgcctctcaattgaattcctataaatttactatctggccatattgtcttaattctttcttttctatactttagtccaagtagactctaaaagcctttctctagggcatacccagagataagccatataaactattgccttctggtccaaatttgtttcccttcagcaaaatggtcctcatcccaacaaccttttagtctggacatacgaaatctgaaatgcttctgtactcttttgctatcttactgtagaatcacaaacatatcaaaccgtaaaaccattgagcaggcccttgctctgtttctgtgcaggaagagacccaaggagcaaggaatgtatacttaccggaaacttactatagacccagcgtgatatttagttacgaataatacagagaaggaaacttggaccttgttttcaagaaattcagttggttccaggcaccaagcactgaactaagtgctttattaacatgatctaatccattccccgggggctgctggagatgttggctgactgtgtttaccctccagatctctcatcctaggttttcatactctgcacaccatcctcggggtccagtgtctccctttgcataacctgctgcattgcattgacagtggagtgttgcttctcactgaaacagctgtcataaggctcatgaaagatctggataatacagagaaaaatgaaaaactgaaattcagtatcattgtgcggcttcctccgcttattgggcagaagatttgtagactttgggatcatcctatgagttctaacatcatttcgcggaaccacgtgacgcgactgcttcagaactataagaaacagcctcggaattctatgattaacaagtcatcgttcagtgtagaatttctgcctctgaactacttcattgaaattctgacagatatagagtcctccaatcaagccctgtatccttttgaaggacatgacaatgtggatgcagaatttgtagaggaagcagctctgaaacacaccgcgatgcttttaggcttatgaaaaagaaaacgcaattggatctgctgctgccattttaatcttgctcattaaccttactcctttgagaattctttaacaatatttaaaattggtaacaaaaatagtttagccataattgtttagccatgtgagtttcaggttggtacacgttcagacagaactgctgtatcacattccaattttgaatagccagtgagcaatcaagtgtagagaaatgataaatggcctaagaaggcatacagtggcataaacgatgctcttcctagtagcttaataggccacaagctagtttctgttgcactctgaaataaaatatgctttaaaaatgtagggaacagtgcttagaaaagcaaaaactaggtgtgtcattgaaataataggcataaaaattaaatgttacataagaacactatttggaaagagggtccttttaaaaactgaatttgtactaaatcagatttgccatgtccagtacagaataatttgtacttagtatttgcagcagggtttgtctttgtgaattcagatgaaacatatttatttttttttatttataaaaggttgatttaggaatattttgtcagtcattaaaaaacctgaaaacata

SEQ ID NO: 440094 - DNA, 3443 bp, Homo sapiens
  misc_feature (2121)..(2121): n is a, c, g, or t
  misc_feature (2231)..(2231): n is a, c, g, or t
tgactttgttggttgaaatccaccctgttaacaatgtgaaggttctaaaggctgtggatagctatatttgggttcagtttctctacccacatattgaaagtcatcctcttccagagaaccatctgttactgatttcagaagagaaatatattgaacaatttcgtatccatgtcgcccaagaagatggaaatagagtggtgattaaaaattctggccatctcccaagagacagaatagctgaggatttcgtttgggctcagtgggatatgtcagaacagagattatattacattgacctgaagaaatcaaggagtatcttaaaatgtatccagttttatgctgatgagagctataacttaatgtttgaagtacccttggacatatcattaagcaactcaggatttaaacttgtcaactttggatgtgattatcatcaataccgagataaattttccaaacacctgactctgtgtgtttttaccaaccatacaggaagtttgtgtgtatgttacagcccgaagtgtgcctcttggggacaaatcacatattcagtgttttacattcataaaggacacagcaagaccttcaccacttctcttgagaatgttgggtcacacatgacaaagggcattacttttctcaaccttgactattatgtggctgtttacttacctggtcatttcttccacctacttaatgttcaacatccagacctgatctgccacaatctctttctgacaggaaataatgaaatgattgatatgctacctcattgccctttacagtcattgtcagggtccctggtattggattgttgttctggaaagctctatagagcactgctcagccagtcgtctttattacagcttctgcagaacacttgcttagactgtgagaagatggctgcgttgcactgcgcgctctactgcggtcaaggtgcgcagttcctggaagcccagattattcagtggatttctgagaatgtctctgcctgccattcatttgacctcattcaggaatttataattgcttcttcatactggagtgtatattcagagacaagtaacatggacaaactattgccacattcctcagtgctcacttggaatacagaaattcctggaataactcttgtgacagaagacattgcattgcctcttatgaaggtgctcagctttaagggctactgggaaaaactgaactccaacctagaatatgttaagtacgccaagccacacttccactataacaacagtgtggtcaggagagagtggcacaacctgatctctgaagaggtatgagtgggtcagtgagaacaaagccagcagcgaggcatagtggactggatccaggtgatgcctttaaatcataaggctggcttccatgtgcagcactcttcccaattgccagggacttgatcattgtcattactgatctcaatgggcagagatgcttctatgatctctgttctcctagggaggaaactgaaaagcagaaagtttaaggggacacacagcacattcatagtagaagtatgattaatatccatgtctcagatgtgttctcaggttacttatgtagttaaaaattgatattaaaaaatctaggtgttcccaacttagtggtcattaggggttggggtagttggagggagaatagtggacgtgactcactgtccaggggtgacccagggaaatctttgggggtgatcgaagacttctatgtgttgattgtggtggtacattgtgggacatgaatctaaacatgataaaatgacatagaatgacacacacacattgtgccaatgtcaatttttgattttgatattgtgctctagttaggtaagatataagcactgaggagactgggtggagggtacattgcatctctctctagtatcgctgcatgtagattagtgttgttgtgtgtagtatatagttgactcgcagtttcctgtgaatctgtaattgtttcagaataaaatatttcttaaaactttaaaaaaaatctaggtgttctgattacctggaaagtatatttcttctctctgatgctcttaactgtattgcattatatccttgacgtgaaaagtcaccgataaaacctttaccttccacattnctgacgtgttctcactcctagaaaacaggaaaaagaaggtctgcggcatacgtgaggaatattcttgataatgcagtaaaggtgatttctaacctagaagcaagaaattnggggccaagattaacacccctcctgcaggaggaagacagccaccagcggctgctcatggggctgatggtgtctgagctaaaagaccattttttgagacacctacagggtgtagaaaagaagaaaattgaacagatggttctggactacatttcaaaactggttggtcttgctttttattctcctcatatgccccttcaccccactccccatatagttctgaaaatgtggtgcagggaacccatttatgtgtttttcaaattagatttttggagatctcccgttcttaaatcagtatttggtgctgtagattgagaaaagggaaataaggaccataaacaaagagcatttggtttggaaagtggtttattgcccttccttcaaatactgattatatacccatggatgcataggacaatgaatttagtatgcttgccaaatgttaatatctcatcttggcaacttccagctccatgtagatgatttctgtacatggaggtttatgcagacaggagagaacttgaacttcaaatcttaattagttccagtagcctaagtaggccagattctagctcacttgtattaatactaccatgtgaggctgagattggcagttccttacctggtagccacttactgaaattttgtgatccagattagtaacaccactgtatgtgtaaatagtagtgataggactagattgaattttaaggttgtcttgagtctttcaaaaagcatagagagttgaggcctgatcttgcttagagtctagaaataatgtttgacaaattcaaaaaaatgtttgcacagaaagagaaagaacactccattatttctccaaatttgtataagaccagtatgcaaataagccagtgtgtgaacatatatttttccattgaactctggaagatttgttaaatttattagctataatcctgatttaatcatttcatgtttaattttcaagttttctgcctttattgcagccattagtgttgtttctacgtaatatatttgaatttctatagtaaggtttgagtttcatagtatttaatatattaggagaggttagtattctcatgtagtgatatttataatcagggatttgaatctttcttaagtctccttctcaatagcactgtaccaaggaactcacttgatgaatgtgttactgatcctccccatgttgacattaacttgctttaaaaaaaaaa

SEQ ID NO: 440095 - DNA, 1259 bp, Homo sapiens
tgactttgttggttgaaatccaccctgttaacaatgtgaaggttctaaaggctgtggatagctatatttgggttcagtttctctacccacatattgaaagtcatcctcttccagagaaccatctgttactgatttcagaagagaaatatattgaacaatttcgtatccatgtcgcccaagaagatggaaatagagtggtgattaaaaattctggccatctcccaagagacagaatagctgaggatttcgtttgggctcagtgggatatgtcagaacagagattatattacattgacctgaagaaatcaaggagtatcttaaaatgtatccagttttatgctgatgagagctataacttaatgtttgaagtacccttggacatatcattaagcaactcaggatttaaacttgtcaactttggatgtgattatcatcaataccgagataaattttccaaacacctgactctgtgtgtttttaccaaccatacaggaagtttgtgtgtatgttacagcccgaagtgtgcctcttggggacaaatcacatattcagtgttttacattcataaaggacacagcaagaccttcaccacttctcttgagaatgttgggtcacacatgacaaagggcattacttttctcaaccttgactattatgtggctgtttacttacctggtcatttcttccacctacttaatgttcaacatccagacctgatctgccacaatctctttctgacaggaaataatgaaatgattgatatgctacctcattgccctttacagtcattgtcagggtccctggtattggattgttgttctggaaagctctatagagcactgctcagccagtcgtctttattacagcttctgcagaacacttgcttagactgtgagaagatggctgcgttgcactgcgcgctctactgcggtcaaggtgcgcagttcctggaagcccagtggaggcagagagcagatttaaataccaacagagttctgtctgactttttaaagattattcagtggatttctgagaatgtctctgcctgccattcatttgacctcattcaggaatttataattgcttcttcatactggagtgtatattcagagacaagtaacatggacaaactattgccacattcctcagtgctcacttggaatacaattgtgcagggtggagcagctattgtggacacgcacagggtgacatcaggaagtccaagaagagcgatataaagaaacctgtggttataacct

SEQ ID NO: 440096 - DNA, 386 bp, Homo sapiens
caggaaaaagaaggtctgcggcatacgtgaggaatattcttgataatgcagtaaagtaagtgaaagcagaggttatcatatctgtaagatggttgacatttacaattactttgttttgttggctaccttttatagaagtagtttacttttgttgcatatccccagcaaaataatattgtcagcttcatgaatgcagccacttggaccctattctggaatttggtgctggaatttctggtgggaaaagcttatatgttgaaccttatagacttgtaacctgcggatagatgtttacaatggataattggtaaagaaatttcctattagcattttaggagagaaaggcaaatagtaggttgattttttttttttttaaagtgtcagtg

SEQ ID NO: 440097 - DNA, 297 bp, Homo sapiens
aatgcaaaagattcatgtatatttgtacttctttggtagtggaggcagagagcagatttaaataccaacagagttctgtctgactttttaaagattattcagtggatttctgagaatgtctctgcctgccattcatttgacctcattcaggaatttataattggtaagtgttgctgatgttgcagcttaagttgaatacttgacctttttgcttgagggaaagcagtaaattgatagtgaatgcctcaacctgtccaaatgctactttggagcacattaaaaaaaaaaaacaaaact

SEQ ID NO: 440098 - DNA, 392 bp, Homo sapiens
aggagatttattaaaaagatgtataaaaaggatcataaaataccgttttacctacccagaattgcattatgtatcttgaagatagtatagaagtgagtatattcttaggcaattctaaaataggtatagaatgcaaaagattcatgtatatttgtacttctttggtagtggaggcagagagcagatttaaataccaacagagttctgtctgactttttaaagattattcagtggatttctgagaatgtctctgcctgccattcatttgacctcattcaggaatttataattggtaagtgttgctgatgttgcagcttaagttgaatacttgacctttttgcttgagggaaagcagtaaattgatagtgaatgcctcaacctgtccaaatgct

SEQ ID NO: 440099 - DNA, 2620 bp, Homo sapiens
  misc_feature (1)..(2): n is a, c, g, or t
nnacagagcctgggctcactgaccagcccaggaggaaccagcctctgccttaccaggccatcaatccctgaagccaggggatctgccctgccagacacgggcatgtgtgtgtgtgtttcaggcttatcatccttgcattgctgggggtttcgcaacacggggaacgttgctggtctggctgaggtttctgtcgtgccacccctcctgccctgcttatggagctactgtatgtgtcagggccgtttgcatcctgttactagtcagtctatcttaatgcactttaggaaactcttccctttccttgcacgtgctttgcgtatactagttccccataaagaatgtcactgcctgaaacagaacattctgtgaaatgcagggctgttggattcacatgttaaattgtttcatctcaatcacgagggttgtgtaggatccagggaagatttatcccggggggtcaagagatatcgatgccctcccagaaggagttgccagcccactgagcagggtggttctgccctcttgcctggcactggatctcaagtatttaagaagaaaagaatggaatacaaagaagttagaagcgctttggggcagattttccagcaagactgggtttgtctgcccctagggccactacactgtagtgtgcattgcaaatcatggtggagaaggtaccatttgatttaacatatcacttttccacctttacctaactacctttgtagtctgataacttgtgccagttagtattatttgctgcagtaattgactggccccctcagctcagtaactcccaaggctactgaactacagggttcagaaagtagaagggagccatgcagtccttccaccgagcgctgttccctcaatttatgaccccagaagggttaagagaaggcccaagtccctctgtttccagtggagcagaggttcttagcagtgagttttagtgttgaacaaaaatcaaagctagagcctactggggttgaggaatgtgttggtttctttctttctcggtcattccctgtttcacacagctctgataagttcaccttgtaggactaggtcacacttaggtgatgaaaaattttcatcctgtgttatgttttctcaatgactcagagaagggaaacccaggctgattcttcttccttctaacccatctcctgaaaactgctcagagcctaactattgctctgtttcatttcagggccaagattaacacccctcctgcaggaggaagacagccaccagcggctgctcatggggctgatggtgtctgagctaaaagaccattttttgagacacctacagggtgtagaaaagaagaaaattgaacagatggttctggactacatttcaaaactgctggatctcatttgccacatcgtagaaaccaattggaggaaacataatcttcattcctgggttctccacttcaatagtcgtggcagtgctgctgaatttgcagtttttcacatcatgaccaggattctggaagctacaaacagtttgtttttacctctgcctcctggttttcatactctgcacaccatcctcggggtccagtgtctccctttgcataacctgctgcattgcattgacagtggagtgttgcttctcactgaaacagctgtcataaggctcatgaaagatctggataatacagagaaaaatgaaaaactgaaattcagtatcattgtgcggcttcctccgcttattgggcagaagatttgtagactttgggatcatcctatgagttctaacatcatttcgcggaaccacgtgacgcgactgcttcagaactataagaaacagcctcggaattctatgattaacaagtcatcgttcagtgtagaatttctgcctctgaactacttcattgaaattctgacagatatagagtcctccaatcaagccctgtatccttttgaaggacatgacaatgtggatgcagaatttgtagaggaagcagctctgaaacacaccgcgatgcttttaggcttatgaaaaagaaaacgcaattggatctgctgctgccattttaatcttgctcattaaccttactcctttgagaattctttaacaatatttaaaattggtaacaaaaatagtttagccataattgtttagccatgtgagtttcaggttggtacacgttcagacagaactgctgtatcacattccaattttgaatagccagtgagcaatcaagtgtagagaaatgataaatggcctaagaaggcatacagtggcataaacgatgctcttcctagtagcttaataggccacaagctagtttctgttgcactctgaaataaaatatgctttaaaaatgtagggaacagtgcttagaaaagcaaaaactaggtgtgtcattgaaataataggcataaaaattaaatgttacataagaacactatttggaaagagggtccttttaaaaactgaatttgtactaaatcagatttgccatgtccagtacagaataatttgtacttagtatttgcagcagggtttgtctttgtgaattcagatgaaacatatttatttttttttatttataaaaggttgatttaggaatattttgtcagtcattaaaaaacctgaaaacata

SEQ ID NO: 440100 - DNA, 2043 bp, Homo sapiens
gctcttgctgagcgtgttgtctgggcaaaagggagaggagggaggaggagagagaaaagcaaaaggtggggaaggctgggaatgctaatggttggggaagtggggaggcccaaggatgatcaaacaaagcgagtatagaaacaaacctatttggaggcaccagaatgaatatttcattacctttgcatgtcaaggggctgtgttcagtgtctgtggccactgtgtagagggaagtacctgattatttcccatttactcctgcttctgtccttccaaaacacccaaaactgttgcccccattggctcagtcattctatatatagagttgttcctgttaatcccccaggactctaggagaagtagactttaatcctttggtagatcccaaagcctgtgacttctaagttggtgactttcactgtcttctttggaggattctcgtcagagttagagccttactcgcagttgctcacggggctttgggtgaatcataagtaattccttttgaggcaaatgttggggaccccttatttatgctcaccagagaaatactgagagttatgcatttccattgatgggaccttcagatccagtattttttatattgatgaagaatgttaataagtggatctaattcaaaccagttgcaggtatgagtgggtaggctgtgacttatttaatgcatatcctgttttcagatggtgtctgagctaaaagaccattttttgagacacctacagggtgtagaaaagaagaaaattgaacagatggttctggactacatttcaaaactgctggatctcatttgccacatcgtagaaaccaattggaggaaacataatcttcattcctgggttctccacttcaatagtcgtggcagtgctgctgaatttgcagtttttcacatcatgaccaggattctggaagctacaaacagtttgtttttacctctgcctcctggttttcatactctgcacaccatcctcggggtccagtgtctccctttgcataacctgctgcattgcattgacagtggagtgttgcttctcactgaaacagctgtcataaggctcatgaaagatctggataatacagagaaaaatgaaaaactgaaattcagtatcattgtgcggcttcctccgcttattgggcagaagatttgtagactttgggatcatcctatgagttctaacatcatttcgcggaaccacgtgacgcgactgcttcagaactataagaaacagcctcggaattctatgattaacaagtcatcgttcagtgtagaatttctgcctctgaactacttcattgaaattctgacagatatagagtcctccaatcaagccctgtatccttttgaaggacatgacaatgtggatgcagaatttgtagaggaagcagctctgaaacacaccgcgatgcttttaggcttatgaaaaagaaaacgcaattggatctgctgctgccattttaatcttgctcattaaccttactcctttgagaattctttaacaatatttaaaattggtaacaaaaatagtttagccataattgtttagccatgtgagtttcaggttggtacacgttcagacagaactgctgtatcacattccaattttgaatagccagtgagcaatcaagtgtagagaaatgataaatggcctaagaaggcatacagtggcataaacgatgctcttcctagtagcttaataggccacaagctagtttctgttgcactctgaaataaaatatgctttaaaaatgtagggaacagtgcttagaaaagcaaaaactaggtgtgtcattgaaataataggcataaaaattaaatgttacataagaacactatttggaaagagggtccttttaaaaactgaatttgtactaaatcagatttgccatgtccagtacagaataatttgtacttagtatttgcagcagggtttgtctttgtgaattcagatgaaacatatttatttttttttatttataaaaggttgatttaggaatattttgtcagtcattaaaaaacctgaaaacata

SEQ ID NO: 440101 - DNA, 2615 bp, Homo sapiens
  misc_feature (1)..(2): n is a, c, g, or t
nnacagagcctgggctcactgaccagcccaggaggaaccagcctctgccttaccaggccatcaatccctgaagccaggggatctgccctgccagacacgggcatgtgtgtgtgtgtttcaggcttatcatccttgcattgctgggggtttcgcaacacggggaacgttgctggtctggctgaggtttctgtcgtgccacccctcctgccctgcttatggagctactgtatgtgtcagggccgtttgcatcctgttactagtcagtctatcttaatgcactttaggaaactcttccctttccttgcacgtgctttgcgtatactagttccccataaagaatgtcactgcctgaaacagaacattctgtgaaatgcagggctgttggattcacatgttaaattgtttcatctcaatcacgagggttgtgtaggatccagggaagatttatcccggggggtcaagagatatcgatgccctcccagaaggagttgccagcccactgagcagggtggttctgccctcttgcctggcactggatctcaagtatttaagaagaaaagaatggaatacaaagaagttagaagcgctttggggcagattttccagcaagactgggtttgtctgcccctagggccactacactgtagtgtgcattgcaaatcatggtggagaaggtaccatttgatttaacatatcacttttccacctttacctaactacctttgtagtctgataacttgtgccagttagtattatttgctgcagtaattgactggccccctcagctcagtaactcccaaggctactgaactacagggttcagaaagtagaagggagccatgcagtccttccaccgagcgctgttccctcaatttatgaccccagaagggttaagagaaggcccaagtccctctgtttccagtggagcagaggttcttagcagtgagttttagtgttgaacaaaaatcaaagctagagcctactggggttgaggaatgtgttggtttctttctttctcggtcattccctgtttcacacagctctgataagttcaccttgtaggactaggtcacacttaggtgatgaaaaattttcatcctgtgttatgttttctcaatgactcagagaagggaaacccaggctgattcttcttccttctaacccatctcctgaaaactgctcagagcctaactattgctctgtttcatttcagggccaagattaacacccctcctgcaggaggaagacagccaccagcggctgctcatggggctgatggtgtctgagctaaaagaccattttttgagacacctacagggtgtagaaaagaagaaaattgaacagatggttctggactacatttcaaaactgctggatctcatttgccacatcgtagaaaccaattggaggaaacataatcttcattcctgggttctccacttcaatagtcgtggcagtgctgctgaatttgcagtttttcacatcatgaccaggattctggaagctacaaacagtttgtttttacctctgcctcctggttttcatactctgcacaccatcctcggggtccagtgtctccctttgcataacctgctgcattgcattgacagtggagtgttgcttctcactgaaacagctgtcataaggctcatgaaagatctggataatacagagaaaaatgaaaaactgaaattcagtatcattgtgcggcttcctccgcttattgggcagaagatttgtagactttgggatcatcctatgagttctaacatcatttcgcggaaccacgtgacgcgactgcttcagaactataagaaacagcctcggaattctatgattaacaagtcatcgttcagtgtagaatttctgcctctgaactacttcattgaaattctgacagatatagagtcctccaatcaagccctgtatccttttgaaggacatgacaatgtggatgcagaatttgtagaggaagcagctctgaaacacaccgcgatgcttttaggcttatgaaaaagaaaacgcaattggatctgctgctgccattttaatcttgctcattaaccttactcctttgagaattctttaacaatatttaaaattggtaacaaaaatagtttagccataattgtttagccatgtgagtttcaggttggtacacgttcagacagaactgctgtatcacattccaattttgaatagccagtgagcaatcaagtgtagagaaatgataaatggcctaagaaggcatacagtggcataaacgatgctcttcctagtagcttaataggccacaagctagtttctgttgcactctgaaataaaatatgctttaaaaatgtagggaacagtgcttagaaaagcaaaaactaggtgtgtcattgaaataataggcataaaaattaaatgttacataagaacactatttggaaagagggtccttttaaaaactgaatttgtactaaatcagatttgccatgtccagtacagaataatttgtacttagtatttcaatgacacacctagtttttgcttttctaagcactgttccctacatttttaaagcatattttatttcagactgcaacagaaactagcttgtggcctagtcgagc

SEQ ID NO: 440102 - DNA, 1592 bp, Homo sapiens
tgactttgttggttgaaatccaccctgttaacaatgtgaaggttctaaaggctgtggatagctatatttgggttcagtttctctacccacatattgaaagtcatcctcttccagagaaccatctgttactgatttcagaagagaaatatattgaacaatttcgtatccatgtcgcccaagaagatggaaatagagtggtgattaaaaattctggccatctcccaagagacagaatagctgaggatttcgtttgggctcagtgggatatgtcagaacagagattatattacattgacctgaagaaatcaaggagtatcttaaaatgtatccagttttatgctgatgagagctataacttaatgtttgaagtacccttggacatatcattaagcaactcaggatttaaacttgtcaactttggatgtgattatcatcaataccgagataaattttccaaacacctgactctgtgtgtttttaccaaccatacaggaagtttgtgtgtatgttacagcccgaagtgtgcctcttggggacaaatcacatattcagtgttttacattcataaaggacacagcaagaccttcaccacttctcttgagaatgttgggtcacacatgacaaagggcattacttttctcaaccttgactattatgtggctgtttacttacctggtcatttcttccacctacttaatgttcaacatccagacctgatctgccacaatctctttctgacaggaaataatgaaatgattgatatgctacctcattgccctttacagtcattgtcagggtccctggtattggattgttgttctggaaagctctatagagcactgctcagccagtcgtctttattacagcttctgcagaacacttgcttagactgtgagaagatggctgcgttgcactgcgcgctctactgcggtcaaggtgcgcagttcctggaagcccagattattcagtggatttctgagaatgtctctgcctgccattcatttgacctcattcaggaatttataattgcttcttcatactggagtgtatattcagagacaagtaacatggacaaactattgccacattcctcagtgctcacttggaatacagaaattcctggaataactcttgtgacagaagacattgcattgcctcttatgaaggtgctcagctttaagggctactgggaaaaactgaactccaacctagaatatgttaagtacgccaagccacacttccactataacaacagtgtggtcaggagagagtggcacaacctgatctctgaagagaaaacaggaaaaagaaggtctgcggcatacgtgaggaatattcttgataatgcagtaaagtgattctaacctagaagcaagaatttggggcaagattaaagcccctcctgcaggaggaagacagcaaccagggtgtcatgggggtctgatggtgtctgagctaaagaccattttgtgagacactacgggtgtgaaccgagaacttgaccgatggttctgcataacttccaaatgtgatctcctttgccattcgttagaagccattggcggaacttatttcctcctggggtctccttc

SEQ ID NO: 440103 - DNA, 7941 bp, Homo sapiens
  misc_feature (7507)..(7507): n is a, c, g, or t
  misc_feature (7554)..(7554): n is a, c, g, or t
  misc_feature (7605)..(7605): n is a, c, g, or t
  misc_feature (7613)..(7613): n is a, c, g, or t
  misc_feature (7678)..(7678): n is a, c, g, or t
  misc_feature (7685)..(7685): n is a, c, g, or t
  misc_feature (7726)..(7726): n is a, c, g, or t
  misc_feature (7793)..(7793): n is a, c, g, or t
  misc_feature (7844)..(7844): n is a, c, g, or t
  misc_feature (7851)..(7851): n is a, c, g, or t
  misc_feature (7941)..(7941): n is a, c, g, or t
gcgcccgcccctccgcgccgcctgcccgcccgcccgccgcgctcccgcccgccgctctccgtggccccgccgcgctgccgccgccgccgctgccagcgaaggtgccggggctccgggccctccctgccggcggccgtcagcgctcggagcgggctgcgcggcgggagctccgggaggcggccgtagccagcgccgccgcgcaggaccaggaggaggagaaagggtgcgcagcccggaggcggggtgcgccggtggggtgcagcggaagagggggtccaggggggagaacttcgtagcagtcatcctttttaggaaaagagggaaaaaataaaaccctcccccaccacctccttctccccacccctcgccgcaccacacacagcgcgggcttctagcgctcggcaccggcgggccaggcgcgtcctgccttcatttatccagcagcttttcggaaaatgcatttgctgttcggagtttaatcagaagaggattcctgcctccgtccccggctccttcatcgtcccctctcccctgtctctctcctggggaggcgtgaagcgagattcatgcctgtgcccgcgcgtgtgtgcgcgcgtgtaaattgccgagaaggggaaaacatcacaggacttctgcgaataccggactgaaaattgtaattcatctgccgccgccgctgccttttttttttctcgagctcttgagatctccggttgggattcctgcggattgacatttctgtgaagcagaagtctgggaatcgatctggaaatcctcctaatttttactccctctccccccgactcctgattcattgggaagtttcaaatcagctataactggagagtgctgaagattgatgggatcgttgccttatgcatttgttttggttttacaaaaaggaaacttgacagaggatcatgctgtacttaaaaaatacaacatcacagaggaagtagactgatattaacaatacttactaataataacgtgcctcatgaaataaagatccgaaaggaattggaataaaaatttcctgcatctcatgccaagggggaaacaccagaatcaagtgttccgcgtgattgaagacaccccctcgtccaagaatgcaaagcacatccaataaaatagctggattataactcctcttctttctctgggggccgtggggtgggagctggggcgagaggtgccgttggcccccgttgcttttcctctgggaaggatggcgcacgctgggagaacggggtacgataaccgggagatagtgatgaagtacatccattataagctgtcgcagaggggctacgagtgggatgcgggagatgtgggcgccgcgcccccgggggccgcccccgcaccgggcatcttctcctcccagcccgggcacacgccccatccagccgcatcccgggacccggtcgccaggacctcgccgctgcagaccccggctgcccccggcgccgccgcggggcctgcgctcagcccggtgccacctgtggtccacctgaccctccgccaggccggcgacgacttctcccgccgctaccgccgcgacttcgccgagatgtccagccagctgcacctgacgcccttcaccgcgcggggacgctttgccacggtggtggaggagctcttcagggacggggtgaactgggggaggattgtggccttctttgagttcggtggggtcatgtgtgtggagagcgtcaaccgggagatgtcgcccctggtggacaacatcgccctgtggatgactgagtacctgaaccggcacctgcacacctggatccaggataacggaggctgggatgcctttgtggaactgtacggccccagcatgcggcctctgtttgatttctcctggctgtctctgaagactctgctcagtttggccctggtgggagcttgcatcaccctgggtgcctatctgggccacaagtgaagtcaacatgcctgccccaaacaaatatgcaaaaggttcactaaagcagtagaaataatatgcattgtcagtgatgtaccatgaaacaaagctgcaggctgtttaagaaaaaataacacacatataaacatcacacacacagacagacacacacacacacaacaattaacagtcttcaggcaaaacgtcgaatcagctatttactgccaaagggaaatatcatttattttttacattattaagaaaaaaagatttatttatttaagacagtcccatcaaaactcctgtctttggaaatccgaccactaattgccaagcaccgcttcgtgtggctccacctggatgttctgtgcctgtaaacatagattcgctttccatgttgttggccggatcaccatctgaagagcagacggatggaaaaaggacctgatcattggggaagctggctttctggctgctggaggctggggagaaggtgttcattcacttgcatttctttgccctgggggctgtgatattaacagagggagggttcctgtggggggaagtccatgcctccctggcctgaagaagagactctttgcatatgactcacatgatgcatacctggtgggaggaaaagagttgggaacttcagatggacctagtacccactgagatttccacgccgaaggacagcgatgggaaaaatgcccttaaatcataggaaagtatttttttaagctaccaattgtgccgagaaaagcattttagcaatttatacaatatcatccagtaccttaagccctgattgtgtatattcatatattttggatacgcaccccccaactcccaatactggctctgtctgagtaagaaacagaatcctctggaacttgaggaagtgaacatttcggtgacttccgcatcaggaaggctagagttacccagagcatcaggccgccacaagtgcctgcttttaggagaccgaagtccgcagaacctgcctgtgtcccagcttggaggcctggtcctggaactgagccggggccctcactggcctcctccagggatgatcaacagggcagtgtggtctccgaatgtctggaagctgatggagctcagaattccactgtcaagaaagagcagtagaggggtgtggctgggcctgtcaccctggggccctccaggtaggcccgttttcacgtggagcatgggagccacgacccttcttaagacatgtatcactgtagagggaaggaacagaggccctgggcccttcctatcagaaggacatggtgaaggctgggaacgtgaggagaggcaatggccacggcccattttggctgtagcacatggcacgttggctgtgtggccttggcccacctgtgagtttaaagcaaggctttaaatgactttggagagggtcacaaatcctaaaagaagcattgaagtgaggtgtcatggattaattgacccctgtctatggaattacatgtaaaacattatcttgtcactgtagtttggttttatttgaaaacctgacaaaaaaaaagttccaggtgtggaatatgggggttatctgtacatcctggggcattaaaaaaaaaatcaatggtggggaactataaagaagtaacaaaagaagtgacatcttcagcaaataaactaggaaatttttttttcttccagtttagaatcagccttgaaacattgatggaataactctgtggcattattgcattatataccatttatctgtattaactttggaatgtactctgttcaatgtttaatgctgtggttgatatttcgaaagctgctttaaaaaaatacatgcatctcagcgtttttttgtttttaattgtatttagttatggcctatacactatttgtgagcaaaggtgatcgttttctgtttgagatttttatctcttgattcttcaaaagcattctgagaaggtgagataagccctgagtctcagctacctaagaaaaacctggatgtcactggccactgaggagctttgtttcaaccaagtcatgtgcatttccacgtcaacagaattgtttattgtgacagttatatctgttgtccctttgaccttgtttcttgaaggtttcctcgtccctgggcaattccgcatttaattcatggtattcaggattacatgcatgtttggttaaacccatgagattcattcagttaaaaatccagatggcaaatgaccagcagattcaaatctatggtggtttgacctttagagagttgctttacgtggcctgtttcaacacagacccacccagagccctcctgccctccttccgcgggggctttctcatggctgtccttcagggtcttcctgaaatgcagtggtgcttacgctccaccaagaaagcaggaaacctgtggtatgaagccagacctccccggcgggcctcagggaacagaatgatcagacctttgaatgattctaatttttaagcaaaatattattttatgaaaggtttacattgtcaaagtgatgaatatggaatatccaatcctgtgctgctatcctgccaaaatcattttaatggagtcagtttgcagtatgctccacgtggtaagatcctccaagctgctttagaagtaacaatgaagaacgtggacgtttttaatataaagcctgttttgtcttttgttgttgttcaaacgggattcacagagtatttgaaaaatgtatatatattaagaggtcacgggggctaattgctggctggctgccttttgctgtggggttttgttacctggttttaataacagtaaatgtgcccagcctcttggccccagaactgtacagtattgtggctgcacttgctctaagagtagttgatgttgcattttccttattgttaaaaacatgttagaagcaatgaatgtatataaaagcctcaactagtcatttttttctcctcttcttttttttcattatatctaattattttgcagttgggcaacagagaaccatccctattttgtattgaagagggattcacatctgcatcttaactgctctttatgaatgaaaaaacagtcctctgtatgtactcctctttacactggccagggtcagagttaaatagagtatatgcactttccaaattggggacaagggctctaaaaaaagccccaaaaggagaagaacatctgagaacctcctcggccctcccagtccctcgctgcacaaatactccgcaagagaggccagaatgacagctgacagggtctatggccatcgggtcgtctccgaagatttggcaggggcagaaaactctggcaggcttaagatttggaataaagtcacagaattaaggaagcacctcaatttagttcaaacaagacgccaacattctctccacagctcacttacctctctgtgttcagatgtggccttccatttatatgtgatctttgttttattagtaaatgcttatcatctaaagatgtagctctggcccagtgggaaaaattaggaagtgattataaatcgagaggagttataataatcaagattaaatgtaaataatcagggcaatcccaacacatgtctagctttcacctccaggatctattgagtgaacagaattgcaaatagtctctatttgtaattgaacttatcctaaaacaaatagtttataaatgtgaacttaaactctaattaattccaactgtacttttaaggcagtggctgtttttagactttcttatcacttatagttagtaatgtacacctactctatcagagaaaaacaggaaaggctcgaaatacaagccattctaaggaaattagggagtcagttgaaattctattctgatcttattctgtggtgtcttttgcagcccagacaaatgtggttacacactttttaagaaatacaattctacattgtcaagcttatgaaggttccaatcagatctttattgttattcaatttggatctttcagggattttttttttaaattattatgggacaaaggacatttgttggaggggtgggagggaggaagaatttttaaatgtaaaacattcccaagtttggatcagggagttggaagttttcagaataaccagaactaagggtatgaaggacctgtattggggtcgatgtgatgcctctgcgaagaaccttgtgtgacaaatgagaaacattttgaagtttgtggtacgacctttagattccagagacatcagcatggctcaaagtgcagctccgtttggcagtgcaatggtataaatttcaagctggatatgtctaatgggtatttaaacaataaatgtgcagttttaactaacaggatatttaatgacaaccttctggttggtagggacatctgtttctaaatgtttattatgtacaatacagaaaaaaattttataaaattaagcaatgtgaaactgaattggagagtgataatacaagtcctttagtcttacccagtgaatcattctgttccatgtctttggacaaccatgaccttggacaatcatgaaatatgcatctcactggatgcaaagaaaatcagatggagcatgaatggtactgtaccggttcatctggactgccccagaaaaataacttcaagcaaacatcctatcaacaacaaggttgttctgcataccaagctgagcacagaagatgggaacactggtggaggatggaaaggctcgctcaatcaagaaaattctgagactattaataaataagactgtagtgtagatactgagtaaatccatgcacctaaaccttttggaaaatctgccgtgggccctccagatagctcatttcattaagtttttccctccaaggtagaatttgcaagagtgacagtggattgcatttcttttggggaagctttcttttggtggttttgtttattataccttcttaagttttcaaccaaggtttgcttttgttttgagttactggggttatttttgttttaaataaaaataagtgtacaataagtgtttttgtattgaaagcttttgttatcaagattttcatacttttaccttccatggctctttttaagattgatacttttaagaggtggctgatattctgcaacactgtacacataaaaaatacggtaaggatactttacatggttaaggtaaagtaagtctccagttggccaccattagctataatggcactttgtttgtgttgttggaaaaagtcacattgccattaaactttccttgtctgtctagttaatattgtgaagaaaaataaagtacagtgtgagatactgaaaaaaaaaaacaaaaaaacaaaaaaaaaaaaaaaacaacaacaatagttggcgaccagctgcgccactagaaaaggctttgctaaacaacactggttgtgaggacccgccgagcccacgattgagctatcgacacaccggtggcacatacagcgcgtcctcaaaagagaagacgcacgcgcgcgacaagcacagcatatggctggtgtgcgtgttgcctcacgaaagtaaaaaaaaaacctccgcctgtgcgtggaagccatctatagcgacggctgtntcatcgacgacacaactctaccataaagagggaataggccggttacngaggatcgacgcagaatgctactaggtcggagtgagactcgtaataacganagcgaacnaggtcgggacaggtgacaaggaaaaggcaaagaagaagcgcgcgaataactgataataaaagtcnttatggnccccggccctgccccgtgtcaacgggtgtgaaggctaaagnaattacgaagatgcaactgaagggaactaaggaaaagcgtagcgaaggcatcgcaatggcctagagnactaggacgatacgtacgatacgaataggtccaaatatcaggtcatcgcanaccgtancaagagtagagccaaggacagagctacgtgtaaagttgaacagtgaaaagagtgaaacaggaggcagcaagagcaatcgaagccacaggn

SEQ ID NO: 440104 - DNA, 1800 bp, Homo sapiens
  misc_feature (21)..(22): n is a, c, g, or t
  misc_feature (1366)..(1366): n is a, c, g, or t
  misc_feature (1413)..(1413): n is a, c, g, or t
  misc_feature (1464)..(1464): n is a, c, g, or t
  misc_feature (1472)..(1472): n is a, c, g, or t
  misc_feature (1537)..(1537): n is a, c, g, or t
  misc_feature (1544)..(1544): n is a, c, g, or t
  misc_feature (1585)..(1585): n is a, c, g, or t
  misc_feature (1652)..(1652): n is a, c, g, or t
  misc_feature (1703)..(1703): n is a, c, g, or t
  misc_feature (1710)..(1710): n is a, c, g, or t
  misc_feature (1800)..(1800): n is a, c, g, or t
ctcgtgcaattcggcagcggnncatggctcaaagtgcagctccgtttggcagtgcaatggtataaatttcaagctggatatgtctaatgggtatttaaacaataaatgtgcagttttaactaacaggatatttaatgacaaccttctggttggtagggacatctgtttctaaatgtttattatgtacaatacagaaaaaaattttataaaattaagcaatgtgaaactgaattggagagtgataatacaagtcctttagtcttacccagtgaatcattctgttccatgtctttggacaaccatgaccttggacaatcatgaaatatgcatctcactggatgcaaagaaaatcagatggagcatgaatggtactgtaccggttcatctggactgccccagaaaaataacttcaagcaaacatcctatcaacaacaaggttgttctgcataccaagctgagcacagaagatgggaacactggtggaggatggaaaggctcgctcaatcaagaaaattctgagactattaataaataagactgtagtgtagatactgagtaaatccatgcacctaaaccttttggaaaatctgccgtgggccctccagatagctcatttcattaagtttttccctccaaggtagaatttgcaagagtgacagtggattgcatttcttttggggaagctttcttttggtggttttgtttattataccttcttaagttttcaaccaaggtttgcttttgttttgagttactggggttatttttgttttaaataaaaataagtgtacaataagtgtttttgtattgaaagcttttgttatcaagattttcatacttttaccttccatggctctttttaagattgatacttttaagaggtggctgatattctgcaacactgtacacataaaaaatacggtaaggatactttacatggttaaggtaaagtaagtctccagttggccaccattagctataatggcactttgtttgtgttgttggaaaaagtcacattgccattaaactttccttgtctgtctagttaatattgtgaagaaaaataaagtacagtgtgagatactgaaaaaaaaaaacaaaaaaacaaaaaaaaaaaaaaaacaacaacaatagttggcgaccagctgcgccactagaaaaggctttgctaaacaacactggttgtgaggacccgccgagcccacgattgagctatcgacacaccggtggcacatacagcgcgtcctcaaaagagaagacgcacgcgcgcgacaagcacagcatatggctggtgtgcgtgttgcctcacgaaagtaaaaaaaaaacctccgcctgtgcgtggaagccatctatagcgacggctgtntcatcgacgacacaactctaccataaagagggaataggccggttacngaggatcgacgcagaatgctactaggtcggagtgagactcgtaataacganagcgaacnaggtcgggacaggtgacaaggaaaaggcaaagaagaagcgcgcgaataactgataataaaagtcnttatggnccccggccctgccccgtgtcaacgggtgtgaaggctaaagnaattacgaagatgcaactgaagggaactaaggaaaagcgtagcgaaggcatcgcaatggcctagagnactaggacgatacgtacgatacgaataggtccaaatatcaggtcatcgcanaccgtancaagagtagagccaaggacagagctacgtgtaaagttgaacagtgaaaagagtgaaacaggaggcagcaagagcaatcgaagccacaggn

SEQ ID NO: 440105 - DNA, 1413 bp, Homo sapiens
  misc_feature (979)..(979): n is a, c, g, or t
  misc_feature (1026)..(1026): n is a, c, g, or t
  misc_feature (1077)..(1077): n is a, c, g, or t
  misc_feature (1085)..(1085): n is a, c, g, or t
  misc_feature (1150)..(1150): n is a, c, g, or t
  misc_feature (1157)..(1157): n is a, c, g, or t
  misc_feature (1198)..(1198): n is a, c, g, or t
  misc_feature (1265)..(1265): n is a, c, g, or t
  misc_feature (1316)..(1316): n is a, c, g, or t
  misc_feature (1323)..(1323): n is a, c, g, or t
  misc_feature (1413)..(1413): n is a, c, g, or t
ctttctttttttgttttttctcccccccgcagaaactagctgattcgattcggctcgtacccccacgctgctcacagaagatgggaacactggtggaggatggaaaggctcgctcaatcaagaaaattctgagactattaataaataagactgtagtgtagatactgagtaaatccatgcacctaaaccttttggaaaatctgccgtgggccctccagatagctcatttcattaagtttttccctccaaggtagaatttgcaagagtgacagtggattgcatttcttttggggaagctttcttttggtggttttgtttattataccttcttaagttttcaaccaaggtttgcttttgttttgagttactggggttatttttgttttaaataaaaataagtgtacaataagtgtttttgtattgaaagcttttgttatcaagattttcatacttttaccttccatggctctttttaagattgatacttttaagaggtggctgatattctgcaacactgtacacataaaaaatacggtaaggatactttacatggttaaggtaaagtaagtctccagttggccaccattagctataatggcactttgtttgtgttgttggaaaaagtcacattgccattaaactttccttgtctgtctagttaatattgtgaagaaaaataaagtacagtgtgagatactgaaaaaaaaaaacaaaaaaacaaaaaaaaaaaaaaaacaacaacaatagttggcgaccagctgcgccactagaaaaggctttgctaaacaacactggttgtgaggacccgccgagcccacgattgagctatcgacacaccggtggcacatacagcgcgtcctcaaaagagaagacgcacgcgcgcgacaagcacagcatatggctggtgtgcgtgttgcctcacgaaagtaaaaaaaaaacctccgcctgtgcgtggaagccatctatagcgacggctgtntcatcgacgacacaactctaccataaagagggaataggccggttacngaggatcgacgcagaatgctactaggtcggagtgagactcgtaataacganagcgaacnaggtcgggacaggtgacaaggaaaaggcaaagaagaagcgcgcgaataactgataataaaagtcnttatggnccccggccctgccccgtgtcaacgggtgtgaaggctaaagnaattacgaagatgcaactgaagggaactaaggaaaagcgtagcgaaggcatcgcaatggcctagagnactaggacgatacgtacgatacgaataggtccaaatatcaggtcatcgcanaccgtancaagagtagagccaaggacagagctacgtgtaaagttgaacagtgaaaagagtgaaacaggaggcagcaagagcaatcgaagccacaggn

SEQ ID NO: 440106 - DNA, 2205 bp, Homo sapiens
gcgcccgcccctccgcgccgcctgcccgcccgcccgccgcgctcccgcccgccgctctccgtggccccgccgcgctgccgccgccgccgctgccagcgaaggtgccggggctccgggccctccctgccggcggccgtcagcgctcggagcgggctgcgcggcgggagctccgggaggcggccgtagccagcgccgccgcgcaggaccaggaggaggagaaagggtgcgcagcccggaggcggggtgcgccggtggggtgcagcggaagagggggtccaggggggagaacttcgtagcagtcatcctttttaggaaaagagggaaaaaataaaaccctcccccaccacctccttctccccacccctcgccgcaccacacacagcgcgggcttctagcgctcggcaccggcgggccaggcgcgtcctgccttcatttatccagcagcttttcggaaaatgcatttgctgttcggagtttaatcagaagaggattcctgcctccgtccccggctccttcatcgtcccctctcccctgtctctctcctggggaggcgtgaagcggtcccgtggatagagattcatgcctgtgcccgcgcgtgtgtgcgcgcgtgtaaattgccgagaaggggaaaacatcacaggacttctgcgaataccggactgaaaattgtaattcatctgccgccgccgctgccttttttttttctcgagctcttgagatctccggttgggattcctgcggattgacatttctgtgaagcagaagtctgggaatcgatctggaaatcctcctaatttttactccctctccccccgactcctgattcattgggaagtttcaaatcagctataactggagagtgctgaagattgatgggatcgttgccttatgcatttgttttggttttacaaaaaggaaacttgacagaggatcatgctgtacttaaaaaatacaacatcacagaggaagtagactgatattaacaatacttactaataataacgtgcctcatgaaataaagatccgaaaggaattggaataaaaatttcctgcatctcatgccaagggggaaacaccagaatcaagtgttccgcgtgattgaagacaccccctcgtccaagaatgcaaagcacatccaataaaatagctggattataactcctcttctttctctgggggccgtggggtgggagctggggcgagaggtgccgttggcccccgttgcttttcctctgggaaggatggcgcacgctgggagaacggggtacgataaccgggagatagtgatgaagtacatccattataagctgtcgcagaggggctacgagtgggatgcgggagatgtgggcgccgcgcccccgggggccgcccccgcaccgggcatcttctcctcccagcccgggcacacgccccatccagccgcatcccgggacccggtcgccaggacctcgccgctgcagaccccggctgcccccggcgccgccgcggggcctgcgctcagcccggtgccacctgtggtccacctgaccctccgccaggccggcgacgacttctcccgccgctaccgccgcgacttcgccgagatgtccagccagctgcacctgacgcccttcaccgcgcggggacgctttgccacggtggtggaggagctcttcagggacggggtgaactgggggaggattgtggccttctttgagttcggtggggtcatgtgtgtggagagcgtcaaccgggagatgtcgcccctggtggacaacatcgccctgtggatgactgagtacctgaaccggcacctgcacacctggatccaggataacggaggctgggatgcctttgtggaactgtacggccccagcatgcggcctctgtttgatttctcctggctgtctctgaagactctgctcagtttggccctggtgggagcttgcatcaccctgggtgcctatctgggccacaagtgaagtcaacatgcctgccccaaacaaatatgcaaaaggttcactaaagcagtagaaataatatgcattgtcagtgatgtaccatgaaacaaagctgcaggctgtttaagaaaaaataacacacatataaacatcacacacacagacagacacacacacacacaacaattttaacttgtttttttgtacataatgtacatactgtcaattttttattaaaagaaatatgctttgatgtgctagcaaa

SEQ ID NO: 440107 - DNA, 8175 bp, Homo sapiens
  misc_feature (7741)..(7741): n is a, c, g, or t
  misc_feature (7788)..(7788): n is a, c, g, or t
  misc_feature (7839)..(7839): n is a, c, g, or t
  misc_feature (7847)..(7847): n is a, c, g, or t
  misc_feature (7912)..(7912): n is a, c, g, or t
  misc_feature (7919)..(7919): n is a, c, g, or t
  misc_feature (7960)..(7960): n is a, c, g, or t
  misc_feature (8027)..(8027): n is a, c, g, or t
  misc_feature (8078)..(8078): n is a, c, g, or t
  misc_feature (8085)..(8085): n is a, c, g, or t
  misc_feature (8175)..(8175): n is a, c, g, or t
gcgcccgcccctccgcgccgcctgcccgcccgcccgccgcgctcccgcccgccgctctccgtggccccgccgcgctgccgccgccgccgctgccagcgaaggtgccggggctccgggccctccctgccggcggccgtcagcgctcggagcgggctgcgcggcgggagctccgggaggcggccgtagccagcgccgccgcgcaggaccaggaggaggagaaagggtgcgcagcccggaggcggggtgcgccggtggggtgcagcggaagagggggtccaggggggagaacttcgtagcagtcatcctttttaggaaaagagggaaaaaataaaaccctcccccaccacctccttctccccacccctcgccgcaccacacacagcgcgggcttctagcgctcggcaccggcgggccaggcgcgtcctgccttcatttatccagcagcttttcggaaaatgcatttgctgttcggagtttaatcagaagaggattcctgcctccgtccccggctccttcatcgtcccctctcccctgtctctctcctggggaggcgtgaagcggtcccgtggatagagattcatgcctgtgcccgcgcgtgtgtgcgcgcgtgtaaattgccgagaaggggaaaacatcacaggacttctgcgaataccggactgaaaattgtaattcatctgccgccgccgctgccttttttttttctcgagctcttgagatctccggttgggattcctgcggattgacatttctgtgaagcagaagtctgggaatcgatctggaaatcctcctaatttttactccctctccccccgactcctgattcattgggaagtttcaaatcagctataactggagagtgctgaagattgatgggatcgttgccttatgcatttgttttggttttacaaaaaggaaacttgacagaggatcatgctgtacttaaaaaatacaagtaagttctctgcacaggaaattggtttaatgtaactttcaatggaaacctttgagattttttacttaaagtgcattcgagtaaatttaatttccaggcagcttaatacattctttttagccgtgttacttgtagtgtgtatgccctgctttcactcagtgtgtacagggaaacgcacctgattttttacttattagtttgttttttctttaacctttcagcatcacagaggaagtagactgatattaacaatacttactaataataacgtgcctcatgaaataaagatccgaaaggaattggaataaaaatttcctgcatctcatgccaagggggaaacaccagaatcaagtgttccgcgtgattgaagacaccccctcgtccaagaatgcaaagcacatccaataaaatagctggattataactcctcttctttctctgggggccgtggggtgggagctggggcgagaggtgccgttggcccccgttgcttttcctctgggaaggatggcgcacgctgggagaacggggtacgataaccgggagatagtgatgaagtacatccattataagctgtcgcagaggggctacgagtgggatgcgggagatgtgggcgccgcgcccccgggggccgcccccgcaccgggcatcttctcctcccagcccgggcacacgccccatccagccgcatcccgggacccggtcgccaggacctcgccgctgcagaccccggctgcccccggcgccgccgcggggcctgcgctcagcccggtgccacctgtggtccacctgaccctccgccaggccggcgacgacttctcccgccgctaccgccgcgacttcgccgagatgtccagccagctgcacctgacgcccttcaccgcgcggggacgctttgccacggtggtggaggagctcttcagggacggggtgaactgggggaggattgtggccttctttgagttcggtggggtcatgtgtgtggagagcgtcaaccgggagatgtcgcccctggtggacaacatcgccctgtggatgactgagtacctgaaccggcacctgcacacctggatccaggataacggaggctgggatgcctttgtggaactgtacggccccagcatgcggcctctgtttgatttctcctggctgtctctgaagactctgctcagtttggccctggtgggagcttgcatcaccctgggtgcctatctgggccacaagtgaagtcaacatgcctgccccaaacaaatatgcaaaaggttcactaaagcagtagaaataatatgcattgtcagtgatgtaccatgaaacaaagctgcaggctgtttaagaaaaaataacacacatataaacatcacacacacagacagacacacacacacacaacaattaacagtcttcaggcaaaacgtcgaatcagctatttactgccaaagggaaatatcatttattttttacattattaagaaaaaaagatttatttatttaagacagtcccatcaaaactcctgtctttggaaatccgaccactaattgccaagcaccgcttcgtgtggctccacctggatgttctgtgcctgtaaacatagattcgctttccatgttgttggccggatcaccatctgaagagcagacggatggaaaaaggacctgatcattggggaagctggctttctggctgctggaggctggggagaaggtgttcattcacttgcatttctttgccctgggggctgtgatattaacagagggagggttcctgtggggggaagtccatgcctccctggcctgaagaagagactctttgcatatgactcacatgatgcatacctggtgggaggaaaagagttgggaacttcagatggacctagtacccactgagatttccacgccgaaggacagcgatgggaaaaatgcccttaaatcataggaaagtatttttttaagctaccaattgtgccgagaaaagcattttagcaatttatacaatatcatccagtaccttaagccctgattgtgtatattcatatattttggatacgcaccccccaactcccaatactggctctgtctgagtaagaaacagaatcctctggaacttgaggaagtgaacatttcggtgacttccgcatcaggaaggctagagttacccagagcatcaggccgccacaagtgcctgcttttaggagaccgaagtccgcagaacctgcctgtgtcccagcttggaggcctggtcctggaactgagccggggccctcactggcctcctccagggatgatcaacagggcagtgtggtctccgaatgtctggaagctgatggagctcagaattccactgtcaagaaagagcagtagaggggtgtggctgggcctgtcaccctggggccctccaggtaggcccgttttcacgtggagcatgggagccacgacccttcttaagacatgtatcactgtagagggaaggaacagaggccctgggcccttcctatcagaaggacatggtgaaggctgggaacgtgaggagaggcaatggccacggcccattttggctgtagcacatggcacgttggctgtgtggccttggcccacctgtgagtttaaagcaaggctttaaatgactttggagagggtcacaaatcctaaaagaagcattgaagtgaggtgtcatggattaattgacccctgtctatggaattacatgtaaaacattatcttgtcactgtagtttggttttatttgaaaacctgacaaaaaaaaagttccaggtgtggaatatgggggttatctgtacatcctggggcattaaaaaaaaaatcaatggtggggaactataaagaagtaacaaaagaagtgacatcttcagcaaataaactaggaaatttttttttcttccagtttagaatcagccttgaaacattgatggaataactctgtggcattattgcattatataccatttatctgtattaactttggaatgtactctgttcaatgtttaatgctgtggttgatatttcgaaagctgctttaaaaaaatacatgcatctcagcgtttttttgtttttaattgtatttagttatggcctatacactatttgtgagcaaaggtgatcgttttctgtttgagatttttatctcttgattcttcaaaagcattctgagaaggtgagataagccctgagtctcagctacctaagaaaaacctggatgtcactggccactgaggagctttgtttcaaccaagtcatgtgcatttccacgtcaacagaattgtttattgtgacagttatatctgttgtccctttgaccttgtttcttgaaggtttcctcgtccctgggcaattccgcatttaattcatggtattcaggattacatgcatgtttggttaaacccatgagattcattcagttaaaaatccagatggcaaatgaccagcagattcaaatctatggtggtttgacctttagagagttgctttacgtggcctgtttcaacacagacccacccagagccctcctgccctccttccgcgggggctttctcatggctgtccttcagggtcttcctgaaatgcagtggtgcttacgctccaccaagaaagcaggaaacctgtggtatgaagccagacctccccggcgggcctcagggaacagaatgatcagacctttgaatgattctaatttttaagcaaaatattattttatgaaaggtttacattgtcaaagtgatgaatatggaatatccaatcctgtgctgctatcctgccaaaatcattttaatggagtcagtttgcagtatgctccacgtggtaagatcctccaagctgctttagaagtaacaatgaagaacgtggacgtttttaatataaagcctgttttgtcttttgttgttgttcaaacgggattcacagagtatttgaaaaatgtatatatattaagaggtcacgggggctaattgctggctggctgccttttgctgtggggttttgttacctggttttaataacagtaaatgtgcccagcctcttggccccagaactgtacagtattgtggctgcacttgctctaagagtagttgatgttgcattttccttattgttaaaaacatgttagaagcaatgaatgtatataaaagcctcaactagtcatttttttctcctcttcttttttttcattatatctaattattttgcagttgggcaacagagaaccatccctattttgtattgaagagggattcacatctgcatcttaactgctctttatgaatgaaaaaacagtcctctgtatgtactcctctttacactggccagggtcagagttaaatagagtatatgcactttccaaattggggacaagggctctaaaaaaagccccaaaaggagaagaacatctgagaacctcctcggccctcccagtccctcgctgcacaaatactccgcaagagaggccagaatgacagctgacagggtctatggccatcgggtcgtctccgaagatttggcaggggcagaaaactctggcaggcttaagatttggaataaagtcacagaattaaggaagcacctcaatttagttcaaacaagacgccaacattctctccacagctcacttacctctctgtgttcagatgtggccttccatttatatgtgatctttgttttattagtaaatgcttatcatctaaagatgtagctctggcccagtgggaaaaattaggaagtgattataaatcgagaggagttataataatcaagattaaatgtaaataatcagggcaatcccaacacatgtctagctttcacctccaggatctattgagtgaacagaattgcaaatagtctctatttgtaattgaacttatcctaaaacaaatagtttataaatgtgaacttaaactctaattaattccaactgtacttttaaggcagtggctgtttttagactttcttatcacttatagttagtaatgtacacctactctatcagagaaaaacaggaaaggctcgaaatacaagccattctaaggaaattagggagtcagttgaaattctattctgatcttattctgtggtgtcttttgcagcccagacaaatgtggttacacactttttaagaaatacaattctacattgtcaagcttatgaaggttccaatcagatctttattgttattcaatttggatctttcagggattttttttttaaattattatgggacaaaggacatttgttggaggggtgggagggaggaagaatttttaaatgtaaaacattcccaagtttggatcagggagttggaagttttcagaataaccagaactaagggtatgaaggacctgtattggggtcgatgtgatgcctctgcgaagaaccttgtgtgacaaatgagaaacattttgaagtttgtggtacgacctttagattccagagacatcagcatggctcaaagtgcagctccgtttggcagtgcaatggtataaatttcaagctggatatgtctaatgggtatttaaacaataaatgtgcagttttaactaacaggatatttaatgacaaccttctggttggtagggacatctgtttctaaatgtttattatgtacaatacagaaaaaaattttataaaattaagcaatgtgaaactgaattggagagtgataatacaagtcctttagtcttacccagtgaatcattctgttccatgtctttggacaaccatgaccttggacaatcatgaaatatgcatctcactggatgcaaagaaaatcagatggagcatgaatggtactgtaccggttcatctggactgccccagaaaaataacttcaagcaaacatcctatcaacaacaaggttgttctgcataccaagctgagcacagaagatgggaacactggtggaggatggaaaggctcgctcaatcaagaaaattctgagactattaataaataagactgtagtgtagatactgagtaaatccatgcacctaaaccttttggaaaatctgccgtgggccctccagatagctcatttcattaagtttttccctccaaggtagaatttgcaagagtgacagtggattgcatttcttttggggaagctttcttttggtggttttgtttattataccttcttaagttttcaaccaaggtttgcttttgttttgagttactggggttatttttgttttaaataaaaataagtgtacaataagtgtttttgtattgaaagcttttgttatcaagattttcatacttttaccttccatggctctttttaagattgatacttttaagaggtggctgatattctgcaacactgtacacataaaaaatacggtaaggatactttacatggttaaggtaaagtaagtctccagttggccaccattagctataatggcactttgtttgtgttgttggaaaaagtcacattgccattaaactttccttgtctgtctagttaatattgtgaagaaaaataaagtacagtgtgagatactgaaaaaaaaaaacaaaaaaacaaaaaaaaaaaaaaaacaacaacaatagttggcgaccagctgcgccactagaaaaggctttgctaaacaacactggttgtgaggacccgccgagcccacgattgagctatcgacacaccggtggcacatacagcgcgtcctcaaaagagaagacgcacgcgcgcgacaagcacagcatatggctggtgtgcgtgttgcctcacgaaagtaaaaaaaaaacctccgcctgtgcgtggaagccatctatagcgacggctgtntcatcgacgacacaactctaccataaagagggaataggccggttacngaggatcgacgcagaatgctactaggtcggagtgagactcgtaataacganagcgaacnaggtcgggacaggtgacaaggaaaaggcaaagaagaagcgcgcgaataactgataataaaagtcnttatggnccccggccctgccccgtgtcaacgggtgtgaaggctaaagnaattacgaagatgcaactgaagggaactaaggaaaagcgtagcgaaggcatcgcaatggcctagagnactaggacgatacgtacgatacgaataggtccaaatatcaggtcatcgcanaccgtancaagagtagagccaaggacagagctacgtgtaaagttgaacagtgaaaagagtgaaacaggaggcagcaagagcaatcgaagccacaggn

SEQ ID NO: 440108 - DNA, 2009 bp, Homo sapiens
gcgcccgcccctccgcgccgcctgcccgcccgcccgccgcgctcccgcccgccgctctccgtggccccgccgcgctgccgccgccgccgctgccagcgaaggtgccggggctccgggccctccctgccggcggccgtcagcgctcggagcgggctgcgcggcgggagctccgggaggcggccgtagccagcgccgccgcgcaggaccaggaggaggagaaagggtgcgcagcccggaggcggggtgcgccggtggggtgcagcggaagagggggtccaggggggagaacttcgtagcagtcatcctttttaggaaaagagggaaaaaataaaaccctcccccaccacctccttctccccacccctcgccgcaccacacacagcgcgggcttctagcgctcggcaccggcgggccaggcgcgtcctgccttcatttatccagcagcttttcggaaaatgcatttgctgttcggagtttaatcagaagaggattcctgcctccgtccccggctccttcatcgtcccctctcccctgtctctctcctggggaggcgtgaagcggtcccgtggatagagattcatgcctgtgcccgcgcgtgtgtgcgcgcgtgtaaattgccgagaaggggaaaacatcacaggacttctgcgaataccggactgaaaattgtaattcatctgccgccgccgctgccttttttttttctcgagctcttgagatctccggttgggattcctgcggattgacatttctgtgaagcagaagtctgggaatcgatctggaaatcctcctaatttttactccctctccccccgactcctgattcattgggaagtttcaaatcagctataactggagagtgctgaagattgatgggatcgttgccttatgcatttgttttggttttacaaaaaggaaacttgacagaggatcatgctgtacttaaaaaatacaacatcacagaggaagtagactgatattaacaatacttactaataataacgtgcctcatgaaataaagatccgaaaggaattggaataaaaatttcctgcatctcatgccaagggggaaacaccagaatcaagtgttccgcgtgattgaagacaccccctcgtccaagaatgcaaagcacatccaataaaatagctggattataactcctcttctttctctgggggccgtggggtgggagctggggcgagaggtgccgttggcccccgttgcttttcctctgggaaggatggcgcacgctgggagaacggggtacgataaccgggagatagtgatgaagtacatccattataagctgtcgcagaggggctacgagtgggatgcgggagatgtgggcgccgcgcccccgggggccgcccccgcaccgggcatcttctcctcccagcccgggcacacgccccatccagccgcatcccgggacccggtcgccaggacctcgccgctgcagaccccggctgcccccggcgccgccgcggggcctgcgctcagcccggtgccacctgtggtccacctgaccctccgccaggccggcgacgacttctcccgccgctaccgccgcgacttcgccgagatgtccagccagctgcacctgacgcccttcaccgcgcggggacgctttgccacggtggtggaggagctcttcagggacggggtgaactgggggaggattgtggccttctttgagttcggtggggtcatgtgtgtggagagcgtcaaccgggagatgtcgcccctggtggacaacatcgccctgtggatgactgagtacctgaaccggcacctgcacacctggatccaggataacggaggctgggtaggtgcatcttggtgatgtgagtctgggctgaggccacaggtccgagatgcgggggttggagtgcgggtgggctcctggggcaatgggaggctgtggagccggcgaaataaaatcagagttgttgcttcccggcgtgtccctacctcctcctctggacaaagcgttcactcccaacctgac

SEQ ID NO: 440109 - DNA, 4480 bp, Homo sapiens
cagaaatagatgaagagcacgtggaggatgacgggctgtctttggacattcaggaaagtgagtacatgtgcaatgaagagacggagatcaaagaggcgcagagctaccagaactccccagtcagctctgcgactaaccaggacgccggctacgggtcgcccttcagtgagagcagcgaccagctagcccatttcaaaggctcttcctctcgagaagagaaggaggatccgcagtgtcccgacagcgtctcgtacccccaggacagcctggcacagatcaaagctgtgtatgcaaacttgttctccgagtcctgctggtccagcttagctctggatttaaagaagtcgggttccaccaccagcaccaacgatgccagccagaaggagagctccgcccccacccccacaccccccacctgccccgtcagcaccactggccccaccacgagcacgcccagcaccagctgcagctccagcaccagccacagcagtaccaccagtaccagcagcagctccgggtacgactggcaccaggctgcactggccaagacgctgcagcagacgtcctcgtatgggctgcttcctgagcccagcctgttcagcaccgtgcagctctaccgccagaacaacaagctctacggctccgtcttcacgggcgccagcaagttccggtgcaaagactgcagtgccgcgtacgacacgctggtggaactgacggtgcacatgaacgagacaggccactaccgtgacgacaacagggacaaggactccgagaagaccaagaggtggtccaagcccaggaagcgctccctgatggagatggaggggaaggaggatgcccagaaggtgctgaagtgcatgtactgtggacactcctttgagtccttgcaggacctcagcgtccacatgatcaaaaccaagcattaccagaaagtgcctctgaaggagccagtgccagccatcaccaaactggtcccctccaccaaaaagcgggcgcttcaggacctggcgcccccctgctcccctgagccagcaggaatggccgcagaggtggccctgagtgagtcagccaaggatcagaaagcagcgaacccgtacgtcacgcccaataaccgctatggctaccagaatggcgccagctacacctggcagtttgaggcccgcaaggcgcagatcctcaagtgcatggagtgtggcagctcccacgacacgctgcagcagctcaccgcccacatgatggtcaccgggcacttcctgaaagtgaccacctcggcttctaagaagggcaagcagttggtgctggaccctgtggtggaagagaagatccagtccatcccactaccgcccaccacccacacgcggctgccggcctccagcatcaaaaagcagcccgactctcccgcggggtccacgacttctgaagaaaagaaagagccagagaaggagaagccgcctgtggctggcgacgcggagaagatcaaggaggagagtgaggacagcttggagaaatttgagcccagcaccctgtacccgtacctgcgtgaggaggacctggacgacagccccaagggagggctggacattctcaagtccctggagaataccgtctccacggccattagcaaagctcagaatggtgcgccctcatggggtggctaccccagcatccatgcagcctaccagctcccgggcaccgtgaagccactgccggcggccgtgcagagcgtgcaggtgcagccgtcctatgctggcggcgtgaagtcgctgtcttccgccgagcacaacgccctcctgcactccccagggagcctcacgcccccaccgcacaagagcaacgtgtctgccatggaggagctggtggagaaggtcacgggcaaggtcaacatcaagaaggaggagagaccccctgagaaggagaagagctccctggccaaggctgcgtcccccatagcaaaagagaataaagatttcccgaaaacggaggaagtcagcggcaaaccacagaagaagggccctgaggccgagactgggaaggccaaaaaggagggaccgctggacgttcacaccccaaatggcacagagcctctcaaagcaaaggtcaccaacggctgtaacaacctggggatcatcatggaccactcaccggagccttccttcatcaacccgctgagcgctttgcagtccatcatgaacacccacctgggcaaggtgtccaagcccgtgagtccctcgctggacccgctggcgatgctgtacaagatcagcaacagcatgctggacaagccggtgtaccccgccacccctgtgaagcaggccgatgccatcgaccgctactattatgaaaacagcgaccagcccattgacttaaccaagtccaagaacaagccgctggtgtccagcgtggctgattcggtggcatcacctctgcgggagagcgcactcatggacatctccgacatggtgaaaaacctcacaggccgcctgacgcccaagtcctccacgccctccacagtttcagagaagtccgatgctgatggcagcagctttgaggaggcgttggacgagctgtcaccggtccacaagaggaagggccggcagtccaactggaacccgcagcaccttctcatcctgcaggcccagttcgcctcgagcttgcgggagaccacagagggcaagtacatcatgtcggacttgggcccgcaggagagggtgcacatctcgaagtttactgggctctccatgaccaccatcagccactggctggccaatgtgaagtaccagttgaggaggacagggggaacgaaattcctaaagaacctggacacagggcatcctgttttcttttgcaacgattgtgcctctcagttcagaactgcttctacatacataagtcatttggagacacacttgggcttcagcctgaaggatctctccaagctgccactcaatcagattcaagaacagcagaatgtttcgaaagtcctcaccaacaaaactctgggcccactgggggccaccgaggaagacttgggctccacattccaatgtaagctctgcaaccggacttttgcgagcaagcacgcagtcaaactgcaccttagtaagacccacggcaagtctcccgaggaccacctgatctatgtgactgagttggagaaacagtagcgtccaggtatgcaagagaccgcggaacattgcactaaacgtcgtcgagctgcactaggcctggcctgagcctctgaaatcagtctttcctttgttgctggcccgcctctctggaccttggttttcttacacatattttgtatatttatatgctctctgtccgatctgtgcatgttatttttctttttccgtgagtcaaagtctgacctttattttcaacatctgttcttggtgttaagctatcttttgtaggaaatagtggggcacactactcagagacattatttagcagtaaagaaagacacaaataacaatgataaaaagacatcctaaaatggtgaagttgccatgacaataaaggtcatagaacctggtagtgtcaaatttaaccctttgaggactgtaattgcatttctgtgcctttcacttgaaaaaaaaaaaagaagaaaaaaaggcttaaaggcatttcattcagatcaaaagctgtgtcagacacaaaacttatttaataattaaaaaatgagcttttatatgcagaactggtttgtgaggaaacatgcatgcagctgtgggaagatagaaagctgtctaggactcacggggttcggaagccacacctctacatgtctaaaacaaaaaacaacaacaacagataccccactcgccactatgcccaaaccctctggatgctgaaaaatgccactttcggcaaaaaaaaaaagtatgcaagctattatttaaaaatgtgtaaaaatgctatttcttttttcctgtaaaatattgcagtttatagttatttacaaatgtaagctttggtacaagctgacctttctatagcgtgctgcattggtaaatgaaaaaaaatggggcaaacgttggagtcctttccttgtaaattgccagcatcagcttaaaaactcctgtatgttacatatcgtaccattttaatctcttcaactttctttgtaccttctggctgtatgctttctcttttaactttttatattgtcattttatattaaatttctgtgtatataatgtaaaaccacaatttttgaataaaatttagttcctgcagcttgatttaaatagaggacttttactggcacctgcatctctccagatgcatgtactcagagggactgtcagacaaaaataaatacataaaaacaaagcaagcaatgcactattaattatacattttgatgttctatcattaatattgtacagtacattttggttcacacaattaaatccactgttttctcagatgtaaaataaacccacatgcagttcttgatttacacggattgtca

SEQ ID NO: 440110 - DNA, 4455 bp, Homo sapiens
cagaaatagatgaagagcacgtggaggatgacgggctgtctttggacattcaggaaagtgagtacatgtgcaatgaagagacggagatcaaagaggcgcagagctaccagaactccccagtcagctctgcgactaaccaggacgccggctacgggtcgcccttcagtgagagcagcgaccagctagcccatttcaaaggctcttcctctcgagaagagaaggaggatccgcagtgtcccgacagcgtctcgtacccccaggacagcctggcacagatcaaagctgtgtatgcaaacttgttctccgagtcctgctggtccagcttagctctggatttaaagaagtcgggttccaccaccagcaccaacgatgccagccagaaggagagctccgcccccacccccacaccccccacctgccccgtcagcaccactggccccaccacgagcacgcccagcaccagctgcagctccagcaccagccacagcagtaccaccagtaccagcagcagctccgggtacgactggcaccaggctgcactggccaagacgctgcagcagacgtcctcgtatgggctgcttcctgagcccagcctgttcagcaccgtgcagctctaccgccagaacaacaagctctacggctccgtcttcacgggcgccagcaagttccggtgcaaagactgcagtgccgcgtacgacacgctggtggaactgacggtgcacatgaacgagacaggccactaccgtgacgacaacagggacaaggactccgagaagaccaagaggtggtccaagcccaggaagcgctccctgatggagatggaggggaaggaggatgcccagaaggtgctgaagtgcatgtactgtggacactcctttgagtccttgcaggacctcagcgtccacatgatcaaaaccaagcattaccagaaagtgcctctgaaggagccagtgccagccatcaccaaactggtcccctccaccaaaaagcgggcgcttcaggacctggcgcccccctgctcccctgagccagcaggaatggccgcagaggtggccctgagtgagtcagccaaggatcagaaagcagcgaacccgtacgtcacgcccaataaccgctatggctaccagaatggcgccagctacacctggcagtttgaggcccgcaaggcgcagatcctcaagtgcatggagtgtggcagctcccacgacacgctgcagcagctcaccgcccacatgatggtcaccgggcacttcctgaaagtgaccacctcggcttctaagaagggcaagcagttggtgctggaccctgtggtggaagagaagatccagtccatcccactaccgcccaccacccacacgcggctgccggcctccagcatcaaaaagcagcccgactctcccgcggggtccacgacttctgaagaaaagaaagagccagagaaggagaagccgcctgtggctggcgacgcggagaagatcaaggaggagagtgaggacagcttggagaaatttgagcccagcaccctgtacccgtacctgcgtgaggaggactggacattctcaagtccctggagaataccgtctccacggccattagcaaagctcagaatggtgcgccctcatggggtggctaccccagcatccatgcagcctaccagctcccgggcaccgtgaagccactgccggcggccgtgcagagcgtgcaggtgcagccgtcctatgctggcggcgtgaagtcgctgtcttccgccgagcacaacgccctcctgcactccccagggagcctcacgcccccaccgcacaagagcaacgtgtctgccatggaggagctggtggagaaggtcacgggcaaggtcaacatcaagaaggaggagagaccccctgagaaggagaagagctccctggccaaggctgcgtcccccatagcaaaagagaataaagatttcccgaaaacggaggaagtcagcggcaaaccacagaagaagggccctgaggccgagactgggaaggccaaaaaggagggaccgctggacgttcacaccccaaatggcacagagcctctcaaagcaaaggtcaccaacggctgtaacaacctggggatcatcatggaccactcaccggagccttccttcatcaacccgctgagcgctttgcagtccatcatgaacacccacctgggcaaggtgtccaagcccgtgagtccctcgctggacccgctggcgatgctgtacaagatcagcaacagcatgctggacaagccggtgtaccccgccacccctgtgaagcaggccgatgccatcgaccgctactattatgaaaacagcgaccagcccattgacttaaccaagtccaagaacaagccgctggtgtccagcgtggctgattcggtggcatcacctctgcgggagagcgcactcatggacatctccgacatggtgaaaaacctcacaggccgcctgacgcccaagtcctccacgccctccacagtttcagagaagtccgatgctgatggcagcagctttgaggaggcgttggacgagctgtcaccggtccacaagaggaagggccggcagtccaactggaacccgcagcaccttctcatcctgcaggcccagttcgcctcgagcttgcgggagaccacagagggcaagtacatcatgtcggacttgggcccgcaggagagggtgcacatctcgaagtttactgggctctccatgaccaccatcagccactggctggccaatgtgaagtaccagttgaggaggacagggggaacgaaattcctaaagaacctggacacagggcatcctgttttcttttgcaacgattgtgcctctcagttcagaactgcttctacatacataagtcatttggagacacacttgggcttcagcctgaaggatctctccaagctgccactcaatcagattcaagaacagcagaatgtttcgaaagtcctcaccaacaaaactctgggcccactgggggccaccgaggaagacttgggctccacattccaatgtaagctctgcaaccggacttttgcgagcaagcacgcagtcaaactgcaccttagtaagacccacggcaagtctcccgaggaccacctgatctatgtgactgagttggagaaacagtagcgtccaggtatgcaagagaccgcggaacattgcactaaacgtcgtcgagctgcactaggcctggcctgagcctctgaaatcagtctttcctttgttgctggcccgcctctctggaccttggttttcttacacatattttgtatatttatatgctctctgtccgatctgtgcatgttatttttctttttccgtgagtcaaagtctgacctttattttcaacatctgttcttggtgttaagctatcttttgtaggaaatagtggggcacactactcagagacattatttagcagtaaagaaagacacaaataacaatgataaaaagacatcctaaaatggtgaagttgccatgacaataaaggtcatagaacctggtagtgtcaaatttaaccctttgaggactgtaattgcatttctgtgcctttcacttgaaaaaaaaaaaagaagaaaaaaaggcttaaaggcatttcattcagatcaaaagctgtgtcagacacaaaacttatttaataattaaaaaatgagcttttatatgcagaactggtttgtgaggaaacatgcatgcagctgtgggaagatagaaagctgtctaggactcacggggttcggaagccacacctctacatgtctaaaacaaaaaacaacaacaacagataccccactcgccactatgcccaaaccctctggatgctgaaaaatgccactttcggcaaaaaaaaaaagtatgcaagctattatttaaaaatgtgtaaaaatgctatttcttttttcctgtaaaatattgcagtttatagttatttacaaatgtaagctttggtacaagctgacctttctatagcgtgctgcattggtaaatgaaaaaaaatggggcaaacgttggagtcctttccttgtaaattgccagcatcagcttaaaaactcctgtatgttacatatcgtaccattttaatctcttcaactttctttgtaccttctggctgtatgctttctcttttaactttttatattgtcattttatattaaatttctgtgtatataatgtaaaaccacaatttttgaataaaatttagttcctgcagcttgatttaaatagaggacttttactggcacctgcatctctccagatgcatgtactcagagggactgtcagacaaaaataaatacataaaaacaaagcaagcaatgcactattaattatacattttgatgttctatcattaatattgtacagtacattttggttcacacaattaaatccactgttttctcagatgtaaaataaacccacatgcagttcttgatttacacggattgtca

SEQ ID NO: 440111 - DNA, 4083 bp, Homo sapiens
gaatggcgccagctacacctggcagtttgaggcccgcaaggcgcagatcctcaagtgcatggagtgtggcagctccagcaccagccacagcagtaccaccagtaccagcagcagctccgggtacgactggcaccaggctgcactggccaagacgctgcagcagacgtcctcgtatgggctgcttcctgagcccagcctgttcagcaccgtgcagctctaccgccagaacaacaagctctacggctccgtcttcacgggcgccagcaagttccggtgcaaagactgcagtgccgcgtacgacacgctggtggaactgacggtgcacatgaacgagacaggccactaccgtgacgacaacagggacaaggactccgagaagaccaagaggtggtccaagcccaggaagcgctccctgatggagatggaggggaaggaggatgcccagaaggtgctgaagtgcatgtactgtggacactcctttgagtccttgcaggacctcagcgtccacatgatcaaaaccaagcattaccagaaagtgcctctgaaggagccagtgccagccatcaccaaactggtcccctccaccaaaaagcgggcgcttcaggacctggcgcccccctgctcccctgagccagcaggaatggccgcagaggtggccctgagtgagtcagccaaggatcagaaagcagcgaacccgtacgtcacgcccaataaccgctatggctaccagaatggcgccagctacacctggcagtttgaggcccgcaaggcgcagatcctcaagtgcatggagtgtggcagctcccacgacacgctgcagcagctcaccgcccacatgatggtcaccgggcacttcctgaaagtgaccacctcggcttctaagaagggcaagcagttggtgctggaccctgtggtggaagagaagatccagtccatcccactaccgcccaccacccacacgcggctgccggcctccagcatcaaaaagcagcccgactctcccgcggggtccacgacttctgaagaaaagaaagagccagagaaggagaagccgcctgtggctggcgacgcggagaagatcaaggaggagagtgaggacagcttggagaaatttgagcccagcaccctgtacccgtacctgcgtgaggaggacctggacgacagccccaagggagggctggacattctcaagtccctggagaataccgtctccacggccattagcaaagctcagaatggtgcgccctcatggggtggctaccccagcatccatgcagcctaccagctcccgggcaccgtgaagccactgccggcggccgtgcagagcgtgcaggtgcagccgtcctatgctggcggcgtgaagtcgctgtcttccgccgagcacaacgccctcctgcactccccagggagcctcacgcccccaccgcacaagagcaacgtgtctgccatggaggagctggtggagaaggtcacgggcaaggtcaacatcaagaaggaggagagaccccctgagaaggagaagagctccctggccaaggctgcgtcccccatagcaaaagagaataaagatttcccgaaaacggaggaagtcagcggcaaaccacagaagaagggccctgaggccgagactgggaaggccaaaaaggagggaccgctggacgttcacaccccaaatggcacagagcctctcaaagcaaaggtcaccaacggctgtaacaacctggggatcatcatggaccactcaccggagccttccttcatcaacccgctgagcgctttgcagtccatcatgaacacccacctgggcaaggtgtccaagcccgtgagtccctcgctggacccgctggcgatgctgtacaagatcagcaacagcatgctggacaagccggtgtaccccgccacccctgtgaagcaggccgatgccatcgaccgctactattatgaaaacagcgaccagcccattgacttaaccaagtccaagaacaagccgctggtgtccagcgtggctgattcggtggcatcacctctgcgggagagcgcactcatggacatctccgacatggtgaaaaacctcacaggccgcctgacgcccaagtcctccacgccctccacagtttcagagaagtccgatgctgatggcagcagctttgaggaggcgttggacgagctgtcaccggtccacaagaggaagggccggcagtccaactggaacccgcagcaccttctcatcctgcaggcccagttcgcctcgagcttgcgggagaccacagagggcaagtacatcatgtcggacttgggcccgcaggagagggtgcacatctcgaagtttactgggctctccatgaccaccatcagccactggctggccaatgtgaagtaccagttgaggaggacagggggaacgaaattcctaaagaacctggacacagggcatcctgttttcttttgcaacgattgtgcctctcagttcagaactgcttctacatacataagtcatttggagacacacttgggcttcagcctgaaggatctctccaagctgccactcaatcagattcaagaacagcagaatgtttcgaaagtcctcaccaacaaaactctgggcccactgggggccaccgaggaagacttgggctccacattccaatgtaagctctgcaaccggacttttgcgagcaagcacgcagtcaaactgcaccttagtaagacccacggcaagtctcccgaggaccacctgatctatgtgactgagttggagaaacagtagcgtccaggtatgcaagagaccgcggaacattgcactaaacgtcgtcgagctgcactaggcctggcctgagcctctgaaatcagtctttcctttgttgctggcccgcctctctggaccttggttttcttacacatattttgtatatttatatgctctctgtccgatctgtgcatgttatttttctttttccgtgagtcaaagtctgacctttattttcaacatctgttcttggtgttaagctatcttttgtaggaaatagtggggcacactactcagagacattatttagcagtaaagaaagacacaaataacaatgataaaaagacatcctaaaatggtgaagttgccatgacaataaaggtcatagaacctggtagtgtcaaatttaaccctttgaggactgtaattgcatttctgtgcctttcacttgaaaaaaaaaaaagaagaaaaaaaggcttaaaggcatttcattcagatcaaaagctgtgtcagacacaaaacttatttaataattaaaaaatgagcttttatatgcagaactggtttgtgaggaaacatgcatgcagctgtgggaagatagaaagctgtctaggactcacggggttcggaagccacacctctacatgtctaaaacaaaaaacaacaacaacagataccccactcgccactatgcccaaaccctctggatgctgaaaaatgccactttcggcaaaaaaaaaaagtatgcaagctattatttaaaaatgtgtaaaaatgctatttcttttttcctgtaaaatattgcagtttatagttatttacaaatgtaagctttggtacaagctgacctttctatagcgtgctgcattggtaaatgaaaaaaaatggggcaaacgttggagtcctttccttgtaaattgccagcatcagcttaaaaactcctgtatgttacatatcgtaccattttaatctcttcaactttctttgtaccttctggctgtatgctttctcttttaactttttatattgtcattttatattaaatttctgtgtatataatgtaaaaccacaatttttgaataaaatttagttcctgcagcttgatttaaatagaggacttttactggcacctgcatctctccagatgcatgtactcagagggactgtcagacaaaaataaatacataaaaacaaagcaagcaatgcactattaattatacattttgatgttctatcattaatattgtacagtacattttggttcacacaattaaatccactgttttctcagatgtaaaataaacccacatgcagttcttgatttacacggattgtca

SEQ ID NO: 440112 - DNA, 724 bp, Homo sapiens
gtgaacccttttaaagagctctatccagtttctttttcatatacaaatataatatgaaatcatctttatctttcatagtatttgtgtttggcatttttaacattactgtttcagtctgcctcatttagttataataacacccttgaagacagaaaatcttctgtcctaaacatattcggcccaataactactttttattaattgattctttttgcatttcaggtcacctatgagatagagaccaatgggacttttggaatccagaaagtttctgtcagtttgggacaaaccaacctgactgttgagccaggcgcttccttacagcaacacttcatccttcgcttcagggttagggcccttctcttataggggatttagaggggaagaaatattgggttagaaataatttctttgcttctgtaatacatgtgaaatagaataagaatatgaaggcctagttcagtctgtcgattgaggcctcaacatttaatattccataattttactacaagttgtggttattctacaagtctttactcattaaaattttctccaattctctgtctggcccccaacaaagcaggacttcaatctaaaatcaaaactttttttatagtcattttgaatcataaattcagccaacacctacaaaaattctttaactagctgttctcatatttctgggcagtcagcattttactcatttcccacttaatctgagtgt

SEQ ID NO: 440113 - DNA, 447 bp, Homo sapiens
cttttgtgttcttccactaagctacattgccttccttattactgaataatgcttaagaaacaatggcttagtacttggtgattgactataggcaaccatcaggcaattcaagcagatgcttctttacccttctgcaggctataaactgtacttcctgctgtctcataccagtttccctggagatccaggtattgtgggcatatgtaggtctcctgtccaacccgcaagctcatgtatcaggagttcgattcctataccagtgccagtctatacaggtaagtcatggctcataaaggatcactaaaccttgcaaagcctagattgtcttatcagtcatttgttaaccaaataattttttaccttccaagagctaatttatgttagcaaccaatgtttgtttaaagtgagctgacataatttgtcaagtctattcagcctgcctgatta

SEQ ID NO: 440114 - DNA, 2564 bp, Homo sapiens
aggttgtcctgtagtaaaatccaatctttcgtcactgtaacaaaccgagagggacccggaggccctgaatgccccatgcgcaccccacagctcgcgctcctgcaagtgttctttctggtgttccccgatggcgtccggcctcagccctcttcctccccatcaggggcagtgcccacgtctttggagctgcagcgagggacggatggcggaaccctccagtccccttcagaggcgactgcaactcgcccggccgtgcctggactccctacagtggtccctactctcgtgactccctcggcccctgggaataggactgtggacctcttcccagtcttaccgatctgtgtctgtgacttgactcctggagcctgcgatataaattgctgctgcgacagggactgctatcttctccatccgaggacagttttctccttctgccttccaggcagcgtaaggtcttcaagctgggtttgtgtagacaactctgttatcttcaggagtaattccccgtttccttcaagagttttcatggattctaatggaatcaggcagttttgtgtccatgtgaacaactcaaacttaaactatttccagaagcttcaaaaggtcaatgcaaccaacttccaggccctggctgcagagtttggaggcgaatcattcacttcaacattccaaactcaatcaccaccatctttttacagggctggggaccccattcttacttacttccccaagtggtctgtaataagcttgctgagacaacctgcaggagttggagctgggggactctgtgctgaaagcaatcctgcaggtttcctagagagtaaaagtacaacttgcactcgttttttcaagaacctggctagtagctgtaccttggattcagccctcaatgctgcctcttactataacttcacagtcttaaaggttccaagaagcatgactgatccacagaatatggagttccaggttcctgtaatacttacctcacaggctaatgctcctctgttggctggaaacacttgtcagaatgtagtttctcaggtcacctatgagatagagaccaatgggacttttggaatccagaaagtttctgtcagtttgggacaaaccaacctgactgttgagccaggcgcttccttacagcaacacttcatccttcgcttcagggcttttcaacagagcacagctgcttctctcaccagtcctagaagtgggaatcctggctatatagttgggaagccactcttggctctgactgatgatataagttactcaatgaccctcttacagagccagggtaatggaagttgctctgttaaaagacatgaagtgcagtttggagtgaatgcaatatctggatgcaagctcaggttgaagaaggcagactgcagccacttgcagcaggagatttatcagactcttcatggaaggcccagaccagagtatgttgccatctttggtaatgctgacccagcccagaaaggagggtggaccaggatcctcaacaggcactgcagcatttcagctataaactgtacttcctgctgtctcataccagtttccctggagatccaggtattgtgggcatatgtaggtctcctgtccaacccgcaagctcatgtatcaggagttcgattcctataccagtgccagtctatacaggattctcagcaagttacagaagtatctttgacaactcttgtgaactttgtggacattacccagaagccacagcctccaaggggccaacccaaaatggactggaaatggccattcgacttctttcccttcaaagtggcattcagcagaggagtattctctcaaaaatgctcagtctctcccatccttatcctgtgcctcttactacttggagttctcaacctagagactatgtgaagaaaagaaaataatcagatttcagttttccctatgagaaactctgaggcagccacttatcttggctaaatagaacctcacctgctcatgaccagagagcatttaggataatagaggacctaactgaaggaatccttgtatatgaaaggagttattttagaaaagcaataaaaatattttattcatcatagctctctgctttgggctctgcaggccaccagatacacatgaggcccctacttctcaagctgggaaggccaagagccttccttcagcctttctggttatgttacacctagctgaatgtttacaaggtctggatccatcagccctcaggcacagttgggccaagcagaaagagagaaacacttctgctgtcaccttgaatgaactcaggaatagcttccctctggactgtagaggagctaactgtttggaacagaaaactgctggctgttgattttgtctggttcctttgccaacatctgggcacaccctttgcccagacacgagtggggaaagcagttctttctcctcagtttccaaagtaaatggggaatcccagctttcttttctactagcaaatgaccctaccatttatttctgcctttttcttccgttcattgtgaggaaaaataaaactggttgagagctttgttgtacta

SEQ ID NO: 440115 - DNA, 2649 bp, Homo sapiens
acggttgccaggcaacggaggcacggcccggcccgcgttaaggaggagggcgcagaccgaaggacactgaaagagctgtaacaaccccactttcgattggttgaagagctctcagccttctcatgagccaatgagaagaggcacgcggatggcgtcagacgctatgcgactcctcccacccacgctctggcaatgcgattggagaccgcggaggcctacgtcggacccggaggccctgaatgccccatgcgcaccccacagctcgcgctcctgcaagtgttctttctggtgttccccgatggcgtccggcctcagccctcttcctccccatcaggggcagtgcccacgtctttggagctgcagcgagggacggatggcggaaccctccagtccccttcagaggcgactgcaactcgcccggccgtgcctggactccctacagtggtccctactctcgtgactccctcggcccctgggaataggactgtggacctcttcccagtcttaccgatctgtgtctgtgacttgactcctggagcctgcgatataaattgctgctgcgacagggactgctatcttctccatccgaggacagttttctccttctgccttccaggcagcgtaaggtcttcaagctgggtttgtgtagacaactctgttatcttcaggagtaattccccgtttccttcaagagttttcatggattctaatggaatcaggcagttttgtgtccatgtgaacaactcaaacttaaactatttccagaagcttcaaaaggtcaatgcaaccaacttccaggccctggctgcagagtttggaggcgaatcattcacttcaacattccaaactcaatcaccaccatctttttacagggctggggaccccattcttacttacttccccaagtggtctgtaataagcttgctgagacaacctgcaggagttggagctgggggactctgtgctgaaagcaatcctgcaggtttcctagagagtaaaagtacaacttgcactcgttttttcaagaacctggctagtagctgtaccttggattcagccctcaatgctgcctcttactataacttcacagtcttaaaggttccaagaagcatgactgatccacagaatatggagttccaggttcctgtaatacttacctcacaggctaatgctcctctgttggctggaaacacttgtcagaatgtagtttctcaggtcacctatgagatagagaccaatgggacttttggaatccagaaagtttctgtcagtttgggacaaaccaacctgactgttgagccaggcgcttccttacagcaacacttcatccttcgcttcagggcttttcaacagagcacagctgcttctctcaccagtcctagaagtgggaatcctggctatatagttgggaagccactcttggctctgactgatgatataagttactcaatgaccctcttacagagccagggtaatggaagttgctctgttaaaagacatgaagtgcagtttggagtgaatgcaatatctggatgcaagctcaggttgaagaaggcagactgcagccacttgcagcaggagatttatcagactcttcatggaaggcccagaccagagtatgttgccatctttggtaatgctgacccagcccagaaaggagggtggaccaggatcctcaacaggcactgcagcatttcagctataaactgtacttcctgctgtctcataccagtttccctggagatccaggtattgtgggcatatgtaggtctcctgtccaacccgcaagctcatgtatcaggagttcgattcctataccagtgccagtctatacaggattctcagcaagttacagaagtatctttgacaactcttgtgaactttgtggacattacccagaagccacagcctccaaggggccaacccaaaatggactggaaatggccattcgacttctttcccttcaaagtggcattcagcagaggagtattctctcaaaaatgctcagtctctcccatccttatcctgtgcctcttactacttggagttctcaacctagagactatgtgaagaaaagaaaataatcagatttcagttttccctatgagaaactctgaggcagccacttatcttggctaaatagaacctcacctgctcatgaccagagagcatttaggataatagaggacctaactgaaggaatccttgtatatgaaaggagttattttagaaaagcaataaaaatattttattcatcatagctctctgctttgggctctgcaggccaccagatacacatgaggcccctacttctcaagctgggaaggccaagagccttccttcagcctttctggttatgttacacctagctgaatgtttacaaggtctggatccatcagccctcaggcacagttgggccaagcagaaagagagaaacacttctgctgtcaccttgaatgaactcaggaatagcttccctctggactgtagaggagctaactgtttggaacagaaaactgctggctgttgattttgtctggttcctttgccaacatctgggcacaccctttgcccagacacgagtggggaaagcagttctttctcctcagtttccaaagtaaatggggaatcccagctttcttttctact

SEQ ID NO: 440116 - DNA, 2782 bp, Homo sapiens
acggttgccaggcaacggaggcacggcccggcccgcgttaaggaggagggcgcagaccgaaggacactgaaagagctgtaacaaccccactttcgattggttgaagagctctcagccttctcatgagccaatgagaagaggcacgcggatggcgtcagacgctatgcgactcctcccacccacgctctggcaatgcgattggagaccgcggaggcctacgtcggacccggaggccctgaatgccccatgcgcaccccacagctcgcgctcctgcaagtgttctttctggtgttccccgatggcgtccggcctcagccctcttcctccccatcaggggcagtgcccacgtctttggagctgcagcgagggacggatggcggaaccctccagtccccttcagaggcgactgcaactcgcccggccgtgcctggactccctacagtggtccctactctcgtgactccctcggcccctgggaataggactgtggacctcttcccagtcttaccgatctgtgtctgtgacttgactcctggagcctgcgatataaattgctgctgcgacagggactgctatcttctccatccgaggacagttttctccttctgccttccaggcagcgtaaggtcttcaagctgggtttgtgtagacaactctgttatcttcaggagtaattccccgtttccttcaagagttttcatggattctaatggaatcaggcagttttgtgtccatgtgaacaactcaaacttaaactatttccagaagcttcaaaaggtcaatgcaaccaacttccaggccctggctgcagagtttggaggcgaatcattcacttcaacattccaaactcaatcaccaccatctttttacagggctggggaccccattcttacttacttccccaagtggtctgtaataagcttgctgagacaacctgcaggagttggagctgggggactctgtgctgaaagcaatcctgcaggtttcctagagagtaaaagtacaacttgcactcgttttttcaagaacctggctagtagctgtaccttggattcagccctcaatgctgcctcttactataacttcacagtcttaaaggttccaagaagcatgactgatccacagaatatggagttccaggttcctgtaatacttacctcacaggctaatgctcctctgttggctggaaacacttgtcagaatgtagtttctcaggtcacctatgagatagagaccaatgggacttttggaatccagaaagtttctgtcagtttgggacaaaccaacctgactgttgagccaggcgcttccttacagcaacacttcatccttcgcttcagggcttttcaacagagcacagctgcttctctcaccagtcctagaagtgggaatcctggctatatagttgggaagccactcttggctctgactgatgatataagttactcaatgaccctcttacagagccagggtaatggaagttgctctgttaaaagacatgaagtgcagtttggagtgaatgcaatatctggatgcaagctcaggttgaagaaggcagactgcagccacttgcagcaggagatttatcagactcttcatggaaggcccagaccagagtatgttgccatctttggtaatgctgacccagcccagaaaggagggtggaccaggatcctcaacaggcactgcagcatttcagctataaactgtacttcctgctgtctcataccagtttccctggagatccaggtattgtgggcatatgtaggtctcctgtccaacccgcaagctcatgtatcaggagttcgattcctataccagtgccagtctatacaggattctcagcaagttacagaagtatctttgacaactcttgtgaactttgtggacattacccagaagccacagcctccaaggggccaacccaaaatggactggaaatggccattcgacttctttcccttcaaagtggcattcagcagaggagtattctctcaaaaatgctcagtctctcccatccttatcctgtgcctcttactacttggagttctcaacctagagactatgtgaagaaaagaaaataatcagatttcagttttccctatgagaaactctgaggcagccacttatcttggctaaatagaacctcacctgctcatgaccagagagcatttaggataatagaggacctaactgaaggaatccttgtatatgaaaggagttattttagaaaagcaataaaaatattttattcatcatagctctctgctttgggctctgcaggccaccagatacacatgaggcccctacttctcaagctgggaaggccaagagccttccttcagcctttctggttatgttacacctagctgaatgtttacaaggtctggatccatcagccctcaggcacagttgggccaagcagaaagagagaaacacttctgctgtcaccttgaatgaactcaggaatagcttccctctggactgtagaggagctaactgtttggaacagaaaactgctggctgttgattttgtctggttcctttgccaacatctgggcacaccctttgcccagacacgagtggggaaagcagttctttctcctcagtttccaaagtaaatggggaatcccagctttcttttctactagcaaatgaccctaccatttatttctgcctttttcttccgttcattgtgaggaaaaataaaactggttgagagctttgttgtactaattccagcagcatggtagaaggcagctgacctgtggtctgcctcctg

SEQ ID NO: 440117 - DNA, 2654 bp, Homo sapiens
acggttgccaggcaacggaggcacggcccggcccgcgttaaggaggagggcgcagaccgaaggacactgaaagagctgtaacaaccccactttcgattggttgaagagctctcagccttctcatgagccaatgagaagaggcacgcggatggcgtcagacgctatgcgactcctcccacccacgctctggcaatgcgattggagaccgcggaggcctacgtcggacccggaggccctgaatgccccatgcgcaccccacagctcgcgctcctgcaagtgttctttctggtgttccccgatggcgtccggcctcagccctcttcctccccatcaggggcagtgcccacgtctttggagctgcagcgagggacggatggcggaaccctccagtccccttcagaggcgactgcaactcgcccggccgtgcctggactccctacagtggtccctactctcgtgactccctcggcccctgggaataggactgtggacctcttcccagtcttaccgatctgtgtctgtgacttgactcctggagcctgcgatataaattgctgctgcgacagggactgctatcttctccatccgaggacagttttctccttctgccttccaggcagcgtaaggtcttcaagctgggtttgtgtagacaactctgttatcttcaggagtaattccccgtttccttcaagagttttcatggattctaatggaatcaggcagttttgtgtccatgtgaacaactcaaacttaaactatttccagaagcttcaaaaggtcaatgcaaccaacttccaggccctggctgcagagtttggaggcgaatcattcacttcaacattccaaactcaatcaccaccatctttttacagggctggggaccccattcttacttacttccccaagtggtctgtaataagcttgctgagacaacctgcaggagttggagctgggggactctgtgctgaaagcaatcctgcaggtttcctagagagtaaaagtacaacttgcactcgttttttcaagaacctggctagtagctgtaccttggattcagccctcaatgctgcctcttactataacttcacagtcttaaaggttccaagaagcatgactgatccacagaatatggaggtcacctatgagatagagaccaatgggacttttggaatccagaaagtttctgtcagtttgggacaaaccaacctgactgttgagccaggcgcttccttacagcaacacttcatccttcgcttcagggcttttcaacagagcacagctgcttctctcaccagtcctagaagtgggaatcctggctatatagttgggaagccactcttggctctgactgatgatataagttactcaatgaccctcttacagagccagggtaatggaagttgctctgttaaaagacatgaagtgcagtttggagtgaatgcaatatctggatgcaagctcaggttgaagaaggcagactgcagccacttgcagcaggagatttatcagactcttcatggaaggcccagaccagagtatgttgccatctttggtaatgctgacccagcccagaaaggagggtggaccaggatcctcaacaggcactgcagcatttcagctataaactgtacttcctgctgtctcataccagtttccctggagatccaggtattgtgggcatatgtaggtctcctgtccaacccgcaagctcatgtatcaggagttcgattcctataccagtgccagtctatacaggattctcagcaagttacagaagtatctttgacaactcttgtgaactttgtggacattacccagaagccacagcctccaaggggccaacccaaaatggactggaaatggccattcgacttctttcccttcaaagtggcattcagcagaggagtattctctcaaaaatgctcagtctctcccatccttatcctgtgcctcttactacttggagttctcaacctagagactatgtgaagaaaagaaaataatcagatttcagttttccctatgagaaactctgaggcagccacttatcttggctaaatagaacctcacctgctcatgaccagagagcatttaggataatagaggacctaactgaaggaatccttgtatatgaaaggagttattttagaaaagcaataaaaatattttattcatcatagctctctgctttgggctctgcaggccaccagatacacatgaggcccctacttctcaagctgggaaggccaagagccttccttcagcctttctggttatgttacacctagctgaatgtttacaaggtctggatccatcagccctcaggcacagttgggccaagcagaaagagagaaacacttctgctgtcaccttgaatgaactcaggaatagcttccctctggactgtagaggagctaactgtttggaacagaaaactgctggctgttgattttgtctggttcctttgccaacatctgggcacaccctttgcccagacacgagtggggaaagcagttctttctcctcagtttccaaagtaaatggggaatcccagctttcttttctactagcaaatgaccctaccatttatttctgcctttttcttccgttcattgtgaggaaaaataaaactggttgagagctttgttgtacta

SEQ ID NO: 440118 - DNA, 2372 bp, Homo sapiens
cttacttctgagatctaaaattctgtgagcaaagttgagctgccacaaagcaggagtggggctgtcggaagaaggagggtgagcacctgggagagtttggggatcttcatcccactcactctgtgtcgtactttcatagtcttaccgatctgtgtctgtgacttgactcctggagcctgcgatataaattgctgctgcgacagggactgctatcttctccatccgaggacagttttctccttctgccttccaggcagcgtaaggtcttcaagctgggtttgtgtagacaactctgttatcttcaggagtaattccccgtttccttcaagagttttcatggattctaatggaatcaggcagttttgtgtccatgtgaacaactcaaacttaaactatttccagaagcttcaaaaggtcaatgcaaccaacttccaggccctggctgcagagtttggaggcgaatcattcacttcaacattccaaactcaatcaccaccatctttttacagggctggggaccccattcttacttacttccccaagtggtctgtaataagcttgctgagacaacctgcaggagttggagctgggggactctgtgctgaaagcaatcctgcaggtttcctagagagtaaaagtacaacttgcactcgttttttcaagaacctggctagtagctgtaccttggattcagccctcaatgctgcctcttactataacttcacagtcttaaaggttccaagaagcatgactgatccacagaatatggagttccaggttcctgtaatacttacctcacaggctaatgctcctctgttggctggaaacacttgtcagaatgtagtttctcaggtcacctatgagatagagaccaatgggacttttggaatccagaaagtttctgtcagtttgggacaaaccaacctgactgttgagccaggcgcttccttacagcaacacttcatccttcgcttcagggcttttcaacagagcacagctgcttctctcaccagtcctagaagtgggaatcctggctatatagttgggaagccactcttggctctgactgatgatataagttactcaatgaccctcttacagagccagggtaatggaagttgctctgttaaaagacatgaagtgcagtttggagtgaatgcaatatctggatgcaagctcaggttgaagaaggcagactgcagccacttgcagcaggagatttatcagactcttcatggaaggcccagaccagagtatgttgccatctttggtaatgctgacccagcccagaaaggagggtggaccaggatcctcaacaggcactgcagcatttcagctataaactgtacttcctgctgtctcataccagtttccctggagatccaggtattgtgggcatatgtaggtctcctgtccaacccgcaagctcatgtatcaggagttcgattcctataccagtgccagtctatacaggattctcagcaagttacagaagtatctttgacaactcttgtgaactttgtggacattacccagaagccacagcctccaaggggccaacccaaaatggactggaaatggccattcgacttctttcccttcaaagtggcattcagcagaggagtattctctcaaaaatgctcagtctctcccatccttatcctgtgcctcttactacttggagttctcaacctagagactatgtgaagaaaagaaaataatcagatttcagttttccctatgagaaactctgaggcagccacttatcttggctaaatagaacctcacctgctcatgaccagagagcatttaggataatagaggacctaactgaaggaatccttgtatatgaaaggagttattttagaaaagcaataaaaatattttattcatcatagctctctgctttgggctctgcaggccaccagatacacatgaggcccctacttctcaagctgggaaggccaagagccttccttcagcctttctggttatgttacacctagctgaatgtttacaaggtctggatccatcagccctcaggcacagttgggccaagcagaaagagagaaacacttctgctgtcaccttgaatgaactcaggaatagcttccctctggactgtagaggagctaactgtttggaacagaaaactgctggctgttgattttgtctggttcctttgccaacatctgggcacaccctttgcccagacacgagtggggaaagcagttctttctcctcagtttccaaagtaaatggggaatcccagctttcttttctactagcaaatgaccctaccatttatttctgcctttttcttccgttcattgtgaggaaaaataaaactggttgagagctttgttgtacta

SEQ ID NO: 440119 - DNA, 1789 bp, Homo sapiens
acggttgccaggcaacggaggcacggcccggcccgcgttaaggaggagggcgcagaccgaaggacactgaaagagctgtaacaaccccactttcgattggttgaagagctctcagccttctcatgagccaatgagaagaggcacgcggatggcgtcagacgctatgcgactcctcccacccacgctctggcaatgcgattggagaccgcggaggcctacgtcggacccggaggccctgaatgccccatgcgcaccccacagctcgcgctcctgcaagtgttctttctggtgttccccgatggcgtccggcctcagccctcttcctccccatcaggggcagtgcccacgtctttggagctgcagcgagggacggatggcggaaccctccagtccccttcagaggcgactgcaactcgcccggccgtgcctggactccctacagtggtccctactctcgtgactccctcggcccctgggaataggactgtggacctcttcccagtcttaccgatctgtgtctgtgacttgactcctggagcctgcgatataaattgctgctgcgacagggactgctatcttctccatccgaggacagttttctccttctgccttccaggcagcgtaaggtcttcaagctgggtttgtgtagacaactctgttatcttcaggagtaattccccgtttccttcaagagttttcatggattctaatggaatcaggcagttttgtgtccatgtgaacaactcaaacttaaactatttccagaagcttcaaaaggtcaatgcaaccaacttccaggccctggctgcagagtttggaggcgaatcattcacttcaacattccaaactcaatcaccaccatctttttacagggctggggaccccattcttacttacttccccaagtggtctgtaataagcttgctgagacaacctgcaggagttggagctgggggactctgtgctgaaagcaatcctgcaggtttcctagagagtaaaagtacaacttgcactcgttttttcaagaacctggctagtagctgtaccttggattcagccctcaatgctgcctcttactataacttcacagtcttaaaggttccaagaagcatgactgatccacagaatatggagttccaggttcctgtaatacttacctcacaggctaatgctcctctgttggctggaaacacttgtcagaatgtagtttctcaggtcacctatgagatagagaccaatgggacttttggaatccagaaagtttctgtcagtttgggacaaaccaacctgactgttgagccaggcgcttccttacagcaacacttcatccttcgcttcagggcttttcaacagagcacagctgcttctctcaccagtcctagaagtgggaatcctggctatatagttgggaagccactcttggctctgactgatgatataagttactcaatgaccctcttacagagccagggtaatggaagttgctctgttaaaagacatgaagtgcagtttggagtgaatgcaatatctggatgcaagctcaggttgaagaaggcagactgcagccacttgcagcaggagatttatcagactcttcatggaaggcccagaccagagtatgttgccatctttggtaatgctgacccagcccagaaaggagggtggaccaggatcctcaacaggcactgcagcatttcagtaaggagagaaatatactttctgatgaagactcatttttacccctttgtaaatcttggatagtaagtttaaaaccagcctgtctccatag

SEQ ID NO: 440120 - DNA, 1558 bp, Homo sapiens
acggttgccaggcaacggaggcacggcccggcccgcgttaaggaggagggcgcagaccgaaggacactgaaagagctgtaacaaccccactttcgattggttgaagagctctcagccttctcatgagccaatgagaagaggcacgcggatggcgtcagacgctatgcgactcctcccacccacgctctggcaatgcgattggagaccgcggaggcctacgtcggacccggaggccctgaatgccccatgcgcaccccacagctcgcgctcctgcaagtgttctttctggtgttccccgatggcgtccggcctcagccctcttcctccccatcaggggcagtgcccacgtctttggagctgcagcgagggacggatggcggaaccctccagtccccttcagaggcgactgcaactcgcccggccgtgcctggactccctacagtggtccctactctcgtgactccctcggcccctgggaataggactgtggacctcttcccagtcttaccgatctgtgtctgtgacttgactcctggagcctgcgatataaattgctgctgcgacagggactgctatcttctccatccgaggacagttttctccttctgccttccaggcagcgtaaggtcttcaagctgggtttgtgtagacaactctgttatcttcaggagtaattccccgtttccttcaagagttttcatggattctaatggaatcaggcagttttgtgtccatgtgaacaactcaaacttaaactatttccagaagcttcaaaaggtcaatgcaaccaacttccaggccctggctgcagagtttggaggcgaatcattcacttcaacattccaaactcaatcaccaccatctttttacagggctggggaccccattcttacttacttccccaagtggtctgtaataagcttgctgagacaacctgcaggagttggagctgggggactctgtgctgaaagcaatcctgcaggtttcctagagagtaaaagtacaacttgcactcgttttttcaagaacctggctagtagctgtaccttggattcagccctcaatgctgcctcttactataacttcacagtcttaaaggttccaagaagcatgactgatccacagaatatggaggattctcagcaagttacagaagtatctttgacaactcttgtgaactttgtggacattacccagaagccacagcctccaaggggccaacccaaaatggactggaaatggccattcgacttctttcccttcaaagtggcattcagcagaggagtattctctcaaaaatgctcagtctctcccatccttatcctgtgcctcttactacttggagttctcaacctagagactatgtgaagaaaagaaaataatcagatttcagttttccctatgagaaactctgaggcagccacttatcttggctaaatagaacctcacctgctcatgaccagagagcatttaggataatagaggacctaactgaaggaatccttgtatatgaaaggagttattttagaaaagcaataaaaatattttattcatcata

SEQ ID NO: 440121 - DNA, 1708 bp, Homo sapiens
acggttgccaggcaacggaggcacggcccggcccgcgttaaggaggagggcgcagaccgaaggacactgaaagagctgtaacaaccccactttcgattggttgaagagctctcagccttctcatgagccaatgagaagaggcacgcggatggcgtcagacgctatgcgactcctcccacccacgctctggcaatgcgattggagaccgcggaggcctacgtcggacccggaggccctgaatgccccatgcgcaccccacagctcgcgctcctgcaagtgttctttctggtgttccccgatggcgtccggcctcagccctcttcctccccatcaggggcagtgcccacgtctttggagctgcagcgagggacggatggcggaaccctccagtccccttcagaggcgactgcaactcgcccggccgtgcctggactccctacagtggtccctactctcgtgactccctcggcccctgggaataggactgtggacctcttcccagtcttaccgatctgtgtctgtgacttgactcctggagcctgcgatataaattgctgctgcgacagggactgctatcttctccatccgaggacagttttctccttctgccttccaggcagcgtaaggtcttcaagctgggtttgtgtagacaactctgttatcttcaggagtaattccccgtttccttcaagagttttcatggattctaatggaatcaggcagttttgtgtccatgtgaacaactcaaacttaaactatttccagaagcttcaaaaggtcaatgcaaccaacttccaggccctggctgcagagtttggaggcgaatcattcacttcaacattccaaactcaatcaccaccatctttttacagggctggggaccccattcttacttacttccccaagtggtctgtaataagcttgctgagacaacctgcaggagttggagctgggggactctgtgctgaaagcaatcctgcaggtttcctagagagtaaaagtacaacttgcactcgttttttcaagaacctggctagtagctgtaccttggattcagccctcaatgctgcctcttactataacttcacagtcttaaaggttccaagaagcatgactgatccacagaatatggagttccaggttcctgtaatacttacctcacaggctaatgctcctctgttggctggaaacacttgtcagaatgtagtttctcaggtcacctatgagatagagaccaatgggacttttggaatccagaaagtttctgtcagtttgggacaaaccaacctgactgttgagccaggcgcttccttacagcaacacttcatccttcgcttcagggcttttcaacagagcacagctgcttctctcaccagtcctagaagtgggaatcctggctatatagttgggaagccactcttggctctgactgatgatataagttactcagtatcctttttagagctgggtggcctgttgcagcctaatgagaaaagctgcaaaggctttcaaacttatgttagactagccaaaggtgaggaattttttgttcattataatgaggtacttatatactaatatatggttaatcatttttggaatctagttgtctctctgtggttttctgaggaaaaaaatcacaaatttgtgactcgaacattatgatagtaatacaaaataaatagcattaaaggagaatgagaacata

SEQ ID NO: 440122 - DNA, 2303 bp, Homo sapiens
cttacttctgagatctaaaattctgtgagcaaagttgagctgccacaaagcaggagtggggctgtcggaagaaggagggtgagcacctgggagagtttggggatcttcatcccactcactctgtgtcgtactttcatagtcttaccgatctgtgtctgtgacttgactcctggagcctgcgatataaattgctgctgcgacagggactgctatcttctccatccgaggacagttttctccttctgccttccaggcagcgtaaggtcttcaagctgggtttgtgtagacaactctgttatcttcaggagtaattccccgtttccttcaagagttttcatggattctaatggaatcaggcagttttgtgtccatgtgaacaactcaaacttaaactatttccagaagcttcaaaaggtcaatgcaaccaacttccaggccctggctgcagagtttggaggcgaatcattcacttcaacattccaaactcaatcaccaccatctttttacagggctggggaccccattcttacttacttccccaagtggtctgtaataagcttgctgagacaacctgcaggagttggagctgggggactctgtgctgaaagcaatcctgcagattcagccctcaatgctgcctcttactataacttcacagtcttaaaggttccaagaagcatgactgatccacagaatatggagttccaggttcctgtaatacttacctcacaggctaatgctcctctgttggctggaaacacttgtcagaatgtagtttctcaggtcacctatgagatagagaccaatgggacttttggaatccagaaagtttctgtcagtttgggacaaaccaacctgactgttgagccaggcgcttccttacagcaacacttcatccttcgcttcagggcttttcaacagagcacagctgcttctctcaccagtcctagaagtgggaatcctggctatatagttgggaagccactcttggctctgactgatgatataagttactcaatgaccctcttacagagccagggtaatggaagttgctctgttaaaagacatgaagtgcagtttggagtgaatgcaatatctggatgcaagctcaggttgaagaaggcagactgcagccacttgcagcaggagatttatcagactcttcatggaaggcccagaccagagtatgttgccatctttggtaatgctgacccagcccagaaaggagggtggaccaggatcctcaacaggcactgcagcatttcagctataaactgtacttcctgctgtctcataccagtttccctggagatccaggtattgtgggcatatgtaggtctcctgtccaacccgcaagctcatgtatcaggagttcgattcctataccagtgccagtctatacaggattctcagcaagttacagaagtatctttgacaactcttgtgaactttgtggacattacccagaagccacagcctccaaggggccaacccaaaatggactggaaatggccattcgacttctttcccttcaaagtggcattcagcagaggagtattctctcaaaaatgctcagtctctcccatccttatcctgtgcctcttactacttggagttctcaacctagagactatgtgaagaaaagaaaataatcagatttcagttttccctatgagaaactctgaggcagccacttatcttggctaaatagaacctcacctgctcatgaccagagagcatttaggataatagaggacctaactgaaggaatccttgtatatgaaaggagttattttagaaaagcaataaaaatattttattcatcatagctctctgctttgggctctgcaggccaccagatacacatgaggcccctacttctcaagctgggaaggccaagagccttccttcagcctttctggttatgttacacctagctgaatgtttacaaggtctggatccatcagccctcaggcacagttgggccaagcagaaagagagaaacacttctgctgtcaccttgaatgaactcaggaatagcttccctctggactgtagaggagctaactgtttggaacagaaaactgctggctgttgattttgtctggttcctttgccaacatctgggcacaccctttgcccagacacgagtggggaaagcagttctttctcctcagtttccaaagtaaatggggaatcccagctttcttttctactagcaaatgaccctaccatttatttctgcctttttcttccgttcattgtgaggaaaaataaaactggttgagagctttgttgtacta

SEQ ID NO: 440123 - DNA, 1604 bp, Homo sapiens
gtgaacccttttaaagagctctatccagtttctttttcatatacaaatataatatgaaatcatctttatctttcatagtatttgtgtttggcatttttaacattactgtttcagtctgcctcatttagttataataacacccttgaagacagaaaatcttctgtcctaaacatattcggcccaataactactttttattaattgattctttttgcatttcaggtcacctatgagatagagaccaatgggacttttggaatccagaaagtttctgtcagtttgggacaaaccaacctgactgttgagccaggcgcttccttacagcaacacttcatccttcgcttcagggcttttcaacagagcacagctgcttctctcaccagtcctagaagtgggaatcctggctatatagttgggaagccactcttggctctgactgatgatataagttactcaatgaccctcttacagagccagggtaatggaagttgctctgttaaaagacatgaagtgcagtttggagtgaatgcaatatctggatgcaagctcaggttgaagaaggcagactgcagccacttgcagcaggagatttatcagactcttcatggaaggcccagaccagagtatgttgccatctttggtaatgctgacccagcccagaaaggagggtggaccaggatcctcaacaggcactgcagcatttcagattctcagcaagttacagaagtatctttgacaactcttgtgaactttgtggacattacccagaagccacagcctccaaggggccaacccaaaatggactggaaatggccattcgacttctttcccttcaaagtggcattcagcagaggagtattctctcaaaaatgctcagtctctcccatccttatcctgtgcctcttactacttggagttctcaacctagagactatgtgaagaaaagaaaataatcagatttcagttttccctatgagaaactctgaggcagccacttatcttggctaaatagaacctcacctgctcatgaccagagagcatttaggataatagaggacctaactgaaggaatccttgtatatgaaaggagttattttagaaaagcaataaaaatattttattcatcatagctctctgctttgggctctgcaggccaccagatacacatgaggcccctacttctcaagctgggaaggccaagagccttccttcagcctttctggttatgttacacctagctgaatgtttacaaggtctggatccatcagccctcaggcacagttgggccaagcagaaagagagaaacacttctgctgtcaccttgaatgaactcaggaatagcttccctctggactgtagaggagctaactgtttggaacagaaaactgctggctgttgattttgtctggttcctttgccaacatctgggcacaccctttgcccagacacgagtggggaaagcagttctttctcctcagtttccaaagtaaatggggaatcccagctttcttttctactagcaaatgaccctaccatttatttctgcctttttcttccgttcattgtgaggaaaaataaaactggttgagagctttgttgtacta

SEQ ID NO: 440124 - DNA, 1171 bp, Homo sapiens
tctctgatatcaggcagctccccagctaggggaagctagagtcagggtttaggtaggtgtaactgttcagttctgctatcattgactattgctaagatattcatttccttgtgtctcactgaaagagaactacataggaccaatatgagataaaggtatatcttgcttagaataattcatttctctcttcagggaaagtaataataacagccaagttagagtgctatatgaatgggtaccaagcgctgacctgtcattgactttcttcccgtgattctcagcaagttacagaagtatctttgacaactcttgtgaactttgtggacattacccagaagccacagcctccaaggggccaacccaaaatggactggaaatggccattcgacttctttcccttcaaagtggcattcagcagaggagtattctctcaaaaatgctcagtctctcccatccttatcctgtgcctcttactacttggagttctcaacctagagactatgtgaagaaaagaaaataatcagatttcagttttccctatgagaaactctgaggcagccacttatcttggctaaatagaacctcacctgctcatgaccagagagcatttaggataatagaggacctaactgaaggaatccttgtatatgaaaggagttattttagaaaagcaataaaaatattttattcatcatagctctctgctttgggctctgcaggccaccagatacacatgaggcccctacttctcaagctgggaaggccaagagccttccttcagcctttctggttatgttacacctagctgaatgtttacaaggtctggatccatcagccctcaggcacagttgggccaagcagaaagagagaaacacttctgctgtcaccttgaatgaactcaggaatagcttccctctggactgtagaggagctaactgtttggaacagaaaactgctggctgttgattttgtctggttcctttgccaacatctgggcacaccctttgcccagacacgagtggggaaagcagttctttctcctcagtttccaaagtaaatggggaatcccagctttcttttctactagcaaatgaccctaccatttatttctgcctttttcttccgttcattgtgaggaaaaataaaactggttgagagctttgttgtacta

SEQ ID NO: 440125 - DNA, 803 bp, Homo sapiens
acggttgccaggcaacggaggcacggcccggcccgcgttaaggaggagggcgcagaccgaaggacactgaaagagctgtaacaaccccactttcgattggttgaagagctctcagccttctcatgagccaatgagaagaggcacgcggatggcgtcagacgctatgcgactcctcccacccacgctctggcaatgcgattggagaccgcggaggcctacgtcggacccggaggccctgaatgccccatgcgcaccccacagctcgcgctcctgcaagtgttctttctggtgttccccgatggcgtccggcctcagccctcttcctccccatcaggggcagtgcccacgtctttggagctgcagcgagggacggatggcggaaccctccagtccccttcagaggcgactgcaactcgcccggccgtgcctggactccctacagtggtccctactctcgtgactccctcggcccctgggaataggactgtggacctcttcccagtcttaccgatctgtgtctgtgacttgactcctggagcctgcgatataaattgctgctgcgacagggactgctatcttctccatccgaggacagttttctccttctgccttccaggcagcgtaaggtcttcaagctgggtttgtgtagacaactctgttatcttcaggagtaattccccgtttccttcaagagttttcatggattctaatggaatcaggcagttttgtgtccatgtgaacaactgtgagtagaaacatgttggttgttctcattttctaacacaggagtgttatattttgtc

SEQ ID NO: 440126 - DNA, 419 bp, Homo sapiens
ggctggccagtagaataagaccttcgtgtcgtcctataggtgcccaaggagtcctctttggcatcatctggccgatattgctgggacactcttttttggacctgccccgccccttctaaatatatcttctccctcctctttcctcacaggtcttcaagctgggtttgtgtagacaactctgttatcttcaggagtaattccccgtttccttcaagagttttcatggattctaatggaatcaggcagttttgtgtccatgtgaacaactgtgagtagaaacatgttggttgttctcattttctaacacaggagtgttatattttgtcttccctggcccacattggaagaagaattgtcttgggccacacgtaaaatacactaacgatagctgatgagttaaaaacaacaacaaaaaaaaa

SEQ ID NO: 440127 - DNA, 2735 bp, Homo sapiens
acggttgccaggcaacggaggcacggcccggcccgcgttaaggaggagggcgcagaccgaaggacactgaaagagctgtaacaaccccactttcgattggttgaagagctctcagccttctcatgagccaatgagaagaggcacgcggatggcgtcagacgctatgcgactcctcccacccacgctctggcaatgcgattggagaccgcggaggcctacgtcggacccggaggccctgaatgccccatgcgcaccccacagctcgcgctcctgcaagtgttctttctggtgttccccgatggcgtccggcctcagccctcttcctccccatcaggggcagtgcccacgtctttggagctgcagcgagggacggatggcggaaccctccagtccccttcagaggcgactgcaactcgcccggccgtgcctggactccctacagtggtccctactctcgtgactccctcggcccctgggaataggactgtggacctcttcccagtcttaccgatctgtgtctgtgacttgactcctggagcctgcgatataaattgctgctgcgacagggactgctatcttctccatccgaggacagttttctccttctgccttccaggcagcgtaaggtcttcaagctgggtttgtgtagacaactctgttatcttcaggagtaattccccgtttccttcaagagttttcatggattctaatggaatcaggcagttttgtgtccatgtgaacaactcaaacttaaactatttccagaagcttcaaaaggtcaatgcaaccaacttccaggccctggctgcagagtttggaggcgaatcattcacttcaacattccaaactcaatcaccaccatctttttacagggctggggaccccattcttacttacttccccaagtggtctgtaataagcttgctgagacaacctgcaggagttggagctgggggactctgtgctgaaagcaatcctgcaggtttcctagagagtaaaagtacaacttgcactcgttttttcaagaacctggctagtagctgtaccttggattcagccctcaatgctgcctcttactataacttcacagtcttaaaggttccaagaagcatgactgatccacagaatatggagttccaggttcctgtaatacttacctcacaggctaatgctcctctgttggctggaaacacttgtcagaatgtagtttctcaggtcacctatgagatagagaccaatgggacttttggaatccagaaagtttctgtcagtttgggacaaaccaacctgactgttgagccaggcgcttccttacagcaacacttcatccttcgcttcagggcttttcaacagagcacagctgcttctctcaccagtcctagaagtgggaatcctggctatatagttgggaagccactcttggctctgactgatgatataagttactcaatgaccctcttacagagccagggtaatggaagttgctctgttaaaagacatgaagtgcagtttggagtgaatgcaatatctggatgcaagctcaggttgaagaaggcagactgcagccacttgcagcaggagatttatcagactcttcatggaaggcccagaccagagtatgttgccatctttggtaatgctgacccagcccagaaaggagggtggaccaggatcctcaacaggcactgcagcatttcagctataaactgtacttcctgctgtctcataccagtttccctggagatccaggtattgtgggcatatgtaggtctcctgtccaacccgcaagctcatgtatcaggagttcgattcctataccagtgccagtctatacaggattctcagcaagttacagaagtatctttgacaactcttgtgaactttgtggacattacccagaagccacagcctccaaggggccaacccaaaatggactggaaatggccattcgacttctttcccttcaaagtggcattcagcagaggagtattctctcaaaaatgctcagtctctcccatccttatcctgtgcctcttactacttggagttctcaacctagagactatgtgaagaaaagaaaataatcagatttcagttttccctatgagaaactctgaggcagccacttatcttggctaaatagaacctcacctgctcatgaccagagagcatttaggataatagaggacctaactgaaggaatccttgtatatgaaaggagttattttagaaaagcaataaaaatattttattcatcatagctctctgctttgggctctgcaggccaccagatacacatgaggcccctacttctcaagctgggaaggccaagagccttccttcagcctttctggttatgttacacctagctgaatgtttacaaggtctggatccatcagccctcaggcacagttgggccaagcagaaagagagaaacacttctgctgtcaccttgaatgaactcaggaatagcttccctctggactgtagaggagctaactgtttggaacagaaaactgctggctgttgattttgtctggttcctttgccaacatctgggcacaccctttgcccagacacgagtggggaaagcagttctttctcctcagtttccaaagtaaatggggaatcccagctttcttttctactagcaaatgaccctaccatttatttctgcctttttcttccgttcattgtgaggaaaaataaaactggttgagagctttgttgtacta

SEQ ID NO: 440128 - DNA, 2260 bp, Homo sapiens
acggttgccaggcaacggaggcacggcccggcccgcgttaaggaggagggcgcagaccgaaggacactgaaagagctgtaacaaccccactttcgattggttgaagagctctcagccttctcatgagccaatgagaagaggcacgcggatggcgtcagacgctatgcgactcctcccacccacgctctggcaatgcgattggagaccgcggaggcctacgtcggacccggaggccctgaatgccccatgcgcaccccacagctcgcgctcctgcaagtgttctttctggtgttccccgatggcgtccggcctcagccctcttcctccccatcaggggcagtgcccacgtctttggagctgcagcgagggacggatggcggaaccctccagtccccttcagaggcgactgcaactcgcccggccgtgcctggactccctacagtggtccctactctcgtgactccctcggcccctgggaataggactgtggacctcttcccagtcttaccgatctgtgtctgtgacttgactcctggagcctgcgatataaattgctgctgcgacagggactgctatcttctccatccgaggacagttttctccttctgccttccaggcagcgtaaggtcttcaagctgggtttgtgtagacaactctgttatcttcaggagtaattccccgtttccttcaagagttttcatggattctaatggaatcaggcagttttgtgtccatgtgaacaactcaaacttaaactatttccagaagcttcaaaaggtcaatgcaaccaacttccaggccctggctgcagagtttggaggcgaatcattcacttcaacattccaaactcaatcaccaccatctttttacagggctggggaccccattcttacttacttccccaagtggtctgtaataagcttgctgagacaacctgcaggagttggagctgggggactctgtgctgaaagcaatcctgcaggtttcctagagagtaaaagtacaacttgcactcgttttttcaagaacctggctagtagctgtaccttggattcagccctcaatgctgcctcttactataacttcacagtcttaaaggttccaagaagcatgactgatccacagaatatggagttccaggttcctgtaatacttacctcacaggctaatgctcctctgttggctggaaacacttgtcagaatgtagtttctcaggtcacctatgagatagagaccaatgggacttttggaatccagaaagtttctgtcagtttgggacaaaccaacctgactgttgagccaggcgcttccttacagcaacacttcatccttcgcttcagggcttttcaacagagcacagctgcttctctcaccagtcctagaagtgggaatcctggctatatagttgggaagccactcttggctctgactgatgatataagttactcaatgaccctcttacagagccagggtaatggaagttgctctgttaaaagacatgaagtgcagtttggagtgaatgcaatatctggatgcaagctcaggttgaagaaggcagactgcagccacttgcagcaggagatttatcagactcttcatggaaggcccagaccagagtatgttgccatctttggtaatgctgacccagcccagaaaggagggtggaccaggatcctcaacaggcactgcagcatttcagctataaactgtacttcctgctgtctcataccagtttccctggagatccaggtattgtgggcatatgtaggtctcctgtccaacccgcaagctcatgtatcaggagttcgattcctataccagtgccagtctatacaggattctcagcaagttacagaagtatctttgacaactcttgtgaactttgtggacattacccagaagccacagcctccaaggggccaacccaaaatggactggaaatggccattcgacttctttcccttcaaagtggcattcagcagaggagtattctctcaaaaatgctcagtctctcccatccttatcctgtgcctcttactacttggagttctcaacctagagactatgtgaagaaaagaaaataatcagatttcagttttccctatgagaaactctgaggcagccacttatcttggctaaatagaacctcacctgctcatgaccagagagcatttaggataatagaggacctaactgaaggaatccttgtatatgaaaggagttattttagaaaagcaataaaaatattttattcatcata

SEQ ID NO: 440129 - DNA, 2597 bp, Homo sapiens
acggttgccaggcaacggaggcacggcccggcccgcgttaaggaggagggcgcagaccgaaggacactgaaagagctgtaacaaccccactttcgattggttgaagagctctcagccttctcatgagccaatgagaagaggcacgcggatggcgtcagacgctatgcgactcctcccacccacgctctggcaatgcgattggagaccgcggaggcctacgtcggacccggaggccctgaatgccccatgcgcaccccacagctcgcgctcctgcaagtgttctttctggtgttccccgatggcgtccggcctcagccctcttcctccccatcaggggcagtgcccacgtctttggagctgcagcgagggacggatggcggaaccctccagtccccttcagaggcgactgcaactcgcccggccgtgcctggactccctacagtggtccctactctcgtgactccctcggcccctgggaataggactgtggacctcttcccagtcttaccgatctgtgtctgtgacttgactcctggagcctgcgatataaattgctgctgcgacagggactgctatcttctccatccgaggacagttttctccttctgccttccaggcagcgtaaggtcttcaagctgggtttgtgtagacaactctgttatcttcaggagtaattccccgtttccttcaagagttttcatggattctaatggaatcaggcagttttgtgtccatgtgaacaactcaaacttaaactatttccagaagcttcaaaaggtcaatgcaaccaacttccaggccctggctgcagagtttggaggcgaatcattcacttcaacattccaaactcaatcaccaccatctttttacagggctggggaccccattcttacttacttccccaagtggtctgtaataagcttgctgagacaacctgcaggagttggagctgggggactctgtgctgaaagcaatcctgcaggtttcctagagagtaaaagtacaacttgcactcgttttttcaagaacctggctagtagctgtaccttggattcagccctcaatgctgcctcttactataacttcacagtcttaaaggttccaagaagcatgactgatccacagaatatggagttccaggttcctgtaatacttacctcacaggctaatgctcctctgttggctggaaacacttgtcagaatgtagtttctcaggtcacctatgagatagagaccaatgggacttttggaatccagaaagtttctgtcagtttgggacaaaccaacctgactgttgagccaggcgcttccttacagcaacacttcatccttcgcttcagggcttttcaacagagcacagctgcttctctcaccagtcctagaagtgggaatcctggctatatagttgggaagccactcttggctctgactgatgatataagttactcaatgaccctcttacagagccagggtaatggaagttgctctgttaaaagacatgaagtgcagtttggagtgaatgcaatatctggatgcaagctcaggttgaagaaggcagactgcagccacttgcagcaggagatttatcagactcttcatggaaggcccagaccagagtatgttgccatctttggtaatgctgacccagcccagaaaggagggtggaccaggatcctcaacaggcactgcagcatttcagattctcagcaagttacagaagtatctttgacaactcttgtgaactttgtggacattacccagaagccacagcctccaaggggccaacccaaaatggactggaaatggccattcgacttctttcccttcaaagtggcattcagcagaggagtattctctcaaaaatgctcagtctctcccatccttatcctgtgcctcttactacttggagttctcaacctagagactatgtgaagaaaagaaaataatcagatttcagttttccctatgagaaactctgaggcagccacttatcttggctaaatagaacctcacctgctcatgaccagagagcatttaggataatagaggacctaactgaaggaatccttgtatatgaaaggagttattttagaaaagcaataaaaatattttattcatcatagctctctgctttgggctctgcaggccaccagatacacatgaggcccctacttctcaagctgggaaggccaagagccttccttcagcctttctggttatgttacacctagctgaatgtttacaaggtctggatccatcagccctcaggcacagttgggccaagcagaaagagagaaacacttctgctgtcaccttgaatgaactcaggaatagcttccctctggactgtagaggagctaactgtttggaacagaaaactgctggctgttgattttgtctggttcctttgccaacatctgggcacaccctttgcccagacacgagtggggaaagcagttctttctcctcagtttccaaagtaaatggggaatcccagctttcttttctactagcaaatgaccctaccatttatttctgcctttttcttccgttcattgtgaggaaaaataaaactggttgagagctttgttgtacta

SEQ ID NO: 440130 - DNA, 2371 bp, Homo sapiens
acggttgccaggcaacggaggcacggcccggcccgcgttaaggaggagggcgcagaccgaaggacactgaaagagctgtaacaaccccactttcgattggttgaagagctctcagccttctcatgagccaatgagaagaggcacgcggatggcgtcagacgctatgcgactcctcccacccacgctctggcaatgcgattggagaccgcggaggcctacgtcggacccggaggccctgaatgccccatgcgcaccccacagctcgcgctcctgcaagtgttctttctggtgttccccgatggcgtccggcctcagccctcttcctccccatcaggggcagtgcccacgtctttggagctgcagcgagggacggatggcggaaccctccagtccccttcagaggcgactgcaactcgcccggccgtgcctggactccctacagtggtccctactctcgtgactccctcggcccctgggaataggactgtggacctcttcccagtcttaccgatctgtgtctgtgacttgactcctggagcctgcgatataaattgctgctgcgacagggactgctatcttctccatccgaggacagttttctccttctgccttccaggcagcgtaaggtcttcaagctgggtttgtgtagacaactctgttatcttcaggagtaattccccgtttccttcaagagttttcatggattctaatggaatcaggcagttttgtgtccatgtgaacaactcaaacttaaactatttccagaagcttcaaaaggtcaatgcaaccaacttccaggccctggctgcagagtttggaggcgaatcattcacttcaacattccaaactcaatcaccaccatctttttacagggctggggaccccattcttacttacttccccaagtggtctgtaataagcttgctgagacaacctgcaggagttggagctgggggactctgtgctgaaagcaatcctgcaggtttcctagagagtaaaagtacaacttgcactcgttttttcaagaacctggctagtagctgtaccttggattcagccctcaatgctgcctcttactataacttcacagtcttaaaggttccaagaagcatgactgatccacagaatatggagttccaggttcctgtaatacttacctcacaggctaatgctcctctgttggctggaaacacttgtcagaatgtagtttctcaggtcacctatgagatagagaccaatgggacttttggaatccagaaagtttctgtcagtttgggacaaaccaacctgactgttgagccaggcgcttccttacagcaacacttcatccttcgcttcagggcttttcaacagagcacagctgcttctctcaccagtcctagaagtgggaatcctggctatatagttgggaagccactcttggctctgactgatgatataagttactcaatgaccctcttacagagccagggtaatggaagttgctctgttaaaagacatgaagtgcagtttggagtgaatgcaatatctggatgcaagctcaggttgaagaaggcagactgcagccacttgcagcaggagatttatcagactcttcatggaaggcccagaccagagtatgttgccatctttggtaatgctgacccagcccagaaaggagggtggaccaggatcctcaacaggcactgcagcatttcagctataaactgtacttcctgctgtctcataccagtttccctggagatccaggtattgtgggcatatgtaggtctcctgtccaacccgcaagctcatgtatcaggagttcgattcctataccagtgccagtctatacaggtcggttattttcctcctacccccccactactctgccagtgtatttgcatcagattattaaatcagtattcaatgtttcatcatgatgtttatgtgaatatgcatgctgcggattctcagcaagttacagaagtatctttgacaactcttgtgaactttgtggacattacccagaagccacagcctccaaggggccaacccaaaatggactggaaatggccattcgacttctttcccttcaaagtggcattcagcagaggagtattctctcaaaaatgctcagtctctcccatccttatcctgtgcctcttactacttggagttctcaacctagagactatgtgaagaaaagaaaataatcagatttcagttttccctatgagaaactctgaggcagccacttatcttggctaaatagaacctcacctgctcatgaccagagagcatttaggataatagaggacctaactgaaggaatccttgtatatgaaaggagttattttagaaaagcaataaaaatattttattcatcata

SEQ ID NO: 440131 - DNA, 1595 bp, Homo sapiens
acggttgccaggcaacggaggcacggcccggcccgcgttaaggaggagggcgcagaccgaaggacactgaaagagctgtaacaaccccactttcgattggttgaagagctctcagccttctcatgagccaatgagaagaggcacgcggatggcgtcagacgctatgcgactcctcccacccacgctctggcaatgcgattggagaccgcggaggcctacgtcggacccggaggccctgaatgccccatgcgcaccccacagctcgcgctcctgcaagtgttctttctggtgttccccgatggcgtccggcctcagccctcttcctccccatcaggggcagtgcccacgtctttggagctgcagcgagggacggatggcggaaccctccagtccccttcagaggcgactgcaactcgcccggccgtgcctggactccctacagtggtccctactctcgtgactccctcggcccctgggaataggactgtggacctcttcccagtcttaccgatctgtgtctgtgacttgactcctggagcctgcgatataaattgctgctgcgacagggactgctatcttctccatccgaggacagttttctccttctgccttccaggcagcgtaaggtcttcaagctgggtttgtgtagacaactctgttatcttcaggagtaattccccgtttccttcaagagttttcatggattctaatggaatcaggcagttttgtgtccatgtgaacaactcaaacttaaactatttccagaagcttcaaaaggtcaatgcaaccaacttccaggccctggctgcagagtttggaggcgaatcattcacttcaacattccaaactcaatcaccaccatctttttacagggctggggaccccattcttacttacttccccaagtggtctgtaataagcttgctgagacaacctgcaggagttggagctgggggactctgtgctgaaagcaatcctgcaggtttcctagagagtaaaagtacaacttgcactcgttttttcaagaacctggctagtagctgtaccttggattcagccctcaatgctgcctcttactataacttcacagtcttaaaggttccaagaagcatgactgatccacagaatatggagttccaggttcctgtaatacttacctcacaggctaatggattctcagcaagttacagaagtatctttgacaactcttgtgaactttgtggacattacccagaagccacagcctccaaggggccaacccaaaatggactggaaatggccattcgacttctttcccttcaaagtggcattcagcagaggagtattctctcaaaaatgctcagtctctcccatccttatcctgtgcctcttactacttggagttctcaacctagagactatgtgaagaaaagaaaataatcagatttcagttttccctatgagaaactctgaggcagccacttatcttggctaaatagaacctcacctgctcatgaccagagagcatttaggataatagaggacctaactgaaggaatccttgtatatgaaaggagttattttagaaaagcaataaaaatattttattcatcata

SEQ ID NO: 440132 - DNA, 1717 bp, Homo sapiens
acggttgccaggcaacggaggcacggcccggcccgcgttaaggaggagggcgcagaccgaaggacactgaaagagctgtaacaaccccactttcgattggttgaagagctctcagccttctcatgagccaatgagaagaggcacgcggatggcgtcagacgctatgcgactcctcccacccacgctctggcaatgcgattggagaccgcggaggcctacgtcggacccggaggccctgaatgccccatgcgcaccccacagctcgcgctcctgcaagtgttctttctggtgttccccgatggcgtccggcctcagccctcttcctccccatcaggggcagtgcccacgtctttggagctgcagcgagggacggatggcggaaccctccagtccccttcagaggcgactgcaactcgcccggccgtgcctggactccctacagtggtccctactctcgtgactccctcggcccctgggaataggactgtggacctcttcccagtcttaccgatctgtgtctgtgacttgactcctggagcctgcgatataaattgctgctgcgacagggactgctatcttctccatccgaggacagttttctccttctgccttccaggcagcgtaaggtcttcaagctgggtttgtgtagacaactctgttatcttcaggagtaattccccgtttccttcaagagttttcatggattctaatggaatcaggcagttttgtgtccatgtgaacaactcaaacttaaactatttccagaagcttcaaaaggtcaatgcaaccaacttccaggccctggctgcagagtttggaggcgaatcattcacttcaacattccaaactcaatcaccaccatctttttacagggctggggaccccattcttacttacttccccaagtggtctgtaataagcttgctgagacaacctgcaggagttggagctgggggactctgtgctgaaagcaatcctgcaggtttcctagagagtaaaagtacaacttgcactcgttttttcaagaacctggctagtagctgtaccttggattcagccctcaatgctgcctcttactataacttcacagtcttaaaggttccaagaagcatgactgatccacagaatatggagttccaggttcctgtaatacttacctcacaggctaatgctcctctgttggctggaaacacttgtcagaatgtagtttctcaggtcacctatgagatagagaccaatgggacttttggaatccagaaagtttctgtcagtttgggacaaaccaacctgactgttgagccaggcgcttccttacagcaacacttcatccttcgcttcagggttagggcccttctcttataggggatttagaggggaagaaatattgggttagaaataatttctttgcttctgtaatacatgtgaaatagaataagaatatgaaggcctagttcagtctgtcgattgaggcctcaacatttaatattccataattttactacaagttgtggttattctacaagtctttactcattaaaattttctccaattctctgtctggcccccaacaaagcaggacttcaatctaaaatcaaaactttttttatagtcattttgaatcataaattcagccaacacctacaaaaattctttaactagctgttctcatatttctgggcagtcagcattttactcatttcccacttaatctgagtgt

SEQ ID NO: 440133 - DNA, 2070 bp, Homo sapiens
agcaggaattgcacaattaactcaataatgctgtgtgttctcaagaagctcccttagtgaggccgatcttaagatggccgattctgcccgttgaaggcatcctgggaaagaaaacaagcatcccagcgggcatctcaccacgacttctcctggagtcctcacatggccactcaatacccaaactctgcagccagggtctttttacagggctggggaccccattcttacttacttccccaagtggtctgtaataagcttgctgagacaacctgcaggagttggagctgggggactctgtgctgaaagcaatcctgcaggtttcctagagagtaaaagtacaacttgcactcgttttttcaagaacctggctagtagctgtaccttggattcagccctcaatgctgcctcttactataacttcacagtcttaaaggttccaagaagcatgactgatccacagaatatggagttccaggttcctgtaatacttacctcacaggctaatgctcctctgttggctggaaacacttgtcagaatgtagtttctcaggtcacctatgagatagagaccaatgggacttttggaatccagaaagtttctgtcagtttgggacaaaccaacctgactgttgagccaggcgcttccttacagcaacacttcatccttcgcttcagggcttttcaacagagcacagctgcttctctcaccagtcctagaagtgggaatcctggctatatagttgggaagccactcttggctctgactgatgatataagttactcaatgaccctcttacagagccagggtaatggaagttgctctgttaaaagacatgaagtgcagtttggagtgaatgcaatatctggatgcaagctcaggttgaagaaggcagactgcagccacttgcagcaggagatttatcagactcttcatggaaggcccagaccagagtatgttgccatctttggtaatgctgacccagcccagaaaggagggtggaccaggatcctcaacaggcactgcagcatttcagctataaactgtacttcctgctgtctcataccagtttccctggagatccaggtattgtgggcatatgtaggtctcctgtccaacccgcaagctcatgtatcaggagttcgattcctataccagtgccagtctatacaggattctcagcaagttacagaagtatctttgacaactcttgtgaactttgtggacattacccagaagccacagcctccaaggggccaacccaaaatggactggaaatggccattcgacttctttcccttcaaagtggcattcagcagaggagtattctctcaaaaatgctcagtctctcccatccttatcctgtgcctcttactacttggagttctcaacctagagactatgtgaagaaaagaaaataatcagatttcagttttccctatgagaaactctgaggcagccacttatcttggctaaatagaacctcacctgctcatgaccagagagcatttaggataatagaggacctaactgaaggaatccttgtatatgaaaggagttattttagaaaagcaataaaaatattttattcatcatagctctctgctttgggctctgcaggccaccagatacacatgaggcccctacttctcaagctgggaaggccaagagccttccttcagcctttctggttatgttacacctagctgaatgtttacaaggtctggatccatcagccctcaggcacagttgggccaagcagaaagagagaaacacttctgctgtcaccttgaatgaactcaggaatagcttccctctggactgtagaggagctaactgtttggaacagaaaactgctggctgttgattttgtctggttcctttgccaacatctgggcacaccctttgcccagacacgagtggggaaagcagttctttctcctcagtttccaaagtaaatggggaatcccagctttcttttctactagcaaatgaccctaccatttatttctgcctttttcttccgttcattgtgaggaaaaataaaactggttgagagctttgttgtacta

SEQ ID NO: 440134 - DNA, 1188 bp, Homo sapiens
acggttgccaggcaacggaggcacggcccggcccgcgttaaggaggagggcgcagaccgaaggacactgaaagagctgtaacaaccccactttcgattggttgaagagctctcagccttctcatgagccaatgagaagaggcacgcggatggcgtcagacgctatgcgactcctcccacccacgctctggcaatgcgattggagaccgcggaggcctacgtcggacccggaggccctgaatgccccatgcgcaccccacagctcgcgctcctgcaagtgttctttctggtgttccccgatggcgtccggcctcagccctcttcctccccatcaggggcagtgcccacgtctttggagctgcagcgagggacggatggcggaaccctccagtccccttcagaggcgactgcaactcgcccggccgtgcctggactccctacagtggtccctactctcgtgactccctcggcccctgggaataggactgtggacctcttcccagtcttaccgatctgtgtctgtgacttgactcctggagcctgcgatataaattgctgctgcgacagggactgctatcttctccatccgaggacagttttctccttctgccttccaggcagcgtaaggtcttcaagctgggtttgtgtagacaactctgttatcttcaggagtaattccccgtttccttcaagagttttcatggattctaatggaatcaggcagttttgtgtccatgtgaacaactcaaacttaaactatttccagaagcttcaaaaggtcaatgcaaccaacttccaggccctggctgcagagtttggaggcgaatcattcacttcaacattccaaactcaatcaccaccatctttttacagggctggggaccccattcttacttacttccccaagtggtctgtaataagcttgctgagacaacctgcaggagttggagctgggggactctgtgctgaaagcaatcctgcaggtttcctagagagtaaaagtacaacttgcactcgttttttcaagaacctggctagtagctgtaccttggattcagccctcaatgctgcctcttactataacttcacagtcttaaaggttccaagaagcatgactgatccacagaatatggagttccaggttcctgtaatacttacctcacatggccactcaataccgggaaccgag

SEQ ID NO: 440135 - DNA, 1067 bp, Homo sapiens
  misc_feature (1005)..(1005): n is a, c, g, or t
  misc_feature (1013)..(1013): n is a, c, g, or t
acggttgccaggcaacggaggcacggcccggcccgcgttaaggaggagggcgcagaccgaaggacactgaaagagctgtaacaaccccactttcgattggttgaagagctctcagccttctcatgagccaatgagaagaggcacgcggatggcgtcagacgctatgcgactcctcccacccacgctctggcaatgcgattggagaccgcggaggcctacgtcggacccggaggccctgaatgccccatgcgcaccccacagctcgcgctcctgcaagtgttctttctggtgttccccgatggcgtccggcctcagccctcttcctccccatcaggggcagtgcccacgtctttggagctgcagcgagggacggatggcggaaccctccagtccccttcagaggcgactgcaactcgcccggccgtgcctggactccctacagtggtccctactctcgtgactccctcggcccctgggaataggactgtggacctcttcccagtcttaccgatctgtgtctgtgacttgactcctggagcctgcgatataaattgctgctgcgacagggactgctatcttctccatccgaggacagttttctccttctgccttccaggcagcgtaaggtcttcaagctgggtttgtgtagacaactctgttatcttcaggagtaattccccgtttccttcaagagttttcatggattctaatggaatcaggcagttttgtgtccatgtgaacaactcaaacttaaactatttccagaagcttcaaaaggtcaatgcaaccaacttccaggccctggctgcagagtttggaggcgaatcattcacttcaacattccaaactcaatcaccaccatctttttacagggctggggaccccattcttacttacttccccaagtggtctgtaataagcttgctgagacaacctgcaggagttggagctgggggggaacttttgtgcttgaaaagccaaatccttgcaagggttttcccttanaagaagtnaaaaagttcccaaacctttggcaccttcggtttttttttcaaaaaaaaccccaa

SEQ ID NO: 440136 - DNA, 208 bp, Homo sapiens
gcggccgcctactactactactgctcgaattcaagcttctaacgatgtacggggacatgaaatgatacctaatttgtttttcttttctcttcatttttactcttaatctagtaggtctcattttgccaagtcactgtctgggaatttaagtggcaaatactttctttgtctcagctaattaaactctaaaattattagcaacaaaaaa

SEQ ID NO: 440137 - DNA, 2518 bp, Homo sapiens
  misc_feature (4)..(4): n is a, c, g, or t
ggcncgagtgacaattaaagatggctgcgcccatgtaacatcactagcgaccggtgacctctttttcccccttgcctggctcctgtggtggcaggctgggcacgaggaccatgctgggccggagcctccgagaagtttctgcggcactgaaacaaggccaaattacaccaacagagctctgtcaaaaatgtctctctcttatcaagaagaccaagtttctaaatgcctacattactgtgtcagaagaggtggccttaaaacaagctgaagaatcagaaaagagatataagaatggacagtcacttggggatttagatggaattcctattgcagtaaaagacaatttcagcacttctggcattgagacaacatgtgcatcaaatatgctgaaaggttatataccaccttataatgctacagtagttcagaagttgttggatcagggagctctactaatgggaaaaacaaatttagatgagtttgctatgggatctgggagcacagatggtgtatttggaccagttaaaaacccctggagttattcaaaacaatatagagaaaagaggaagcagaatccccacagcgagaatgaagattcagactggctgataactggaggaagctcaggtgggagtgcagctgctgtatcggcgttcacatgctacgcggctttaggatcagatacaggaggatcgaccagaaatcctgctgcccactgtgggcttgttggtttcaaaccaagctatggcttagtttcccgtcatggtctcattcccctggtgaattcgatggatgtgccaggaatcttaaccagatgtgtggatgatgcagcaattgtgttgggtgcactggccggacctgaccccagggactctaccacagtacatgaacctattaataaaccattcatgcttcccagtttggcagatgtgagcaaactatgtataggaattccaaaggtaactttttcctttcattactttacagaaatactgtcaagtccaatagagagcacagacttgggaggcggattgggtgggtttgaatctctgctctgccacttttattaatcatgtgagttgagtatgtgacttaatctcttttagctcaatttccccatctgtaaaataggaataataaaaatactgacttcagagaggtttgtgaggatcaattagacagtcatgttaagtctgtaaattgtttctgtaatgggcaagatagcaaatattttagattttgtggaccatgcagtctttatcataactgcttaactgccattatagtgagaaagcagccacagacaatatgtaaatgaaaaagtgtgtctctgttccaataaaactttattttcaaaaaccagctggcttgtcacatctggcctatgggccatagtttgcccatccctaatgtaaagaaaggactttagcccaaagccacaacttgcatagtaatgcctcaaaaaatgttaacatctttactgttattattattactactgcatctattacagtagcaattgagtaatgaatacatgaatgttataatgttaaattactaaccttttaaaaatattaagcattgcaatatattaatactttaaatcttttaggaagataagttaccctgcagaataatgaagtttcacaacctcagcactgttggtgtttggggctggtaattgtttgttgtgggagactgtcctgtgcattgtaagatgtttagtagcatccctggcctctacccctacatgcaagtagtaccccaccaccaaaaccacaatcccacaaccaaaaatgtctgcagacattgtcaagtgtctcctggttagggaaaaggagacaaaagtaacccccaggtaagaccactgctatagagaaatactaccttatttaaaatcttccattaaggtaatatatgtaaggccaggtgcgtacacctgtaatcccagcaccttgggaagccaaggcaggaggatcgcttgagatcaggagtttgagaccagcctgggcaacatacagagccctatgtctacaaaaagttttaaaaaaattgtggggtgtggtggtgtgcacctgtggtcctagctgtttgggaggctgaggggggaggattgcttgagtccaggaggttgagactgccgtgagccatgattgcaccactgcactccaccctaggtgacagagcaagaccctatctcaaaaaaaaaaaaaaaaaagaaggcaatatctgtgcattctttttaagcatttatttatagagagcataggctttaaaacagacccagtttgaaatcctagaccctctacttacctgctatttaacattaggaaaataacttcttatgtcaagatttttcattaacaaaatgaaggattataatacctacatcacaggcttgttaaaagcatgagatgagagagaatctttgaaaatcatctaacaggctgggcacggtggctcacgcctgtaatcccagcactttgggaggccgaggcgggcagatcacgaggtcagg

SEQ ID NO: 440138 - DNA, 854 bp, Homo sapiens
gtgggtgcctgtagtcccagctactcggaaggctaaggcaggagaatggcgtgaacccaggaggcggagcctgcagtgagctgagattgcgccactgcactccagcctgggcgacagagtgagactccgtctcaaaaaaaaaaaaaagaaaatcatctaacagggtacctgatacatgagcatttaacatatatgctgatatatgctgatatgctgttaggttcctgatacataatgagcatttaacaaatattttccccaaccagatctccaatctttaatgttgttatatccagatcataatatctagtactgtgctttgtcataccataaacactctgaaatggatttagtctttctagctacctaccagcaattttatcctattttctaatgtattaccaaaggtcctgaagtacagatttttataaaatcatctatacagatgaagtacaaatttttataaaataatctatacagttccaattttgtatcttgactttttgctataaggaatatcttgtaccggaattatcaagtgaagtacagtctctttggtccaaagctgctgacctctttgagtctgagggggccaaagtaattgaagtatcccttccgtacactctagttccctctatttgtttgtttaagcagctaaaacatttatctattgcctctcccattccaagcattataaataataaagcatttgttatagattgaactatacatgagtgtcttccaaaggccgtattctgacattccggtgaagaccgtgatcacgtctgagggggttacacataatgtacgaacaacaaaggatgaggctagataggggaacgatagcgatcccc

SEQ ID NO: 440139 - DNA, 4114 bp, Homo sapiens
  misc_feature (4)..(4): n is a, c, g, or t
ggcncgagtgacaattaaagatggctgcgcccatgtaacatcactagcgaccggtgacctctttttcccccttgcctggctcctgtggtggcaggctgggcacgaggaccatgctgggccggagcctccgagaagtttctgcggcactgaaacaaggccaaattacaccaacagagctctgtcaaaaatgtctctctcttatcaagaagaccaagtttctaaatgcctacattactgtgtcagaagaggtggccttaaaacaagctgaagaatcagaaaagagatataagaatggacagtcacttggggatttagatggaattcctattgcagtaaaagacaatttcagcacttctggcattgagacaacatgtgcatcaaatatgctgaaaggttatataccaccttataatgctacagtagttcagaagttgttggatcagggagctctactaatgggaaaaacaaatttagatgagtttgctatgggatctgggagcacagatggtgtatttggaccagttaaaaacccctggagttattcaaaacaatatagagaaaagaggaagcagaatccccacagcgagaatgaagattcagactggctgataactggaggaagctcaggtgggagtgcagctgctgtatcggcgttcacatgctacgcggctttaggatcagatacaggaggatcgaccagaaatcctgctgcccactgtgggcttgttggtttcaaaccaagctatggcttagtttcccgtcatggtctcattcccctggtgaattcgatggatgtgccaggaatcttaaccagatgtgtggatgatgcagcaattgtgttgggtgcactggccggacctgaccccagggactctaccacagtacatgaacctattaataaaccattcatgcttcccagtttggcagatgtgagcaaactatgtataggaattccaaaggaatatcttgtaccggaattatcaagtgaagtacagtctctttggtccaaagctgctgacctctttgagtctgagggggccaaagtaattgaagtatcccttcctcacaccagttattcaattgtctgctaccatgtattgtgcacatcagaagtggcatcgaatatggcaagatttgatgggctacaatatggtcacagatgtgacattgatgtgtccactgaagccatgtatgctgcaaccagacgagaagggtttaatgatgtggtgagaggaagaattctctcaggaaactttttcttattaaaagaaaactatgaaaattattttgtcaaagcacagaaagtgagacgcctcattgctaatgactttgtaaatgcttttaactctggagtagatgtcttgctaactcccaccaccttgagtgaggcagtaccatacttggagttcatcaaagaggacaacagaacccgaagtgcccaggatgatatttttacacaagctgtaaatatggcaggattgccagcagtgagtatccctgttgcactctcaaaccaagggttgccaataggactgcagtttattggacgtgcgttttgtgaccagcagcttcttacagtagccaaatggtttgaaaaacaagtacagtttcctgttattcaacttcaagaactcatggatgattgttcagcagtccttgaaaatgaaaagttagcctctgtctctctaaaacagtaaacatatcttacaaattaaaatgacttttaggctgggtgcagtggctcacacctgtaatcccagcactttgggaggccaaggcgagcggatcatgaggtcagaagatctagaacagcctggtcaacatggtgaaaccccgtctctactaaaaatacaaaaattagccaggcttagtggcgggcatctgtagtcccagctactcaggaggctgaggcaggagaatcacttgaaccctggaggtggaggttgcagtgagccgagatcatgccactgcactgcactccagcctgggtgacaaagcaagactgtgtctcaaaataaataaataaaataaaataaaatgacgtacagagattctatattctagagagtcaaatggtcttgctcaattcttgtaattaggttcttgttaatacagtcattccatggaattactttttaaaattcctgtgacaattaataataaataacgtgtcagcatttagtaagcatccactaagtgtacaatacttctacaataacacaagatacctgttcctcaaagacaatgcattctgccataatgttcattaaagagtttacagtaaaaataagattagggataaacttctcaaaaattgtacatctgtgtaactaaagcactaacaaaaacatgaatagtccttctagaggtaacttggatagcctaggcaggcaacttatcatgtggtgaaggccgcctcaggggttgttaaaaatgcacagaaacaattgagtgcgattattggcttctgagcgctgagcagagcaggtggaagaggaactttgagcacaggaggaaatgcaaccagtcagggcccagaatcatgcaaatctcaggggtatgcctctctggggaggagctccacttgcagggactccttttatttccctaagaaagagctgaaatgactgagaactttcctttcctccttagagttacaattttacttctgctattccggagcccatgcctagaagccagaacaactccatgttacactgagttcatgctcctatttactgatcacaaatgagctcattaatgtcatcgaaacatttattgtaacctaacagaccatcacagattggaaacttggtagatagcagagcatggtattagtgaaaaaggttcaaaatacacaagtaacatacactctgaaaaacatgcagataatttgctgatgaagcagaagaggggatgcgcatggcaagaacttgccttaccccagattctctatatctcatggtttccttttcctcttgactgtctttacgagtgttttttatttgggaccctcgagcccagagatattaatggatatctgtattcaatatttgacaaaatctaatggaaaccatccatttactcatgataaggcttcatcactggatttctgtgtcttcactagaacaccattgtcatctcatattgatcaggtattttaatctagcacttacatattgttgataaatgaaagctgaattgttacttaataaattcactttgtttagtaaaaaaaaattgttttctaaatatgacgttcatgaagagaaaataatgagtcagaatcatctgcagaaccactggaatgtttcatcgtcacctgttagttttcataaacagttttctgtcctctctgagatcctcccgctcccaaatactcaacctgattaacttcacataaaagtcttatgtgccaggcttagtaatattcctatagattttgactctgaatccctgaaagaggaagaaatccatgagagaaaattgcattactttatagcaagaggaaaccgttttaagttttttaattgctcagacaccacaacatcctagatggaggaaaccattttagttgaaggagcaaatatgatgtcaaaagcaagtaaataaacaaaccgttgccccaatctgtttttatgtaatgaatttaaaaaaaaagagagagagagagagatgggctctccctgtgttgcccaggctagtctcaaactcctgggctcaagtgatctgcctccctcagcctcccaaagtgctgagattaaagacgtgagccaccacacctggccgaaataataatattcaatattatatattcaatgatattattcagtattcaatattatttcaaataatattaaatctcttgttcctgtatctctacatgagctgcactaataatttgaatctggaaattaaaaagtgaaacatttaccgttctcatatactgatacccaactaccatgaaatgatacctaatttgtttttcttttctcttcatttttactcttaatctagtaggtctcattttgccaagtcactgtctgggaatttaagtggcaaatactttctttgtctcagctaattaaactctaaaattattagcaacaaaaaa

SEQ ID NO: 440140 - DNA, 2097 bp, Homo sapiens
  misc_feature (4)..(4): n is a, c, g, or t
ggcncgagtgacaattaaagatggctgcgcccatgtaacatcactagcgaccggtgacctctttttcccccttgcctggctcctgtggtggcaggctgggcacgaggaccatgctgggccggagcctccgagaagtttctgcggcactgaaacaaggccaaattacaccaacagagctctgtcaaaaatgtctctctcttatcaagaagaccaagtttctaaatgcctacattactgtgtcagaagaggtggccttaaaacaagctgaagaatcagaaaagagatataagaatggacagtcacttggggatttagatggaattcctattgcagtaaaagacaatttcagcacttctggcattgagacaacatgtgcatcaaatatgctgaaaggttatataccaccttataatgctacagtagttcagaagttgttggatcagggagctctactaatgggaaaaacaaatttagatgagtttgctatgggatctgggagcacagatggtgtatttggaccagttaaaaacccctggagttattcaaaacaatatagagaaaagaggaagcagaatccccacagcgagaatgaagattcagactggctgataactggaggaagctcaggtgggagtgcagctgctgtatcggcgttcacatgctacgcggctttaggatcagatacaggaggatcgaccagaaatcctgctgcccactgtgggcttgttggtttcaaaccaagctatggcttagtttcccgtcatggtctcattcccctggtgaattcgatggatgtgccaggaatcttaaccagatgtgtggatgatgcagcaattgtgttgggtgcactggccggacctgaccccagggactctaccacagtacatgaacctattaataaaccattcatgcttcccagtttggcagatgtgagcaaactatgtataggaattccaaaggaatatcttgtaccggaattatcaagtgaagtacagtctctttggtccaaagctgctgacctctttgagtctgagggggccaaagtaattgaagtatcccttcctcacaccagttattcaattgtctgctaccatgtattgtgcacatcagaagtggcatcgaatatggcaagatttgatgggctacaatatggtcacagatgtgacattgatgtgtccactgaagccatgtatgctgcaaccagacgagaagggtttaatgatgtggtgagaggaagaattctctcaggaaactttttcttattaaaagaaaactatgaaaattattttgtcaaagcacagaaagtgagacgcctcattgctaatgactttgtaaatgcttttaactctggagtagatgtcttgctaactcccaccaccttgagtgaggcagtaccatacttggagttcatcaaagaggacaacagaacccgaagtgcccaggatgatatttttacacaagctgtaaatatggcaggattgccagcagtgagtatccctgttgcactctcaaaccaagggttgccaataggactgcagtttattggacgtgcgttttgtgaccagcagcttcttacagtagccaaatggtttgaaaaacaagtacagtttcctgttattcaacttcaagaactcatggatgattgttcagcagtccttgaaaatgaaaagttagcctctgtctctctaaaacagtaaacatatcttacaaattaaaatgacttttaggctgggtgcagtggctcacacctgtaatcccagcactttgggaggccaaggcgagcggatcatgaggtcagaagatctagaacagcctggtcaacatggtgaaaccccgtctctactaaaaatacaaaaattagccaggcttagtggcgggcatctgtagtcccagctactcaggaggctgaggcaggagaatcacttgaaccctggaggtggaggttgcagtgagccgagatcatgccactgcactgcactccagcctgggtgacaaagcaagactgtgtctcaaaataaataaataaaataaaataatcccggatgcggcaagaaacccattgtggcgactcgcgacgttgattgatagtggatattg

SEQ ID NO: 440141 - DNA, 3752 bp, Homo sapiens
ttgtcatccacgctggaatgcaatggtgcgatctcggctcgctgcagcctccgcctcccagcttcaagcgattctcctgactcagcctcccaagtagctgggactacaggcatgccccaccattcccaatctgggagcacagatggtgtatttggaccagttaaaaacccctggagttattcaaaacaatatagagaaaagaggaagcagaatccccacagcgagaatgaagattcagactggctgataactggaggaagctcaggtgggagtgcagctgctgtatcggcgttcacatgctacgcggctttaggatcagatacaggaggatcgaccagaaatcctgctgcccactgtgggcttgttggtttcaaaccaagctatggcttagtttcccgtcatggtctcattcccctggtgaattcgatggatgtgccaggaatcttaaccagatgtgtggatgatgcagcaattgtgttgggtgcactggccggacctgaccccagggactctaccacagtacatgaacctattaataaaccattcatgcttcccagtttggcagatgtgagcaaactatgtataggaattccaaaggaatatcttgtaccggaattatcaagtgaagtacagtctctttggtccaaagctgctgacctctttgagtctgagggggccaaagtaattgaagtatcccttcctcacaccagttattcaattgtctgctaccatgtattgtgcacatcagaagtggcatcgaatatggcaagatttgatgggctacaatatggtcacagatgtgacattgatgtgtccactgaagccatgtatgctgcaaccagacgagaagggtttaatgatgtggtgagaggaagaattctctcaggaaactttttcttattaaaagaaaactatgaaaattattttgtcaaagcacagaaagtgagacgcctcattgctaatgactttgtaaatgcttttaactctggagtagatgtcttgctaactcccaccaccttgagtgaggcagtaccatacttggagttcatcaaagaggacaacagaacccgaagtgcccaggatgatatttttacacaagctgtaaatatggcaggattgccagcagtgagtatccctgttgcactctcaaaccaagggttgccaataggactgcagtttattggacgtgcgttttgtgaccagcagcttcttacagtagccaaatggtttgaaaaacaagtacagtttcctgttattcaacttcaagaactcatggatgattgttcagcagtccttgaaaatgaaaagttagcctctgtctctctaaaacagtaaacatatcttacaaattaaaatgacttttaggctgggtgcagtggctcacacctgtaatcccagcactttgggaggccaaggcgagcggatcatgaggtcagaagatctagaacagcctggtcaacatggtgaaaccccgtctctactaaaaatacaaaaattagccaggcttagtggcgggcatctgtagtcccagctactcaggaggctgaggcaggagaatcacttgaaccctggaggtggaggttgcagtgagccgagatcatgccactgcactgcactccagcctgggtgacaaagcaagactgtgtctcaaaataaataaataaaataaaataaaatgacgtacagagattctatattctagagagtcaaatggtcttgctcaattcttgtaattaggttcttgttaatacagtcattccatggaattactttttaaaattcctgtgacaattaataataaataacgtgtcagcatttagtaagcatccactaagtgtacaatacttctacaataacacaagatacctgttcctcaaagacaatgcattctgccataatgttcattaaagagtttacagtaaaaataagattagggataaacttctcaaaaattgtacatctgtgtaactaaagcactaacaaaaacatgaatagtccttctagaggtaacttggatagcctaggcaggcaacttatcatgtggtgaaggccgcctcaggggttgttaaaaatgcacagaaacaattgagtgcgattattggcttctgagcgctgagcagagcaggtggaagaggaactttgagcacaggaggaaatgcaaccagtcagggcccagaatcatgcaaatctcaggggtatgcctctctggggaggagctccacttgcagggactccttttatttccctaagaaagagctgaaatgactgagaactttcctttcctccttagagttacaattttacttctgctattccggagcccatgcctagaagccagaacaactccatgttacactgagttcatgctcctatttactgatcacaaatgagctcattaatgtcatcgaaacatttattgtaacctaacagaccatcacagattggaaacttggtagatagcagagcatggtattagtgaaaaaggttcaaaatacacaagtaacatacactctgaaaaacatgcagataatttgctgatgaagcagaagaggggatgcgcatggcaagaacttgccttaccccagattctctatatctcatggtttccttttcctcttgactgtctttacgagtgttttttatttgggaccctcgagcccagagatattaatggatatctgtattcaatatttgacaaaatctaatggaaaccatccatttactcatgataaggcttcatcactggatttctgtgtcttcactagaacaccattgtcatctcatattgatcaggtattttaatctagcacttacatattgttgataaatgaaagctgaattgttacttaataaattcactttgtttagtaaaaaaaaattgttttctaaatatgacgttcatgaagagaaaataatgagtcagaatcatctgcagaaccactggaatgtttcatcgtcacctgttagttttcataaacagttttctgtcctctctgagatcctcccgctcccaaatactcaacctgattaacttcacataaaagtcttatgtgccaggcttagtaatattcctatagattttgactctgaatccctgaaagaggaagaaatccatgagagaaaattgcattactttatagcaagaggaaaccgttttaagttttttaattgctcagacaccacaacatcctagatggaggaaaccattttagttgaaggagcaaatatgatgtcaaaagcaagtaaataaacaaaccgttgccccaatctgtttttatgtaatgaatttaaaaaaaaagagagagagagagagatgggctctccctgtgttgcccaggctagtctcaaactcctgggctcaagtgatctgcctccctcagcctcccaaagtgctgagattaaagacgtgagccaccacacctggccgaaataataatattcaatattatatattcaatgatattattcagtattcaatattatttcaaataatattaaatctcttgttcctgtatctctacatgagctgcactaataatttgaatctggaaattaaaaagtgaaacatttaccgttctcatatactgatacccaactaccatgaaatgatacctaatttgtttttcttttctcttcatttttactcttaatctagtaggtctcattttgccaagtcactgtctgggaatttaagtggcaaatactttctttgtctcagctaattaaactctaaaattattagcaacaaaaaa

SEQ ID NO: 440142 - DNA, 3349 bp, Homo sapiens
ccggcacgaggctgcggtcggtacggccagtgcacccaggactctaccacagtacatgaatggtttattaataggttcatgtactgtggtagagtccctggggtcaggtccggccagtacatgaacctattaataaaccattcatgcttcccagtttggcagatgtgagcaaactatgtataggaattccaaaggaatatcttgtaccggaattatcaagtgaagtacagtctctttggtccaaagctgctgacctctttgagtctgagggggccaaagtaattgaagtatcccttcctcacaccagttattcaattgtctgctaccatgtattgtgcacatcagaagtggcatcgaatatggcaagatttgatgggctacaatatggtcacagatgtgacattgatgtgtccactgaagccatgtatgctgcaaccagacgagaagggtttaatgatgtggtgagaggaagaattctctcaggaaactttttcttattaaaagaaaactatgaaaattattttgtcaaagcacagaaagtgagacgcctcattgctaatgactttgtaaatgcttttaactctggagtagatgtcttgctaactcccaccaccttgagtgaggcagtaccatacttggagttcatcaaagaggacaacagaacccgaagtgcccaggatgatatttttacacaagctgtaaatatggcaggattgccagcagtgagtatccctgttgcactctcaaaccaagggttgccaataggactgcagtttattggacgtgcgttttgtgaccagcagcttcttacagtagccaaatggtttgaaaaacaagtacagtttcctgttattcaacttcaagaactcatggatgattgttcagcagtccttgaaaatgaaaagttagcctctgtctctctaaaacagtaaacatatcttacaaattaaaatgacttttaggctgggtgcagtggctcacacctgtaatcccagcactttgggaggccaaggcgagcggatcatgaggtcagaagatctagaacagcctggtcaacatggtgaaaccccgtctctactaaaaatacaaaaattagccaggcttagtggcgggcatctgtagtcccagctactcaggaggctgaggcaggagaatcacttgaaccctggaggtggaggttgcagtgagccgagatcatgccactgcactgcactccagcctgggtgacaaagcaagactgtgtctcaaaataaataaataaaataaaataaaatgacgtacagagattctatattctagagagtcaaatggtcttgctcaattcttgtaattaggttcttgttaatacagtcattccatggaattactttttaaaattcctgtgacaattaataataaataacgtgtcagcatttagtaagcatccactaagtgtacaatacttctacaataacacaagatacctgttcctcaaagacaatgcattctgccataatgttcattaaagagtttacagtaaaaataagattagggataaacttctcaaaaattgtacatctgtgtaactaaagcactaacaaaaacatgaatagtccttctagaggtaacttggatagcctaggcaggcaacttatcatgtggtgaaggccgcctcaggggttgttaaaaatgcacagaaacaattgagtgcgattattggcttctgagcgctgagcagagcaggtggaagaggaactttgagcacaggaggaaatgcaaccagtcagggcccagaatcatgcaaatctcaggggtatgcctctctggggaggagctccacttgcagggactccttttatttccctaagaaagagctgaaatgactgagaactttcctttcctccttagagttacaattttacttctgctattccggagcccatgcctagaagccagaacaactccatgttacactgagttcatgctcctatttactgatcacaaatgagctcattaatgtcatcgaaacatttattgtaacctaacagaccatcacagattggaaacttggtagatagcagagcatggtattagtgaaaaaggttcaaaatacacaagtaacatacactctgaaaaacatgcagataatttgctgatgaagcagaagaggggatgcgcatggcaagaacttgccttaccccagattctctatatctcatggtttccttttcctcttgactgtctttacgagtgttttttatttgggaccctcgagcccagagatattaatggatatctgtattcaatatttgacaaaatctaatggaaaccatccatttactcatgataaggcttcatcactggatttctgtgtcttcactagaacaccattgtcatctcatattgatcaggtattttaatctagcacttacatattgttgataaatgaaagctgaattgttacttaataaattcactttgtttagtaaaaaaaaattgttttctaaatatgacgttcatgaagagaaaataatgagtcagaatcatctgcagaaccactggaatgtttcatcgtcacctgttagttttcataaacagttttctgtcctctctgagatcctcccgctcccaaatactcaacctgattaacttcacataaaagtcttatgtgccaggcttagtaatattcctatagattttgactctgaatccctgaaagaggaagaaatccatgagagaaaattgcattactttatagcaagaggaaaccgttttaagttttttaattgctcagacaccacaacatcctagatggaggaaaccattttagttgaaggagcaaatatgatgtcaaaagcaagtaaataaacaaaccgttgccccaatctgtttttatgtaatgaatttaaaaaaaaagagagagagagagagatgggctctccctgtgttgcccaggctagtctcaaactcctgggctcaagtgatctgcctccctcagcctcccaaagtgctgagattaaagacgtgagccaccacacctggccgaaataataatattcaatattatatattcaatgatattattcagtattcaatattatttcaaataatattaaatctcttgttcctgtatctctacatgagctgcactaataatttgaatctggaaattaaaaagtgaaacatttaccgttctcatatactgatacccaactaccatgaaatgatacctaatttgtttttcttttctcttcatttttactcttaatctagtaggtctcattttgccaagtcactgtctgggaatttaagtggcaaatactttctttgtctcagctaattaaactctaaaattattagcaacaaaaaa

SEQ ID NO: 440143 - DNA, 2883 bp, Homo sapiens
  misc_feature (26)..(26): n is a, c, g, or t
  misc_feature (39)..(39): n is a, c, g, or t
cctagtcggcactgactctcttaatntccaccgctacanaaactatgaaaattattttgtcaaagcacagaaagtgagacgcctcattgctaatgactttgtaaatgcttttaactctggagtagatgtcttgctaactcccaccaccttgagtgaggcagtaccatacttggagttcatcaaagaggacaacagaacccgaagtgcccaggatgatatttttacacaagctgtaaatatggcaggattgccagcagtgagtatccctgttgcactctcaaaccaagggttgccaataggactgcagtttattggacgtgcgttttgtgaccagcagcttcttacagtagccaaatggtttgaaaaacaagtacagtttcctgttattcaacttcaagaactcatggatgattgttcagcagtccttgaaaatgaaaagttagcctctgtctctctaaaacagtaaacatatcttacaaattaaaatgacttttaggctgggtgcagtggctcacacctgtaatcccagcactttgggaggccaaggcgagcggatcatgaggtcagaagatctagaacagcctggtcaacatggtgaaaccccgtctctactaaaaatacaaaaattagccaggcttagtggcgggcatctgtagtcccagctactcaggaggctgaggcaggagaatcacttgaaccctggaggtggaggttgcagtgagccgagatcatgccactgcactgcactccagcctgggtgacaaagcaagactgtgtctcaaaataaataaataaaataaaataaaatgacgtacagagattctatattctagagagtcaaatggtcttgctcaattcttgtaattaggttcttgttaatacagtcattccatggaattactttttaaaattcctgtgacaattaataataaataacgtgtcagcatttagtaagcatccactaagtgtacaatacttctacaataacacaagatacctgttcctcaaagacaatgcattctgccataatgttcattaaagagtttacagtaaaaataagattagggataaacttctcaaaaattgtacatctgtgtaactaaagcactaacaaaaacatgaatagtccttctagaggtaacttggatagcctaggcaggcaacttatcatgtggtgaaggccgcctcaggggttgttaaaaatgcacagaaacaattgagtgcgattattggcttctgagcgctgagcagagcaggtggaagaggaactttgagcacaggaggaaatgcaaccagtcagggcccagaatcatgcaaatctcaggggtatgcctctctggggaggagctccacttgcagggactccttttatttccctaagaaagagctgaaatgactgagaactttcctttcctccttagagttacaattttacttctgctattccggagcccatgcctagaagccagaacaactccatgttacactgagttcatgctcctatttactgatcacaaatgagctcattaatgtcatcgaaacatttattgtaacctaacagaccatcacagattggaaacttggtagatagcagagcatggtattagtgaaaaaggttcaaaatacacaagtaacatacactctgaaaaacatgcagataatttgctgatgaagcagaagaggggatgcgcatggcaagaacttgccttaccccagattctctatatctcatggtttccttttcctcttgactgtctttacgagtgttttttatttgggaccctcgagcccagagatattaatggatatctgtattcaatatttgacaaaatctaatggaaaccatccatttactcatgataaggcttcatcactggatttctgtgtcttcactagaacaccattgtcatctcatattgatcaggtattttaatctagcacttacatattgttgataaatgaaagctgaattgttacttaataaattcactttgtttagtaaaaaaaaattgttttctaaatatgacgttcatgaagagaaaataatgagtcagaatcatctgcagaaccactggaatgtttcatcgtcacctgttagttttcataaacagttttctgtcctctctgagatcctcccgctcccaaatactcaacctgattaacttcacataaaagtcttatgtgccaggcttagtaatattcctatagattttgactctgaatccctgaaagaggaagaaatccatgagagaaaattgcattactttatagcaagaggaaaccgttttaagttttttaattgctcagacaccacaacatcctagatggaggaaaccattttagttgaaggagcaaatatgatgtcaaaagcaagtaaataaacaaaccgttgccccaatctgtttttatgtaatgaatttaaaaaaaaagagagagagagagagatgggctctccctgtgttgcccaggctagtctcaaactcctgggctcaagtgatctgcctccctcagcctcccaaagtgctgagattaaagacgtgagccaccacacctggccgaaataataatattcaatattatatattcaatgatattattcagtattcaatattatttcaaataatattaaatctcttgttcctgtatctctacatgagctgcactaataatttgaatctggaaattaaaaagtgaaacatttaccgttctcatatactgatacccaactaccatgaaatgatacctaatttgtttttcttttctcttcatttttactcttaatctagtaggtctcattttgccaagtcactgtctgggaatttaagtggcaaatactttctttgtctcagctaattaaactctaaaattattagcaacaaaaaa

SEQ ID NO: 440144 - DNA, 1543 bp, Homo sapiens
  misc_feature (4)..(4): n is a, c, g, or t
ggcncgagtgacaattaaagatggctgcgcccatgtaacatcactagcgaccggtgacctctttttcccccttgcctggctcctgtggtggcaggctgggcacgaggaccatgctgggccggagcctccgagaagtttctgcggcactgaaacaaggccaaattacaccaacagagctctgtcaaaaatgtctctctcttatcaagaagaccaagtttctaaatgcctacattactgtgtcagaagaggtggccttaaaacaagctgaagaatcagaaaagagatataagaatggacagtcacttggggatttagatggaattcctattgcagtaaaagacaatttcagcacttctggcattgagacaacatgtgcatcaaatatgctgaaaggttatataccaccttataatgctacagtagttcagaagttgttggatcagggagctctactaatgggaaaaacaaatttagatgagtttgctatgggatctgggagcacagatggtgtatttggaccagttaaaaacccctggagttattcaaaacaatatagagaaaagaggaagcagaatccccacagcgagaatgaagattcagactggctgataactggaggaagctcaggtgggagtgcagctgctgtatcggcgttcacatgctacgcggctttaggatcagatacaggaggatcgaccagaaatcctgctgcccactgtgggcttgttggtttcaaaccaagctatggcttagtttcccgtcatggtctcattcccctggtgaattcgatggatgtgccaggaatcttaaccagatgtgtggatgatgcagcaattgtgttgggtgcactggccggacctgaccccagggactctaccacagtacatgaacctattaataaaccattcatgcttcccagtttggcagatgtgagcaaactatgtataggaattccaaaggaatatcttgtaccggaattatcaagtgaagtacagtctctttggtccaaagctgctgacctctttgagtctgagggggccaaagtaattgaagtatcccttcctcacaccagttattcaattgtctgctaccatgtattgtgcacatcagaagtggcatcgaatatggcaagatttgatgggctacaatatggtcacagatgtgacattgatgtgtccactgaagccatgtatgctgcaaccagacgagaagggtttaatgatgtggtgagaggaagaattctctcaggaaactttttcttattaaaagagtaagacaactcatttaggaattttcttcattcttgaaacctcaagtaacatgtctcttatcaggtcttataagtcaaggtatttagtaaagaaacaaaatctttatgatttgaattagaaaagacctgtttatggcacttttgggtcctggtattcaaaaacaaaagaaatgttggtactttagctaaatgattggtacagattacaggcagtcctccatatctgtgggttttgcaaccttggattcaaccaaacacaaatcaaaaatattc

SEQ ID NO: 440145 - DNA, 531 bp, Homo sapiens
ggggctggtaattgtttgttgtgggagactgtcctgtgcattgtaagatgtttagtagcatccctggcctctacccctacatgcaagtagtaccccaccaccaaaaccacaatcccacaaccaaaaatgtctgcagacattgtcaagtgtctcctggttagggaaaaggagacaaaagtaacccccaggtaagaccactgctatagagaaatactaccttatttaaaatcttccattaaggtaatatatgtaaggccaggtgcgtacacctgtaatcccagcaccttgggaagccaaggcaggaggatcgcttgagatcaggagtttgagaccagcctgggcaacatacagagccctatgtctacaaaaagttttaaaaaaattgtggggtgtggtggtgtgcacctgtggtcctagctgtttgggaggctgaggggggaggattgcttgagtccaggaggttgagactgccgtgagccatgattgcaccactgcactccaccctaggtgacagagcaagaccctatctca

SEQ ID NO: 440146 - DNA, 323 bp, Homo sapiens
tactttatgaattctctgagatgaacatgtgttacttttgtgtaatcagaggaaaatacagtttaaaaatatacaattgaaagggtagattccaaatataattagagatatatcattcttctaaagataattccatttaaattccagggctttaggatcagatacaggaggatcgaccagaaatcctgctgcccactgtgggcttgttggtttcaaaccaagctatggcttagtttcccgtcatggtctcattcccctggtgaattcgatggatgtgccaggaatcttaaccagatgtgtggatgatgcagcaattgtgttgg

SEQ ID NO: 440147 - DNA, 3232 bp, Homo sapiens
  misc_feature (4)..(4): n is a, c, g, or t
ggcncgagtgacaattaaagatggctgcgcccatgtaacatcactagcgaccggtgacctctttttcccccttgcctggctcctgtggtggcaggctgggcacgaggaccatgctgggccggagcctccgagaagtttctgcggcactgaaacaaggccaaattacaccaacagagctctgtcaaaaatgtctctctcttatcaagaagaccaagtttctaaatgcctacattactgtgtcagaagaggtggccttaaaacaagctgaagaatcagaaaagagatataagaatggacagtcacttggggatttagatggaattcctattgcagtaaaagacaatttcagcacttctggcattgagacaacatgtgcatcaaatatgctgaaaggttatataccaccttataatgctacagtagttcagaagttgttggatcagggagctctactaatgggaaaaacaaatttagatgagtttgctatgggatctgggagcacagatggtgtatttggaccagttaaaaacccctggagttattcaaaacaatatagagaaaagaggaagcagaatccccacagcgagaatgaagattcagactggctgataactggaggaagctcaggtgggagtgcagctgctgtatcggcgttcacatgctacgcggctttaggatcagatacaggaggatcgaccagaaatcctgctgcccactgtgggcttgttggtttcaaaccaagctatggcttagtttcccgtcatggtctcattcccctggtgaattcgatggatgtgccaggaatcttaaccagatgtgtggatgatgcagcaattgtgttgggtgcactggccggacctgaccccagggactctaccacagtacatgaacctattaataaaccattcatgcttcccagtttggcagatgtgagcaaactatgtataggaattccaaaggaatatcttgtaccggaattatcaagtgaagtacagtctctttggtccaaagctgctgacctctttgagtctgagggggccaaagtaattgaagtatcccttcctcacaccagttattcaattgtctgctaccatgtattgtgcacatcagaagtggcatcgaatatggcaagatttgatgggctacaatatggtcacagatgtgacattgatgtgtccactgaagccatgtatgctgcaaccagacgagaagggtttaatgatgtggtgagaggaagaattctctcaggaaactttttcttattaaaagaaaactatgaaaattattttgtcaaagcacagaaagtgagacgcctcattgctaatgactttgtaaatgcttttaactctggagtagatgtcttgctaactcccaccaccttgagtgaggcagtaccatacttggagttcatcaaagaggacaacagaacccgaagtgcccaggatgatatttttacacaagctgtaaatatggcaggattgccagcagtgagtatccctgttgcactctcaaaccaagggttgccaataggactgcagtttattggacgtgcgttttgtgaccagcagcttcttacagtagccaaatggtttgaaaaacaagtacagtttcctgttattcaacttcaagaactcatggatgattgttcagcagtccttgaaaatgaaaagttagcctctgtctctctaaaacagtaaacatatcttacaaattaaaatgacttttaggctgggtgcagtggctcacacctgtaatcccagcactttgggaggccaaggcgagcggatcatgaggtcagaagatctagaacagcctggtcaacatggtgaaaccccgtctctactaaaaatacaaaaattagccaggcttagtggcgggcatctgtagtcccagctactcaggaggctgaggcaggagaatcacttgaaccctggaggtggaggttgcagtgagccgagatcatgccactgcactgcactccagcctgggtgacaaagcaagactgtgtctcaaaataaataaataaaataaaataaaatgacgtacagagattctatattctagagagtcaaatggtcttgctcaattcttgtaattaggttcttgttaatacagtcattccatggaattactttttaaaattcctgtgacaattaataataaataacgtgtcagcatttagtaagcatccactaagtgtacaatacttctacaataacacaagatacctgttcctcaaagacaatgcattctgccataatgttcattaaagagtttacagtaaaaataagattagggataaacttctcaaaaattgtacatctgtgtaactaaagcactaacaaaaacatgaatagtccttctagaggtaacttggatagcctaggcaggcaacttatcatgtggtgaaggccgcctcaggggttgttaaaaatgcacagaaacaattgagtgcgattattggcttctgagcgctgagcagagcaggtggaagaggaactttgagcacaggaggaaatgcaaccagtcagggcccagaatcatgcaaatctcaggggtatgcctctctggggaggagctccacttgcagggactccttttatttccctaagaaagagctgaaatgactgagaactttcctttcctccttagagttacaattttacttctgctattccggagcccatgcctagaagccagaacaactccatgttacactgagttcatgctcctatttactgatcacaaatgagctcattaatgtcatcgaaacatttattgtaacctaacagaccatcacagattggaaacttggtagatagcagagcatggtattagtgaaaaaggttcaaaatacacaagtaacatacactctgaaaaacatgcagataatttgctgatgaagcagaagaggggatgcgcatggcaagaacttgccttaccccagattctctatatctcatggtttccttttcctcttgactgtctttacgagtgttttttatttgggaccctcgagcccagagatattaatggatatctgtattcaatatttgacaaaatctaatggaaaccatccatttactcatgataaggcttcatcactggatttctgtgtcttcactagaacaccattgtcatctcatattgatcaggtattttaatctagcacttacatattgttgataaatgaaagctgaattgttacttaataaattcactttgtttagta

SEQ ID NO: 440148 - DNA, 866 bp, Homo sapiens
  misc_feature (26)..(26): n is a, c, g, or t
  misc_feature (39)..(39): n is a, c, g, or t
cctagtcggcactgactctcttaatntccaccgctacanaaactatgaaaattattttgtcaaagcacagaaagtgagacgcctcattgctaatgactttgtaaatgcttttaactctggagtagatgtcttgctaactcccaccaccttgagtgaggcagtaccatacttggagttcatcaaagaggacaacagaacccgaagtgcccaggatgatatttttacacaagctgtaaatatggcaggattgccagcagtgagtatccctgttgcactctcaaaccaagggttgccaataggactgcagtttattggacgtgcgttttgtgaccagcagcttcttacagtagccaaatggtttgaaaaacaagtacagtttcctgttattcaacttcaagaactcatggatgattgttcagcagtccttgaaaatgaaaagttagcctctgtctctctaaaacagtaaacatatcttacaaattaaaatgacttttaggctgggtgcagtggctcacacctgtaatcccagcactttgggaggccaaggcgagcggatcatgaggtcagaagatctagaacagcctggtcaacatggtgaaaccccgtctctactaaaaatacaaaaattagccaggcttagtggcgggcatctgtagtcccagctactcaggaggctgaggcaggagaatcacttgaaccctggaggtggaggttgcagtgagccgagatcatgccactgcactgcactccagcctgggtgacaaagcaagactgtgtctcaaaataaataaataaaataaaataatcccggatgcggcaagaaacccattgtggcgactcgcgacgttgattgatagtggatattg

SEQ ID NO: 440149 - DNA, 4220 bp, Homo sapiens
  misc_feature (4)..(4): n is a, c, g, or t
ggcncgagtgacaattaaagatggctgcgcccatgtaacatcactagcgaccggtgacctctttttcccccttgcctggctcctgtggtggcaggctgggcacgaggaccatgctgggccggagcctccgagaacctgactttgaaaccaaaagttggctaaggagaagaatgtcatgtcctccacctgtcctcaagctgatcagtgcatcacccttcatccactacactaagtgtagaggtttctgcggcactgaaacaaggccaaattacaccaacagagctctgtcaaaaatgtctctctcttatcaagaagaccaagtttctaaatgcctacattactgtgtcagaagaggtggccttaaaacaagctgaagaatcagaaaagagatataagaatggacagtcacttggggatttagatggaattcctattgcagtaaaagacaatttcagcacttctggcattgagacaacatgtgcatcaaatatgctgaaaggttatataccaccttataatgctacagtagttcagaagttgttggatcagggagctctactaatgggaaaaacaaatttagatgagtttgctatgggatctgggagcacagatggtgtatttggaccagttaaaaacccctggagttattcaaaacaatatagagaaaagaggaagcagaatccccacagcgagaatgaagattcagactggctgataactggaggaagctcaggtgggagtgcagctgctgtatcggcgttcacatgctacgcggctttaggatcagatacaggaggatcgaccagaaatcctgctgcccactgtgggcttgttggtttcaaaccaagctatggcttagtttcccgtcatggtctcattcccctggtgaattcgatggatgtgccaggaatcttaaccagatgtgtggatgatgcagcaattgtgttgggtgcactggccggacctgaccccagggactctaccacagtacatgaacctattaataaaccattcatgcttcccagtttggcagatgtgagcaaactatgtataggaattccaaaggaatatcttgtaccggaattatcaagtgaagtacagtctctttggtccaaagctgctgacctctttgagtctgagggggccaaagtaattgaagtatcccttcctcacaccagttattcaattgtctgctaccatgtattgtgcacatcagaagtggcatcgaatatggcaagatttgatgggctacaatatggtcacagatgtgacattgatgtgtccactgaagccatgtatgctgcaaccagacgagaagggtttaatgatgtggtgagaggaagaattctctcaggaaactttttcttattaaaagaaaactatgaaaattattttgtcaaagcacagaaagtgagacgcctcattgctaatgactttgtaaatgcttttaactctggagtagatgtcttgctaactcccaccaccttgagtgaggcagtaccatacttggagttcatcaaagaggacaacagaacccgaagtgcccaggatgatatttttacacaagctgtaaatatggcaggattgccagcagtgagtatccctgttgcactctcaaaccaagggttgccaataggactgcagtttattggacgtgcgttttgtgaccagcagcttcttacagtagccaaatggtttgaaaaacaagtacagtttcctgttattcaacttcaagaactcatggatgattgttcagcagtccttgaaaatgaaaagttagcctctgtctctctaaaacagtaaacatatcttacaaattaaaatgacttttaggctgggtgcagtggctcacacctgtaatcccagcactttgggaggccaaggcgagcggatcatgaggtcagaagatctagaacagcctggtcaacatggtgaaaccccgtctctactaaaaatacaaaaattagccaggcttagtggcgggcatctgtagtcccagctactcaggaggctgaggcaggagaatcacttgaaccctggaggtggaggttgcagtgagccgagatcatgccactgcactgcactccagcctgggtgacaaagcaagactgtgtctcaaaataaataaataaaataaaataaaatgacgtacagagattctatattctagagagtcaaatggtcttgctcaattcttgtaattaggttcttgttaatacagtcattccatggaattactttttaaaattcctgtgacaattaataataaataacgtgtcagcatttagtaagcatccactaagtgtacaatacttctacaataacacaagatacctgttcctcaaagacaatgcattctgccataatgttcattaaagagtttacagtaaaaataagattagggataaacttctcaaaaattgtacatctgtgtaactaaagcactaacaaaaacatgaatagtccttctagaggtaacttggatagcctaggcaggcaacttatcatgtggtgaaggccgcctcaggggttgttaaaaatgcacagaaacaattgagtgcgattattggcttctgagcgctgagcagagcaggtggaagaggaactttgagcacaggaggaaatgcaaccagtcagggcccagaatcatgcaaatctcaggggtatgcctctctggggaggagctccacttgcagggactccttttatttccctaagaaagagctgaaatgactgagaactttcctttcctccttagagttacaattttacttctgctattccggagcccatgcctagaagccagaacaactccatgttacactgagttcatgctcctatttactgatcacaaatgagctcattaatgtcatcgaaacatttattgtaacctaacagaccatcacagattggaaacttggtagatagcagagcatggtattagtgaaaaaggttcaaaatacacaagtaacatacactctgaaaaacatgcagataatttgctgatgaagcagaagaggggatgcgcatggcaagaacttgccttaccccagattctctatatctcatggtttccttttcctcttgactgtctttacgagtgttttttatttgggaccctcgagcccagagatattaatggatatctgtattcaatatttgacaaaatctaatggaaaccatccatttactcatgataaggcttcatcactggatttctgtgtcttcactagaacaccattgtcatctcatattgatcaggtattttaatctagcacttacatattgttgataaatgaaagctgaattgttacttaataaattcactttgtttagtaaaaaaaaattgttttctaaatatgacgttcatgaagagaaaataatgagtcagaatcatctgcagaaccactggaatgtttcatcgtcacctgttagttttcataaacagttttctgtcctctctgagatcctcccgctcccaaatactcaacctgattaacttcacataaaagtcttatgtgccaggcttagtaatattcctatagattttgactctgaatccctgaaagaggaagaaatccatgagagaaaattgcattactttatagcaagaggaaaccgttttaagttttttaattgctcagacaccacaacatcctagatggaggaaaccattttagttgaaggagcaaatatgatgtcaaaagcaagtaaataaacaaaccgttgccccaatctgtttttatgtaatgaatttaaaaaaaaagagagagagagagagatgggctctccctgtgttgcccaggctagtctcaaactcctgggctcaagtgatctgcctccctcagcctcccaaagtgctgagattaaagacgtgagccaccacacctggccgaaataataatattcaatattatatattcaatgatattattcagtattcaatattatttcaaataatattaaatctcttgttcctgtatctctacatgagctgcactaataatttgaatctggaaattaaaaagtgaaacatttaccgttctcatatactgatacccaactaccatgaaatgatacctaatttgtttttcttttctcttcatttttactcttaatctagtaggtctcattttgccaagtcactgtctgggaatttaagtggcaaatactttctttgtctcagctaattaaactctaaaattattagcaacaaaaaa

SEQ ID NO: 440150 - DNA, 3554 bp, Homo sapiens
accctcccgcaccaacctacaggactagcttcgtacgcccatctgtttaatacggcgcgagggatggaggtgcagactgcatgtatcggtcgtacacatgactacgcggctttaggatcagatacaggaggatcgaccagaaatcctgctgcccactgtgggcttgttggtttcaaaccaagctatggcttagtttcccgtcatggtctcattcccctggtgaattcgatggatgtgccaggaatcttaaccagatgtgtggatgatgcagcaattgtgttgggtgcactggccggacctgaccccagggactctaccacagtacatgaacctattaataaaccattcatgcttcccagtttggcagatgtgagcaaactatgtataggaattccaaaggaatatcttgtaccggaattatcaagtgaagtacagtctctttggtccaaagctgctgacctctttgagtctgagggggccaaagtaattgaagtatcccttcctcacaccagttattcaattgtctgctaccatgtattgtgcacatcagaagtggcatcgaatatggcaagatttgatgggctacaatatggtcacagatgtgacattgatgtgtccactgaagccatgtatgctgcaaccagacgagaagggtttaatgatgtggtgagaggaagaattctctcaggaaactttttcttattaaaagaaaactatgaaaattattttgtcaaagcacagaaagtgagacgcctcattgctaatgactttgtaaatgcttttaactctggagtagatgtcttgctaactcccaccaccttgagtgaggcagtaccatacttggagttcatcaaagaggacaacagaacccgaagtgcccaggatgatatttttacacaagctgtaaatatggcaggattgccagcagtgagtatccctgttgcactctcaaaccaagggttgccaataggactgcagtttattggacgtgcgttttgtgaccagcagcttcttacagtagccaaatggtttgaaaaacaagtacagtttcctgttattcaacttcaagaactcatggatgattgttcagcagtccttgaaaatgaaaagttagcctctgtctctctaaaacagtaaacatatcttacaaattaaaatgacttttaggctgggtgcagtggctcacacctgtaatcccagcactttgggaggccaaggcgagcggatcatgaggtcagaagatctagaacagcctggtcaacatggtgaaaccccgtctctactaaaaatacaaaaattagccaggcttagtggcgggcatctgtagtcccagctactcaggaggctgaggcaggagaatcacttgaaccctggaggtggaggttgcagtgagccgagatcatgccactgcactgcactccagcctgggtgacaaagcaagactgtgtctcaaaataaataaataaaataaaataaaatgacgtacagagattctatattctagagagtcaaatggtcttgctcaattcttgtaattaggttcttgttaatacagtcattccatggaattactttttaaaattcctgtgacaattaataataaataacgtgtcagcatttagtaagcatccactaagtgtacaatacttctacaataacacaagatacctgttcctcaaagacaatgcattctgccataatgttcattaaagagtttacagtaaaaataagattagggataaacttctcaaaaattgtacatctgtgtaactaaagcactaacaaaaacatgaatagtccttctagaggtaacttggatagcctaggcaggcaacttatcatgtggtgaaggccgcctcaggggttgttaaaaatgcacagaaacaattgagtgcgattattggcttctgagcgctgagcagagcaggtggaagaggaactttgagcacaggaggaaatgcaaccagtcagggcccagaatcatgcaaatctcaggggtatgcctctctggggaggagctccacttgcagggactccttttatttccctaagaaagagctgaaatgactgagaactttcctttcctccttagagttacaattttacttctgctattccggagcccatgcctagaagccagaacaactccatgttacactgagttcatgctcctatttactgatcacaaatgagctcattaatgtcatcgaaacatttattgtaacctaacagaccatcacagattggaaacttggtagatagcagagcatggtattagtgaaaaaggttcaaaatacacaagtaacatacactctgaaaaacatgcagataatttgctgatgaagcagaagaggggatgcgcatggcaagaacttgccttaccccagattctctatatctcatggtttccttttcctcttgactgtctttacgagtgttttttatttgggaccctcgagcccagagatattaatggatatctgtattcaatatttgacaaaatctaatggaaaccatccatttactcatgataaggcttcatcactggatttctgtgtcttcactagaacaccattgtcatctcatattgatcaggtattttaatctagcacttacatattgttgataaatgaaagctgaattgttacttaataaattcactttgtttagtaaaaaaaaattgttttctaaatatgacgttcatgaagagaaaataatgagtcagaatcatctgcagaaccactggaatgtttcatcgtcacctgttagttttcataaacagttttctgtcctctctgagatcctcccgctcccaaatactcaacctgattaacttcacataaaagtcttatgtgccaggcttagtaatattcctatagattttgactctgaatccctgaaagaggaagaaatccatgagagaaaattgcattactttatagcaagaggaaaccgttttaagttttttaattgctcagacaccacaacatcctagatggaggaaaccattttagttgaaggagcaaatatgatgtcaaaagcaagtaaataaacaaaccgttgccccaatctgtttttatgtaatgaatttaaaaaaaaagagagagagagagagatgggctctccctgtgttgcccaggctagtctcaaactcctgggctcaagtgatctgcctccctcagcctcccaaagtgctgagattaaagacgtgagccaccacacctggccgaaataataatattcaatattatatattcaatgatattattcagtattcaatattatttcaaataatattaaatctcttgttcctgtatctctacatgagctgcactaataatttgaatctggaaattaaaaagtgaaacatttaccgttctcatatactgatacccaactaccatgaaatgatacctaatttgtttttcttttctcttcatttttactcttaatctagtaggtctcattttgccaagtcactgtctgggaatttaagtggcaaatactttctttgtctcagctaattaaactctaaaattattagcaacaaaaaa

SEQ ID NO: 440151 - DNA, 3668 bp, Homo sapiens
gtgggtgcctgtagtcccagctactcggaaggctaaggcaggagaatggcgtgaacccaggaggcggagcctgcagtgagctgagattgcgccactgcactccagcctgggcgacagagtgagactccgtctcaaaaaaaaaaaaaagaaaatcatctaacagggtacctgatacatgagcatttaacatatatgctgatatatgctgatatgctgttaggttcctgatacataatgagcatttaacaaatattttccccaaccagatctccaatctttaatgttgttatatccagatcataatatctagtactgtgctttgtcataccataaacactctgaaatggatttagtctttctagctacctaccagcaattttatcctattttctaatgtattaccaaaggtcctgaagtacagatttttataaaatcatctatacagatgaagtacaaatttttataaaataatctatacagttccaattttgtatcttgactttttgctataaggaatatcttgtaccggaattatcaagtgaagtacagtctctttggtccaaagctgctgacctctttgagtctgagggggccaaagtaattgaagtatcccttcctcacaccagttattcaattgtctgctaccatgtattgtgcacatcagaagtggcatcgaatatggcaagatttgatgggctacaatatggtcacagatgtgacattgatgtgtccactgaagccatgtatgctgcaaccagacgagaagggtttaatgatgtggtgagaggaagaattctctcaggaaactttttcttattaaaagaaaactatgaaaattattttgtcaaagcacagaaagtgagacgcctcattgctaatgactttgtaaatgcttttaactctggagtagatgtcttgctaactcccaccaccttgagtgaggcagtaccatacttggagttcatcaaagaggacaacagaacccgaagtgcccaggatgatatttttacacaagctgtaaatatggcaggattgccagcagtgagtatccctgttgcactctcaaaccaagggttgccaataggactgcagtttattggacgtgcgttttgtgaccagcagcttcttacagtagccaaatggtttgaaaaacaagtacagtttcctgttattcaacttcaagaactcatggatgattgttcagcagtccttgaaaatgaaaagttagcctctgtctctctaaaacagtaaacatatcttacaaattaaaatgacttttaggctgggtgcagtggctcacacctgtaatcccagcactttgggaggccaaggcgagcggatcatgaggtcagaagatctagaacagcctggtcaacatggtgaaaccccgtctctactaaaaatacaaaaattagccaggcttagtggcgggcatctgtagtcccagctactcaggaggctgaggcaggagaatcacttgaaccctggaggtggaggttgcagtgagccgagatcatgccactgcactgcactccagcctgggtgacaaagcaagactgtgtctcaaaataaataaataaaataaaataaaatgacgtacagagattctatattctagagagtcaaatggtcttgctcaattcttgtaattaggttcttgttaatacagtcattccatggaattactttttaaaattcctgtgacaattaataataaataacgtgtcagcatttagtaagcatccactaagtgtacaatacttctacaataacacaagatacctgttcctcaaagacaatgcattctgccataatgttcattaaagagtttacagtaaaaataagattagggataaacttctcaaaaattgtacatctgtgtaactaaagcactaacaaaaacatgaatagtccttctagaggtaacttggatagcctaggcaggcaacttatcatgtggtgaaggccgcctcaggggttgttaaaaatgcacagaaacaattgagtgcgattattggcttctgagcgctgagcagagcaggtggaagaggaactttgagcacaggaggaaatgcaaccagtcagggcccagaatcatgcaaatctcaggggtatgcctctctggggaggagctccacttgcagggactccttttatttccctaagaaagagctgaaatgactgagaactttcctttcctccttagagttacaattttacttctgctattccggagcccatgcctagaagccagaacaactccatgttacactgagttcatgctcctatttactgatcacaaatgagctcattaatgtcatcgaaacatttattgtaacctaacagaccatcacagattggaaacttggtagatagcagagcatggtattagtgaaaaaggttcaaaatacacaagtaacatacactctgaaaaacatgcagataatttgctgatgaagcagaagaggggatgcgcatggcaagaacttgccttaccccagattctctatatctcatggtttccttttcctcttgactgtctttacgagtgttttttatttgggaccctcgagcccagagatattaatggatatctgtattcaatatttgacaaaatctaatggaaaccatccatttactcatgataaggcttcatcactggatttctgtgtcttcactagaacaccattgtcatctcatattgatcaggtattttaatctagcacttacatattgttgataaatgaaagctgaattgttacttaataaattcactttgtttagtaaaaaaaaattgttttctaaatatgacgttcatgaagagaaaataatgagtcagaatcatctgcagaaccactggaatgtttcatcgtcacctgttagttttcataaacagttttctgtcctctctgagatcctcccgctcccaaatactcaacctgattaacttcacataaaagtcttatgtgccaggcttagtaatattcctatagattttgactctgaatccctgaaagaggaagaaatccatgagagaaaattgcattactttatagcaagaggaaaccgttttaagttttttaattgctcagacaccacaacatcctagatggaggaaaccattttagttgaaggagcaaatatgatgtcaaaagcaagtaaataaacaaaccgttgccccaatctgtttttatgtaatgaatttaaaaaaaaagagagagagagagagatgggctctccctgtgttgcccaggctagtctcaaactcctgggctcaagtgatctgcctccctcagcctcccaaagtgctgagattaaagacgtgagccaccacacctggccgaaataataatattcaatattatatattcaatgatattattcagtattcaatattatttcaaataatattaaatctcttgttcctgtatctctacatgagctgcactaataatttgaatctggaaattaaaaagtgaaacatttaccgttctcatatactgatacccaactaccatgaaatgatacctaatttgtttttcttttctcttcatttttactcttaatctagtaggtctcattttgccaagtcactgtctgggaatttaagtggcaaatactttctttgtctcagctaattaaactctaaaattattagcaacaaaaaa

SEQ ID NO: 440152 - DNA, 1743 bp, Homo sapiens
  misc_feature (4)..(4): n is a, c, g, or t
ggcncgagtgacaattaaagatggctgcgcccatgtaacatcactagcgaccggtgacctctttttcccccttgcctggctcctgtggtggcaggctgggcacgaggaccatgctgggccggagcctccgagaagtttctgcggcactgaaacaaggccaaattacaccaacagagctctgtcaaaaatgtctctctcttatcaagaagaccaagtttctaaatgcctacattactgtgtcagaagaggtggccttaaaacaagctgaagaatcagaaaagagatataagaatggacagtcacttggggatttagatggaattcctattgcagtaaaagacaatttcagcacttctggcattgagacaacatgtgcatcaaatatgctgaaaggttatataccaccttataatgctacagtagttcagaagttgttggatcagggagctctactaatgggaaaaacaaatttagatgagtttgctatgggatctgggagcacagatggtgtatttggaccagttaaaaacccctggagttattcaaaacaatatagagaaaagaggaagcagaatccccacagcgagaatgaagattcagactggctgataactggaggaagctcaggtgggagtgcagctgctgtatcggcgttcacatgctacgcggctttaggatcagatacaggaggatcgaccagaaatcctgctgcccactgtgggcttgttggtttcaaaccaagctatggcttagtttcccgtcatggtctcattcccctggtgaattcgatggatgtgccaggaatcttaaccagatgtgtggatgatgcagcaattgtgttgggtgcactggccggacctgaccccagggactctaccacagtacatgaacctattaataaaccattcatgcttcccagtttggcagatgtgagcaaactatgtataggaattccaaaggaatatcttgtaccggaattatcaagtgaagtacagtctctttggtccaaagctgctgacctctttgagtctgagggggccaaagtaattgaagtatcccttcctcacaccagttattcaattgtctgctaccatgtattgtgcacatcagaagtggcatcgaatatggcaagatttgatgggctacaatatggtaagatggctgggttattttatttttaaggtagttgtcgcaaacatttgaaaagttcacttattagtgacaaaaaagttaatgcttgagataatgttagtgattcagaaaagttcatcagtgaatcattttacctttgtcattttagacttgtacttacactatttgtcataaatatttgtgtatgtttggtttgcttctcaggactgtgaataactcgaagggatagtatcttgttgtcatatgctcagtcccgctaatgtagagctcaataaatgtttgaatgaatgaatgagggagtgaacaattggagtttctttcttggttcttttcttttcttctctctccatgaccagtccatcagtcaaaaggcagatggggaaaagaaaccattaagggcaactccctaaactttagtattggtgacaaaaatgtgaatctaaataagccaggcatggtggcgcatacctgtaatctaagctactcaggaggccgaggcaggagaatcacttgacaagggaggcagaacttgcagtgagccgagattacaccactgcactccagcctaggtgacagagtgagactccatct

SEQ ID NO: 440153 - DNA, 741 bp, Homo sapiens
agtaacacacatttatgactttttctccaggagttagctgtgccagtggttcatgacgggggcgctcttttggcctttgtctgtggtgtcgtgtacacgctcctacagtccatcatctcttacaaatcatgtccccagtggaacagtctctcgacatgccacatacggatggtcatctctgccgtttcttgcgcagctgtcatccccagtatcctttttcacatttgtgccttgttaaaggaataaaacattcagtgacactgttaaagaagggtaatgaagactttatagggaccgctgcaatgagttctgacagcagggcggagagattgggctcaactctgaatacagcattggcaagtgcgaatctatagccaaggagtaggatgaggtcagtgaatggaaaagtactaaaaggaaacctcaaggatgagggggaattctggccaaaccaacctaacaggattcttattgagtactggccatgtgatcagacatcacctgggaagggtggaggaggaggaggaacccaatcagatattgagtgtgatcagatatgagggtggggggtccttgctaaactgacttagccagggttctttgctaaaactggatcttacaaggaagtgcacagatggacctaggagaagtttcaggggcttgactaaagttcagccaagcaaaggatctttgtcaccgtgtcttagcaaagcttgacacttcccttccccacaaccaaaa

SEQ ID NO: 440154 - DNA, 476 bp, Homo sapiens
tttgcaaggtgaggtgagaacattttaatcctgcacacatttttttttgtttaggtaatacaggagttgatggcaacgatggttactcattatgaaccacactgaaacgaccttcaattcaatttccatctgctaataaatatagtcaagtgctgcataatgttttggtcaacatcccctaagattataaaaccatatttgactgcaccttttctacatttagatacacaaataccactgtgttacaactgcctacagtattcagtacagtgacatgctgtgcaggtttgtagcctagaagcaataggtttgtgtaagtacacttgttatgaaatccacaatgtttgtacaataaaaccgcctaatgacgcatttctcagaacatatccctgttgttaatcaatgcatgactgcataagaatatctgacttaaaaaacacatgaactaatggccaagtggtgaaaggctgcatatg

SEQ ID NO: 440155 - DNA, 336 bp, Homo sapiens
  misc_feature (201)..(201): n is a, c, g, or t
  misc_feature (215)..(215): n is a, c, g, or t
  misc_feature (222)..(222): n is a, c, g, or t
tcccccatacgagatcccccatacagagtacgtgccttaatctttatctttgtaatgccacaatgaacagagtgcctcctggtacactgtaggagcttaagaaatactcactgaatgcatgaatgaatgaatgaacaaatgaaggaatgactaaggatgtttgtagtgctataatatagaatgggatttactcgtatgggngatctcggagatcncccatanagagtactcccagctacactacctcaatcaccaccaccgagaccccatcacacagtactcccagcttcacttcttcgattaccaccaccgagacccccttaagcagtactccca

SEQ ID NO: 440156 - DNA, 3038 bp, Homo sapiens
gggaaggccagagcgggcgtccccgccagtgaccccacgccgcccgtccgcgcccaacccggcctccgccgagtgtccaaaccaaaagcgaaaggaacccgaccccgcgtcccctccggcggctccgtagtcgcgtccgcttggagctcgccgggcgcctccgaccctgccgggccgctttgtgacttcactcgtttcgcaacaagcccgggcagcccgcgccccacccactctggcccggcagcctcgccgcccgcagcctcgctccgctcctcgcgcttcccctccctccggggctgggcctgccccggccgtcgcggagcctcccctcccaccgtccgtgagtgtacgcgcccggccgccgcctccaggcagcccggagcaacccggcgcccggccccgctgggcgcagcactccgtcggcggcggcggcggcgcgatgctgtgcttcctgaggggaatggctttcgtccccttcctcttggtgacctggtcgtcagccgccttcattatctcctacgtggtcgccgtgctctccgggcacgtcaaccccttcctcccgtatatcagtgatacgggaacaacacctccagagagtggtatttttggatttatgataaacttctctgcatttcttggtgcagccacgatgtatacaagatacaaaatagtacagaagcaaaatcaaacctgctatttcagcactcctgtttttaacttggtgtctttagtgcttggattggtgggatgtttcggaatgggcattgtcgccaattttcaggagttagctgtgccagtggttcatgacgggggcgctcttttggcctttgtctgtggtgtcgtgtacacgctcctacagtccatcatctcttacaaatcatgtccccagtggaacagtctctcgacatgccacatacggatggtcatctctgccgtttcttgcgcagctgtcatccccatgattgtctgtgcttcactaatttccataaccaagctggagtggaatccaagagaaaaggattatgtatatcacgtagtgagtgcgatctgtgaatggacagtggcctttggttttattttctacttcctaactttcatccaagatttccagagtgtcaccctaaggatatccacagaaatcaatggtgatatttgaagaaagaagaattcagtctcactcagtgaatgtcgcaggccatttctaaaagtgctacagaggacagacagggttttgaggccaccctgattattgggatgcatctgcagcacatccaggacttgaatttcattacgagttcctaatagttgtatttctaaagatgtgtttcctagagaatgtacagccttatgacactgtagtgatgtttttataattttctaagtagatttttttatattaacaaattcatatacagaaaaaataaggtgttacaaaaaatggagagctcttatttttgtacagattctgtcgtttttgttttatttgtgtgagatttatggaaatacactaaatgagtaattcaggttcagtacatttattacaaagtgaaatcaggggatattcatttgtaaattttattcttagtgaatgaactgtataattttttttatcaggagagcacttataaaattcaatttataaagatcatatacccaaatcataaagatttagttgatacattaacactaagatactctgatttttagccgaactaaacaaagtgcttctactgagaggcctttataccaccatgtacagtaactctaagtgaatacggaagaccttggttttgaaattctgccaccttgtttctccctgctcatgaggtcgcaccttttgctcttgctgctaattgcccattcgtagtgggtgtaatgccaggtggaatggtttcaacaagtcaggtgaaaaccatcctttattgttgctggcacaacttgatatatagtctgactcagaactgaagctcacatctcaaattcatttcatgccagtaaatgtggcaaagagaagaaaggcccaagagcgagacaagaagaatggagaagggggcagccaagaagaacttctgggttcagggtactgtttatttgctccttctcttcatgcctgtggctggatgtcccacaacactataagaaatataagtcaagccctttgtgttaagcaagaactacagactccatcttttcacccaaatcatgaatgaccaataaaaagcaagttattccagaggaagaagcagcccttgaaatgttaaggcttaggcttgaaaggtgaagagcaggaattctctctttcaaatcctagagcataaacccatgtgtggccaagtgagatcagccctcaagggcacatgccaagggcagagcagcccatgtagacagcttcggagggcatgggggtgtagggagttcggggtagctcctcattaactatttgttgggtgagtaaaggggtgaggctcagtggcaggtacctctgcaatgacaagctgcctcccctctatgtgtttagcatatgttattagaacatgtccgacacccctaccgctgccatttgggccctttaataaagccaagtagagaaatctggcaataaaaggcaaatgtaagcatgctttctttaagacgcatcataaatggttttctttaagtgaatggaagagtttgacagagatacacctttgtaagaaaacattaagaatgctggctggctgtggtggctcacacctgtattcccagcactttgggaggcctaggcaggaggattgcttgagcctgggacttcgagaccagactgggaaacatggcaaaatcccatctctacaacaaaaatacaaaaattagccaagtgcggtggtgtgcctgtagtcctagttacttgggaggctgaggtgggagaatcacctgagcccaggaggtggaggctgcagtgagccatgccaatgcactccagtctgggcaacagagtgagaccctgtctcaaaaataaataaataaataaatgaataaagagaatgctaatcatttctggg

SEQ ID NO: 440157 - DNA, 2525 bp, Homo sapiens
catagtgagatcattccttaggtggtgcagagctgttggaaatgtcattgtcaacgctgggattgtttaacttcttttaaacctttctctttcatttttaaaaatagagtgtcaccctaaggatatccacagaaatcaatggtgatatttgaagaaagaagaattcagtctcactcagtgaatgtcgcaggccatttctaaaagtgctacagaggacagacagggttttgaggccaccctgattattgggatgcatctgcagcacatccaggacttgaatttcattacgagttcctaatagttgtatttctaaagatgtgtttcctagagaatgtacagccttatgacactgtagtgatgtttttataattttctaagtagatttttttatattaacaaattcatatacagaaaaaataaggtgttacaaaaaatggagagctcttatttttgtacagattctgtcgtttttgttttatttgtgtgagatttatggaaatacactaaatgagtaattcaggttcagtacatttattacaaagtgaaatcaggggatattcatttgtaaattttattcttagtgaatgaactgtataattttttttatcaggagagcacttataaaattcaatttataaagatcatatacccaaatcataaagatttagttgatacattaacactaagatactctgatttttagccgaactaaacaaagtgcttctactgagaggcctttataccaccatgtacagtaactctaagtgaatacggaagaccttggttttgaaattctgccaccttgtttctccctgctcatgaggtcgcaccttttgctcttgctgctaattgcccattcgtagtgggtgtaatgccaggtggaatggtttcaacaagtcaggtgaaaaccatcctttattgttgctggcacaacttgatatatagtctgactcagaactgaagctcacatctcaaattcatttcatgccagtaaatgtggcaaagagaagaaaggcccaagagcgagacaagaagaatggagaagggggcagccaagaagaacttctgggttcagggtactgtttatttgctccttctcttcatgcctgtggctggatgtcccacaacactataagaaatataagtcaagccctttgtgttaagcaagaactacagactccatcttttcacccaaatcatgaatgaccaataaaaagcaagttattccagaggaagaagcagcccttgaaatgttaaggcttaggcttgaaaggtgaagagcaggaattctctctttcaaatcctagagcataaacccatgtgtggccaagtgagatcagccctcaagggcacatgccaagggcagagcagcccatgtagacagcttcggagggcatgggggtgtagggagttcggggtagctcctcattaactatttgttgggtgagtaaaggggtgaggctcagtggcaggtacctctgcaatgacaagctgcctcccctctatgtgtttagcatatgttattagaacatgtccgacacccctaccgctgccatttgggccctttaataaagccaagtagagaaatctggcaataaaaggcaaatgtaagcatgctttctttaagacgcatcataaatggttttctttaagtgaatggaagagtttgacagagatacacctttgtaagaaaacattaagaatgctggctggctgtggtggctcacacctgtattcccagcactttgggaggcctaggcaggaggattgcttgagcctgggacttcgagaccagactgggaaacatggcaaaatcccatctctacaacaaaaatacaaaaattagccaagtgcggtggtgtgcctgtagtcctagttacttgggaggctgaggtgggagaatcacctgagcccaggaggtggaggctgcagtgagccatgccaatgcactccagtctgggcaacagagtgagaccctgtctcaaaaataaataaataaataaatgaataaagagaatgctaatcatttctgggttcactgcgactcactgtagtgctggggatcccccttgtaacactggaactgaaagacagtgatgaaagctatgtcaagcattcattattctgaagaggaggagaaatgccacatacctttcccatgggacctgtggtggaatgaatccatacttctgcctcacttcgagcagacttttgttctcggcgctcctcacgatggagtttcatgcttcattttcacatctctctgcacaattagattgggagctccttgagggcagagtacgtgccttaatctttatctttgtaatgccacaatgaacagagtgcctcctggtacactgtaggagcttaagaaatactcactgaatgcatgaatgaatgaatgaacaaatgaaggaatgactaaggatgtttgtagtgctataatatagaatgggatttactctgctttaccagttagtttcataataaacaaatagtctgtatcgcctggtaaaaaaaaaagt

SEQ ID NO: 440158 - DNA, 3020 bp, Homo sapiens
gggaaggccagagcgggcgtccccgccagtgaccccacgccgcccgtccgcgcccaacccggcctccgccgagtgtccaaaccaaaagcgaaaggaacccgaccccgcgtcccctccggcggctccgtagtcgcgtccgcttggagctcgccgggcgcctccgaccctgccgggccgctttgtgacttcactcgtttcgcaacaagcccgggcagcccgcgccccacccactctggcccggcagcctcgccgcccgcagcctcgctccgctcctcgcgcttcccctccctccggggctgggcctgccccggccgtcgcggagcctcccctcccaccgtccgtgagtgtacgcgcccggccgccgcctccaggcagcccggagcaacccggcgcccggccccgctgggcgcagcactccgtcggcggcggcggcggcgcgatgctgtgcttcctgaggggaatggctttcgtccccttcctcttggtgacctggtcgtcagccgccttcattatctcctacgtggtcgccgtgctctccgggcacgtcaaccccttcctcccgtatatcagtgatacgggaacaacacctccagagagtggtatttttggatttatgataaacttctctgcatttcttggtgcagccacgatgtatacaagatacaaaatagtacagaagcaaaatcaaacctgctatttcagcactcctgtttttaacttggtgtctttagtgcttggattggtgggatgtttcggaatgggcattgtcgccaattttcaggagttagctgtgccagtggttcatgacgggggcgctcttttggcctttgtctgtggtgtcgtgtacacgctcctacagtccatcatctcttacaaatcatgtccccagtggaacagtctctcgacatgccacatacggatggtcatctctgccgtttcttgcgcagctgtcatccccatgattgtctgtgcttcactaatttccataaccaagctggagtggaatccaagagaaaaggattatgtatatcacgtagtgagtgcgatctgtgaatggacagtggcctttggttttattttctacttcctaactttcatccaagatttccagagtgtcaccctaaggatatccacagaaatcaatggtgatatttgaagaaagaagaattcagtctcactcagtgaatgtcgcaggccatttctaaaagtgctacagaggacagacagggttttgaggccaccctgattattgggatgcatctgcagcacatccaggacttgaatttcattacgagttcctaatagttgtatttctaaagatgtgtttcctagagaatgtacagccttatgacactgtagtgatgtttttataattttctaagtagatttttttatattaacaaattcatatacagaaaaaataaggtgttacaaaaaatggagagctcttatttttgtacagattctgtcgtttttgttttatttgtgtgagatttatggaaatacactaaatgagtaattcaggttcagtacatttattacaaagtgaaatcaggggatattcatttgtaaattttattcttagtgaatgaactgtataattttttttatcaggagagcacttataaaattcaatttataaagatcatatacccaaatcataaagatttagttgatacattaacactaagatactctgatttttagccgaactaaacaaagtgcttctactgagaggcctttataccaccatgtacagtaactctaagtgaatacggaagaccttggttttgaaattctgccaccttgtttctccctgctcatgaggtcgcaccttttgctcttgctgctaattgcccattcgtagtgggtgtaatgccaggtggaatggtttcaacaagtcaggtgaaaaccatcctttattgttgctggcacaacttgatatatagtctgactcagaactgaagctcacatctcaaattcatttcatgccagtaaatgtggcaaagagaagaaaggcccaagagcgagacaagaagaatggagaagggggcagccaagaagaacttctgggttcagggtactgtttatttgctccttctcttcatgcctgtggctggatgtcccacaacactataagaaatataagtcaagccctttgtgttaagcaagaactacagactccatcttttcacccaaatcatgaatgaccaataaaaagcaagttattccagaggaagaagcagcccttgaaatgttaaggcttaggcttgaaaggtgaagagcaggaattctctctttcaaatcctagagcataaacccatgtgtggccaagtgagatcagccctcaagggcacatgccaagggcagagcagcccatgtagacagcttcggagggcatgggggtgtagggagttcggggtagctcctcattaactatttgttgggtgagtaaaggggtgaggctcagtggcaggtacctctgcaatgacaagctgcctcccctctatgtgtttagcatatgttattagaacatgtccgacacccctaccgctgccatttgggccctttaataaagccaagtagagaaatctggcaataaaaggcaaatgtaagcatgctttctttaagacgcatcataaatggttttctttaagtgaatggaagagtttgacagagatacacctttgtaagaaaacattaagaatgctggctggctgtggtggctcacacctgtattcccagcactttgggaggcctaggcaggaggattgcttgagcctgggacttcgagaccagactgggaaacatggcaaaatcccatctctacaacaaaaatacaaaaattagccaagtgcggtgtgctgggactacaggcgtgagccactgcgcctggcccagtaatttgttttgctgttaaattagaaaatatcacttggctactactatgaagtagatttatctgggagatgattccagatccatttggactttataaaggtatgattacgatttaaacc

SEQ ID NO: 440159 - DNA, 1492 bp, Homo sapiens
gggaaggccagagcgggcgtccccgccagtgaccccacgccgcccgtccgcgcccaacccggcctccgccgagtgtccaaaccaaaagcgaaaggaacccgaccccgcgtcccctccggcggctccgtagtcgcgtccgcttggagctcgccgggcgcctccgaccctgccgggccgctttgtgacttcactcgtttcgcaacaagcccgggcagcccgcgccccacccactctggcccggcagcctcgccgcccgcagcctcgctccgctcctcgcgcttcccctccctccggggctgggcctgccccggccgtcgcggagcctcccctcccaccgtccgtgagtgtacgcgcccggccgccgcctccaggcagcccggagcaacccggcgcccggccccgctgggcgcagcactccgtcggcggcggcggcggcgcgatgctgtgcttcctgaggggaatggctttcgtccccttcctcttggtgacctggtcgtcagccgccttcattatctcctacgtggtcgccgtgctctccgggcacgtcaaccccttcctcccgtatatcagtgatacgggaacaacacctccagagagtggtatttttggatttatgataaacttctctgcatttcttggtgcagccacgatgtatacaagatacaaaatagtacagaagcaaaatcaaacctgctatttcagcactcctgtttttaacttggtgtctttagtgcttggattggtgggatgtttcggaatgggcattgtcgccaattttcaggagttagctgtgccagtggttcatgacgggggcgctcttttggcctttgtctgtggtgtcgtgtacacgctcctacagtccatcatctcttacaaatcatgtccccagtggaacagtctctcgacatgccacatacggatggtcatctctgccgtttcttgcgcagctgtcatccccagtatcctttttcacatttgtgccttgttaaaggaataaaacattcagtgacactgttaaagaagggtaatgaagactttatagggaccgctgcaatgagttctgacagcagggcggagagattgggctcaactctgaatacagcattggcaagtgcgaatctatagccaaggagtaggatgaggtcagtgaatggaaaagtactaaaaggaaacctcaaggatgagggggaattctggccaaaccaacctaacaggattcttattgagtactggccatgtgatcagacatcacctgggaagggtggaggaggaggaggaacccaatcagatattgagtgtgatcagatatgagggtggggggtccttgctaaactgacttagccagggttctttgctaaaactggatcttacaaggaagtgcacagatggacctaggagaagtttcaggggcttgactaaagttcagccaagcaaaggatctttgtcaccgtgtcttagcaaagcttgacacttcccttccccacaaccaaaa

SEQ ID NO: 440160 - DNA, 1440 bp, Homo sapiens
gggaaggccagagcgggcgtccccgccagtgaccccacgccgcccgtccgcgcccaacccggcctccgccgagtgtccaaaccaaaagcgaaaggaacccgaccccgcgtcccctccggcggctccgtagtcgcgtccgcttggagctcgccgggcgcctccgaccctgccgggccgctttgtgacttcactcgtttcgcaacaagcccgggcagcccgcgccccacccactctggcccggcagcctcgccgcccgcagcctcgctccgctcctcgcgcttcccctccctccggggctgggcctgccccggccgtcgcggagcctcccctcccaccgtccgtgagtgtacgcgcccggccgccgcctccaggcagcccggagcaacccggcgcccggccccgctgggcgcagcactccgtcggcggcggcggcggcgcgatgctgtgcttcctgaggggaatggctttcgtccccttcctcttggtgacctggtcgtcagccgccttcattatctcctacgtggtcgccgtgctctccgggcacgtcaaccccttcctcccgtatatcagtgatacgggaacaacacctccagagagtggtatttttggatttatgataaacttctctgcatttcttggtgcagccacgatgtatacaagatacaaaatagtacagaagcaaaatcaaacctgctatttcagcactcctgtttttaacttggtgtctttagtgcttggattggtgggatgtttcggaatgggcattgtcgccaattttcaggagttagctgtgccagtggttcatgacgggggcgctcttttggcctttgtctgtggtgtcgtgtacacgctcctacagtccatcatctcttacaaatcatgtccccagtggaacagtctctcgacatgccacatacggatggtcatctctgccgtttcttgcgcagctgtcatccccatgattgtctgtgcttcactaatttccataaccaagctggagtggaatccaagagaaaaggtaatacaggagttgatggcaacgatggttactcattatgaaccacactgaaacgaccttcaattcaatttccatctgctaataaatatagtcaagtgctgcataatgttttggtcaacatcccctaagattataaaaccatatttgactgcaccttttctacatttagatacacaaataccactgtgttacaactgcctacagtattcagtacagtgacatgctgtgcaggtttgtagcctagaagcaataggtttgtgtaagtacacttgttatgaaatccacaatgtttgtacaataaaaccgcctaatgacgcatttctcagaacatatccctgttgttaatcaatgcatgactgcataagaatatctgacttaaaaaacacatgaactaatggccaagtggtgaaaggctgcatatg

SEQ ID NO: 440161 - DNA, 3529 bp, Homo sapiens
gggaaggccagagcgggcgtccccgccagtgaccccacgccgcccgtccgcgcccaacccggcctccgccgagtgtccaaaccaaaagcgaaaggaacccgaccccgcgtcccctccggcggctccgtagtcgcgtccgcttggagctcgccgggcgcctccgaccctgccgggccgctttgtgacttcactcgtttcgcaacaagcccgggcagcccgcgccccacccactctggcccggcagcctcgccgcccgcagcctcgctccgctcctcgcgcttcccctccctccggggctgggcctgccccggccgtcgcggagcctcccctcccaccgtccgtgagtgtacgcgcccggccgccgcctccaggcagcccggagcaacccggcgcccggccccgctgggcgcagcactccgtcggcggcggcggcggcgcgatgctgtgcttcctgaggggaatggctttcgtccccttcctcttggtgacctggtcgtcagccgccttcattatctcctacgtggtcgccgtgctctccgggcacgtcaaccccttcctcccgtatatcagtgatacgggaacaacacctccagagagtggtatttttggatttatgataaacttctctgcatttcttggtgcagccacgatgtatacaagatacaaaatagtacagaagcaaaatcaaacctgctatttcagcactcctgtttttaacttggtgtctttagtgcttggattggtgggatgtttcggaatgggcattgtcgccaattttcaggagttagctgtgccagtggttcatgacgggggcgctcttttggcctttgtctgtggtgtcgtgtacacgctcctacagtccatcatctcttacaaatcatgtccccagtggaacagtctctcgacatgccacatacggatggtcatctctgccgtttcttgcgcagctgtcatccccatgattgtctgtgcttcactaatttccataaccaagctggagtggaatccaagagaaaaggattatgtatatcacgtagtgagtgcgatctgtgaatggacagtggcctttggttttattttctacttcctaactttcatccaagatttccagagtgtcaccctaaggatatccacagaaatcaatggtgatatttgaagaaagaagaattcagtctcactcagtgaatgtcgcaggccatttctaaaagtgctacagaggacagacagggttttgaggccaccctgattattgggatgcatctgcagcacatccaggacttgaatttcattacgagttcctaatagttgtatttctaaagatgtgtttcctagagaatgtacagccttatgacactgtagtgatgtttttataattttctaagtagatttttttatattaacaaattcatatacagaaaaaataaggtgttacaaaaaatggagagctcttatttttgtacagattctgtcgtttttgttttatttgtgtgagatttatggaaatacactaaatgagtaattcaggttcagtacatttattacaaagtgaaatcaggggatattcatttgtaaattttattcttagtgaatgaactgtataattttttttatcaggagagcacttataaaattcaatttataaagatcatatacccaaatcataaagatttagttgatacattaacactaagatactctgatttttagccgaactaaacaaagtgcttctactgagaggcctttataccaccatgtacagtaactctaagtgaatacggaagaccttggttttgaaattctgccaccttgtttctccctgctcatgaggtcgcaccttttgctcttgctgctaattgcccattcgtagtgggtgtaatgccaggtggaatggtttcaacaagtcaggtgaaaaccatcctttattgttgctggcacaacttgatatatagtctgactcagaactgaagctcacatctcaaattcatttcatgccagtaaatgtggcaaagagaagaaaggcccaagagcgagacaagaagaatggagaagggggcagccaagaagaacttctgggttcagggtactgtttatttgctccttctcttcatgcctgtggctggatgtcccacaacactataagaaatataagtcaagccctttgtgttaagcaagaactacagactccatcttttcacccaaatcatgaatgaccaataaaaagcaagttattccagaggaagaagcagcccttgaaatgttaaggcttaggcttgaaaggtgaagagcaggaattctctctttcaaatcctagagcataaacccatgtgtggccaagtgagatcagccctcaagggcacatgccaagggcagagcagcccatgtagacagcttcggagggcatgggggtgtagggagttcggggtagctcctcattaactatttgttgggtgagtaaaggggtgaggctcagtggcaggtacctctgcaatgacaagctgcctcccctctatgtgtttagcatatgttattagaacatgtccgacacccctaccgctgccatttgggccctttaataaagccaagtagagaaatctggcaataaaaggcaaatgtaagcatgctttctttaagacgcatcataaatggttttctttaagtgaatggaagagtttgacagagatacacctttgtaagaaaacattaagaatgctggctggctgtggtggctcacacctgtattcccagcactttgggaggcctaggcaggaggattgcttgagcctgggacttcgagaccagactgggaaacatggcaaaatcccatctctacaacaaaaatacaaaaattagccaagtgcggtggtgtgcctgtagtcctagttacttgggaggctgaggtgggagaatcacctgagcccaggaggtggaggctgcagtgagccatgccaatgcactccagtctgggcaacagagtgagaccctgtctcaaaaataaataaataaataaatgaataaagagaatgctaatcatttctgggttcactgcgactcactgtagtgctggggatcccccttgtaacactggaactgaaagacagtgatgaaagctatgtcaagcattcattattctgaagaggaggagaaatgccacatacctttcccatgggacctgtggtggaatgaatccatacttctgcctcacttcgagcagacttttgttctcggcgctcctcacgatggagtttcatgcttcattttcacatctctctgcacaattagattgggagctccttgagggcagagtacgtgccttaatctttatctttgtaatgccacaatgaacagagtgcctcctggtacactgtaggagcttaagaaatactcactgaatgcatgaatgaatgaatgaacaaatgaaggaatgactaaggatgtttgtagtgctataatatagaatgggatttactctgctttaccagttagtttcataataaacaaatagtctgtatcgcctggtaaaaaaaaaagt

SEQ ID NO: 440162 - DNA, 3468 bp, Homo sapiens
gggaaggccagagcgggcgtccccgccagtgaccccacgccgcccgtccgcgcccaacccggcctccgccgagtgtccaaaccaaaagcgaaaggaacccgaccccgcgtcccctccggcggctccgtagtcgcgtccgcttggagctcgccgggcgcctccgaccctgccgggccgctttgtgacttcactcgtttcgcaacaagcccgggcagcccgcgccccacccactctggcccggcagcctcgccgcccgcagcctcgctccgctcctcgcgcttcccctccctccggggctgggcctgccccggccgtcgcggagcctcccctcccaccgtccgtgagtgtacgcgcccggccgccgcctccaggcagcccggagcaacccggcgcccggccccgctgggcgcagcactccgtcggcggcggcggcggcgcgatgctgtgcttcctgaggggaatggctttcgtccccttcctcttggtgacctggtcgtcagccgccttcattatctcctacgtggtcgccgtgctctccgggcacgtcaaccccttcctcccgtatatcagtgatacgggaacaacacctccagagagtggtatttttggatttatgataaacttctctgcatttcttggtgcagccacgatgtatacaagatacaaaatagtacagaagcaaaatcaaacctgctatttcagcactcctgtttttaacttggtgtctttagtgcttggattggtgggatgtttcggaatgggcattgtcgccaattttcaggagttagctgtgccagtggttcatgacgggggcgctcttttggcctttgtctgtggtgtcgtgtacacgctcctacagtccatcatctcttacaaatcatgtccccagtggaacagtctctcgacatgccacatacggatggtcatctctgccgtttcttgcgcagctgtcatccccatgattgtctgtgcttcactaatttccataaccaagctggagtggaatccaagagaaaaggattatgtatatcacgtagtgagtgcgatctgtgaatggacagtggcctttggttttattttctacttcctaactttcatccaagatttccagagtgtcaccctaaggatatccacagaaatcaatggtgatatttgaagaaagaagaattcagtctcactcagtgaatgtcgcaggccatttctaaaagtgctacagaggacagacagggttttgaggccaccctgattattgggatgcatctgcagcacatccaggacttgaatttcattacgagttcctaatagttgtatttctaaagatgtgtttcctagagaatgtacagccttatgacactgtagtgatgtttttataattttctaagtagatttttttatattaacaaattcatatacagaaaaaataaggtgttacaaaaaatggagagctcttatttttgtacagattctgtcgtttttgttttatttgtgtgagatttatggaaatacactaaatgagtaattcaggttcagtacatttattacaaagtgaaatcaggggatattcatttgtaaattttattcttagtgaatgaactgtataattttttttatcaggagagcacttataaaattcaatttataaagatcatatacccaaatcataaagatttagttgatacattaacactaagatactctgatttttagccgaactaaacaaagtgcttctactgagaggcctttataccaccatgtacagtaactctaagtgaatacggaagaccttggttttgaaattctgccaccttgtttctccctgctcatgaggtcgcaccttttgctcttgctgctaattgcccattcgtagtgggtgtaatgccaggtggaatggtttcaacaagtcaggtgaaaaccatcctttattgttgctggcacaacttgatatatagtctgactcagaactgaagctcacatctcaaattcatttcatgccagtaaatgtggcaaagagaagaaaggcccaagagcgagacaagaagaatggagaagggggcagccaagaagaacttctgggttcagggtactgtttatttgctccttctcttcatgcctgtggctggatgtcccacaacactataagaaatataagtcaagccctttgtgttaagcaagaactacagactccatcttttcacccaaatcatgaatgaccaataaaaagcaagttattccagaggaagaagcagcccttgaaatgttaaggcttaggcttgaaaggtgaagagcaggaattctctctttcaaatcctagagcataaacccatgtgtggccaagtgagatcagccctcaagggcacatgccaagggcagagcagcccatgtagacagcttcggagggcatgggggtgtagggagttcggggtagctcctcattaactatttgttgggtgagtaaaggggtgaggctcagtggcaggtacctctgcaatgacaagctgcctcccctctatgtgtttagcatatgttattagaacatgtccgacacccctaccgctgccatttgggccctttaataaagccaagtagagaaatctggcaataaaaggcaaatgtaagcatgctttctttaagacgcatcataaatggttttctttaagtgaatggaagagtttgacagagatacacctttgtaagaaaacattaagaatgctggctggctgtggtggctcacacctgtattcccagcactttgggaggcctaggcaggaggattgcttgagcctgggacttcgagaccagactgggaaacatggcaaaatcccatctctacaacaaaaatacaaaaattagccaagtgcggtggtgtgcctgtagtcctagttacttgggaggctgaggtgggagaatcacctgagcccaggaggtggaggctgcagtgagccatgccaatgcactccagtctgggcaacagagtgagttcactgcgactcactgtagtgctggggatcccccttgtaacactggaactgaaagacagtgatgaaagctatgtcaagcattcattattctgaagaggaggagaaatgccacatacctttcccatgggacctgtggtggaatgaatccatacttctgcctcacttcgagcagacttttgttctcggcgctcctcacgatggagtttcatgcttcattttcacatctctctgcacaattagattgggagctccttgagggcagagtacgtgccttaatctttatctttgtaatgccacaatgaacagagtgcctcctggtacactgtaggagcttaagaaatactcactgaatgcatgaatgaatgaatgaacaaatgaaggaatgactaaggatgtttgtagtgctataatatagaatgggatttactctgctttaccagttagtttcataataaacaaatagtctgtatcgcctggtaaaaaaaaaagt

SEQ ID NO: 440163 - DNA, 1122 bp, Homo sapiens
gggaaggccagagcgggcgtccccgccagtgaccccacgccgcccgtccgcgcccaacccggcctccgccgagtgtccaaaccaaaagcgaaaggaacccgaccccgcgtcccctccggcggctccgtagtcgcgtccgcttggagctcgccgggcgcctccgaccctgccgggccgctttgtgacttcactcgtttcgcaacaagcccgggcagcccgcgccccacccactctggcccggcagcctcgccgcccgcagcctcgctccgctcctcgcgcttcccctccctccggggctgggcctgccccggccgtcgcggagcctcccctcccaccgtccgtgagtgtacgcgcccggccgccgcctccaggcagcccggagcaacccggcgcccggccccgctgggcgcagcactccgtcggcggcggcggcggcgcgatgctgtgcttcctgaggggaatggctttcgtccccttcctcttggtgacctggtcgtcagccgccttcattatctcctacgtggtcgccgtgctctccgggcacgtcaaccccttcctcccgtatatcagaccctgtctcaaaaataaataaataaataaatgaataaagagaatgctaatcatttctgggttcactgcgactcactgtagtgctggggatcccccttgtaacactggaactgaaagacagtgatgaaagctatgtcaagcattcattattctgaagaggaggagaaatgccacatacctttcccatgggacctgtggtggaatgaatccatacttctgcctcacttcgagcagacttttgttctcggcgctcctcacgatggagtttcatgcttcattttcacatctctctgcacaattagattgggagctccttgagggcagagtacgtgccttaatctttatctttgtaatgccacaatgaacagagtgcctcctggtacactgtaggagcttaagaaatactcactgaatgcatgaatgaatgaatgaacaaatgaaggaatgactaaggatgtttgtagtgctataatatagaatgggatttactctgctttaccagttagtttcataataaacaaatagtctgtatcgcctggtaaaaaaaaaagt

SEQ ID NO: 440164 - DNA, 903 bp, Homo sapiens
gggaaggccagagcgggcgtccccgccagtgaccccacgccgcccgtccgcgcccaacccggcctccgccgagtgtccaaaccaaaagcgaaaggaacccgaccccgcgtcccctccggcggctccgtagtcgcgtccgcttggagctcgccgggcgcctccgaccctgccgggccgctttgtgacttcactcgtttcgcaacaagcccgggcagcccgcgccccacccactctggcccggcagcctcgccgcccgcagcctcgctccgctcctcgcgcttcccctccctccggggctgggcctgccccggccgtcgcggagcctcccctcccaccgtccgtgagtgtacgcgcccggccgccgcctccaggcagcccggagcaacccggcgcccggccccgctgggcgcagcactccgtcggcggcggcggcggcgcgatgctgtgcttcctgaggggaatggctttcgtccccttcctcttggtgacctggtcgtcagccgccttcattatctcctacgtggtcgccgtgctctccgggcacgtcaaccccttcctcccgtatatcagtgatacgggaacaacacctccagagagtggtatttttggatttatgataaacttctctgcatttcttggtgcagccacgatgtatacaagatacaaaatagtacagaagcaaaatcaaacctgctatttcagcactcctgtttttaacttggtgtctttagtgcttggattggtgggatgtttcggaatgggcattgtcgccaattttcaggtataatctggagctttttcagttatgaggagtggtggagtgtatgtgtctgaagagagcagcagaaatgcaagaggcacacttatgccattatagccattaaatgcttgatgagtttacaa

SEQ ID NO: 440165 - DNA, 556 bp, Homo sapiens
tggggtaattatttctggatcagccgaggccctgctcctcaggccttcttgaggggagcaccagggctgcgggtcagggatgaagctgatggccctgaagccgttcccctgccccagaataccgtcctgcagccactcactctgggttcacgtccttctgctggaacaggctgttttggagtcagcggaagatcaccaaggccagggagtggttccaccgcactgtgaagattgactcggacctgggggatgcctgggccttcttctacaagtttgagctgcagcatggcactgaggagcagcaggaggaggtgaggaagcgctgtgagagtgcagagcctcggcatggggagctgtggtgcgccgtgtccaaggacatcgccaactggcagaagaagatcggggacatccttaggctggtggccggccgcatcaagaacaccttctgattgagcggttgccatggccggtctccgtggggcagggttgggccgcatgtggaagggctctgagctgtgtcctccttcattaaaagtttttatgtctcgtgtcagaa

SEQ ID NO: 440166 - DNA, 523 bp, Homo sapiens
agggaatcaaaagtgggcggggcgtgtgcggactgagcgctctgcttccggggcgcgggtgacgcgacgacggcgacactttgctacggagtgcatcggacgtcgaagcctagagtctctgcgtctttccctcttccgctgcctcattcctttccttcctagccttggtcgtcgccgccaccatgaacaagaagaagaaaccgttcctagggatgcccgcgcccctcggctacgtgccggggctgggccggggcgccactggcttcaccacgcggtcagacattgggcccgcccgtgatgcaaatgaccctgtggatgatcgccatgcacccccaggcaagagaaccgttggggaccagatgaagaaaaatcaggctgctgacgatgacgacgaggatctaaatgacaccaattacgatgagtttaatggctatgctgggagcctcttctcaagtggaccctacgagaaagatgatgaggaagcagatgctatctatgcagccctggataaaaggatggatga

SEQ ID NO: 440167 - DNA, 614 bp, Homo sapiens
tcgaatcgagctcggaccccagcagcgcgttggagactgggggttgctggatggtactggggagtcctgtgccaaaccagaagcaggcacaggtgtgaatgggccctgagggacctgggcatgcccactgtcgctcttgatggattcaggcctggagttcgtcttggggtgaacacattcagaagcccttttcagtcgttgtgcacacctgactgcatttctttgctagtagcaaatgatacacctacgagaggaggacaggaagtctcatggcttctttctttgctagtagaaatgatacacctacgagaggaggacaggaagtctcacggcttctttctttgctagtagaaatgatacacctacgagaggaggacaggaagtctcacggcttctttctttgctagtagaaatgatacacctacgagaggaggaccggaagtctcacggcttctttctttgctagtagaaatgatacacctacgagaggaggacaggaagtctcacggcttctttctttgctagtagaaatgatacacctacgagaggaggacaggaagtctcacggcttctttcttgctagtagatgatacacccacagagcgactgaccgg

SEQ ID NO: 440168 - DNA, 464 bp, Homo sapiens
tatgtgctgttggtagacggctgtgggacctccgggggcctgtctcctcaggttggagtccgtgcggctggagtaccgtgcggggctgaagaacatcgcaaatacactcatggccaaggcgctgcaggagtgccccaactccggtaagggggtgccccgactccggtaagggggtgccctgactccggtaagggggtgccttgactccggtaagggggtgcttcctggcttcccagactccgcagggctggcacttcctgagggagtgggggctcaggcttcagacggactttattaaaatgtgtagtttgtgtgaatcatttcagtcaaaagtttcagctatactcggccgttaagacaacttaatgaaattcttggcctcaaaatgggagaatttgatttcatttctgaagtgttatcatttctttttcttttaaaatttaaaagaaattggccaggtgtgg

SEQ ID NO: 440169 - DNA, 588 bp, Homo sapiens
agcagctgtaaggtgggcacggaagagctcagtgtgggccaagttgggtttaagggcctggttggatgtggagggggagatgatcgaagccttagggtggagagagattgccttggtaacatcatcagggtaggctgaaactttcaggtaagcagagaagatcagaagtgtttgagactgcagttcattgtcaccaggatctttggaggtttcccaaaggtgttagaaaaagaggtgttagtaagtgataaccaggagtggagaagagcacaggaacagagttattcagacacccggtgtcttgggggtctcctgcagcgccactggcttcaccacgcggtcagacattgggcccgcccgtgatgcaaatgaccctgtggatgatcgccatgcacccccaggcaagagaaccgttggggaccagatgaagaaaaatcaggctgctgacgatgacgacgaggatctaaatgacaccaattacgatgagtttaatggctatgctgggagcctcttctcaagtggaccctacgagaaagatgatgaggaagcagatgctatctatgcagccctggataaaaggatggatga

SEQ ID NO: 440170 - DNA, 366 bp, Homo sapiens
cctgagggactcggtcacccactgcagatgagaagctgggcatggctgtgtccagttctccatagacaccacctgagctgctctcttacttgttggttgcagttgaagaagtgtccccactccacacccctgtggcttttgctctctcggctggaggagaagattgggcagcttactcgagcacgggccattttggaaaagtctcgtctgaagaacccaaagaaccctgggctgtggtgagtcctggagggggcagcctggcctctgggcacagcttccccatcaggtgggccgccgtcacccagctgcttgtgtggagtcactcgtgcagtgcttccaggctcaggggcttggggggcggtaggt

SEQ ID NO: 440171 - DNA, 3065 bp, Homo sapiens
  misc_feature (17)..(17): n is a, c, g, or t
aaaaaaaataggctagnagagccggtgttaatcctacggagtgcatcggacgtcgaagcctagagtctctgcgtctttccctcttccgctgcctcattcctttccttcctagccttggtcgtcgccgccaccatgaacaagaagaagaaaccgttcctagggatgcccgcgcccctcggctacgtgccggggctgggccggggcgccactggcttcaccacgcggtcagacattgggcccgcccgtgatgcaaatgaccctgtggatgatcgccatgcacccccaggcaagagaaccgttggggaccagatgaagaaaaatcaggctgctgacgatgacgacgaggatctaaatgacaccaattacgatgagtttaatggctatgctgggagcctcttctcaagtggaccctacgagaaagatgatgaggaagcagatgctatctatgcagccctggataaaaggatggatgaaagaagaaaagaaagacgggagcaaagggagaaagaagaaatagagaaatatcgtatggaacgccccaaaatccaacagcagttctcagacctcaagaggaagttggcagaagtcacagaagaagagtggctgagcatccccgaggttggcgatgccagaaataaacgtcagcggaacccacgctatgagaagctgacccctgttcctgacagtttctttgccaaacatttacagaccggagagaaccatacctcagtggatccccgacaaactcaatttggaggtcttaacacaccctatccaggtggactaaacactccatacccaggtggaatgacgccaggactgatgacacctggcacaggtgagctggacatgaggaagattggccaagcgaggaacactctgatggacatgaggctgagccaggtgtctgactccgtgagtggacagaccgtcgttgaccccaaaggctacctgacggatttaaattccatgatcccgacacacggaggagacatcaatgatatcaagaaggcgcgactgctcctcaagtctgttcgggagacgaaccctcatcacccgccagcctggattgcatcagcccgcctggaagaagtcactgggaagctacaagtagctcggaaccttatcatgaaggggacggagatgtgccccaagagtgaagatgtctggctggaagcagccaggttgcagcctggggacacagccaaggccgtggtagcccaagctgtccgtcatctcccacagtctgtcaggatttacatcagagccgcagagctggaaacggacattcgtgcaaagaagcgggttcttcggaaagccctcgagcatgttccaaactcggttcgcttgtggaaagcagccgttgagctggaagaacctgaagatgctagaatcatgctgagccgagctgtggagtgctgccccaccagcgtggagctctggcttgctctggcaaggctggagacctatgaaaatgcccgcaaggtcttgaacaaggcgcgggagaacattcctacagaccgacatatctggatcacggctgctaagctggaggaagccaatgggaacacgcagatggtggagaagatcatcgaccgagccatcacctcgctgcgggccaacggtgtggagatcaaccgtgagcagtggatccaggatgccgaggaatgtgacagggctgggagtgtggccacctgccaggccgtcatgcgtgccgtgattgggattgggattgaggaggaagatcggaagcatacctggatggaggatgctgacagttgtgtagcccacaatgccctggagtgtgcacgagccatctacgcctacgccctgcaggtgttccccagcaagaagagtgtgtggctgcgcgccgcgtacttcgagaagaaccatggcactcgggagtccctggaagcactcctgcagagggctgtggcccactgccccaaagcagaggtgctgtggctcatgggcgccaagtccaagtggctggcaggggatgtgcctgcagcaaggagcatcctggccctggccttccaggccaaccccaacagtgaggagatctggctggcagccgtgaagctggagtccgagaatgatgagtacgagcgggcccggaggctgctggccaaggcgcggagcagtgcccccaccgcccgggtgttcatgaagtctgtgaagctggagtgggtgcaagacaacatcagggcagcccaagatctgtgcgaggaggccctgcggcactatgaggacttccccaagctgtggatgatgaaggggcagatcgaggagcagaaggagatgatggagaaggcgcgggaagcctataaccaggggttgaagaagtgtccccactccacacccctgtggcttttgctctctcggctggaggagaagattgggcagcttactcgagcacgggccattttggaaaagtctcgtctgaagaacccaaagaaccctgggctgtggttggagtccgtgcggctggagtaccgtgcggggctgaagaacatcgcaaatacactcatggccaaggcgctgcaggagtgccccaactccggtatcctgtggtctgaggccatcttcctcgaggcaaggccccagaggaggaccaagagcgtggatgccctgaagaagtgtgagcatgacccccatgtgctcctggccgtggccaagctgttttggagtcagcggaagatcaccaaggccagggagtggttccaccgcactgtgaagattgactcggacctgggggatgcctgggccttcttctacaagtttgagctgcagcatggcactgaggagcagcaggaggaggtgaggaagcgctgtgagagtgcagagcctcggcatggggagctgtggtgcgccgtgtccaaggacatcgccaactggcagaagaagatcggggacatccttaggctggtggccggccgcatcaagaacaccttctgattgagcggttgccatggccggtctccgtggggcagggttgggccgcatgtggaagggctctgagctgtgtcctccttcattaaaagtttttatgtctcgtgtcagaa

SEQ ID NO: 440172 - DNA, 3146 bp, Homo sapiens
agggaatcaaaagtgggcggggcgtgtgcggactgagcgctctgcttccggggcgcgggtgacgcgacgacggcgacactttgctacggagtgcatcggacgtcgaagcctagagtctctgcgtctttccctcttccgctgcctcattcctttccttcctagccttggtcgtcgccgccaccatgaacaagaagaagaaaccgttcctagggatgcccgcgcccctcggctacgtgccggggctgggccggggcgccactggcttcaccacgcggtcagacattgggcccgcccgtgatgcaaatgaccctgtggatgatcgccatgcacccccaggcaagagaaccgttggggaccagatgaagaaaaatcaggctgctgacgatgacgacgaggatctaaatgacaccaattacgatgagtttaatggctatgctgggagcctcttctcaagtggaccctacgagaaagatgatgaggaagcagatgctatctatgcagccctggataaaaggatggatgaaagaagaaaagaaagacgggagcaaagggagaaagaagaaatagagaaatatcgtatggaacgccccaaaatccaacagcagttctcagacctcaagaggaagttggcagaagtcacagaagaagagtggctgagcatccccgaggttggcgatgccagaaataaacgtcagcggaacccacgctatgagaagctgacccctgttcctgacagtttctttgccaaacatttacagaccggagagaaccatacctcagtggatccccgacaaactcaatttggaggtcttaacacaccctatccaggtggactaaacactccatacccaggtggaatgacgccaggactgatgacacctggcacaggtgagctggacatgaggaagattggccaagcgaggaacactctgatggacatgaggctgagccaggtgtctgactccgtgagtggacagaccgtcgttgaccccaaaggctacctgacggatttaaattccatgatcccgacacacggaggagacatcaatgatatcaagaaggcgcgactgctcctcaagtctgttcgggagacgaaccctcatcacccgccagcctggattgcatcagcccgcctggaagaagtcactgggaagctacaagtagctcggaaccttatcatgaaggggacggagatgtgccccaagagtgaagatgtctggctggaagcagccaggttgcagcctggggacacagccaaggccgtggtagcccaagctgtccgtcatctcccacagtctgtcaggatttacatcagagccgcagagctggaaacggacattcgtgcaaagaagcgggttcttcggaaagccctcgagcatgttccaaactcggttcgcttgtggaaagcagccgttgagctggaagaacctgaagatgctagaatcatgctgagccgagctgtggagtgctgccccaccagcgtggagctctggcttgctctggcaaggctggagacctatgaaaatgcccgcaaggtcttgaacaaggcgcgggagaacattcctacagaccgacatatctggatcacggctgctaagctggaggaagccaatgggaacacgcagatggtggagaagatcatcgaccgagccatcacctcgctgcgggccaacggtgtggagatcaaccgtgagcagtggatccaggatgccgaggaatgtgacagggctgggagtgtggccacctgccaggccgtcatgcgtgccgtgattgggattgggattgaggaggaagatcggaagcatacctggatggaggatgctgacagttgtgtagcccacaatgccctggagtgtgcacgagccatctacgcctacgccctgcaggtgttccccagcaagaagagtgtgtggctgcgcgccgcgtacttcgagaagaaccatggcactcgggagtccctggaagcactcctgcagagggctgtggcccactgccccaaagcagaggtgctgtggctcatgggcgccaagtccaagtggctggcaggggatgtgcctgcagcaaggagcatcctggccctggccttccaggccaaccccaacagtgaggagatctggctggcagccgtgaagctggagtccgagaatgatgagtacgagcgggcccggaggctgctggccaaggcgcggagcagtgcccccaccgcccgggtgttcatgaagtctgtgaagctggagtgggtgcaagacaacatcagggcagcccaagatctgtgcgaggaggccctgcggcactatgaggacttccccaagctgtggatgatgaaggggcagatcgaggagcagaaggagatgatggagaaggcgcgggaagcctataaccaggggttgaagaagtgtccccactccacacccctgtggcttttgctctctcggctggaggagaagattgggcagcttactcgagcacgggccattttggaaaagtctcgtctgaagaacccaaagaaccctgggctgtggttggagtccgtgcggctggagtaccgtgcggggctgaagaacatcgcaaatacactcatggccaaggcgctgcaggagtgccccaactccggtatcctgtggtctgaggccatcttcctcgaggcaaggccccagaggaggaccaagagcgtggatgccctgaagaagtgtgagcatgacccccatgtgctcctggccgtggccaagctgttttggagtcagcggaagatcaccaaggccagggagtggttccaccgcactgtgaagattgactcggacctgggggatgcctgggccttcttctacaagtttgagctgcagcatggcactgaggagcagcaggaggaggtgaggaagcgctgtgagagtgcagagcctcggcatggggagctgtggtgcgccgtgtccaaggacatcgccaactggcagaagaagatcggggacatccttaggctggtggccggccgcatcaagaacaccttctgattgagcggttgccatggccggtctccgtggggcagggttgggccgcatgtggaagggctctgagctgtgtcctccttcattaaaagtttttatgtctcgtgtcagaaagaaaaatcacaaacaaacacaacacaaaaa

SEQ ID NO: 440173 - DNA, 3180 bp, Homo sapiens
agcagctgtaaggtgggcacggaagagctcagtgtgggccaagttgggtttaagggcctggttggatgtggagggggagatgatcgaagccttagggtggagagagattgccttggtaacatcatcagggtaggctgaaactttcaggtaagcagagaagatcagaagtgtttgagactgcagttcattgtcaccaggatctttggaggtttcccaaaggtgttagaaaaagaggtgttagtaagtgataaccaggagtggagaagagcacaggaacagagttattcagacacccggtgtcttgggggtctcctgcagcgccactggcttcaccacgcggtcagacattgggcccgcccgtgatgcaaatgaccctgtggatgatcgccatgcacccccaggcaagagaaccgttggggaccagatgaagaaaaatcaggctgctgacgatgacgacgaggatctaaatgacaccaattacgatgagtttaatggctatgctgggagcctcttctcaagtggaccctacgagaaagatgatgaggaagcagatgctatctatgcagccctggataaaaggatggatgaaagaagaaaagaaagacgggagcaaagggagaaagaagaaatagagaaatatcgtatggaacgccccaaaatccaacagcagttctcagacctcaagaggaagttggcagaagtcacagaagaagagtggctgagcatccccgaggttggcgatgccagaaataaacgtcagcggaacccacgctatgagaagctgacccctgttcctgacagtttctttgccaaacatttacagaccggagagaaccatacctcagtggatccccgacaaactcaatttggaggtcttaacacaccctatccaggtggactaaacactccatacccaggtggaatgacgccaggactgatgacacctggcacaggtgagctggacatgaggaagattggccaagcgaggaacactctgatggacatgaggctgagccaggtgtctgactccgtgagtggacagaccgtcgttgaccccaaaggctacctgacggatttaaattccatgatcccgacacacggaggagacatcaatgatatcaagaaggcgcgactgctcctcaagtctgttcgggagacgaaccctcatcacccgccagcctggattgcatcagcccgcctggaagaagtcactgggaagctacaagtagctcggaaccttatcatgaaggggacggagatgtgccccaagagtgaagatgtctggctggaagcagccaggttgcagcctggggacacagccaaggccgtggtagcccaagctgtccgtcatctcccacagtctgtcaggatttacatcagagccgcagagctggaaacggacattcgtgcaaagaagcgggttcttcggaaagccctcgagcatgttccaaactcggttcgcttgtggaaagcagccgttgagctggaagaacctgaagatgctagaatcatgctgagccgagctgtggagtgctgccccaccagcgtggagctctggcttgctctggcaaggctggagacctatgaaaatgcccgcaaggtcttgaacaaggcgcgggagaacattcctacagaccgacatatctggatcacggctgctaagctggaggaagccaatgggaacacgcagatggtggagaagatcatcgaccgagccatcacctcgctgcgggccaacggtgtggagatcaaccgtgagcagtggatccaggatgccgaggaatgtgacagggctgggagtgtggccacctgccaggccgtcatgcgtgccgtgattgggattgggattgaggaggaagatcggaagcatacctggatggaggatgctgacagttgtgtagcccacaatgccctggagtgtgcacgagccatctacgcctacgccctgcaggtgttccccagcaagaagagtgtgtggctgcgcgccgcgtacttcgagaagaaccatggcactcgggagtccctggaagcactcctgcagagggctgtggcccactgccccaaagcagaggtgctgtggctcatgggcgccaagtccaagtggctggcaggggatgtgcctgcagcaaggagcatcctggccctggccttccaggccaaccccaacagtgaggagatctggctggcagccgtgaagctggagtccgagaatgatgagtacgagcgggcccggaggctgctggccaaggcgcggagcagtgcccccaccgcccgggtgttcatgaagtctgtgaagctggagtgggtgcaagacaacatcagggcagcccaagatctgtgcgaggaggccctgcggcactatgaggacttccccaagctgtggatgatgaaggggcagatcgaggagcagaaggagatgatggagaaggcgcgggaagcctataaccaggggttgaagaagtgtccccactccacacccctgtggcttttgctctctcggctggaggagaagattgggcagcttactcgagcacgggccattttggaaaagtctcgtctgaagaacccaaagaaccctgggctgtggttggagtccgtgcggctggagtaccgtgcggggctgaagaacatcgcaaatacactcatggccaaggcgctgcaggagtgccccaactccggtatcctgtggtctgaggccatcttcctcgaggcaaggccccagaggaggaccaagagcgtggatgccctgaagaagtgtgagcatgacccccatgtgctcctggccgtggccaagctgttttggagtcagcggaagatcaccaaggccagggagtggttccaccgcactgtgaagattgactcggacctgggggatgcctgggccttcttctacaagtttgagctgcagcatggcactgaggagcagcaggaggaggtgaggaagcgctgtgagagtgcagagcctcggcatggggagctgtggtgcgccgtgtccaaggacatcgccaactggcagaagaagatcggggacatccttaggctggtggccggccgcatcaagaacaccttctgattgagcggttgccatggccggtctccgtggggcagggttgggccgcatgtggaagggctctgagctgtgtcctccttcattaaaagtttttatgtctcgtgtcagaa

SEQ ID NO: 440174 - DNA, 3020 bp, Homo sapiens
agggaatcaaaagtgggcggggcgtgtgcggactgagcgctctgcttccggggcgcgggtgacgcgacgacggcgacactttgctacggagtgcatcggacgtcgaagcctagagtctctgcgtctttccctcttccgctgcctcattcctttccttcctagccttggtcgtcgccgccaccatgaacaagaagaagaaaccgttcctagggatgcccgcgcccctcggctacgtgccggggctgggccggggcgccactggcttcaccacgcggtcagacattgggcccgcccgtgatgcaaatgaccctgtggatgatcgccatgcacccccaggcaagagaaccgttggggaccagatgaagaaaaatcaggctgctgacgatgacgacgaggatctaaatgacaccaattacgatgagtttaatggctatgctgggagcctcttctcaagtggaccctacgagaaagatgatgaggaagcagatgctatctatgcagccctggataaaaggatggatgaaagaagaaaagaaagacgggagcaaagggagaaagaagaaatagagaaatatcgtatggaacgccccaaaatccaacagcagttctcagacctcaagaggaagttggcagaagtcacagaagaagagtggctgagcatccccgaggttggcgatgccagaaataaacgtcagcggaacccacgctatgagaagctgacccctgttcctgacagtttctttgccaaacatttacagaccggagagaaccatacctcagtggatccccgacaaactcaatttggaggtcttaacacaccctatccaggtggactaaacactccatacccaggtggaatgacgccaggactgatgacacctggcacaggtgagctggacatgaggaagattggccaagcgaggaacactctgatggacatgaggctgagccaggtgtctgactccgtgagtggacagaccgtcgttgaccccaaaggctacctgacggatttaaattccatgatcccgacacacggaggagacatcaatgatatcaagaaggcgcgactgctcctcaagtctgttcgggagacgaaccctcatcacccgccagcctggattgcatcagcccgcctggaagaagtcactgggaagctacaagtagctcggaaccttatcatgaaggggacggagatgtgccccaagagtgaagatgtctggctggaagcagccaggttgcagcctggggacacagccaaggccgtggtagcccaagctgtccgtcatctcccacagtctgtcaggatttacatcagagccgcagagctggaaacggacattcgtgcaaagaagcgggttcttcggaaagccctcgagcatgttccaaactcggttcgcttgtggaaagcagccgttgagctggaagaacctgaagatgctagaatcatgctgagccgagctgtggagtgctgccccaccagcgtggagctctggcttgctctggcaaggctggagacctatgaaaatgcccgcaaggtcttgaacaaggcgcgggagaacattcctacagaccgacatatctggatcacggctgctaagctggaggaagccaatgggaacacgcagatggtggagaagatcatcgaccgagccatcacctcgctgcgggccaacggtgtggagatcaaccgtgagcagtggatccaggatgccgaggaatgtgacagggctgggagtgtggccacctgccaggccgtcatgcgtgccgtgattgggattgggattgaggaggaagatcggaagcatacctggatggaggatgctgacagttgtgtagcccacaatgccctggagtgtgcacgagccatctacgcctacgccctgcaggtgttccccagcaagaagagtgtgtggctgcgcgccgcgtacttcgagaagaaccatggcactcgggagtccctggaagcactcctgcagagggctgtggcccactgccccaaagcagaggtgctgtggctcatgggcgccaagtccaagtggctggcaggggatgtgcctgcagcaaggagcatcctggccctggccttccaggccaaccccaacagtgaggagatctggctggcagccgtgaagctggagtccgagaatgatgagtacgagcgggcccggaggctgctggccaaggcgcggagcagtgcccccaccgcccgggtgttcatgaagtctgtgaagctggagtgggtgcaagacaacatcagggcagcccaagatctgtgcgaggaggccctgcggcactatgaggacttccccaagctgtggatgatgaaggggcagatcgaggagcagaaggagatgatggagaaggcgcgggaagcctataaccaggggttgaagaagtgtccccactccacacccctgtggcttttgctctctcggctggaggagaagattgggcagcttactcgagcacgggccattttggaaaagtctcgtctgaagaacccaaagaaccctgggctgtggttggagtccgtgcggctggagtaccgtgcggggctgaagaacatcgcaaatacactcatggccaaggcgctgcaggagtgccccaactccggtatcctgtggtctgaggccatcttcctcgaggcaaggccccagaggaggaccaagagcgtggatgccctgaagaagtgtgagcatgacccccatgtgctcctggccgtggccaagctgttttggagtcagcggaagatcaccaaggccagggagtggttccaccgcactgtgaagattgactcggacctgggggatgcctgggccttcttctacaagtttgagctgcagcatggcactgaggaagaagatcggggacatccttaggctggtggccggccgcatcaagaacaccttctgattgagcggttgccatggccggtctccgtggggcagggttgggccgcatgtggaagggctctgagctgtgtcctccttcattaaaagtttttatgtctcgtgtcagaa

SEQ ID NO: 440175 - DNA, 2608 bp, Homo sapiens
  misc_feature (2526)..(2526): n is a, c, g, or t
  misc_feature (2529)..(2529): n is a, c, g, or t
  misc_feature (2539)..(2539): n is a, c, g, or t
agggaatcaaaagtgggcggggcgtgtgcggactgagcgctctgcttccggggcgcgggtgacgcgacgacggcgacactttgctacggagtgcatcggacgtcgaagcctagagtctctgcgtctttccctcttccgctgcctcattcctttccttcctagccttggtcgtcgccgccaccatgaacaagaagaagaaaccgttcctagggatgcccgcgcccctcggctacgtgccggggctgggccggggcgccactggcttcaccacgcggtcagacattgggcccgcccgtgatgcaaatgaccctgtggatgatcgccatgcacccccaggcaagagaaccgttggggaccagatgaagaaaaatcaggctgctgacgatgacgacgaggatctaaatgacaccaattacgatgagtttaatggctatgctgggagcctcttctcaagtggaccctacgagaaagatgatgaggaagcagatgctatctatgcagccctggataaaaggatggatgaaagaagaaaagaaagacgggagcaaagggagaaagaagaaatagagaaatatcgtatggaacgccccaaaatccaacagcagttctcagacctcaagaggaagttggcagaagtcacagaagaagagtggctgagcatccccgaggttggcgatgccagaaataaacgtcagcggaacccacgctatgagaagctgacccctgttcctgacagtttctttgccaaacatttacagaccggagagaaccatacctcagtggatccccgacaaactcaatttggaggtcttaacacaccctatccaggtggactaaacactccatacccaggtggaatgacgccaggactgatgacacctggcacaggtgagctggacatgaggaagattggccaagcgaggaacactctgatggacatgaggctgagccaggtgtctgactccgtgagtggacagaccgtcgttgaccccaaaggctacctgacggatttaaattccatgatcccgacacacggaggagacatcaatgatatcaagaaggcgcgactgctcctcaagtctgttcgggagacgaaccctcatcacccgccagcctggattgcatcagcccgcctggaagaagtcactgggaagctacaagtagctcggaaccttatcatgaaggggacggagatgtgccccaagagtgaagatgtctggctggaagcagccaggttgcagcctggggacacagccaaggccgtggtagcccaagctgtccgtcatctcccacagtctgtcaggatttacatcagagccgcagagctggaaacggacattcgtgcaaagaagcgggttcttcggaaagccctcgagcatgttccaaactcggttcgcttgtggaaagcagccgttgagctggaagaacctgaagatgctagaatcatgctgagccgagctgtggagtgctgccccaccagcgtggagctctggcttgctctggcaaggctggagacctatgaaaatgcccgcaaggtcttgaacaaggcgcgggagaacattcctacagaccgacatatctggatcacggctgctaagctggaggaagccaatgggaacacgcagatggtggagaagatcatcgaccgagccatcacctcgctgcgggccaacggtgtggagatcaaccgtgagcagtggatccaggatgccgaggaatgtgacagggctgggagtgtggccacctgccaggccgtcatgcgtgccgtgattgggattgggattgaggaggaagatcggaagcatacctggatggaggatgctgacagttgtgtagcccacaatgccctggagtgtgcacgagccatctacgcctacgccctgcaggtgttccccagcaagaagagtgtgtggctgcgcgccgcgtacttcgagaagaaccatggcactcgggagtccctggaagcactcctgcagagggctgtggcccactgccccaaagcagaggtgctgtggctcatgggcgccaagtccaagtggctggcaggggatgtgcctgcagcaaggagcatcctggccctggccttccaggccaaccccaacagtgaggagatctggctggcagccgtgaagctggagtccgagaatgatgagtacgagcgggcccggaggctgctggccaaggcgcggagcagtgcccccaccgcccgggtgttcatgaagtctgtgaagctggagtgggtgcaagacaacatcagggcagcccaagatctgtgcgaggaggccctgcggcactatgaggacttccccaagctgtggatgatgaaggggcagatcgaggagcagaaggagatgatggagaaggcgcgggaagcctataaccaggggttgaagaagtgtccccactccacacccctgtggcttttgctctctcggctggaggagaagattgggcagcttactcgagcacgggccattttggaaaagtctcgtctgaagaacccaaagaaccctgggctgtgagccncgnggaggaacanggcgggacaagaacaaccgcaaaaacactggcagaggcgcgagtcccacaacagacacggggcgggaca

SEQ ID NO: 440176 - DNA, 1818 bp, Homo sapiens
ctaccacaagatgctccgtttgtccttgtttgtgtctgccccagacctgaaggaagccacataaagggcagccctcgagcatgttccaaactcggttcgcttgtggaaagcagccgttgagctggaagaacctgaagatgctagaatcatgctgagccgagctgtggagtgctgccccaccagcgtggagctctggcttgctctggcaaggctggagacctatgaaaatgcccgcaaggtcttgaacaaggcgcgggagaacattcctacagaccgacatatctggatcacggctgctaagctggaggaagccaatgggaacacgcagatggtggagaagatcatcgaccgagccatcacctcgctgcgggccaacggtgtggagatcaaccgtgagcagtggatccaggatgccgaggaatgtgacagggctgggagtgtggccacctgccaggccgtcatgcgtgccgtgattgggattgggattgaggaggaagatcggaagcatacctggatggaggatgctgacagttgtgtagcccacaatgccctggagtgtgcacgagccatctacgcctacgccctgcaggtgttccccagcaagaagagtgtgtggctgcgcgccgcgtacttcgagaagaaccatggcactcgggagtccctggaagcactcctgcagagggctgtggcccactgccccaaagcagaggtgctgtggctcatgggcgccaagtccaagtggctggcaggggatgtgcctgcagcaaggagcatcctggccctggccttccaggccaaccccaacagtgaggagatctggctggcagccgtgaagctggagtccgagaatgatgagtacgagcgggcccggaggctgctggccaaggcgcggagcagtgcccccaccgcccgggtgttcatgaagtctgtgaagctggagtgggtgcaagacaacatcagggcagcccaagatctgtgcgaggaggccctgcggcactatgaggacttccccaagctgtggatgatgaaggggcagatcgaggagcagaaggagatgatggagaaggcgcgggaagcctataaccaggggttgaagaagtgtccccactccacacccctgtggcttttgctctctcggctggaggagaagattgggcagcttactcgagcacgggccattttggaaaagtctcgtctgaagaacccaaagaaccctgggctgtggttggagtccgtgcggctggagtaccgtgcggggctgaagaacatcgcaaatacactcatggccaaggcgctgcaggagtgccccaactccggtatcctgtggtctgaggccatcttcctcgaggcaaggccccagaggaggaccaagagcgtggatgccctgaagaagtgtgagcatgacccccatgtgctcctggccgtggccaagctgttttggagtcagcggaagatcaccaaggccagggagtggttccaccgcactgtgaagattgactcggacctgggggatgcctgggccttcttctacaagtttgagctgcagcatggcactgaggagcagcaggaggaggtgaggaagcgctgtgagagtgcagagcctcggcatggggagctgtggtgcgccgtgtccaaggacatcgccaactggcagaagaagatcggggacatccttaggctggtggccggccgcatcaagaacaccttctgattgagcggttgccatggccggtctccgtggggcagggttgggccgcatgtggaagggctctgagctgtgtcctccttcattaaaagtttttatgtctcgtgtcagaa

SEQ ID NO: 440177 - DNA, 821 bp, Homo sapiens
agggaatcaaaagtgggcggggcgtgtgcggactgagcgctctgcttccggggcgcgggtgacgcgacgacggcgacactttgctacggagtgcatcggacgtcgaagcctagagtctctgcgtctttccctcttccgctgcctcattcctttccttcctagccttggtcgtcgccgccaccatgaacaagaagaagaaaccgttcctagggatgcccgcgcccctcggctacgtgccggggctgggccggggcgccactggcttcaccacgcggtcagacattgggcccgcccgtgatgcaaatgaccctgtggatgatcgccatgcacccccaggcaagagaaccgttggggaccagatgaagaaaaatcaggctgctgacgatgacgacgaggatctaaatgacaccaattacgatgagtttaatggctatgctgggagcctcttctcaagtggaccctacgagaaagatgatgaggaagcagatgctatctatgcagccctggataaaaggatggatgaaagaagaaaagaaagacgggagcaaagggagaaagaagaaatagagaaatatcgtatggaacgccccaaaatccaacagcagttctcagacctcaagaggaagttggcagaagtcacagaagaagagtggctgagcatccccgaggttggcgatgccagaaataaacgtcagcggaacccacgctatgagaagctgacccctgttcctgacagtttctttgccaaacatttacagaccggagagaaccatacctcagtggatccccgacaaactgtgagcttccaaaaaagggcacat

SEQ ID NO: 440178 - DNA, 318 bp, Homo sapiens
gtgtcaggggtaggttgggggagtggggctggtcagggctggaagtgtgtgtctgcaggagcagcaggaggaggtgaggaagcgctgtgagagtgcagagcctcggcatggggagctgtggtgcgccgtgtccaaggacatcgccaactggcagaagaagatcggggacatccttaggctggtggccggccgcatcaagaacaccttctgattgagcggttgccatggccggtctccgtggggcagggttgggccgcatgtggaagggctctgagctgtgtcctccttcattaaaagtttttatgtctcgtgtcagaa

SEQ ID NO: 440179 - DNA, 807 bp, Homo sapiens
  misc_feature (17)..(17): n is a, c, g, or t
aaaaaaaataggctagnagagccggtgttaatcctacggagtgcatcggacgtcgaagcctagagtctctgcgtctttccctcttccgctgcctcattcctttccttcctagccttggtcgtcgccgccaccatgaacaagaagaagaaaccgttcctagggatgcccgcgcccctcggctacgtgccggggctgggccgggggaagcaacgggctttggggtcaggacatacctgtgtgtgcaccctgcttgccgcctagatgtgacacattgactctcagcccagtgttttggtctgtaagatgggtaatgctgtatacggtctgcagtgaggagtagaggaatctgacgtgtagtggaaacacgcgaccaccttcctcaggtcgggctgacactccccccccccgcccgcccgcccgccccgccttaagcgtgcctgggtcctctatgcctgcaacacagatgaccaccgtgcgttgctggataagtgagcagtcgttattatcctatttggctattcatttgatgaggaacactactgggtttttcttggtggtggtattatattggaatctgtggggcacacacaagctcactaaggagggtttgctattaccataaataagtacgtaaagaggaccagatttagaacccagtgcttaatggagagtagcattggagccaagtttagtaagagagctggacttagggctgtagaaacggtgacgatagaagagaaactgacattctgcgtgtgggagttcaaaaaaagtgaggcaaggaggaagcccagggaacaggaggga

SEQ ID NO: 440180 - DNA, 540 bp, Homo sapiens
gagccatcacctcgctgcgggccaacggtgtggagatcaaccgtgagcagtggatccaggtgggccgcaggcgggtgtcgtggtgtctgctttaacagtgcacatgcagcacgtgagagtcccacgcaggactgggggttgctggatggtactggggagtcctgtgccaaaccagaagcaggcacaggtgtgaatgggccctgagggacctgggcatgcccactgtcgctcttgatggattcaggcctggagttcgtcttggggtgaacacattcagaagcccttttcagtcgttgtgcacacctgactgcatttctttgctagtagcaaatgatacacctacgagaggaggacaggaagtctcatggcttctttctttgctagtagaaatgatacacctacgagaggaggacaggaagtctcacggcttctttctttgctagtagaaatgatacacctacgagaggaggacaggaagtctcacggcttctttctttgctagtagaaatgatacacctacgagaggaggaccggaagtct

SEQ ID NO: 440181 - DNA, 2995 bp, Homo sapiens
agggaatcaaaagtgggcggggcgtgtgcggactgagcgctctgcttccggggcgcgggtgacgcgacgacggcgacactttgctacggagtgcatcggacgtcgaagcctagagtctctgcgtctttccctcttccgctgcctcattcctttccttcctagccttggtcgtcgccgccaccatgaacaagaagaagaaaccgttcctagggatgcccgcgcccctcggctacgtgccggggctgggccggggcgccactggcttcaccacgcggtcagacattgggcccgcccgtgatgcaaatgaccctgtggatgatcgccatgcacccccaggcaagagaaccgttggggaccagatgaagaaaaatcaggctgctgacgatgacgacgaggatctaaatgacaccaattacgatgagtttaatggctatgctgggagcctcttctcaagtggaccctacgagaaagatgatgaggaagcagatgctatctatgcagccctggataaaaggatggatgaaagaagaaaagaaagacgggagcaaagggagaaagaagaaatagagaaatatcgtatggaacgccccaaaatccaacagcagttctcagacctcaagaggaagttggcagaagtcacagaagaagagtggctgagcatccccgaggttggcgatgccagaaataaacgtcagcggaacccacgctatgagaagctgacccctgttcctgacagtttctttgccaaacatttacagaccggagagaaccatacctcagtggatccccgacaaactcaatttggaggtcttaacacaccctatccaggtggactaaacactccatacccaggtggaatgacgccaggactgatgacacctggcacaggtgagctggacatgaggaagattggccaagcgaggaacactctgatggacatgaggctgagccaggtgtctgactccgtgagtggacagaccgtcgttgaccccaaaggctacctgacggatttaaattccatgatcccgacacacggaggagacatcaatgatatcaagaaggcgcgactgctcctcaagtctgttcgggagacgaaccctcatcacccgccagcctggattgcatcagcccgcctggaagaagtcactgggaagctacaagtagctcggaaccttatcatgaaggggacggagatgtgccccaagagtgaagatgtctggctggaagcagccaggttgcagcctggggacacagccaaggccgtggtagcccaagctgtccgtcatctcccacagtctgtcaggatttacatcagagccgcagagctggaaacggacattcgtgcaaagaagcgggttcttcggaaagccctcgagcatgttccaaactcggttcgcttgtggaaagcagccgttgagctggaagaacctgaagatgctagaatcatgctgagccgagctgtggagtgctgccccaccagcgtggagctctggcttgctctggcaaggctggagacctatgaaaatgcccgcaaggtcttgaacaaggcgcgggagaacattcctacagaccgacatatctggatcacggctgctaagctggaggaagccaatgggaacacgcagatggtggagaagatcatcgaccgagccatcacctcgctgcgggccaacggtgtggagatcaaccgtgagcagtggatccaggatgccgaggaatgtgacagggctgggagtgtggccacctgccaggccgtcatgcgtgccgtgattgggattgggattgaggaggaagatcggaagcatacctggatggaggatgctgacagttgtgtagcccacaatgccctggagtgtgcacgagccatctacgcctacgccctgcaggtgttccccagcaagaagagtgtgtggctgcgcgccgcgtacttcgagaagaaccatggcactcgggagtccctggaagcactcctgcagagggctgtggcccactgccccaaagcagaggtgctgtggctcatgggcgccaagtccaagtggctggcaggggatgtgcctgcagcaaggagcatcctggccctggccttccaggtgttcatgaagtctgtgaagctggagtgggtgcaagacaacatcagggcagcccaagatctgtgcgaggaggccctgcggcactatgaggacttccccaagctgtggatgatgaaggggcagatcgaggagcagaaggagatgatggagaaggcgcgggaagcctataaccaggggttgaagaagtgtccccactccacacccctgtggcttttgctctctcggctggaggagaagattgggcagcttactcgagcacgggccattttggaaaagtctcgtctgaagaacccaaagaaccctgggctgtggttggagtccgtgcggctggagtaccgtgcggggctgaagaacatcgcaaatacactcatggccaaggcgctgcaggagtgccccaactccggtatcctgtggtctgaggccatcttcctcgaggcaaggccccagaggaggaccaagagcgtggatgccctgaagaagtgtgagcatgacccccatgtgctcctggccgtggccaagctgttttggagtcagcggaagatcaccaaggccagggagtggttccaccgcactgtgaagattgactcggacctgggggatgcctgggccttcttctacaagtttgagctgcagcatggcactgaggagcagcaggaggaggtgaggaagcgctgtgagagtgcagagcctcggcatggggagctgtggtgcgccgtgtccaaggacatcgccaactggcagaagaagatcggggacatccttaggctggtggccggccgcatcaagaacaccttctgattgagcggttgccatggccggtctccgtggggcagggttgggccgcatgtggaagggctctgagctgtgtcctccttcattaaaagtttttatgtctcgtgtcagaa

SEQ ID NO: 440182 - DNA, 452 bp, Homo sapiens
agatgctagaatcatgctgagccgagctgtggagtgctgccccaccagcgtggagctctggcttgctctggcaaggctggagacctatgaaaatgcctcgtcgccgccaccatgaacaagaagaagaaaccgttcctagggatgcccgcgcccctcggctacgtgccggggctgggccggggcgccactggcttcaccacgcggtcagacattgggcccgcccgtgatgcaaatgaccctgtggatgatcgccatgcacccccaggcaagagaaccgttggggaccagatgaagaaaaatcaggctgctgacgatgacgacgaggatctaaatgacaccaattacgatgagtttaatggctatgctgggagcctcttctcaagtggaccctacgagaaagatgatgaggaagcagatgctatctatgcagccctggataaaaggatggatga

SEQ ID NO: 440183 - DNA, 3115 bp, Homo sapiens
agggaatcaaaagtgggcggggcgtgtgcggactgagcgctctgcttccggggcgcgggtgacgcgacgacggcgacactttgctacggagtgcatcggacgtcgaagcctagagtctctgcgtctttccctcttccgctgcctcattcctttccttcctagccttggtcgtcgccgccaccatgaacaagaagaagaaaccgttcctagggatgcccgcgcccctcggctacgtgccggggctgggccggggcgccactggcttcaccacgcggtcagacattgggcccgcccgtgatgcaaatgaccctgtggatgatcgccatgcacccccaggcaagagaaccgttggggaccagatgaagaaaaatcaggctgctgacgatgacgacgaggatctaaatgacaccaattacgatgagtttaatggctatgctgggagcctcttctcaagtggaccctacgagaaagatgatgaggaagcagatgctatctatgcagccctggataaaaggatggatgaaagaagaaaagaaagacgggagcaaagggagaaagaagaaatagagaaatatcgtatggaacgccccaaaatccaacagcagttctcagacctcaagaggaagttggcagaagtcacagaagaagagtggctgagcatccccgaggttggcgatgccagaaataaacgtcagcggaacccacgctatgagaagctgacccctgttcctgacagtttctttgccaaacatttacagaccggagagaaccatacctcagtggatccccgacaaactcaatttggaggtcttaacacaccctatccaggtggactaaacactccatacccaggtggaatgacgccaggactgatgacacctggcacaggtgagctggacatgaggaagattggccaagcgaggaacactctgatggacatgaggctgagccaggtgtctgactccgtgagtggacagaccgtcgttgaccccaaaggctacctgacggatttaaattccatgatcccgacacacggaggagacatcaatgatatcaagaaggcgcgactgctcctcaagtctgttcgggagacgaaccctcatcacccgccagcctggattgcatcagcccgcctggaagaagtcactgggaagctacaagtagctcggaaccttatcatgaaggggacggagatgtgccccaagagtgaagatgtctggctggaagcagccaggttgcagcctggggacacagccaaggccgtggtagcccaagctgtccgtcatctcccacagtctgtcaggatttacatcagagccgcagagctggaaacggacattcgtgcaaagaagcgggttcttcggaaagccctcgagcatgttccaaactcggttcgcttgtggaaagcagccgttgagctggaagaacctgaagatgctagaatcatgctgagccgagctgtggagtgctgccccaccagcgtggagctctggcttgctctggcaaggctggagacctatgaaaatgcccgcaaggtcttgaacaaggcgcgggagaacattcctacagaccgacatatctggatcacggctgctaagctggaggaagccaatgggaacacgcagatggtggagaagatcatcgaccgagccatcacctcgctgcgggccaacggtgtggagatcaaccgtgagcagtggatccaggatgccgaggaatgtgacagggctgggagtgtggccacctgccaggccgtcatgcgtgccgtgattgggattgggattgaggaggaagatcggaagcatacctggatggaggatgctgacagttgtgtagcccacaatgccctggagtgtgcacgagccatctacgcctacgccctgcaggtgttccccagcaagaagagtgtgtggctgcgcgccgcgtacttcgagaagaaccatggcactcgggagtccctggaagcactcctgcagagggctgtggcccactgccccaaagcagaggtgctgtggctcatgggcgccaagtccaagtggctggcaggggatgtgcctgcagcaaggagcatcctggccctggccttccaggccaaccccaacagtgaggagatctggctggcagccgtgaagctggagtccgagaatgatgagtacgagcgggcccggaggctgctggccaaggcgcggagcagtgcccccaccgcccgggtgttcatgaagtctgtgaagctggagtgggtgcaagacaacatcagggcagcccaagatctgtgcgaggaggccctgcggcactatgaggacttccccaagctgtggatgatgaaggggcagatcgaggagcagaaggagatgatggagaaggcgcgggaagcctataaccaggggttgaagaagtgtccccactccacacccctgtggcttttgctctctcggctggaggagaagattgggcagcttactcgagcacgggccattttggaaaagtctcgtctgaagaacccaaagaaccctgggctgtggttggagtccgtgcggctggagtaccgtgcggggctgaagaacatcgcaaatacactcatggccaaggcgctgcaggagtgccccaactccggtatcctgtggtctgaggccatcttcctcgaggcaaggccccagaggaggaccaagagcgtggatgccctgaagaagtgtgagcatgacccccatgtgctcctggccgtggccaagctgttttggagtcagcggaagatcaccaaggccagggagtggttccaccgcactgtgaagattgactcggacctgggggatgcctgggccttcttctacaagtttgagctgcagcatggcactgaggagcagcaggaggaggtgaggaagcgctgtgagagtgcagagcctcggcatggggagctgtggtgcgccgtgtccaaggacatcgccaactggcagaagaagatcggggacatccttaggctggtggccggccgcatcaagaacaccttctgattgagcggttgccatggccggtctccgtggggcagggttgggccgcatgtggaagggctctgagctgtgtcctccttcattaaaagtttttatgtctcgtgtcagaa

SEQ ID NO: 440184 - DNA, 3141 bp, Homo sapiens
agggaatcaaaagtgggcggggcgtgtgcggactgagcgctctgcttccggggcgcgggtgacgcgacgacggcgacactttgctacggagtgcatcggacgtcgaagcctagagtctctgcgtctttccctcttccgctgcctcattcctttccttcctagccttggtcgtcgccgccaccatgaacaagaagaagaaaccgttcctagggatgcccgcgcccctcggctacgtgccggggctgggccggggcgccactggcttcaccacgcggtcagacattgggcccgcccgtgatgcaaatgaccctgtggatgatcgccatgcacccccaggcaagagaaccgttggggaccagatgaagaaaaatcaggctgctgacgatgacgacgaggatctaaatgacaccaattacgatgagtttaatggctatgctgggagcctcttctcaagtggaccctacgagaaagatgatgaggaagcagatgctatctatgcagccctggataaaaggatggatgaaagaagaaaagaaagacgggagcaaagggagaaagaagaaatagagaaatatcgtatggaacgccccaaaatccaacagcagttctcagacctcaagaggaagttggcagaagtcacagaagaagagtggctgagcatccccgaggttggcgatgccagaaataaacgtcagcggaacccacgctatgagaagctgacccctgttcctgacagtttctttgccaaacatttacagaccggagagaaccatacctcagtggatccccgacaaactcaatttggaggtcttaacacaccctatccaggtggactaaacactccatacccaggtggaatgacgccaggactgatgacacctggcacaggtgagctggacatgaggaagattggccaagcgaggaacactctgatggacatgaggctgagccaggtgtctgactccgtgagtggacagaccgtcgttgaccccaaaggctacctgacggatttaaattccatgatcccgacacacggaggagacatcaatgatatcaagaaggcgcgactgctcctcaagtctgttcgggagacgaaccctcatcacccgccagcctggattgcatcagcccgcctggaagaagtcactgggaagctacaagtagctcggaaccttatcatgaaggggacggagatgtgccccaagagtgaagatgtctggctggaagcagccaggttgcagcctggggacacagccaaggccgtggtagcccaagctgtccgtcatctcccacagtctgtcaggatttacatcagagccgcagagctggaaacggacattcgtgcaaagaagcgggttcttcggaaagccctcgagcatgttccaaactcggttcgcttgtggaaagcagccgttgagctggaagaacctgaagatgctagaatcatgctgagccgagctgtggagtgctgccccaccagcgtggagctctggcttgctctggcaaggctggagacctatgaaaatgcccgcaaggtcttgaacaaggcgcgggagaacattcctacagaccgacatatctggatcacggctgctaagctggaggaagccaatgggaacacgcagatggtggagaagatcatcgaccgagccatcacctcgctgcgggccaacggtgtggagatcaaccgtgagcagtggatccaggatgccgaggaatgtgacagggctgggagtgtggccacctgccaggccgtcatgcgtgccgtgattgggattgggattgaggaggaagatcggaagcatacctggatggaggatgctgacagttgtgtagcccacaatgccctggagtgtgcacgagccatctacgcctacgccctgcaggtgttccccagcaagaagagtgtgtggctgcgcgccgcgtacttcgagaagaaccatggcactcgggagtccctggaagcactcctgcagagggctgtggcccactgccccaaagcagaggtgctgtggctcatgggcgccaagtccaagtggctggcaggggatgtgcctgcagcaaggagcatcctggccctggccttccaggccaaccccaacagtgaggagatctggctggcagccgtgaagctggagtccgagaatgatgagtacgagcgggcccggaggctgctggccaaggcgcggagcagtgcccccaccgcccgggtgttcatgaagtctgtgaagctggagtgggtgcaagacaacatcagggcagcccaagatctgtgcgaggaggccctgcggcactatgaggacttccccaagctgtggatgatgaaggggcagatcgaggagcagaaggagatgatggagaaggcgcgggaagcctataaccaggggttgaagaagtgtccccactccacacccctgtggcttttgctctctcggctggaggagaagattgggcagcttactcgagcacgggccattttggaaaagtctcgtctgaagaacccaaagaaccctgggctgtggttggagtccgtgcggctggagtaccgtgcggggctgaagaacatcgcaaatacactcatggccaaggcgctgcaggagtgccccaactccggtatcctgtggtctgaggccatcttcctcgaggcaaggccccagaggaggaccaagagcgtggatgccctgaagaagtgtgagcatgacccccatgtgctcctggccgtggccaagctgttttggagtcagcggaagatcaccaaggccagggagtggttccaccgcactgtgaagattgactcggacctgggggatgcctgggccttcttctacaagtttgagctgcagcatggcactgaggagcagcaggaggaggtgaggaagcgctgtgagagtgcagagcctcggcatggggagctgtggtgcgccgtgtccaaggacatcgccaactggcagaagaagatcggggacatccttaggctggtggccggccgcatcaagaacaccttctgattgagcggttgccatggccggtctccgtggggcagggttgggccgcatgtggaagggctctgagctgtgtcctccttcattaaaagtttttatgtctcgtgtcagaaaaaaataatcaaaaacgacaaaacag

SEQ ID NO: 440185 - DNA, 2988 bp, Homo sapiens
agggaatcaaaagtgggcggggcgtgtgcggactgagcgctctgcttccggggcgcgggtgacgcgacgacggcgacactttgctacggagtgcatcggacgtcgaagcctagagtctctgcgtctttccctcttccgctgcctcattcctttccttcctagccttggtcgtcgccgccaccatgaacaagaagaagaaaccgttcctagggatgcccgcgcccctcggctacgtgccggggctgggccggggcgccactggcttcaccacgcggtcagacattgggcccgcccgtgatgcaaatgaccctgtggatgatcgccatgcacccccaggcaagagaaccgttggggaccagatgaagaaaaatcaggctgctgacgatgacgacgaggatctaaatgacaccaattacgatgagtttaatggctatgctgggagcctcttctcaagtggaccctacgagaaagatgatgaggaagcagatgctatctatgcagccctggataaaaggatggatgaaagaagaaaagaaagacgggagcaaagggagaaagaagaaatagagaaatatcgtatggaacgccccaaaatccaacagcagttctcagacctcaagaggaagttggcagaagtcacagaagaagagtggctgagcatccccgaggttggcgatgccagaaataaacgtcagcggaacccacgctatgagaagctgacccctgttcctgacagtttctttgccaaacatttacagaccggagagaaccatacctcagtggatccccgacaaactcaatttggaggtcttaacacaccctatccaggtggactaaacactccatacccaggtggaatgacgccaggactgatgacacctggcacaggtgagctggacatgaggaagattggccaagcgaggaacactctgatggacatgaggctgagccaggtgtctgactccgtgagtggacagaccgtcgttgaccccaaaggctacctgacggatttaaattccatgatcccgacacacggaggagacatcaatgatatcaagaaggcgcgactgctcctcaagtctgttcgggagacgaaccctcatcacccgccagcctggattgcatcagcccgcctggaagaagtcactgggaagctacaagtagctcggaaccttatcatgaaggggacggagatgtgccccaagagtgaagatgtctggctggaagcagccaggttgcagcctggggacacagccaaggccgtggtagcccaagctgtccgtcatctcccacagtctgtcaggatttacatcagagccgcagagctggaaacggacattcgtgcaaagaagcgggttcttcggaaagccctcgagcatgttccaaactcggttcgcttgtggaaagcagccgttgagctggaagaacctgaagatgctagaatcatgctgagccgagctgtggagtgctgccccaccagcgtggagctctggcttgctctggcaaggctggagacctatgaaaatgcccgcaaggtcttgaacaaggcgcgggagaacattcctacagaccgacatatctggatcacggctgctaagctggaggaagccaatgggaacacgcagatggtggagaagatcatcgaccgagccatcacctcgctgcgggccaacggtgtggagatcaaccgtgagcagtggatccaggatgccgaggaatgtgacagggctgggagtgtggccacctgccaggccgtcatgcgtgccgtgattgggattgggattgaggaggaagatcggaagcatacctggatggaggatgctgacagttgtgtagcccacaatgccctggagtgtgcacgagccatctacgcctacgccctgcaggtgttccccagcaagaagagtgtgtggctgcgcgccgcgtacttcgagaagaaccatggcactcgggagtccctggaagcactcctgcagagggctgtggcccactgccccaaagcagaggtgctgtggctcatgggcgccaagtccaagtggctggcaggggatgtgcctgcagcaaggagcatcctggccctggccttccaggccaaccccaacagtgaggagatctggctggcagccgtgaagctggagtccgagaatgatgagtacgagcgggcccggaggctgctggccaaggcgcggagcagtgcccccaccgcccgggtgttcatgaagtctgtgaagctggagtgggtgcaagacaacatcagggcagcccaagatctgtgcgaggaggccctgcggcactatgaggacttccccaagctgtggatgatgaaggggcagatcgaggagcagaaggagatgatggagaaggcgcgggaagcctataaccaggggttgaagaagtgtccccactccacacccctgtggcttttgctctctcggctggaggagaagattgggcagcttactcgagcacgggccattttggaaaagtctcgtctgaagaacccaaagaaccctgggctgtggttggagtccgtgcggctggagtaccgtgcggggctgaagaacatcgcaaatacactcatggccaaggcgctgcaggagtgccccaactccggtatcctgtggtctgaggccatcttcctcgaggcaaggccccagaggaggaccaagagcgtggatgccctgaagaagtgtgagcatgacccccatgtgctcctggccgtggccaagctgttttggagtcagcggaagatcaccaaggccagggagtggttccaccgcactgtgaagattgactcggacctgggggatgcctgggccttcttctacaagtttgagctgcagcatggcactgaggagcagcaggaggaggtgaggaagcgctgtgagagtgcagagcctcggcatggggagctgtggtgcgccgtgtccaaggacatcgccaactggcacatcttcgagggatcctctagaacaccgcagagatggg

SEQ ID NO: 440186 - DNA, 2777 bp, Homo sapiens
  misc_feature (17)..(17): n is a, c, g, or t
aaaaaaaataggctagnagagccggtgttaatcctacggagtgcatcggacgtcgaagcctagagtctctgcgtctttccctcttccgctgcctcattcctttccttcctagccttggtcgtcgccgccaccatgaacaagaagaagaaaccgttcctagggatgcccgcgcccctcggctacgtgccggggctgggccggggggagcaaagggagaaagaagaaatagagaaatatcgtatggaacgccccaaaatccaacagcagttctcagacctcaagaggaagttggcagaagtcacagaagaagagtggctgagcatccccgaggttggcgatgccagaaataaacgtcagcggaacccacgctatgagaagctgacccctgttcctgacagtttctttgccaaacatttacagaccggagagaaccatacctcagtggatccccgacaaactcaatttggaggtcttaacacaccctatccaggtggactaaacactccatacccaggtggaatgacgccaggactgatgacacctggcacaggtgagctggacatgaggaagattggccaagcgaggaacactctgatggacatgaggctgagccaggtgtctgactccgtgagtggacagaccgtcgttgaccccaaaggctacctgacggatttaaattccatgatcccgacacacggaggagacatcaatgatatcaagaaggcgcgactgctcctcaagtctgttcgggagacgaaccctcatcacccgccagcctggattgcatcagcccgcctggaagaagtcactgggaagctacaagtagctcggaaccttatcatgaaggggacggagatgtgccccaagagtgaagatgtctggctggaagcagccaggttgcagcctggggacacagccaaggccgtggtagcccaagctgtccgtcatctcccacagtctgtcaggatttacatcagagccgcagagctggaaacggacattcgtgcaaagaagcgggttcttcggaaagccctcgagcatgttccaaactcggttcgcttgtggaaagcagccgttgagctggaagaacctgaagatgctagaatcatgctgagccgagctgtggagtgctgccccaccagcgtggagctctggcttgctctggcaaggctggagacctatgaaaatgcccgcaaggtcttgaacaaggcgcgggagaacattcctacagaccgacatatctggatcacggctgctaagctggaggaagccaatgggaacacgcagatggtggagaagatcatcgaccgagccatcacctcgctgcgggccaacggtgtggagatcaaccgtgagcagtggatccaggatgccgaggaatgtgacagggctgggagtgtggccacctgccaggccgtcatgcgtgccgtgattgggattgggattgaggaggaagatcggaagcatacctggatggaggatgctgacagttgtgtagcccacaatgccctggagtgtgcacgagccatctacgcctacgccctgcaggtgttccccagcaagaagagtgtgtggctgcgcgccgcgtacttcgagaagaaccatggcactcgggagtccctggaagcactcctgcagagggctgtggcccactgccccaaagcagaggtgctgtggctcatgggcgccaagtccaagtggctggcaggggatgtgcctgcagcaaggagcatcctggccctggccttccaggccaaccccaacagtgaggagatctggctggcagccgtgaagctggagtccgagaatgatgagtacgagcgggcccggaggctgctggccaaggcgcggagcagtgcccccaccgcccgggtgttcatgaagtctgtgaagctggagtgggtgcaagacaacatcagggcagcccaagatctgtgcgaggaggccctgcggcactatgaggacttccccaagctgtggatgatgaaggggcagatcgaggagcagaaggagatgatggagaaggcgcgggaagcctataaccaggggttgaagaagtgtccccactccacacccctgtggcttttgctctctcggctggaggagaagattgggcagcttactcgagcacgggccattttggaaaagtctcgtctgaagaacccaaagaaccctgggctgtggttggagtccgtgcggctggagtaccgtgcggggctgaagaacatcgcaaatacactcatggccaaggcgctgcaggagtgccccaactccggtatcctgtggtctgaggccatcttcctcgaggcaaggccccagaggaggaccaagagcgtggatgccctgaagaagtgtgagcatgacccccatgtgctcctggccgtggccaagctgttttggagtcagcggaagatcaccaaggccagggagtggttccaccgcactgtgaagattgactcggacctgggggatgcctgggccttcttctacaagtttgagctgcagcatggcactgaggagcagcaggaggaggtgaggaagcgctgtgagagtgcagagcctcggcatggggagctgtggtgcgccgtgtccaaggacatcgccaactggcagaagaagatcggggacatccttaggctggtggccggccgcatcaagaacaccttctgattgagcggttgccatggccggtctccgtggggcagggttgggccgcatgtggaagggctctgagctgtgtcctccttcattaaaagtttttatgtctcgtgtcagaa

SEQ ID NO: 440187 - DNA, 2693 bp, Homo sapiens
agggaatcaaaagtgggcggggcgtgtgcggactgagcgctctgcttccggggcgcgggtgacgcgacgacggcgacactttgctacggagtgcatcggacgtcgaagcctagagtctctgcgtctttccctcttccgctgcctcattcctttccttcctagccttggtcgtcgccgccaccatgaacaagaagaagaaaccgttcctagggatgcccgcgcccctcggctacgtgccggggctgggccggggcgccactggcttcaccacgcggtcagacattgggcccgcccgtgatgcaaatgaccctgtggatgatcgccatgcacccccaggcaagagaaccgttggggaccagatgaagaaaaatcaggctgctgacgatgacgacgaggatctaaatgacaccaattacgatgagtttaatggctatgctgggagcctcttctcaagtggaccctacgagaaagatgatgaggaagcagatgctatctatgcagccctggataaaaggatggatgaaagaagaaaagaaagacgggagcaaagggagaaagaagaaatagagaaatatcgtatggaacgccccaaaatccaacagcagttctcagacctcaagaggaagttggcagaagtcacagaagaagagtggctgagcatccccgaggttggcgatgccagaaataaacgtcagcggaacccacgctatgagaagctgacccctgttcctgacagtttctttgccaaacatttacagaccggagagaaccatacctcagtggatccccgacaaactcaatttggaggtcttaacacaccctatccaggtggactaaacactccatacccaggtggaatgacgccaggactgatgacacctggcacaggtgagctggacatgaggaagattggccaagcgaggaacactctgatggacatgaggctgagccaggtgtctgactccgtgagtggacagaccgtcgttgaccccaaaggctacctgacggatttaaattccatgatcccgacacacggaggagacatcaatgatatcaagaaggcgcgactgctcctcaagtctgttcgggagacgaaccctcatcacccgccagcctggattgcatcagcccgcctggaagaagtcactgggaagctacaagtagctcggaaccttatcatgaaggggacggagatgtgccccaagagtgaagatgtctggctggaagcagccaggttgcagcctggggacacagccaaggccgtggtagcccaagctgtccgtcatctcccacagtctgtcaggatttacatcagagccgcagagctggaaacggacattcgtgcaaagaagcgggttcttcggaaagccctcgagcatgttccaaactcggttcgcttgtggaaagcagccgttgagctggaagaacctgaagatgctagaatcatgctgagccgagctgtggagtgctgccccaccagcgtggagctctggcttgctctggcaaggctggagacctatgaaaatgcccgcaaggtcttgaacaaggcgcgggagaacattcctacagaccgacatatctggatcacggctgctaagctggaggaagccaatgggaacacgcagatggtggagaagatcatcgaccgagccatcacctcgctgcgggccaacggtgtggagatcaaccgtgagcagtggatccaggatgccgaggaatgtgacagggctgggagtgtggccacctgccaggccgtcatgcgtgccgtgattgggattgggattgaggaggaagatcggaagcatacctggatggaggatgctgacagttgtgtagcccacaatgccctggagtgtgcacgagccatctacgcctacgccctgcaggtgttccccagcaagaagagtgtgtggctgcgcgccgcgtacttcgagaagaaccatggcactcgggagtccctggaagcactcctgcagagggctgtggcccactgccccaaagcagaggtgctgtggctcatgggcgccaagtccaagtggctggcaggggatgtgcctgcagcaaggagcatcctggccctggccttccaggccaaccccaacagtgaggagatctggctggcagccgtgaagctggagtccgagaatgatgagtacgagcgggcccggaggctgctggccaaggcgcggagcagtgcccccaccgcccgggtgttcatgaagtctgtgaagctggagtgggtgcaagacaacatcagggcagcccaagatctgtgcgaggaggccctgcggcactatgaggacttccccaagctgtggatgatgaaggggcagatcgaggagcagaaggagatgatggagaaggcgcgggaagcctataaccaggggttgaagaagtgtccccactccacacccctgtggcttttgctctctcggctggaggagaagattgggcagcttactcgagcacgggccattttggaaaagtctcgtctgaagaacccaaagaaccctgggctgtggttggagtccgtgcggctggagtaccgtgcggggctgaagaacatcgcaaatacactcatggccaaggcgctgcaggagtgccccaactccggtattctgtggtcttaggccatcttccttgagggggggccccggtccccaatttcccctttagtgggttgtttccaatta

SEQ ID NO: 440188 - DNA, 2015 bp, Homo sapiens
tgacttcttccaggcgggctgatgcaatcccgcctggaagaagtcactgggaagctacaagtagctcggaaccttatcatgaaggggacggagatgtgccccaagagtgaagatgtctggctggaagcagccaggttgcagcctggggacacagccaaggccgtggtagcccaagctgtccgtcatctcccacagtctgtcaggatttacatcagagccgcagagctggaaacggacattcgtgcaaagaagcgggttcttcggaaagccctcgagcatgttccaaactcggttcgcttgtggaaagcagccgttgagctggaagaacctgaagatgctagaatcatgctgagccgagctgtggagtgctgccccaccagcgtggagctctggcttgctctggcaaggctggagacctatgaaaatgcccgcaaggtcttgaacaaggcgcgggagaacattcctacagaccgacatatctggatcacggctgctaagctggaggaagccaatgggaacacgcagatggtggagaagatcatcgaccgagccatcacctcgctgcgggccaacggtgtggagatcaaccgtgagcagtggatccaggatgccgaggaatgtgacagggctgggagtgtggccacctgccaggccgtcatgcgtgccgtgattgggattgggattgaggaggaagatcggaagcatacctggatggaggatgctgacagttgtgtagcccacaatgccctggagtgtgcacgagccatctacgcctacgccctgcaggtgttccccagcaagaagagtgtgtggctgcgcgccgcgtacttcgagaagaaccatggcactcgggagtccctggaagcactcctgcagagggctgtggcccactgccccaaagcagaggtgctgtggctcatgggcgccaagtccaagtggctggcaggggatgtgcctgcagcaaggagcatcctggccctggccttccaggccaaccccaacagtgaggagatctggctggcagccgtgaagctggagtccgagaatgatgagtacgagcgggcccggaggctgctggccaaggcgcggagcagtgcccccaccgcccgggtgttcatgaagtctgtgaagctggagtgggtgcaagacaacatcagggcagcccaagatctgtgcgaggaggccctgcggcactatgaggacttccccaagctgtggatgatgaaggggcagatcgaggagcagaaggagatgatggagaaggcgcgggaagcctataaccaggggttgaagaagtgtccccactccacacccctgtggcttttgctctctcggctggaggagaagattgggcagcttactcgagcacgggccattttggaaaagtctcgtctgaagaacccaaagaaccctgggctgtggttggagtccgtgcggctggagtaccgtgcggggctgaagaacatcgcaaatacactcatggccaaggcgctgcaggagtgccccaactccggtatcctgtggtctgaggccatcttcctcgaggcaaggccccagaggaggaccaagagcgtggatgccctgaagaagtgtgagcatgacccccatgtgctcctggccgtggccaagctgttttggagtcagcggaagatcaccaaggccagggagtggttccaccgcactgtgaagattgactcggacctgggggatgcctgggccttcttctacaagtttgagctgcagcatggcactgaggagcagcaggaggaggtgaggaagcgctgtgagagtgcagagcctcggcatggggagctgtggtgcgccgtgtccaaggacatcgccaactggcagaagaagatcggggacatccttaggctggtggccggccgcatcaagaacaccttctgattgagcggttgccatggccggtctccgtggggcagggttgggccgcatgtggaagggctctgagctgtgtcctccttcattaaaagtttttatgtctcgtgtcagaa

SEQ ID NO: 440189 - DNA, 1757 bp, Homo sapiens
agggaatcaaaagtgggcggggcgtgtgcggactgagcgctctgcttccggggcgcgggtgacgcgacgacggcgacactttgctacggagtgcatcggacgtcgaagcctagagtctctgcgtctttccctcttccgctgcctcattcctttccttcctagccttggtcgtcgccgccaccatgaacaagaagaagaaaccgttcctagggatgcccgcgcccctcggctacgtgccggggctgggccggggcgccactggcttcaccacgcggtcagacattgggcccgcccgtgatgcaaatgaccctgtggatgatcgccatgcacccccaggcaagagaaccgttggggaccagatgaagaaaaatcaggctgctgacgatgacgacgaggatctaaatgacaccaattacgatgagtttaatggctatgctgggagcctcttctcaagtggaccctacgagaaagatgatgaggaagcagatgctatctatgcagccctggataaaaggatggatgaaagaagaaaagaaagacgggagcaaagggagaaagaagaaatagagaaatatcgtatggaacgccccaaaatccaacagcagttctcagacctcaagaggaagttggcagaagtcacagaagaagagtggctgagcatccccgaggttggcgatgccagaaataaacgtcagcggaacccacgctatgagaagctgacccctgttcctgacagtttctttgccaaacatttacagaccggagagaaccatacctcagtggatccccgacaaactcaatttggaggtcttaacacaccctatccaggtggactaaacactccatacccaggtggaatgacgccaggactgatgacacctggcacaggtgagctggacatgaggaagattggccaagcgaggaacactctgatggacatgaggctgagccaggtgtctgactccgtgagtggacagaccgtcgttgaccccaaaggctacctgacggatttaaattccatgatcccgacacacggaggagacatcaatgatatcaagaaggcgcgactgctcctcaagtctgttcgggagacgaaccctcatcacccgccagcctggattgcatcagcccgcctggaagaagtcactgggaagctacaagtagctcggaaccttatcatgaaggggacggagatgtgccccaagagtgaagatgtctggctggaagcagccaggttgcagcctggggacacagccaaggccgtggtagcccaagctgtccgtcatctcccacagtctgtcaggatttacatcaagaacaccttctgattgagcggttgccatggccggtctccgtggggcagggttgggccgcatgtggaagggctctgagctgtgtcctccttcattaaaagtttttatgtctcgtgtcagaataaaaaaaaaaaaaaaaaaaaaaaaaaaaataaaataaaaaaaaacttaaaaaataaaaaaatatattaaaaacatctttcaaaattgccaaatacctcctttagattcccttttccacatactcggttttgccaacttctaaccaaaaaaaaaatttcggggggggccaccttaccctaattggcctaaagcgggtgtacctcacaagtagcttttgctccaattcccccctttctggtggggcaaacctttgggttctccctcccttaaaacgcttgtgtgaaaatacccccgttgtctccttggcgtgggcaaaatttc

SEQ ID NO: 440190 - DNA, 750 bp, Homo sapiens
  misc_feature (17)..(17): n is a, c, g, or t
aaaaaaaataggctagnagagccggtgttaatcctacggagtgcatcggacgtcgaagcctagagtctctgcgtctttccctcttccgctgcctcattcctttccttcctagccttggtcgtcgccgccaccatgaacaagaagaagaaaccgttcctagggatgcccgcgcccctcggctacgtgccggggctgggccgggggaagcaacgggctttggggtcaggacatacctgtgtgtgcaccctgcttgccgcctagatgtgacacattgactctcagcccagtgttttggtctgtaagatgggtaatgctgtatacggtctgcagtgaggagtagaggaatctgacgtgtagtggaaacacgcgaccaccttcctcaggtcgggctgacactccccccccccgcccgcccgcccgccccgccttaagcgtgcctgggtcctctatgcctgcaacacagatgaccaccgtgcgttgcgccactggcttcaccacgcggtcagacattgggcccgcccgtgatgcaaatgaccctgtggatgatcgccatgcacccccaggcaagagaaccgttggggaccagatgaagaaaaatcaggctgctgacgatgacgacgaggatctaaatgacaccaattacgatgagtttaatggctatgctgggagcctcttctcaagtggaccctacgagaaagatgatgaggaagcagatgctatctatgcagccctggataaaaggatggatga

SEQ ID NO: 440191 - DNA, 465 bp, Homo sapiens
ccaggagtggagaagagcacaggaacagagttattcagacacccggtgtcttgggggtctcctgcagcgccactggcttcaccacgcggtcagacattgggcccgcccgtgatgcaaatgaccctgtggatgatcgccatgcacccccaggcaagagaaccgttggggaccagatgaagaaaaatcaggctgctgacgatgacgacgaggatctaaatgacaccaattacgatgaggtgagatgtgtccggctttcgtggctcctccagccagtctctgggagcagctgacctaaccagtgtgtgttggtgtctgtaatgaatggcttggagtggctcatgcatttaaattttagctattcatggaacatctttactgagagtgagagggagcaggaaaaacacggagaaatgtgcactttttgtccctcagaagagatgttcttgcaggtgttaggaccactgc

SEQ ID NO: 440192 - DNA, 1299 bp, Homo sapiens
cccagccagaaaagatggagcacacgctggggagaggccttcatctgctgtaaagggcctctccccagccagaaaagatggagcacacgctgggtggtggccccgcttcctcactggaaggagatggtgctcttcttttttctttctgaattgtggccaccttcataccagtctgtcatggaacacttaagccgcttgagtgcctgctggtactcccagccctgccatgcctgagccccctgcacacaaggagccaggagtaatcagggcagaccctttagggcacggggacttctggattgtgaaattggctctctgggggccaaggccttctaacgttggtggaagtggctttggcttattgggtcggattctaggccattcattccaacctttagagacatcccagctttccctagcccagagtctgcagcccctccaccatcccacatcctccccctccctttcctcatgaaccccagtcgcgcctctgccttctcaaacccctccaccatcccacaccctcctcctgcccttcctcatgaaccccagtcgcgcctctgccttctcatccctgcgcaccacacaggctcgctcgtgcccggtgagtgctgaggctgctctgcacgtggagtatggccctgtgggcaagggctgggctcttggaggtaggggagctacaggggcgactgggaggaggatgtcgtgttacacacgcatcagagttaactttgcagtgagagcggccttgctgcggccaaagaacatggaaaagcatgagtggggtgatgtgccttaaagcatcagacacttgggcctcgggcatcaggagccagccacagggatgtctggggaaatggcgttccatgagatgcaagcacacaagaatgcacttggcacatctggggaacagcaggcagctgatatcactgggcccaccccgcaccagggaggatggaagcaggtgaggagctagaccacactgaggcggtggtcgggactcggggtttgctcagtgagccgttcactatgtgcaggggcagttccccgtctgaatttaggtgacgacactcaggtccagccttgccagtctcagcctccggtctccgttccccctctgcagaggccacattgtctgctgcacgtgatcatgaggggttgtgaagtgcttgccccatcagtagccatgtgtgcatgtgtaaataccatcctctgtgtgccctggaggctgtccttcagatagcatgtacaggtggcagcatagggcctgtccctactgagagtgcagggaactcagca

SEQ ID NO: 440193 - DNA, 2718 bp, Homo sapiens
attcagaggaaacgacgacaggaaatggtgacagatagggaacgaggatgaagggaagggagagccagtgacgactggcagtggagtggggagcaccgccacctctcctcctccacttgcccctcctgtggcactggacaagctagtgggcttttcgttgtccatgggcttattcggtggggatgtgaccagctttgaacccgtccccttaaacatgctcctcctgcacggaagagacaggggcaggggagagactctctccccaccacccggctcaggccccagcacagcccggcctctggcctcactggcgtctgtgcccagtgacgcaggcaggtgagctcctggcaaattagcattgcaggctgtgctctctcctcctgctctgctgcagctgggagtgtgcagagactggaggggatgacagtcaccctctgttttctgtggtggctctgttttctgtggtgctggatgcacctctgttttctgtggtggctccaagagagtgcacggtccctgctgattgaaagaaggatgaagggcagaagaggggcggggagctgtgtgccctaagatctcattgcctttttatgccgattaacatgcttttagcccctactgagcttatagttaacagaagtttccaggtctttcttcacctgaactgtgtctaaagcaagttccctccaccttctgtatttatacgcttgatttttaaaacctaaatgttgggcttcacatttgttccttgtaaatttcatcttggtgattgcagtctaccctctggcctttaaaaattgtctgagccttgattcgatcatgaaaccagcttacccttcccctgtgtgctggccccagttttctaaccaggtgttgaatgaactggatggactctgccagatccctccgtgcaaggctggaatcagtccattgttcaactgtgccctttggggctgtggttcatttggctctgatttttcctatatgttctctcctccaacccccatagctccatcttgtctacaagattttgttagaagccgtcaaaatcctgctgactcgagatgcgctgtgctgcatgttctccctgggcacagcaggctactaatcctgttacaaagagaaatgccgtacattgcgagcagtgctggcccctgggactcaccgtgcccttttctaagtgcttacagactctctgtttaataatccattccagaaattttccagggctcattgttgagcttggtgttcgcaactttgagtgatcagcccttctcctttgtgggagcaccaggacagagcagcctttgtccctccccagtctcagttccctcccactgcccctgtggacctcgaatgcagagcttatgcacctaccgaaggtcgtgtcagcacccaaggcagaacgaggctgccctgggaactagggtcaattaaaacagcttgtgctggaggaccctttacagcagatgaaggcctctccccagccagaaaagatggagcacacgctgggtggtggccccgcttcctcactggaaggagatggtgctcttcttttttctttctgaattgtggccaccttcataccagtctgtcatggaacacttaagccgcttgagtgcctgctggtactcccagccctgccatgcctgagccccctgcacacaaggagccaggagtaatcagggcagaccctttagggcacggggacttctggattgtgaaattggctctctgggggccaaggccttctaacgttggtggaagtggctttggcttattgggtcggattctaggccattcattccaacctttagagacatcccagctttccctagcccagagtctgcagcccctccaccatcccacatcctccccctccctttcctcatgaaccccagtcgcgcctctgccttctcaaacccctccaccatcccacaccctcctcctgcccttcctcatgaaccccagtcgcgcctctgccttctcatccctgcgcaccacacaggctcgctcgtgcccggtgagtgctgaggctgctctgcacgtggagtatggccctgtgggcaagggctgggctcttggaggtaggggagctacaggggcgactgggaggaggatgtcgtgttacacacgcatcagagttaactttgcagtgagagcggccttgctgcggccaaagaacatggaaaagcatgagtggggtgatgtgccttaaagcatcagacacttgggcctcgggcatcaggagccagccacagggatgtctggggaaatggcgttccatgagatgcaagcacacaagaatgcacttggcacatctggggaacagcaggcagctgatatcactgggcccaccccgcaccagggaggatggaagcaggtgaggagctagaccacactgaggcggtggtcgggactcggggtttgctcagtgagccgttcactatgtgcaggggcagttccccgtctgaatttaggtgacgacactcaggtccagccttgccagtctcagcctccggtctccgttccccctctgcagaggccacattgtctgctgcacgtgatcatgaggggttgtgaagtgcttgccccatcagtagccatgtgtgcatgtgtaaataccatcctctgtgtgccctggaggctgtccttcagatagcatgtacaggtggcagcatagggcctgtccctactgagagtgcagggaactcagca

SEQ ID NO: 440194 - DNA, 2405 bp, Homo sapiens
acacatcaggccccatcccaggtgctagagacttagcagtgaatgaggctgacttcgcagtctgcaggggagttcagagtcctcttactgtgtggatccagtttaaagggatgtgactgtggctgagactggtgcctggcatggattcgttcatgagtccagggctctgttttctgtggtggctccaagagagtgcacggtccctgctgattgaaagaaggatgaagggcagaagaggggcggggagctgtgtgccctaagatctcattgcctttttatgccgattaacatgcttttagcccctactgagcttatagttaacagaagtttccaggtctttcttcacctgaactgtgtctaaagcaagttccctccaccttctgtatttatacgcttgatttttaaaacctaaatgttgggcttcacatttgttccttgtaaatttcatcttggtgattgcagtctaccctctggcctttaaaaattgtctgagccttgattcgatcatgaaaccagcttacccttcccctgtgtgctggccccagttttctaaccaggtgttgaatgaactggatggactctgccagatccctccgtgcaaggctggaatcagtccattgttcaactgtgccctttggggctgtggttcatttggctctgatttttcctatatgttctctcctccaacccccatagctccatcttgtctacaagattttgttagaagccgtcaaaatcctgctgactcgagatgcgctgtgctgcatgttctccctgggcacagcaggctactaatcctgttacaaagagaaatgccgtacattgcgagcagtgctggcccctgggactcaccgtgcccttttctaagtgcttacagactctctgtttaataatccattccagaaattttccagggctcattgttgagcttggtgttcgcaactttgagtgatcagcccttctcctttgtgggagcaccaggacagagcagcctttgtccctccccagtctcagttccctcccactgcccctgtggacctcgaatgcagagcttatgcacctaccgaaggtcgtgtcagcacccaaggcagaacgaggctgccctgggaactagggtcaattaaaacagcttgtgctggaggaccctttacagcagatgaaggcctctccccagccagaaaagatggagcacacgctgggtggtggccccgcttcctcactggaaggagatggtgctcttcttttttctttctgaattgtggccaccttcataccagtctgtcatggaacacttaagccgcttgagtgcctgctggtactcccagccctgccatgcctgagccccctgcacacaaggagccaggagtaatcagggcagaccctttagggcacggggacttctggattgtgaaattggctctctgggggccaaggccttctaacgttggtggaagtggctttggcttattgggtcggattctaggccattcattccaacctttagagacatcccagctttccctagcccagagtctgcagcccctccaccatcccacatcctccccctccctttcctcatgaaccccagtcgcgcctctgccttctcaaacccctccaccatcccacaccctcctcctgcccttcctcatgaaccccagtcgcgcctctgccttctcatccctgcgcaccacacaggctcgctcgtgcccggtgagtgctgaggctgctctgcacgtggagtatggccctgtgggcaagggctgggctcttggaggtaggggagctacaggggcgactgggaggaggatgtcgtgttacacacgcatcagagttaactttgcagtgagagcggccttgctgcggccaaagaacatggaaaagcatgagtggggtgatgtgccttaaagcatcagacacttgggcctcgggcatcaggagccagccacagggatgtctggggaaatggcgttccatgagatgcaagcacacaagaatgcacttggcacatctggggaacagcaggcagctgatatcactgggcccaccccgcaccagggaggatggaagcaggtgaggagctagaccacactgaggcggtggtcgggactcggggtttgctcagtgagccgttcactatgtgcaggggcagttccccgtctgaatttaggtgacgacactcaggtccagccttgccagtctcagcctccggtctccgttccccctctgcagaggccacattgtctgctgcacgtgatcatgaggggttgtgaagtgcttgccccatcagtagccatgtgtgcatgtgtaaataccatcctctgtgtgccctggaggctgtccttcagatagcatgtacaggtggcagcatagggcctgtccctactgagagtgcagggaactcagca

SEQ ID NO: 440195 - DNA, 500 bp, Homo sapiens
tctgatggtgtccagagtgagctttggcagtctctaagactggagtgtaatggtgcaatcttggctcattgcaacctccgcctcctggattcaagcgactcttctgcttcagcctcctaagtagctgggactacaggtcctgattcagtaggttcaggaggagcctgattctgctcgtccaagctgccagggtctgatttcctttgtgtgagcactccgccactaggggttctttggctggcaagagaaactagagaagttttgcttccaggaggggagagggacttgagtgagaacgccatccaggccatccccaggaaagcttttcggggagctacggaccttaaaaatttttacacatacataaggccgctgcaagtcagtgaacatcgctgagcctcgatatattgttctggaaaatggggatactaagatctacttcacaggcatgttctgaggtttaaatgaaacatggaaataaatatactttgtcaaatgct

SEQ ID NO: 440196 - DNA, 650 bp, Homo sapiens
gggagagtgaatctgattggcccatcttaggtcaagaggtcacaccaggccagtgagctgttggcagggattgtgggatccgctggtgcagcaacactatggtgcccacactatctcaggagctggagtgggacctattcccttagaaggcagtgcctggcattcctgttctctcacttgttgacctcccctttgctttgtagggatctgttactaattcttcccatctggagcaaattatggactttcatgcacaggctgttatgctaaatcagcatgaaaatgggtttgagagagaccaaatgtgctgggtaaggcatggtcaccaagtctgtaggtggtggcgcagcccacatttcagttgattttgtctgtgtggcctccagaagttaaaatcctgttaggggttattctgcacgaatgtttcccctgctgtgaggttagtctgtccatttctttcctatgcaggatctatggctcagagaggtgatttgccttggaccacagagcagcttgacaatagggttggaattagacaccaggccttctaggggccctgaagagcctgaaaatggtcttaaaccttgacctaggaatctcatatttgggcatctgccctaaagaaataataaagcatgagcacagacaag

SEQ ID NO: 440197 - DNA, 454 bp, Homo sapiens
  misc_feature (32)..(32): n is a, c, g, or t
  misc_feature (57)..(57): n is a, c, g, or t
  misc_feature (60)..(60): n is a, c, g, or t
  misc_feature (107)..(107): n is a, c, g, or t
  misc_feature (111)..(111): n is a, c, g, or t
agtggacttcttcttaaatttaaccccccccncttccagggggaacctcaaatggcnaancaaccatccacctggggatcccataaagaattgacctttgcgggggncaancaagcttgcggggtcttgcagctgatggagaaccagattggagcagtggaacgtggtgcttttgatgacatgaaggagctggagcggctgcgactgaaccgaaaccagctgcacatgttaccggaactgctgttccagaacaaccaggctttgtcaagactgatctatggctcagagaggtgatttgccttggaccacagagcagcttgacaatagggttggaattagacaccaggccttctaggggccctgaagagcctgaaaatggtcttaaaccttgacctaggaatctcatatttgggcatctgccctaaagaaataataaagcatgagcacagacaag

SEQ ID NO: 440198 - DNA, 6595 bp, Homo sapiens
gggagacgcaggcggcgaaacggcagaggagccgagccccctccgcccaaggcgccctccctccgtccgcgcacaggcgccgtcgcttggaggagcaaggtgcctcccagcccgcaggggcgccgcgcgcaagcccgcgggctcttcggtggctctgccccgggactgcacctggaggcggccccggacggggatggtcagcggctgctgccgtctggctcgcgagcgggacgctgtgagggcaccatggcgctgactcccgggtgggggtcctcggcggggccggtccggccggagctctggctgctgctgtgggcagccgcgtggcgcctgggtgcctcggcgtgccccgccctctgcacctgcaccggaaccacggtggactgccacggcacggggctgcaggccattcccaagaatatacctcggaacaccgagcgcctggaactcaatggcaacaacatcactcggatccataagaatgactttgcggggctcaagcagctgcgggtgctgcagctgatggagaaccagattggagcagtggaacgtggtgcttttgatgacatgaaggagctggagcggctgcgactgaaccgaaaccagctgcacatgttaccggaactgctgttccagaacaaccaggctttgtcaagactggacttgagtgagaacgccatccaggccatccccaggaaagcttttcggggagctacggaccttaaaaatttacggctggacaagaaccagatcagctgcattgaggaaggggccttccgtgctctgcgggggctggaggtgctgaccctgaacaacaacaatatcaccaccatccccgtgtccagcttcaaccatatgcccaagctacggaccttccgcctgcactccaaccacctgttttgcgactgccacctggcctggctctcgcagtggctgaggcagcggccaaccatcgggctcttcacccagtgctcgggcccagccagcctgcgtggcctcaatgtggcagaggtccagaagagtgagttcagctgctcaggccagggagaagcggggcgcgtgcccacctgcaccctgtcctccggctcctgcccggccatgtgcacctgcagcaatggcatcgtggactgtcgtggaaaaggcctcactgccatcccggccaacctgcccgagaccatgacggagatacgcctggagctgaacggcatcaagtccatccctcctggagccttctcaccctacagaaagctacggaggatagacctgagcaacaatcagatcgctgagattgcacccgacgccttccagggcctccgctccctgaactcgctggtcctctatggaaacaagatcacagacctcccccgtggtgtgtttggaggcctatacaccctacagctcctgctcctgaatgccaacaagatcaactgcatccggcccgatgccttccaggacctgcagaacctctcactgctctccctgtatgacaacaagatccagagcctcgccaagggcactttcacctccctgcgggccatccagactctgcacctggcccagaaccctttcatttgcgactgtaacctcaagtggctggcagacttcctgcgcaccaatcccatcgagacgagtggtgcccgctgtgccagtccccggcgcctcgccaacaagcgcatcgggcagatcaagagcaagaagttccggtgctcagccaaagagcagtacttcattccaggcacggaggattaccagctgaacagcgagtgcaacagcgacgtggtctgtccccacaagtgccgctgtgaggccaacgtggtggagtgctccagcctgaagctcaccaagatccctgagcgcatcccccagtccacggcagaactgcgattgaataacaatgagatttccatcctggaggccactgggatgtttaaaaaacttacacatctgaagaaaatcaatctgagcaacaacaaggtgtcagaaattgaagatggggccttcgagggcgcagcctctgtgagcgagctgcacctaactgccaaccagctggagtccatccggagcggcatgttccggggtctggatggcttgaggaccctaatgctgcggaacaaccgcatcagctgcatccacaacgacagcttcacgggcctgcgcaacgtccggctcctctcgctctacgacaaccagatcaccaccgtatccccaggagccttcgacaccctccagtccctctccacactgaatctcctggccaaccctttcaactgcaactgccagctggcctggctaggaggctggctacggaagcgcaagatcgtgacggggaacccgcgatgccagaaccctgactttttgcggcagattcccctgcaggacgtggccttccctgacttcaggtgtgaggaaggccaggaggaggggggctgcctgccccgcccacagtgcccacaggagtgcgcctgcctggacaccgtggtccgatgcagcaacaagcacctgcgggccctgcccaagggcattcccaagaatgtcacagaactctatttggacgggaaccagttcacgctggttccgggacagctgtctaccttcaagtacctgcagctcgtggacctgagcaacaacaagatcagttccttaagcaattcctccttcaccaacatgagccagctgaccactctgatcctcagctacaatgccctgcagtgcatcccgcctttggccttccagggactccgctccctgcgcctgctgtctctccacggcaatgacatctccaccctccaagagggcatctttgcagacgtgacctccctgtctcacctggccattggtgccaaccccctatactgtgactgccacctccgctggctgtccagctgggtgaagactggctacaaggaaccgggcattgctcgttgtgctgggccccaggacatggagggcaagctgctcctcaccacgcctgccaagaagtttgaatgccaaggtcctccaacgctggctgtccaggccaagtgtgatctctgcttgtccagtccgtgccagaaccagggcacctgccacaacgacccccttgaggtgtacaggtgcgcctgccccagcggctataagggtcgagactgtgaggtgtccctggacagctgttccagtggcccctgtgaaaatgggggcacctgccatgcacaggagggcgaggatgccccgttcacgtgctcctgtcccaccggctttgaaggaccaacctgtggggtgaacacagatgactgtgtggatcatgcctgtgccaatgggggcgtctgtgtggatggtgtgggcaactacacctgccagtgccccctgcagtatgagggaaaggcctgtgagcagctggtggacttgtgctctccggatctgaacccatgtcaacacgaggcccagtgtgtgggcaccccggatgggcccaggtgtgagtgcatgccaggttatgcaggtgacaactgcagtgagaaccaggatgactgcagggaccaccgctgccagaatggggcccagtgtatggatgaagtcaacagctactcctgcctctgtgctgagggctacagtggacagctctgtgagatccctccccatctgcctgcccccaagagcccctgtgaggggactgagtgccagaatggggccaactgtgtggaccagggcaacaggcctgtgtgccagtgcctcccaggcttcggtggccctgagtgtgagaagttgctcagtgtcaactttgtggatcgggacacttacctgcagttcactgacctgcaaaactggccacgggccaacatcacgttgcaggtctccacggcagaggacaatgggatccttctgtacaacggggacaacgaccacattgcagttgagctgtaccagggccatgtgcgtgtcagctacgacccaggcagctaccccagctctgccatctacagtgctgagacgatcaacgatgggcaattccacaccgttgagctggttgcctttgaccagatggtgaatctctccattgatggcgggagccccatgaccatggacaactttggcaaacattacacgctcaacagcgaggcgccactctatgtgggagggatgcccgtggatgtcaactcagctgccttccgcctgtggcagatcctcaacggcaccggcttccacggttgcatccgaaacctgtacatcaacaacgagctgcaggacttcaccaagacgcagatgaagccaggcgtggtgccaggctgcgaaccctgccgcaagctctactgcctgcatggcatctgccagcccaatgccaccccagggcccatgtgccactgcgaggctggctgggtgggcctgcactgtgaccagcccgctgacggcccctgccatggccacaagtgtgtccatgggcaatgcgtgcccctcgacgctctttcctacagctgccagtgccaggatgggtactcgggggcactgtgcaaccaggccggggccctggcagagccctgcagaggcctgcagtgcctgcatggccactgccaggcctcaggcaccaagggggcacactgtgtgtgtgaccccggcttttcgggcgagctgtgtgagcaagagtccgagtgccggggggaccctgtccgggactttcaccaggtccagaggggctatgccatctgccagaccacgcgccccctgtcatgggtggagtgccggggctcgtgcccaggccagggctgctgccagggccttcggctgaagcggaggaagttcacctttgagtgcagcgatgggacctcttttgccgaggaggtggaaaagcccaccaagtgtggctgtgccctctgcgcatagcgctgggcgtggacaggccggtgagggcgggcaaggggccccagccgctgcagcagcggagacagtcgccagcagctgggctggggtgcaggtcatcacaggacggctcctgggcagctgggccctcctgggtggggtggtgccagagcagccttttaaaagcaaattgcgccatagctgggggcagcgggggtgggcgaggcctgagctgcgggctgccctctccggaagtgccttgcacaaataggcgcttaataaatatttgttgagtgaatgtgtgcgtgaggtcaggccaagaagtgcagaacgatgacacccctccttacctgctatctgaatctggagaagaaaaatgacagccttccaaaccaacccttccctttggcctgtggcccaggctggcttggaactgggtctgtggccccagaagcctcttacccctctgcgggcaaccatgaagtactgtcagcctccccgggaagccagcctggttcattctgctgctacagaatctgctggtggtaggccaggctctggagcgggggtgccgcctcctgctggccagggagggtcggacccttgccccctgggctgactggcagctctgcagccacggcttgggaacgaggctgtgggtggaggtggttcttaggaccaggcctctgaatcctaaagttctagcatgactactgtagctgcgagggcttatgtggaggaaacagtcacaggggctgctcagggtggcagaccccactaaagagggcagagggttctttgctctagataaacaaacatcatctgcctccagacactggccacagtaggagtattggtcctgggcttccccagccaccagtcagccacaagctgtcggtgacctattggtagagggactgggtgtgagggtctgggccagggtgcttgacctgggagcagctggttcagagtccttcacaccgcaggccagtagggagcagtggaagggacagtgctccaggcattgggaagtccctgctggctctatcactcggggcaaacttctccccacctgggccttgggttcttcagctataaaatggccagaggtggggggcgggatgactaaaggaacagtgcagactcccccactgtggtcttgggaggccagaggagttagaagacctatctatctatctatctatctacattgatcacatcaaaagtatttatgtgcctaacccggggctggggattgtggacgttctggcctaatggacagatgtgaactcatcccagagcatcgcaggaatgaccaggatgcccgggaagagttgagctgagtgggggctccagccacagacagcggcccaggccagggagttgtggcaacagggccggggctcccggtgaaggtgtcaggaagtggaaaaggctggactttgtctcctctttgcctgctggtagcctaaccgcaaaagtatctctttatacagaatacttacagattctaatatatatttgtatttcattttgttacagtatttttatatgttaaagtcaacatccagcgtcttgttttgcctttcagatgctatgtggtcgtggcacgttttgttgggggtttctgtagtcgtcttgtttggatcaactcctagaggctggtttagaacaggcccatgagggagctgcacctgccctggaagtattgttttagactatgtcgatattgtctgttgtcttccatgtgaacatgacattgagtcac

SEQ ID NO: 440199 - DNA, 6863 bp, Homo sapiens
gggagacgcaggcggcgaaacggcagaggagccgagccccctccgcccaaggcgccctccctccgtccgcgcacaggcgccgtcgcttggaggagcaaggtgcctcccagcccgcaggggcgccgcgcgcaagcccgcgggctcttcggtggctctgccccgggactgcacctggaggcggccccggacggggatggtcagcggctgctgccgtctggctcgcgagcgggacgctgtgagggcaccatggcgctgactcccgggtgggggtcctcggcggggccggtccggccggagctctggctgctgctgtgggcagccgcgtggcgcctgggtgcctcggcgtgccccgccctctgcacctgcaccggaaccacggtggactgccacggcacggggctgcaggccattcccaagaatatacctcggaacaccgagcgcctggaactcaatggcaacaacatcactcggatccataagaatgactttgcggggctcaagcagctgcgggtgctgcagctgatggagaaccagattggagcagtggaacgtggtgcttttgatgacatgaaggagctggagcggctgcgactgaaccgaaaccagctgcacatgttaccggaactgctgttccagaacaaccaggctttgtcaagactggacttgagtgagaacgccatccaggccatccccaggaaagcttttcggggagctacggaccttaaaaatttacggctggacaagaaccagatcagctgcattgaggaaggggccttccgtgctctgcgggggctggaggtgctgaccctgaacaacaacaatatcaccaccatccccgtgtccagcttcaaccatatgcccaagctacggaccttccgcctgcactccaaccacctgttttgcgactgccacctggcctggctctcgcagtggctgaggcagcggccaaccatcgggctcttcacccagtgctcgggcccagccagcctgcgtggcctcaatgtggcagaggtccagaagagtgagttcagctgctcaggccagggagaagcggggcgcgtgcccacctgcaccctgtcctccggctcctgcccggccatgtgcacctgcagcaatggcatcgtggactgtcgtggaaaaggcctcactgccatcccggccaacctgcccgagaccatgacggagatacgcctggagctgaacggcatcaagtccatccctcctggagccttctcaccctacagaaagctacggaggatagacctgagcaacaatcagatcgctgagattgcacccgacgccttccagggcctccgctccctgaactcgctggtcctctatggaaacaagatcacagacctcccccgtggtgtgtttggaggcctatacaccctacagctcctgctcctgaatgccaacaagatcaactgcatccggcccgatgccttccaggacctgcagaacctctcactgctctccctgtatgacaacaagatccagagcctcgccaagggcactttcacctccctgcgggccatccagactctgcacctggcccagaaccctttcatttgcgactgtaacctcaagtggctggcagacttcctgcgcaccaatcccatcgagacgagtggtgcccgctgtgccagtccccggcgcctcgccaacaagcgcatcgggcagatcaagagcaagaagttccggtgctcagccaaagagcagtacttcattccaggcacggaggattaccagctgaacagcgagtgcaacagcgacgtggtctgtccccacaagtgccgctgtgaggccaacgtggtggagtgctccagcctgaagctcaccaagatccctgagcgcatcccccagtccacggcagaactgcgattgaataacaatgagatttccatcctggaggccactgggatgtttaaaaaacttacacatctgaagaaaatcaatctgagcaacaacaaggtgtcagaaattgaagatggggccttcgagggcgcagcctctgtgagcgagctgcacctaactgccaaccagctggagtccatccggagcggcatgttccggggtctggatggcttgaggaccctaatgctgcggaacaaccgcatcagctgcatccacaacgacagcttcacgggcctgcgcaacgtccggctcctctcgctctacgacaaccagatcaccaccgtatccccaggagccttcgacaccctccagtccctctccacactgaatctcctggccaaccctttcaactgcaactgccagctggcctggctaggaggctggctacggaagcgcaagatcgtgacggggaacccgcgatgccagaaccctgactttttgcggcagattcccctgcaggacgtggccttccctgacttcaggtgtgaggaaggccaggaggaggggggctgcctgccccgcccacagtgcccacaggagtgcgcctgcctggacaccgtggtccgatgcagcaacaagcacctgcgggccctgcccaagggcattcccaagaatgtcacagaactctatttggacgggaaccagttcacgctggttccgggacagctgtctaccttcaagtacctgcagctcgtggacctgagcaacaacaagatcagttccttaagcaattcctccttcaccaacatgagccagctgaccactctgatcctcagctacaatgccctgcagtgcatcccgcctttggccttccagggactccgctccctgcgcctgctgtctctccacggcaatgacatctccaccctccaagagggcatctttgcagacgtgacctccctgtctcacctggccattggtgccaaccccctatactgtgactgccacctccgctggctgtccagctgggtgaagactggctacaaggaaccgggcattgctcgttgtgctgggccccaggacatggagggcaagctgctcctcaccacgcctgccaagaagtttgaatgccaaggtcctccaacgctggctgtccaggccaagtgtgatctctgcttgtccagtccgtgccagaaccagggcacctgccacaacgacccccttgaggtgtacaggtgcgcctgccccagcggctataagggtcgagactgtgaggtgtccctggacagctgttccagtggcccctgtgaaaatgggggcacctgccatgcacaggagggcgaggatgccccgttcacgtgctcctgtcccaccggctttgaaggaccaacctgtggggtgaacacagatgactgtgtggatcatgcctgtgccaatgggggcgtctgtgtggatggtgtgggcaactacacctgccagtgccccctgcagtatgagggaaaggcctgtgagcagctggtggacttgtgctctccggatctgaacccatgtcaacacgaggcccagtgtgtgggcaccccggatgggcccaggtgtgagtgcatgccaggttatgcaggtgacaactgcagtgagaaccaggatgactgcagggaccaccgctgccagaatggggcccagtgtatggatgaagtcaacagctactcctgcctctgtgctgagggctacagtggacagctctgtgagatccctccccatctgcctgcccccaagagcccctgtgaggggactgagtgccagaatggggccaactgtgtggaccagggcaacaggcctgtgtgccagtgcctcccaggcttcggtggccctgagtgtgagaagttgctcagtgtcaactttgtggatcgggacacttacctgcagttcactgacctgcaaaactggccacgggccaacatcacgttgcaggtctccacggcagaggacaatgggatccttctgtacaacggggacaacgaccacattgcagttgagctgtaccagggccatgtgcgtgtcagctacgacccaggcagctaccccagctctgccatctacagtgctgagacgatcaacgatgggcaattccacaccgttgagctggttgcctttgaccagatggtgaatctctccattgatggcgggagccccatgaccatggacaactttggcaaacattacacgctcaacagcgaggcgccactctatgtgggagggatgcccgtggatgtcaactcagctgccttccgcctgtggcagatcctcaacggcaccggcttccacggttgcatccgaaacctgtacatcaacaacgagctgcaggacttcaccaagacgcagatgaagccaggcgtggtgccaggctgcgaaccctgccgcaagctctactgcctgcatggcatctgccagcccaatgccaccccagggcccatgtgccactgcgaggctggctgggtgggcctgcactgtgaccagcccgctgacggcccctgccatggccacaagtgtgtccatgggcaatgcgtgcccctcgacgctctttcctacagctgccagtgccaggatgggtactcgggggcactgtgcaaccaggccggggccctggcagagccctgcagaggcctgcagtgcctgcatggccactgccaggcctcaggcaccaagggggcacactgtgtgtgtgaccccggcttttcgggcgagctgtgtgagcaagagtccgagtgccggggggaccctgtccgggactttcaccaggtccagaggggctatgccatctgccagaccacgcgccccctgtcatgggtggagtgccggggctcgtgcccaggccagggctgctgccagggccttcggctgaagcggaggaagttcacctttgagtgcagcgatgggacctcttttgccgaggaggtggaaaagcccaccaagtgtggctgtgccctctgcgcatagcgctgggcgtggacaggccggtgagggcgggcaaggggccccagccgctgcagcagcggagacagtcgccagcagctgggctggggtgcaggtcatcacaggacggctcctgggcagctgggccctcctgggtggggtggtgccagagcagccttttaaaagcaaattgcgccatagctgggggcagcgggggtgggcgaggcctgagctgcgggctgccctctccggaagtgccttgcacaaataggcgcttaataaatatttgttgagtgaatgtgtgcgtgaggtcaggccaagaagtgcagaacgatgacacccctccttacctgctatctgaatctggagaagaaaaatgacagccttccaaaccaacccttccctttggcctgtggcccaggctggcttggaactgggtctgtggccccagaagcctcttacccctctgcgggcaaccatgaagtactgtcagcctccccgggaagccagcctggttcattctgctgctacagaatctgctggtggtaggccaggctctggagcgggggtgccgcctcctgctggccagggagggtcggacccttgccccctgggctgactggcagctctgcagccacggcttgggaacgaggctgtgggtggaggtggttcttaggaccaggcctctgaatcctaaagttctagcatgactactgtagctgcgagggcttatgtggaggaaacagtcacaggggctgctcagggtggcagaccccactaaagagggcagagggttctttgctctagataaacaaacatcatctgcctccagacactggccacagtaggagtattggtcctgggcttccccagccaccagtcagccacaagctgtcggtgacctattggtagagggactgggtgtgagggtctgggccagggtgcttgacctgggagcagctggttcagagtccttcacaccgcaggccagtagggagcagtggaagggacagtgctccaggcattgggaagtccctgctggctctatcactcggggcaaacttctccccacctgggccttgggttcttcagctataaaatggccagaggtggggggcgggatgactaaaggaacagtgcagactcccccactgtggtcttgggaggccagaggagttagaagacctatctatctatctatctatctacattgatcacatcaaaagtatttatgtgcctaacccggggctggggattgtggacgttctggcctaatggacagatgtgaactcatcccagagcatcgcaggaatgaccaggatgcccgggaagagttgagctgagtgggggctccagccacagacagcggcccaggccagggagttgctggcaacgaaggagccagtggtggaagaagaagaggccctgaatatacgattgcctgcccacgttgtcttctcttccatacacagtgaaaatgtagaaagatgggagcaccatgtgagcttaaggctcccctgaccggccccaccacatggcccagcctcctagcacagcagcgctgacctcagtgcagtctgaggattggaatccaccatgagatgatgtgagagctgtgtgccccaggatcaactttttctccaacttggccatcagccagcgagttgctaaggacctgagtcagcactcacgttgcctattcacactccgcttgaaagtccggaaggcatgaagagatacagcagggtgcgtccggagggagctgtggccttgcaacaccactggcaacagggccggggctcccggtgaaggtgtcaggaagtggaaaaggctggactttgtctcctctttgcctgctgatgctatgtggtcgtggcacgttttgttgggggtttctgtagtcgtcttgtttggatcaactcctagaggctggtttagaacaggcccatgagggagctgcacctgccctggaagtattgttttagactatgtcgatattgtctgttgtcttccatgtgaacatgacattgagtcac

SEQ ID NO: 440200 - DNA, 5168 bp, Homo sapiens
ctctctgacttatgtcctttcctctcagtggacagctctgtgagatccctccccatctgcctgcccccaagagcccctgtgaggggactgagtgccagaatggggccaactgtgtggaccagggcaacaggcctgtgtgccagtgcctcccaggcttcggtggccctgagtgtgagaagttgctcagtgtcaactttgtggatcgggacacttacctgcagttcactgacctgcaaaactggccacgggccaacatcacgttgcaggtctccacggcagaggacaatgggatccttctgtacaacggggacaacgaccacattgcagttgagctgtaccagggccatgtgcgtgtcagctacgacccaggcagctaccccagctctgccatctacagtgctgagacgatcaacgatgggcaattccacaccgttgagctggttgcctttgaccagatggtgaatctctccattgatggcgggagccccatgaccatggacaactttggcaaacattacacgctcaacagcgaggcgccactctatgtgggagggatgcccgtggatgtcaactcagctgccttccgcctgtggcagatcctcaacggcaccggcttccacggttgcatccgaaacctgtacatcaacaacgagctgcaggacttcaccaagacgcagatgaagccaggcgtggtgccaggctgcgaaccctgccgcaagctctactgcctgcatggcatctgccagcccaatgccaccccagggcccatgtgccactgcgaggctggctgggtgggcctgcactgtgaccagcccgctgacggcccctgccatggccacaagtgtgtccatgggcaatgcgtgcccctcgacgctctttcctacagctgccagtgccaggatgggtactcgggggcactgtgcaaccaggccggggccctggcagagccctgcagaggcctgcagtgcctgcatggccactgccaggcctcaggcaccaagggggcacactgtgtgtgtgaccccggcttttcgggcgagctgtgtgagcaaggtcaggggcccccctcctgacgtgccctccccagggtcccccacaaattgctttagcaatttgactcttcctcccagtctcggcagcccttctgtcccttcccagccctgtaccatgggctactatggggctttcagagtccctccaccctctgggcactgctcccaatctctcctggcccagtttgccctgcagctcccttattcagggtatgcgcctcttctggctggggtctctccttgcagaagagaccacccagggtaacagctcctggcccaacctctgcctcttggccccatcacctcatgacctgggagcggcagcaggaagtccgagggttggggactccttcccaggccctccctggcctgcttgaccaagatggcttctgctggaatccggactgctaaggctgggcagggagaagctggagaaacccagaactcaggcaccttaagggtcccctaggctatcccctccccagcatgaatccttttcataatgttattgcccccggggcctccagcctctcttgcacgcctctagcaatggggaccccccctccctccagcagttcagtctgtcctggagggccctgacgctaggaccagactgtaggccctgggaggaagcttgtgcatgtcagtgggaggcggaagtatgctggggacagaggtggggtctgagagccaaaggatccaccccacagatgctgccctcctcctcctcttcctcctgcctccctggaggcagcagctcacccatgggtgtgccctgaggctttctcttggtgtctgtcccatccagagtccgagtgccggggggaccctgtccgggactttcaccaggtccagaggggctatgccatctgccagaccacgcgccccctgtcatgggtggagtgccggggctcgtgcccaggccagggctgctgccagggccttcggctgaagcggaggaagttcacctttgagtgcagcgatgggacctcttttgccgaggaggtggaaaagcccaccaagtgtggctgtgccctctgcgcatagcgctgggcgtggacaggccggtgagggcgggcaaggggccccagccgctgcagcagcggagacagtcgccagcagctgggctggggtgcaggtcatcacaggacggctcctgggcagctgggccctcctgggtggggtggtgccagagcagccttttaaaagcaaattgcgccatagctgggggcagcgggggtgggcgaggcctgagctgcgggctgccctctccggaagtgccttgcacaaataggcgcttaataaatatttgttgagtgaatgtgtgcgtgaggtcaggccaagaagtgcagaacgatgacacccctccttacctgctatctgaatctggagaagaaaaatgacagccttccaaaccaacccttccctttggcctgtggcccaggctggcttggaactgggtctgtggccccagaagcctcttacccctctgcgggcaaccatgaagtactgtcagcctccccgggaagccagcctggttcattctgctgctacagaatctgctggtggtaggccaggctctggagcgggggtgccgcctcctgctggccagggagggtcggacccttgccccctgggctgactggcagctctgcagccacggcttgggaacgaggctgtgggtggaggtggttcttaggaccaggcctctgaatcctaaagttctagcatgactactgtagctgcgagggcttatgtggaggaaacagtcacaggggctgctcagggtggcagaccccactaaagagggcagagggttctttgctctagataaacaaacatcatctgcctccagacactggccacagtaggagtattggtcctgggcttccccagccaccagtcagccacaagctgtcggtgacctattggtagagggactgggtgtgagggtctgggccagggtgcttgacctgggagcagctggttcagagtccttcacaccgcaggccagtagggagcagtggaagggacagtgctccaggcattgggaagtccctgctggctctatcactcggggcaaacttctccccacctgggccttgggttcttcagctataaaatggccagaggtggggggcgggatgactaaaggaacagtgcagactcccccactgtggtcttgggaggccagaggagttagaagacctatctatctatctatctatctacattgatcacatcaaaagtatttatgtgcctaacccggggctggggattgtggacgttctggcctaatggacagatgtgaactcatcccagagcatcgcaggaatgaccaggatgcccgggaagagttgagctgagtgggggctccagccacagacagcggcccaggccagggagttgctggcaacgaaggagccagtggtggaagaagaagaggccctgaatatacgattgcctgcccacgttgtcttctcttccatacacagtgaaaatgtagaaagatggtttgtgaggccaaactgtgaatgggctaaagggaggcaaagttgcactctccttccccagagggctcaccaagagggcacacccccgggggttctggtgggcaacgggggtgagcatgtccctgccctggctccctccatctgtgaccaggaggcatggctgggtgtatgttcaggtgaggctcagagtggcattgtgtccctgtcccctgcccagggcagtgaggggagcccttgatgctgattagaaggctagaactggggtagaggtgcctggcatgtctcatgccatggggactcaatctagcaactgtgagtcctggggtccctgtgatgggaagagggcagtgccctgcccaatgtggcaggtgtcctcatggcaggatctgcccctcaccagggggctgggatctacttgcttggagctctgagcaaggccacaatgcccgcccccacccccaagtagactgcagcctgggcctcatggggcttctcccaggcccacatggcatccctctctgagtttccaggccaccgtgggaccctgcagagcatctgcaccgggctggatagggcagaaaagctcaagggcagctagcttgcctcttccctggaagaaaggtgctctgggactcaccaaccctgagaaagatagctttcctggccaccaccattccccaccaccctggagaagccaattcccaggcttgaagggcactggctggcaggaggcctcttcattctgcaggaggtggaaaggacacctgtagacaggtgatgctcacccctcacctggcgccatggggctgggaggtgagcggctggcatgtttgttcctagggagcaccatgtgagcttaaggctcccctgaccggccccaccacatggcccagcctcctagcacagcagcgctgacctcagtgcagtctgaggattggaatccaccatgagatgatgtgagagctgtgtgccccaggatcaactttttctccaacttggccatcagccagcgagttgctaaggacctgagtcagcactcacgttgcctattcacactccgcttgaaagtccggaaggtggctactgcaaaatcacccctctgagaagtcctctctccacatcttgtccccctttgtgaagacccctagttcgctctgcattttaggcatgaagagatacagcagggtgcgtccggagggagctgtggccttgcaacaccactggcaacagggccggggctcccggtgaaggtgtcaggaagtggaaaaggctggactttgtctcctctttgcctgctggtagcctaaccgcaaaagtatctctttatacagaatacttacagattctaatatatatttgtatttcattttgttacagtatttttatatgttaaagtcaacatccagcgtcttgttttgcctttcagatgctatgtggtcgtggcacgttttgttgggggtttctgtagtcgtcttgtttggatcaactcctagaggctggtttagaacaggcccatgagggagctgcacctgccctggaagtattgttttagactatgtcgatattgtctgttgtcttccatgtgaacatgacattgagtcac

SEQ ID NO: 440201 - DNA, 1784 bp, Homo sapiens
ggtgtgtgccgtcccgcttctgtccctttttctgctctcgcgtttgccgtgttggccctttttttgtggtggtgtgtcgggcccgcatcgtctttcatttcggcggcccctctgccgttggtctgctctggtttgccaccagctgtcgtgcccgctcgtgcttccgcttcacttgtgtgatgccttcaagtcggtggggtcgcctttatgcatatgcttcctgtgtctgttggtcttcatactatcttggattcggttgttcttcggtataacgagttcccttttcgggtaaggctcccccgcaggcaagaggatgccaattccagcccttccccacttggcggacgccttcaccggagcccggtcctctagcagtgctgtccaagcctcgagctccctccggacgcaccctctgtagtctcgtcaggcactcaaatgcagaccgaactaggggtcttcacaaagggggacaagatcatgggagagaggacttctcagaggcgagtgatatttcaagtagccaccctctcccggactttcaagcggtagtgctgaataggcaaccgtgaagtcgctcgactcaggtccttagcaactcgctggctgtatgcccaaggctctggagaataaagttgatcctaggggcacacaagctctcacatcatctcatggtggattccaatcctcaacgactagcaactcgagagctaacgcgcttgctgtgctaggaggctgggcccatgtggtgggaccggcgtcagcgggagccttaagctcacatggtgctccctaggaacaaacatcgccacccgctcacctcccagccccatggcgccaggtgaggggtgagcatcacctgtctacaggtgtcctttccaattcccaggcttgaagggcactggctggcaggaggcctcttcattctgcaggaggtggaaaggacacctgtagacaggtgatgctcacccctcacctggcgccatggggctgggaggtgagcggctggcatgtttgttcctagggagcaccatgtgagcttaaggctcccctgaccggccccaccacatggcccagcctcctagcacagcagcgctgacctcagtgcagtctgaggattggaatccaccatgagatgatgtgagagctgtgtgccccaggatcaactttttctccaacttggccatcagccagcgagttgctaaggacctgagtcagcactcacgttgcctattcacactccgcttgaaagtccggaaggtggctactgcaaaatcacccctctgagaagtcctctctccacatcttgtccccctttgtgaagacccctagttcgctctgcattttaggcatgaagagatacagcagggtgcgtccggagggagctgtggccttgcaacaccactggcaacagggccggggctcccggtgaaggtgtcaggaagtggaaaaggctggactttgtctcctctttgcctgctggtagcctaaccgcaaaagtatctctttatacagaatacttacagattctaatatatatttgtatttcattttgttacagtatttttatatgttaaagtcaacatccagcgtcttgttttgcctttcagatgctatgtggtcgtggcacgttttgttgggggtttctgtagtcgtcttgtttggatcaactcctagaggctggtttagaacaggcccatgagggagctgcacctgccctggaagtattgttttagactatgtcgatattgtctgttgtcttccatgtgaacatgacattgagtcac

SEQ ID NO: 440202 - DNA, 841 bp, Homo sapiens
gggagacgcaggcggcgaaacggcagaggagccgagccccctccgcccaaggcgccctccctccgtccgcgcacaggcgccgtcgcttggaggagcaaggtgcctcccagcccgcaggggcgccgcgcgcaagcccgcgggctcttcggtggctctgccccgggactgcacctggaggcggccccggacggggatggtcagcggctgctgccgtctggctcgcgagcgggacgctgtgagggcaccatggcgctgactcccgggtgggggtcctcggcggggccggtccggccggagctctggctgctgctgtgggcagccgcgtggcgcctgggtgcctcggcgtgccccgccctctgcacctgcaccggaaccacggtggactgccacggcacggggctgcaggccattcccaagaatatacctcggaacaccgagcgcctggaactcaatggcaacaacatcactcggatccataagaatgactttgcggggctcaagcagctgcgggtgctgcagctgatggagaaccagattggagcagtggaacgtggtgcttttgatgacatgaaggagctggagcggctgcgactgaaccgaaaccagctgcacatgttaccggaactgctgttccagaacaaccaggctttgtcaagactgatctatggctcagagaggtgatttgccttggaccacagagcagcttgacaatagggttggaattagacaccaggccttctaggggccctgaagagcctgaaaatggtcttaaaccttgacctaggaatctcatatttgggcatctgccctaaagaaataataaagcatgagcacagacaag

SEQ ID NO: 440203 - DNA, 7920 bp, Homo sapiens
gggagacgcaggcggcgaaacggcagaggagccgagccccctccgcccaaggcgccctccctccgtccgcgcacaggcgccgtcgcttggaggagcaaggtgcctcccagcccgcaggggcgccgcgcgcaagcccgcgggctcttcggtggctctgccccgggactgcacctggaggcggccccggacggggatggtcagcggctgctgccgtctggctcgcgagcgggacgctgtgagggcaccatggcgctgactcccgggtgggggtcctcggcggggccggtccggccggagctctggctgctgctgtgggcagccgcgtggcgcctgggtgcctcggcgtgccccgccctctgcacctgcaccggaaccacggtggactgccacggcacggggctgcaggccattcccaagaatatacctcggaacaccgagcgcctggaactcaatggcaacaacatcactcggatccataagaatgactttgcggggctcaagcagctgcgggtgctgcagctgatggagaaccagattggagcagtggaacgtggtgcttttgatgacatgaaggagctggagcggctgcgactgaaccgaaaccagctgcacatgttaccggaactgctgttccagaacaaccaggctttgtcaagactggacttgagtgagaacgccatccaggccatccccaggaaagcttttcggggagctacggaccttaaaaatttacggctggacaagaaccagatcagctgcattgaggaaggggccttccgtgctctgcgggggctggaggtgctgaccctgaacaacaacaatatcaccaccatccccgtgtccagcttcaaccatatgcccaagctacggaccttccgcctgcactccaaccacctgttttgcgactgccacctggcctggctctcgcagtggctgaggcagcggccaaccatcgggctcttcacccagtgctcgggcccagccagcctgcgtggcctcaatgtggcagaggtccagaagagtgagttcagctgctcaggccagggagaagcggggcgcgtgcccacctgcaccctgtcctccggctcctgcccggccatgtgcacctgcagcaatggcatcgtggactgtcgtggaaaaggcctcactgccatcccggccaacctgcccgagaccatgacggagatacgcctggagctgaacggcatcaagtccatccctcctggagccttctcaccctacagaaagctacggaggatagacctgagcaacaatcagatcgctgagattgcacccgacgccttccagggcctccgctccctgaactcgctggtcctctatggaaacaagatcacagacctcccccgtggtgtgtttggaggcctatacaccctacagctcctgctcctgaatgccaacaagatcaactgcatccggcccgatgccttccaggacctgcagaacctctcactgctctccctgtatgacaacaagatccagagcctcgccaagggcactttcacctccctgcgggccatccagactctgcacctggcccagaaccctttcatttgcgactgtaacctcaagtggctggcagacttcctgcgcaccaatcccatcgagacgagtggtgcccgctgtgccagtccccggcgcctcgccaacaagcgcatcgggcagatcaagagcaagaagttccggtgctcagccaaagagcagtacttcattccaggcacggaggattaccagctgaacagcgagtgcaacagcgacgtggtctgtccccacaagtgccgctgtgaggccaacgtggtggagtgctccagcctgaagctcaccaagatccctgagcgcatcccccagtccacggcagaactgcgattgaataacaatgagatttccatcctggaggccactgggatgtttaaaaaacttacacatctgaagaaaatcaatctgagcaacaacaaggtgtcagaaattgaagatggggccttcgagggcgcagcctctgtgagcgagctgcacctaactgccaaccagctggagtccatccggagcggcatgttccggggtctggatggcttgaggaccctaatgctgcggaacaaccgcatcagctgcatccacaacgacagcttcacgggcctgcgcaacgtccggctcctctcgctctacgacaaccagatcaccaccgtatccccaggagccttcgacaccctccagtccctctccacactgaatctcctggccaaccctttcaactgcaactgccagctggcctggctaggaggctggctacggaagcgcaagatcgtgacggggaacccgcgatgccagaaccctgactttttgcggcagattcccctgcaggacgtggccttccctgacttcaggtgtgaggaaggccaggaggaggggggctgcctgccccgcccacagtgcccacaggagtgcgcctgcctggacaccgtggtccgatgcagcaacaagcacctgcgggccctgcccaagggcattcccaagaatgtcacagaactctatttggacgggaaccagttcacgctggttccgggacagctgtctaccttcaagtacctgcagctcgtggacctgagcaacaacaagatcagttccttaagcaattcctccttcaccaacatgagccagctgaccactctgatcctcagctacaatgccctgcagtgcatcccgcctttggccttccagggactccgctccctgcgcctgctgtctctccacggcaatgacatctccaccctccaagagggcatctttgcagacgtgacctccctgtctcacctggccattggtgccaaccccctatactgtgactgccacctccgctggctgtccagctgggtgaagactggctacaaggaaccgggcattgctcgttgtgctgggccccaggacatggagggcaagctgctcctcaccacgcctgccaagaagtttgaatgccaaggtcctccaacgctggctgtccaggccaagtgtgatctctgcttgtccagtccgtgccagaaccagggcacctgccacaacgacccccttgaggtgtacaggtgcgcctgccccagcggctataagggtcgagactgtgaggtgtccctggacagctgttccagtggcccctgtgaaaatgggggcacctgccatgcacaggagggcgaggatgccccgttcacgtgctcctgtcccaccggctttgaaggaccaacctgtggggtgaacacagatgactgtgtggatcatgcctgtgccaatgggggcgtctgtgtggatggtgtgggcaactacacctgccagtgccccctgcagtatgagggaaaggcctgtgagcagctggtggacttgtgctctccggatctgaacccatgtcaacacgaggcccagtgtgtgggcaccccggatgggcccaggtgtgagtgcatgccaggttatgcaggtgacaactgcagtgagaaccaggatgactgcagggaccaccgctgccagaatggggcccagtgtatggatgaagtcaacagctactcctgcctctgtgctgagggctacagtggacagctctgtgagatccctccccatctgcctgcccccaagagcccctgtgaggggactgagtgccagaatggggccaactgtgtggaccagggcaacaggcctgtgtgccagtgcctcccaggcttcggtggccctgagtgtgagaagttgctcagtgtcaactttgtggatcgggacacttacctgcagttcactgacctgcaaaactggccacgggccaacatcacgttgcaggtctccacggcagaggacaatgggatccttctgtacaacggggacaacgaccacattgcagttgagctgtaccagggccatgtgcgtgtcagctacgacccaggcagctaccccagctctgccatctacagtgctgagacgatcaacgatgggcaattccacaccgttgagctggttgcctttgaccagatggtgaatctctccattgatggcgggagccccatgaccatggacaactttggcaaacattacacgctcaacagcgaggcgccactctatgtgggagggatgcccgtggatgtcaactcagctgccttccgcctgtggcagatcctcaacggcaccggcttccacggttgcatccgaaacctgtacatcaacaacgagctgcaggacttcaccaagacgcagatgaagccaggcgtggtgccaggctgcgaaccctgccgcaagctctactgcctgcatggcatctgccagcccaatgccaccccagggcccatgtgccactgcgaggctggctgggtgggcctgcactgtgaccagcccgctgacggcccctgccatggccacaagtgtgtccatgggcaatgcgtgcccctcgacgctctttcctacagctgccagtgccaggatgggtactcgggggcactgtgcaaccaggccggggccctggcagagccctgcagaggcctgcagtgcctgcatggccactgccaggcctcaggcaccaagggggcacactgtgtgtgtgaccccggcttttcgggcgagctgtgtgagcaagagtccgagtgccggggggaccctgtccgggactttcaccaggtccagaggggctatgccatctgccagaccacgcgccccctgtcatgggtggagtgccggggctcgtgcccaggccagggctgctgccagggccttcggctgaagcggaggaagttcacctttgagtgcagcgatgggacctcttttgccgaggaggtggaaaagcccaccaagtgtggctgtgccctctgcgcatagcgctgggcgtggacaggccggtgagggcgggcaaggggccccagccgctgcagcagcggagacagtcgccagcagctgggctggggtgcaggtcatcacaggacggctcctgggcagctgggccctcctgggtggggtggtgccagagcagccttttaaaagcaaattgcgccatagctgggggcagcgggggtgggcgaggcctgagctgcgggctgccctctccggaagtgccttgcacaaataggcgcttaataaatatttgttgagtgaatgtgtgcgtgaggtcaggccaagaagtgcagaacgatgacacccctccttacctgctatctgaatctggagaagaaaaatgacagccttccaaaccaacccttccctttggcctgtggcccaggctggcttggaactgggtctgtggccccagaagcctcttacccctctgcgggcaaccatgaagtactgtcagcctccccgggaagccagcctggttcattctgctgctacagaatctgctggtggtaggccaggctctggagcgggggtgccgcctcctgctggccagggagggtcggacccttgccccctgggctgactggcagctctgcagccacggcttgggaacgaggctgtgggtggaggtggttcttaggaccaggcctctgaatcctaaagttctagcatgactactgtagctgcgagggcttatgtggaggaaacagtcacaggggctgctcagggtggcagaccccactaaagagggcagagggttctttgctctagataaacaaacatcatctgcctccagacactggccacagtaggagtattggtcctgggcttccccagccaccagtcagccacaagctgtcggtgacctattggtagagggactgggtgtgagggtctgggccagggtgcttgacctgggagcagctggttcagagtccttcacaccgcaggccagtagggagcagtggaagggacagtgctccaggcattgggaagtccctgctggctctatcactcggggcaaacttctccccacctgggccttgggttcttcagctataaaatggccagaggtggggggcgggatgactaaaggaacagtgcagactcccccactgtggtcttgggaggccagaggagttagaagacctatctatctatctatctatctacattgatcacatcaaaagtatttatgtgcctaacccggggctggggattgtggacgttctggcctaatggacagatgtgaactcatcccagagcatcgcaggaatgaccaggatgcccgggaagagttgagctgagtgggggctccagccacagacagcggcccaggccagggagttgctggcaacgaaggagccagtggtggaagaagaagaggccctgaatatacgattgcctgcccacgttgtcttctcttccatacacagtgaaaatgtagaaagatggtttgtgaggccaaactgtgaatgggctaaagggaggcaaagttgcactctccttccccagagggctcaccaagagggcacacccccgggggttctggtgggcaacgggggtgagcatgtccctgccctggctccctccatctgtgaccaggaggcatggctgggtgtatgttcaggtgaggctcagagtggcattgtgtccctgtcccctgcccagggcagtgaggggagcccttgatgctgattagaaggctagaactggggtagaggtgcctggcatgtctcatgccatggggactcaatctagcaactgtgagtcctggggtccctgtgatgggaagagggcagtgccctgcccaatgtggcaggtgtcctcatggcaggatctgcccctcaccagggggctgggatctacttgcttggagctctgagcaaggccacaatgcccgcccccacccccaagtagactgcagcctgggcctcatggggcttctcccaggcccacatggcatccctctctgagtttccaggccaccgtgggaccctgcagagcatctgcaccgggctggatagggcagaaaagctcaagggcagctagcttgcctcttccctggaagaaaggtgctctgggactcaccaaccctgagaaagatagctttcctggccaccaccattccccaccaccctggagaagccaattcccaggcttgaagggcactggctggcaggaggcctcttcattctgcaggaggtggaaaggacacctgtagacaggtgatgctcacccctcacctggcgccatggggctgggaggtgagcggctggcatgtttgttcctagggagcaccatgtgagcttaaggctcccctgaccggccccaccacatggcccagcctcctagcacagcagcgctgacctcagtgcagtctgaggattggaatccaccatgagatgatgtgagagctgtgtgccccaggatcaactttttctccaacttggccatcagccagcgagttgctaaggacctgagtcagcactcacgttgcctattcacactccgcttgaaagtccggaaggtggctactgcaaaatcacccctctgagaagtcctctctccacatcttgtccccctttgtgaagacccctagttcgctctgcattttaggcatgaagagatacagcagggtgcgtccggagggagctgtggccttgcaacaccactggcaacagggccggggctcccggtgaaggtgtcaggaagtggaaaaggctggactttgtctcctctttgcctgctggtagcctaaccgcaaaagtatctctttatacagaatacttacagattctaatatatatttgtatttcattttgttacagtatttttatatgttaaagtcaacatccagcgtcttgttttgcctttcagatgctatgtggtcgtggcacgttttgttgggggtttctgtagtcgtcttgtttggatcaactcctagaggctggtttagaacaggcccatgagggagctgcacctgccctggaagtattgttttagactatgtcgatattgtctgttgtcttccatgtgaacatgacattgagtcac

SEQ ID NO: 440204 - DNA, 8727 bp, Homo sapiens
gggagacgcaggcggcgaaacggcagaggagccgagccccctccgcccaaggcgccctccctccgtccgcgcacaggcgccgtcgcttggaggagcaaggtgcctcccagcccgcaggggcgccgcgcgcaagcccgcgggctcttcggtggctctgccccgggactgcacctggaggcggccccggacggggatggtcagcggctgctgccgtctggctcgcgagcgggacgctgtgagggcaccatggcgctgactcccgggtgggggtcctcggcggggccggtccggccggagctctggctgctgctgtgggcagccgcgtggcgcctgggtgcctcggcgtgccccgccctctgcacctgcaccggaaccacggtggactgccacggcacggggctgcaggccattcccaagaatatacctcggaacaccgagcgcctggaactcaatggcaacaacatcactcggatccataagaatgactttgcggggctcaagcagctgcgggtgctgcagctgatggagaaccagattggagcagtggaacgtggtgcttttgatgacatgaaggagctggagcggctgcgactgaaccgaaaccagctgcacatgttaccggaactgctgttccagaacaaccaggctttgtcaagactggacttgagtgagaacgccatccaggccatccccaggaaagcttttcggggagctacggaccttaaaaatttacggctggacaagaaccagatcagctgcattgaggaaggggccttccgtgctctgcgggggctggaggtgctgaccctgaacaacaacaatatcaccaccatccccgtgtccagcttcaaccatatgcccaagctacggaccttccgcctgcactccaaccacctgttttgcgactgccacctggcctggctctcgcagtggctgaggcagcggccaaccatcgggctcttcacccagtgctcgggcccagccagcctgcgtggcctcaatgtggcagaggtccagaagagtgagttcagctgctcaggccagggagaagcggggcgcgtgcccacctgcaccctgtcctccggctcctgcccggccatgtgcacctgcagcaatggcatcgtggactgtcgtggaaaaggcctcactgccatcccggccaacctgcccgagaccatgacggagatacgcctggagctgaacggcatcaagtccatccctcctggagccttctcaccctacagaaagctacggaggatagacctgagcaacaatcagatcgctgagattgcacccgacgccttccagggcctccgctccctgaactcgctggtcctctatggaaacaagatcacagacctcccccgtggtgtgtttggaggcctatacaccctacagctcctgctcctgaatgccaacaagatcaactgcatccggcccgatgccttccaggacctgcagaacctctcactgctctccctgtatgacaacaagatccagagcctcgccaagggcactttcacctccctgcgggccatccagactctgcacctggcccagaaccctttcatttgcgactgtaacctcaagtggctggcagacttcctgcgcaccaatcccatcgagacgagtggtgcccgctgtgccagtccccggcgcctcgccaacaagcgcatcgggcagatcaagagcaagaagttccggtgctcagccaaagagcagtacttcattccaggcacggaggattaccagctgaacagcgagtgcaacagcgacgtggtctgtccccacaagtgccgctgtgaggccaacgtggtggagtgctccagcctgaagctcaccaagatccctgagcgcatcccccagtccacggcagaactgcgattgaataacaatgagatttccatcctggaggccactgggatgtttaaaaaacttacacatctgaagaaaatcaatctgagcaacaacaaggtgtcagaaattgaagatggggccttcgagggcgcagcctctgtgagcgagctgcacctaactgccaaccagctggagtccatccggagcggcatgttccggggtctggatggcttgaggaccctaatgctgcggaacaaccgcatcagctgcatccacaacgacagcttcacgggcctgcgcaacgtccggctcctctcgctctacgacaaccagatcaccaccgtatccccaggagccttcgacaccctccagtccctctccacactgaatctcctggccaaccctttcaactgcaactgccagctggcctggctaggaggctggctacggaagcgcaagatcgtgacggggaacccgcgatgccagaaccctgactttttgcggcagattcccctgcaggacgtggccttccctgacttcaggtgtgaggaaggccaggaggaggggggctgcctgccccgcccacagtgcccacaggagtgcgcctgcctggacaccgtggtccgatgcagcaacaagcacctgcgggccctgcccaagggcattcccaagaatgtcacagaactctatttggacgggaaccagttcacgctggttccgggacagctgtctaccttcaagtacctgcagctcgtggacctgagcaacaacaagatcagttccttaagcaattcctccttcaccaacatgagccagctgaccactctgatcctcagctacaatgccctgcagtgcatcccgcctttggccttccagggactccgctccctgcgcctgctgtctctccacggcaatgacatctccaccctccaagagggcatctttgcagacgtgacctccctgtctcacctggccattggtgccaaccccctatactgtgactgccacctccgctggctgtccagctgggtgaagactggctacaaggaaccgggcattgctcgttgtgctgggccccaggacatggagggcaagctgctcctcaccacgcctgccaagaagtttgaatgccaaggtcctccaacgctggctgtccaggccaagtgtgatctctgcttgtccagtccgtgccagaaccagggcacctgccacaacgacccccttgaggtgtacaggtgcgcctgccccagcggctataagggtcgagactgtgaggtgtccctggacagctgttccagtggcccctgtgaaaatgggggcacctgccatgcacaggagggcgaggatgccccgttcacgtgctcctgtcccaccggctttgaaggaccaacctgtggggtgaacacagatgactgtgtggatcatgcctgtgccaatgggggcgtctgtgtggatggtgtgggcaactacacctgccagtgccccctgcagtatgagggaaaggcctgtgagcagctggtggacttgtgctctccggatctgaacccatgtcaacacgaggcccagtgtgtgggcaccccggatgggcccaggtgtgagtgcatgccaggttatgcaggtgacaactgcagtgagaaccaggatgactgcagggaccaccgctgccagaatggggcccagtgtatggatgaagtcaacagctactcctgcctctgtgctgagggctacagtggacagctctgtgagatccctccccatctgcctgcccccaagagcccctgtgaggggactgagtgccagaatggggccaactgtgtggaccagggcaacaggcctgtgtgccagtgcctcccaggcttcggtggccctgagtgtgagaagttgctcagtgtcaactttgtggatcgggacacttacctgcagttcactgacctgcaaaactggccacgggccaacatcacgttgcaggtctccacggcagaggacaatgggatccttctgtacaacggggacaacgaccacattgcagttgagctgtaccagggccatgtgcgtgtcagctacgacccaggcagctaccccagctctgccatctacagtgctgagacgatcaacgatgggcaattccacaccgttgagctggttgcctttgaccagatggtgaatctctccattgatggcgggagccccatgaccatggacaactttggcaaacattacacgctcaacagcgaggcgccactctatgtgggagggatgcccgtggatgtcaactcagctgccttccgcctgtggcagatcctcaacggcaccggcttccacggttgcatccgaaacctgtacatcaacaacgagctgcaggacttcaccaagacgcagatgaagccaggcgtggtgccaggctgcgaaccctgccgcaagctctactgcctgcatggcatctgccagcccaatgccaccccagggcccatgtgccactgcgaggctggctgggtgggcctgcactgtgaccagcccgctgacggcccctgccatggccacaagtgtgtccatgggcaatgcgtgcccctcgacgctctttcctacagctgccagtgccaggatgggtactcgggggcactgtgcaaccaggccggggccctggcagagccctgcagaggcctgcagtgcctgcatggccactgccaggcctcaggcaccaagggggcacactgtgtgtgtgaccccggcttttcgggcgagctgtgtgagcaaggtcaggggcccccctcctgacgtgccctccccagggtcccccacaaattgctttagcaatttgactcttcctcccagtctcggcagcccttctgtcccttcccagccctgtaccatgggctactatggggctttcagagtccctccaccctctgggcactgctcccaatctctcctggcccagtttgccctgcagctcccttattcagggtatgcgcctcttctggctggggtctctccttgcagaagagaccacccagggtaacagctcctggcccaacctctgcctcttggccccatcacctcatgacctgggagcggcagcaggaagtccgagggttggggactccttcccaggccctccctggcctgcttgaccaagatggcttctgctggaatccggactgctaaggctgggcagggagaagctggagaaacccagaactcaggcaccttaagggtcccctaggctatcccctccccagcatgaatccttttcataatgttattgcccccggggcctccagcctctcttgcacgcctctagcaatggggaccccccctccctccagcagttcagtctgtcctggagggccctgacgctaggaccagactgtaggccctgggaggaagcttgtgcatgtcagtgggaggcggaagtatgctggggacagaggtggggtctgagagccaaaggatccaccccacagatgctgccctcctcctcctcttcctcctgcctccctggaggcagcagctcacccatgggtgtgccctgaggctttctcttggtgtctgtcccatccagagtccgagtgccggggggaccctgtccgggactttcaccaggtccagaggggctatgccatctgccagaccacgcgccccctgtcatgggtggagtgccggggctcgtgcccaggccagggctgctgccagggccttcggctgaagcggaggaagttcacctttgagtgcagcgatgggacctcttttgccgaggaggtggaaaagcccaccaagtgtggctgtgccctctgcgcatagcgctgggcgtggacaggccggtgagggcgggcaaggggccccagccgctgcagcagcggagacagtcgccagcagctgggctggggtgcaggtcatcacaggacggctcctgggcagctgggccctcctgggtggggtggtgccagagcagccttttaaaagcaaattgcgccatagctgggggcagcgggggtgggcgaggcctgagctgcgggctgccctctccggaagtgccttgcacaaataggcgcttaataaatatttgttgagtgaatgtgtgcgtgaggtcaggccaagaagtgcagaacgatgacacccctccttacctgctatctgaatctggagaagaaaaatgacagccttccaaaccaacccttccctttggcctgtggcccaggctggcttggaactgggtctgtggccccagaagcctcttacccctctgcgggcaaccatgaagtactgtcagcctccccgggaagccagcctggttcattctgctgctacagaatctgctggtggtaggccaggctctggagcgggggtgccgcctcctgctggccagggagggtcggacccttgccccctgggctgactggcagctctgcagccacggcttgggaacgaggctgtgggtggaggtggttcttaggaccaggcctctgaatcctaaagttctagcatgactactgtagctgcgagggcttatgtggaggaaacagtcacaggggctgctcagggtggcagaccccactaaagagggcagagggttctttgctctagataaacaaacatcatctgcctccagacactggccacagtaggagtattggtcctgggcttccccagccaccagtcagccacaagctgtcggtgacctattggtagagggactgggtgtgagggtctgggccagggtgcttgacctgggagcagctggttcagagtccttcacaccgcaggccagtagggagcagtggaagggacagtgctccaggcattgggaagtccctgctggctctatcactcggggcaaacttctccccacctgggccttgggttcttcagctataaaatggccagaggtggggggcgggatgactaaaggaacagtgcagactcccccactgtggtcttgggaggccagaggagttagaagacctatctatctatctatctatctacattgatcacatcaaaagtatttatgtgcctaacccggggctggggattgtggacgttctggcctaatggacagatgtgaactcatcccagagcatcgcaggaatgaccaggatgcccgggaagagttgagctgagtgggggctccagccacagacagcggcccaggccagggagttgctggcaacgaaggagccagtggtggaagaagaagaggccctgaatatacgattgcctgcccacgttgtcttctcttccatacacagtgaaaatgtagaaagatggtttgtgaggccaaactgtgaatgggctaaagggaggcaaagttgcactctccttccccagagggctcaccaagagggcacacccccgggggttctggtgggcaacgggggtgagcatgtccctgccctggctccctccatctgtgaccaggaggcatggctgggtgtatgttcaggtgaggctcagagtggcattgtgtccctgtcccctgcccagggcagtgaggggagcccttgatgctgattagaaggctagaactggggtagaggtgcctggcatgtctcatgccatggggactcaatctagcaactgtgagtcctggggtccctgtgatgggaagagggcagtgccctgcccaatgtggcaggtgtcctcatggcaggatctgcccctcaccagggggctgggatctacttgcttggagctctgagcaaggccacaatgcccgcccccacccccaagtagactgcagcctgggcctcatggggcttctcccaggcccacatggcatccctctctgagtttccaggccaccgtgggaccctgcagagcatctgcaccgggctggatagggcagaaaagctcaagggcagctagcttgcctcttccctggaagaaaggtgctctgggactcaccaaccctgagaaagatagctttcctggccaccaccattccccaccaccctggagaagccaattcccaggcttgaagggcactggctggcaggaggcctcttcattctgcaggaggtggaaaggacacctgtagacaggtgatgctcacccctcacctggcgccatggggctgggaggtgagcggctggcatgtttgttcctagggagcaccatgtgagcttaaggctcccctgaccggccccaccacatggcccagcctcctagcacagcagcgctgacctcagtgcagtctgaggattggaatccaccatgagatgatgtgagagctgtgtgccccaggatcaactttttctccaacttggccatcagccagcgagttgctaaggacctgagtcagcactcacgttgcctattcacactccgcttgaaagtccggaaggtggctactgcaaaatcacccctctgagaagtcctctctccacatcttgtccccctttgtgaagacccctagttcgctctgcattttaggcatgaagagatacagcagggtgcgtccggagggagctgtggccttgcaacaccactggcaacagggccggggctcccggtgaaggtgtcaggaagtggaaaaggctggactttgtctcctctttgcctgctggtagcctaaccgcaaaagtatctctttatacagaatacttacagattctaatatatatttgtatttcattttgttacagtatttttatatgttaaagtcaacatccagcgtcttgttttgcctttcagatgctatgtggtcgtggcacgttttgttgggggtttctgtagtcgtcttgtttggatcaactcctagaggctggtttagaacaggcccatgagggagctgcacctgccctggaagtattgttttagactatgtcgatattgtctgttgtcttccatgtgaacatgacattgagtcac

SEQ ID NO: 440205 - DNA, 3819 bp, Homo sapiens
gggagacgcaggcggcgaaacggcagaggagccgagccccctccgcccaaggcgccctccctccgtccgcgcacaggcgccgtcgcttggaggagcaaggtgcctcccagcccgcaggggcgccgcgcgcaagcccgcgggctcttcggtggctctgccccgggactgcacctggaggcggccccggacggggatggtcagcggctgctgccgtctggctcgcgagcgggacgctgtgagggcaccatggcgctgactcccgggtgggggtcctcggcggggccggtccggccggagctctggctgctgctgtgggcagccgcgtggcgcctgggtgcctcggcgtgccccgccctctgcacctgcaccggaaccacggtggactgccacggcacggggctgcaggccattcccaagaatatacctcggaacaccgagcgcctggaactcaatggcaacaacatcactcggatccataagaatgactttgcggggctcaagcagctgcgggtgctgcagctgatggagaaccagattggagcagtggaacgtggtgcttttgatgacatgaaggagctggagcggctgcgactgaaccgaaaccagctgcacatgttaccggaactgctgttccagaacaaccaggctttgtcaagactggacttgagtgagaacgccatccaggccatccccaggaaagcttttcggggagctacggaccttaaaaatttacggctggacaagaaccagatcagctgcattgaggaaggggccttccgtgctctgcgggggctggaggtgctgaccctgaacaacaacaatatcaccaccatccccgtgtccagcttcaaccatatgcccaagctacggaccttccgcctgcactccaaccacctgttttgcgactgccacctggcctggctctcgcagtggctgaggcagcggccaaccatcgggctcttcacccagtgctcgggcccagccagcctgcgtggcctcaatgtggcagaggtccagaagagtgagttcagctgctcaggccagggagaagcggggcgcgtgcccacctgcaccctgtcctccggctcctgcccggccatgtgcacctgcagcaatggcatcgtggactgtcgtggaaaaggcctcactgccatcccggccaacctgcccgagaccatgacggagatacgcctggagctgaacggcatcaagtccatccctcctggagccttctcaccctacagaaagctacggaggatagacctgagcaacaatcagatcgctgagattgcacccgacgccttccagggcctccgctccctgaactcgctggtcctctatggaaacaagatcacagacctcccccgtggtgtgtttggaggcctatacaccctacagctcctgctcctgaatgccaacaagatcaactgcatccggcccgatgccttccaggacctgcagaacctctcactgctctccctgtatgacaacaagatccagagcctcgccaagggcactttcacctccctgcgggccatccagactctgcacctggcccagaaccctttcatttgcgactgtaacctcaagtggctggcagacttcctgcgcaccaatcccatcgagacgagtggtgcccgctgtgccagtccccggcgcctcgccaacaagcgcatcgggcagatcaagagcaagaagttccggtgctcagccaaagagcagtacttcattccaggcacggaggattaccagctgaacagcgagtgcaacagcgacgtggtctgtccccacaagtgccgctgtgaggccaacgtggtggagtgctccagcctgaagctcaccaagatccctgagcgcatcccccagtccacggcagaactgcgattgaataacaatgagatttccatcctggaggccactgggatgtttaaaaaacttacacatctgaagaaaatcaatctgagcaacaacaaggtgtcagaaattgaagatggggccttcgagggcgcagcctctgtgagcgagctgcacctaactgccaaccagctggagtccatccggagcggcatgttccggggtctggatggcttgaggaccctaatgctgcggaacaaccgcatcagctgcatccacaacgacagcttcacgggcctgcgcaacgtccggctcctctcgctctacgacaaccagatcaccaccgtatccccaggagccttcgacaccctccagtccctctccacactgaatctcctggccaaccctttcaactgcaactgccagctggcctggctaggaggctggctacggaagcgcaagatcgtgacggggaacccgcgatgccagaaccctgactttttgcggcagattcccctgcaggacgtggccttccctgacttcaggtgtgaggaaggccaggaggaggggggctgcctgccccgcccacagtgcccacaggagtgcgcctgcctggacaccgtggtccgatgcagcaacaagcacctgcgggccctgcccaagggcattcccaagaatgtcacagaactctatttggacgggaaccagttcacgctggttccgggacagctgtctaccttcaagtacctgcagctcgtggacctgagcaacaacaagatcagttccttaagcaattcctccttcaccaacatgagccagctgaccactctgatcctcagctacaatgccctgcagtgcatcccgcctttggccttccagggactccgctccctgcgcctgctgtctctccacggcaatgacatctccaccctccaagagggcatctttgcagacgtgacctccctgtctcacctggccattggtgccaaccccctatactgtgactgccacctccgctggctgtccagctgggtgaagactggctacaaggaaccgggcattgctcgttgtgctgggccccaggacatggagggcaagctgctcctcaccacgcctgccaagaagtttgaatgccaaggtcctccaacgctggctgtccaggccaagtgtgatctctgcttgtccagtccgtgccagaaccagggcacctgccacaacgacccccttgaggtgtacaggtgcgcctgccccagcggctataagggtcgagactgtgaggtgtccctggacagctgttccagtggcccctgtgaaaatgggggcacctgccatgcacaggagggcgaggatgccccgttcacgtgctcctgtcccaccggctttgaaggaccaacctgtggggtgaacacagatgactgtgtggatcatgcctgtgccaatgggggcgtctgtgtggatggtgtgggcaactacacctgccagtgccccctgcagtatgagggaaaggcctgtgagcagctggtggacttgtgctctccggatctgaacccatgtcaacacgaggcccagtgtgtgggcaccccggatgggcccaggtgtgagtgcatgccaggttatgcaggtgacaactgcagtgagaaccaggatgactgcagggaccaccgctgccagaatggggcccagtgtatggatgaagtcaacagctactcctgcctctgtgctgagggctacagtggacagctctgtgagatccctccccatctgcctgcccccaagagcccaggtgtgagtgcatgccaggttatgcaggtgacaactgcagtgagaaccaggatgactgcagggaccaccgctgccagaatggggcccagtgtatggatgaagtcaacagctactcctgcctctgtgctgagggctacagtggacagctctgtgagatccctccccatctgcctgcccccagag

SEQ ID NO: 440206 - DNA, 463 bp, Homo sapiens
atttattggctgaggtcctactagttgtgatgtgtaagtgttctgcttatgaatgttaagacctgtacttgatttcattttactaaaataagtgggcctgggtctttttttttttttttttcctccatcagtttatccaaggcacagcagagctccgtggtgacacctcaccacatctcaggcatccgggctgtctcccgacctccccacgggccacactcatagttccttgtcttgtgcagttgtgaatctatgtcaaacaaaagactgtccttaaaatatgagctgtgggtcagcttgctgtttctttagactgttgatttctgatgtttccatgtaatacttgtgtgcctactgtatgccagggcactgtgcagagccctggaagtacctcaggtcccagacaggatgaggcccctggccttcctggagcttttatccattctcctgacccagtgcctag

SEQ ID NO: 440207 - DNA, 450 bp, Homo sapiens
acgggtgcctgtaataaattaaattaattactattttaaaaacccaggtgttgaagggtctagtgtaatatcttttcatcctcaaaacgagttctatgagatagccaatattattccccccattttgaaaaatcaatgcccttattaatgtggttaaagtgaaagttcagaaggtaatggggagagaaccagacatatctgtttggcacttaaaaggttaagtttaatagggacaaagaagtcagtcaaagaatgcatgtaaagaaatatgcaacttatgccaggcacagtggctcacgcctgtaatcccaacactttgggaggccaaggcgggaggatcacttgagcccaggagttcaagaccagcccggtcaacagagcaagaccctgtctctattaaaaaagtatgtataccctggtgtaatgtcagcagatttacatgtatgtggg

SEQ ID NO: 440208 - DNA, 4126 bp, Homo sapiens
ctcagaggctggagggatcctccgtatgctgaacgctggtcccctgggccccctttatttctttctctatactttgtttctgtgtctttttctcttccaaagtctctcgttccacctaacgagaaacacccacaggtgtggaggggcaacccatcccttcagacaattgggaggtgagggccgattgccttacacggtgagacaagcggcctgactcgtgactatttttttggacaaatcaggcagccactgactcccttcattatggcctcagctttatctctgggcaataagtgtgatcccttccttcgctgcgtcctttgcaggggcggtggcgctctgcaaggcccaagggggcgtggtccagatgactttgaatcccagttgtcgcccccagggtcagccaggagactagtcagaagcaaacgcgcctgcggcaatccgcccgatgcctttggtctctctcgggcttccgtccacccgcccctcccccgcgtttccattggctgtagctccggcccggggcgggcgaagagggagcgagtgggcggggccgcgtggcgtcagcgcaagatggcggcctcggcagcggtgttctcgcgcttgcgaagcgggctccggctcggctcgcggggactgtgcacgaggttggcgacgccgccccgccgggccccagatcaggccgcagagatcgggagccgcgggagcactaaggcgcaagggccacagcagcagccgggctcagagggtcccagctatgccaaaaaagttgcgctctggcttgctgggctgcttggagctggtgggactgtgagcgtcgtctatatctttggaaacaacccggtggacgaaaatggtgccaagattcctgatgagttcgacaatgatccaattctggtacagcagttgcgccggacatacaaatatttcaaagattatagacagatgatcatcgagcccaccagcccttgccttctcccagaccctctgcaggaaccgtactaccagccaccctacacgctcgttttggagctcaccggcgtcctcttgcatcctgagtggtcgctggccactggctggaggtttaagaagcgcccaggcatcgagaccttgttccagcagcttgcccctttatatgaaattgtcatctttacgtcagagactggcatgactgcgtttccactcattgatagtgtggacccccatggcttcatctcctaccgcctattccgggacgccacaagatacatggatggacaccatgtaaaggatatttcatgtctgaatcgggacccagctcgagtagtagttgtggactgcaagaaggaagccttccgcctgcagccctataacggcgttgccctgcggccctgggacggcaactctgatgaccgggtcttgttggatctgtctgccttcctcaagaccattgcactgaatggtgtggaggacgtgcgaaccgtgctggagcactatgccctggaggatgacccgctggcggctttcaaacagcggcaaagccggctagagcaggaggagcagcagcgcctggccgagctctccaagtccaacaagcagaacctcttccttggctccctcaccagccgcttgtggcctcgctccaaacagccctgaactctgggcctcctcaaactcagtgcctgggtccagggccccagtgcttccagaccaagacttgggccaccacttgtccaataaagtacatcccagacgccacacctgctgtgtcccgagagtctccagatgggggcatcagggtgaggtccgggactcttgggtcatcgtcccacagtggctgatcggctgccaagcacagtgggggtgctttgttggatcagagcagatttttcaccctggtctcggaatctaaaaaccctcgctgtgtcttcctgtgtgttgcgtgatctgtgaaaaatacatctccctctgaccacagactcctcatctgtggagaagggaagagaggatggcacttggctttaaagacaggtagctgccaggctactgtggagagaatgtgttatgggcctagtgggcctctggtggaccagagattacccctctcaacaggccagctgctggttggctccagccagtgtggccctggggtaaagggggcctggagttgcttgacacgccagttgttcaaaagaagcaagaacttgggaatatttttttttttttttggagacagggtctcactgttgcccaggctggagcacagtggtgtaactatagctcactgcagtgttgaacttctgggctcaaacaatcttcctgccttggcctccccaaatgctgagattataggagtgagccactctgcccaactacttttaattaaatagccacatgtgtctcctgtattgacagtaccactgtgtattaagagtatgagtcccagattgtgtaagttcaaatccaagctctaccacttctcggctggcttgtgatcctgtgcaagttactttacctctcagtgcctcggtttctacatttataaaataataactgggcaggcacagtggctcatggctgtcatcccaacacttcaggaggccgaggtgggaggatcgcctgaggccaggagttggagagcagcctgggcaacatgggaagagcctgtctcttgcggggggggggagaagaaagttcttgtctcaggctagctttggggaccaaatgaagcactcccatgtaggcactcaaatggaactatgtaaaccttaggcaaggcacctctgcctcagtttcctcatctctaaaatggggtgatggtagtatgttagcagagtggttgtgaggagtgaacgggacagtccgtatgtgggttatatgtatatattcccaggtgcttgctgttaccaggccatatgggttattcacagattgaaatatcttagctgggcacggtggctcacccctataatcccagcactttgggagaccgaggcgggtggatcacctgaggtcaggagttcgagaccagcctggccaacatggtgaaaccctgtctctactaaaaaaatacaaataaattagctgggcatggtggtgggtgcctgtagtcccagctacttgggaggctgaggcaggagaatcgattaaacccaggaggcagaggttgcagtgagctgagatcacaccattgcactccagcctgggcgacagagtaaggctctgtctccaaaaaaaaaaaaaaaaaaaaaaacaaaaaaaaaaccagtttgactttatctccctcgccctgcctccatccccacattgccccccactatcccagtctctcctactccagccttcatctagtgctaactgattaaatattctaagatgaccttctctggtgtgtgtgatgataattaaaaggcattcagaactgtgtggaccagactgaacctctgcactctagatttttttttttttgaagcctctacaaaggataattaaaatttacaccatgactctttgtcctggggtgcactgtctgtaagccggtggagttatttcccaaaatccttggtccttcccagcttgaggaagtctgcaggactgagggaggggacctgtgctttttttttggtttttttggagatggagtctctgttgcccaggctggagtgcagtggggcgatctcggctcactgcaccctgcacctcctgggttcaagtgattctcctgcctcaggctcccaagtagctgggattacaggcgtgtgccactgtcaggcctctgagcccaagccaagccatcgcatcccctgtgccttgcacatatacacccagatggcctgaagtaactgaagaatcacaaaagaagtgaaaaggccctgccccgccttaactgatgacattccaccattgtgatttgttcctgccccaccttaactgagtgattaaccctgcaaattttcttctcctggctcagaagcacccccactgagcaccttgcgaccccccactcctgcccgccctttgactgtaattttccattaccttcccaaatactataaaacagccccacccctatctcccttcgctgactcttttcggactcagcccacctgcacccaggtgaaataaacagctttattgctcacacaaa

SEQ ID NO: 440209 - DNA, 3253 bp, Homo sapiens
ctcagaggctggagggatcctccgtatgctgaacgctggtcccctgggccccctttatttctttctctatactttgtttctgtgtctttttctcttccaaagtctctcgttccacctaacgagaaacacccacaggtgtggaggggcaacccatcccttcagacaattgggaggtgagggccgattgccttacacggtgagacaagcggcctgactcgtgactatttttttggacaaatcaggcagccactgactcccttcattatggcctcagctttatctctgggcaataagtgtgatcccttccttcgctgcgtcctttgcaggggcggtggcgctctgcaaggcccaagggggcgtggtccagatgactttgaatcccagttgtcgcccccagggtcagccaggagactagtcagaagcaaacgcgcctgcggcaatccgcccgatgcctttggtctctctcgggcttccgtccacccgcccctcccccgcgtttccattggctgtagctccggcccggggcgggcgaagagggagcgagtgggcggggccgcgtggcgtcagcgcaagatggcggcctcggcagcggtgttctcgcgcttgcgaagcgggctccggctcggctcgcggggactgtgcacgaggttggcgacgccgccccgccgggccccagatcaggccgcagagatcgggagccgcgggagcactaaggcgcaagggccacagcagcagccgggctcagagggtcccagctatgccaaaaaagttgcgctctggcttgctgggctgcttggagctggtgggactgtgagcgtcgtctatatctttggaaacaacccggtggacgaaaatggtgccaagattcctgatgagttcgacaatgatccaattctggtacagcagttgcgccggacatacaaatatttcaaagattatagacagatgatcatcgagcccaccagcccttgccttctcccagaccctctgcaggaaccgtactaccagccaccctacacgctcgttttggagctcaccggcgtcctcttgcatcctgagtggtcgctggccactggctggaggtttaagaagcgcccaggcatcgagaccttgttccagcagcttgcccctttatatgaaattgtcatctttacgtcagagactggcatgactgcgtttccactcattgatagtgtggacccccatggcttcatctcctaccgcctattccgggacgccacaagatacatggatggacaccatgtaaaggatatttcatgtctgaatcgggacccagctcgagtagtagttgtggactgcaagaaggaagccttccgcctgcagccctataacggcgttgccctgcggccctgggacggcaactctgatgaccgggtcttgttggatctgtctgccttcctcaagaccattgcactgaatggtgtggaggacgtgcgaaccgtgctggagcactatgccctggaggatgacccgctggcggctttcaaacagcggcaaagccggctagagcaggaggagcagcagcgcctggccgagctctccaagtccaacaagcagaacctcttccttggctccctcaccagccgcttgtggcctcgctccaaacagccctgaactctgggcctcctcaaactcagtgcctgggtccagggccccagtgcttccagaccaagacttgggccaccacttgtccaataaagtacatcccagacgccacacctgctgtgtcccgagagtctccagatgggggcatcagggtgaggtccgggactcttgggtcatcgtcccacagtggctgatcggctgccaagcacagtgggggtgctttgttggatcagagcagatttttcaccctggtctcggaatctaaaaaccctcgctgtgtcttcctgtgtgttgcgtgatctgtgaaaaatacatctccctctgaccacagactcctcatctgtggagaagggaagagaggatggcacttggctttaaagacaggtagctgccaggctactgtggagagaatgtgttatgggcctagtgggcctctggtggaccagagattacccctctcaacaggccagctgctggttggctccagccagtgtggccctggggtaaagggggcctggagttgcttgacacgccagttgttcaaaagaagcaagaacttgggaatatttttttttttttttggagacagggtctcactgttgcccaggctgaggcaggagaatcgattaaacccaggaggcagaggttgcagtgagctgagatcacaccattgcactccagcctgggcgacagagtaaggctctgtctccaaaaaaaaaaaaaaaaaaaaaaacaaaaaaaaaaccagtttgactttatctccctcgccctgcctccatccccacattgccccccactatcccagtctctcctactccagccttcatctagtgctaactgattaaatattctaagatgaccttctctggtgtgtgtgatgataattaaaaggcattcagaactgtgtggaccagactgaacctctgcactctagatttttttttttttgaagcctctacaaaggataattaaaatttacaccatgactctttgtcctggggtgcactgtctgtaagccggtggagttatttcccaaaatccttggtccttcccagcttgaggaagtctgcaggactgagggaggggacctgtgctttttttttggtttttttggagatggagtctctgttgcccaggctggagtgcagtggggcgatctcggctcactgcaccctgcacctcctgggttcaagtgattctcctgcctcaggctcccaagtagctgggattacaggcgtgtgccactgtcaggcctctgagcccaagccaagccatcgcatcccctgtgccttgcacatatacacccagatggcctgaagtaactgaagaatcacaaaagaagtgaaaaggccctgccccgccttaactgatgacattccaccattgtgatttgttcctgccccaccttaactgagtgattaaccctgcaaattttcttctcctggctcagaagcacccccactgagcaccttgcgaccccccactcctgcccgccctttgactgtaattttccattaccttcccaaatactataaaacagccccacccctatctcccttcgctgactcttttcggactcagcccacctgcacccaggtgaaataaacagctttattgctcacacaaa

SEQ ID NO: 440210 - DNA, 2643 bp, Homo sapiens
ctcagaggctggagggatcctccgtatgctgaacgctggtcccctgggccccctttatttctttctctatactttgtttctgtgtctttttctcttccaaagtctctcgttccacctaacgagaaacacccacaggtgtggaggggcaacccatcccttcagacaattgggaggtgagggccgattgccttacacggtgagacaagcggcctgactcgtgactatttttttggacaaatcaggcagccactgactcccttcattatggcctcagctttatctctgggcaataagtgtgatcccttccttcgctgcgtcctttgcaggggcggtggcgctctgcaaggcccaagggggcgtggtccagatgactttgaatcccagttgtcgcccccagggtcagccaggagactagtcagaagcaaacgcgcctgcggcaatccgcccgatgcctttggtctctctcgggcttccgtccacccgcccctcccccgcgtttccattggctgtagctccggcccggggcgggcgaagagggagcgagtgggcggggccgcgtggcgtcagcgcaagatggcggcctcggcagcggtgttctcgcgcttgcgaagcgggctccggctcggctcgcggggactgtgcacgaggttggcgacgccgccccgccgggccccagatcaggccgcagagatcgggagccgcgggagcactaaggcgcaagggccacagcagcagccgggctcagagggtcccagctatgccaaaaaagttgcgctctggcttgctgggctgcttggagctggtgggactgtgagcgtcgtctatatctttggaaacaacccggtggacgaaaatggtgccaagattcctgatgagttcgacaatgatccaattctggtacagcagttgcgccggacatacaaatatttcaaagattatagacagatgatcatcgagcccaccagcccttgccttctcccagaccctctgcaggaaccgtactaccagccaccctacacgctcgttttggagctcaccggcgtcctcttgcatcctgagtggtcgctggccactggctggaggtttaagaagcgcccaggcatcgagaccttgttccagcagcttgcccctttatatgaaattgtcatctttacgtcagagactggcatgactgcgtttccactcattgatagtgtggacccccatggcttcatctcctaccgcctattccgggacgccacaagatacatggatggacaccatgtaaaggatatttcatgtctgaatcgggacccagctcgagtagtagttgtggactgcaagaaggaagccttccgcctgcagccctataacggcgttgccctgcggccctgggacggcaactctgatgaccgggtcttgttggatctgtctgccttcctcaagaccattgcactgaatggtgtggaggacgtgcgaaccgtgctggagcactatgccctggaggatgacccgctggcggctttcaaacagcggcaaagccggctagagcaggaggagcagcagcgcctggccgagctctccaagtccaacaagcagaacctcttccttggctccctcaccagccgcttgtggcctcgctccaaacagccctgaactctgggcctcctcaaactcagtgcctgggtccagggccccagtgcttccagaccaagacttgggccaccacttgtccaataaagtacatcccagacgccacacctgctgtgtcccgagagtctccagatgggggcatcagggtgaggtccgggactcttgggtcatcgtcccacagtggctgatcggctgccaagcacagtgggggtgctttgttggatcagagcagatttttcaccctggtctcggaatctaaaaaccctcgctgtgtcttcctgtgtgttgcgtgatctgtgaaaaatacatctccctctgaccacagactcctcatctgtggagaagggaagagaggatggcacttggctttaaagacaggtagctgccaggctactgtggagagaatgtgttatgggcctagtgggcctctggtggaccagagattacccctctcaacaggccagctgctggttggctccagccagtgtggccctggggtaaagggggcctggagttgcttgacacgccagttgttcaaaagaagcaagaacttgggaatatttttttttttttttggagacagggtctcactgttgcccaggctggagtgcattgatgtgatcttagcttacaacagccttgacctcccgggttcaagcaatgctcccgcctcagcctcccaagtagctgagattacaggcgcacaccaccacgcccggctaatttttgtatttttttagtagagacagggtttcaccatgttggttaggctggtctcgaactcctgacctcgtgatccgcccgcctcggcctcccagggtgctgggattgcaggcatgagccaccatgcctggccccacataaagtttctgagcacttgaaatgtggctagtgtgactgagaaactgaatttttaattttgtttgagactgggcacagtggctcacgcctgtaatcctgacactttgggaggccgaagcaggaggattgcttgaatccaggagtacgaga

SEQ ID NO: 440211 - DNA, 2883 bp, Homo sapiens
ctcagaggctggagggatcctccgtatgctgaacgctggtcccctgggccccctttatttctttctctatactttgtttctgtgtctttttctcttccaaagtctctcgttccacctaacgagaaacacccacaggtgtggaggggcaacccatcccttcagacaattgggaggtgagggccgattgccttacacggtgagacaagcggcctgactcgtgactatttttttggacaaatcaggcagccactgactcccttcattatggcctcagctttatctctgggcaataagtgtgatcccttccttcgctgcgtcctttgcaggggcggtggcgctctgcaaggcccaagggggcgtggtccagatgactttgaatcccagttgtcgcccccagggtcagccaggagactagtcagaagcaaacgcgcctgcggcaatccgcccgatgcctttggtctctctcgggcttccgtccacccgcccctcccccgcgtttccattggctgtagctccggcccggggcgggcgaagagggagcgagtgggcggggccgcgtggcgtcagcgcaagatggcggcctcggcagcggtgttctcgcgcttgcgaagcgggctccggctcggctcgcggggactgtgcacgaggttggcgacgccgccccgccgggccccagatcaggccgcagagatcgggagccgcgggagcactaaggcgcaagggccacagcagcagccgggctcagagggtcccagctatgccaaaaaagttgcgctctggcttgctgggctgcttggagctggtgggactgtgagcgtcgtctatatctttggaaacaacccggtggacgaaaatggtgccaagattcctgatgagttcgacaatgatccaattctggtacagcagttgcgccggacatacaaatatttcaaagattatagacagatgatcatcgagcccaccagcccttgccttctcccagaccctctgcaggaaccgtactaccagccaccctacacgctcgttttggagctcaccggcgtcctcttgcatcctgagtggtcgctggccactggctggaggtttaagaagcgcccaggcatcgagaccttgttccagcagcttgcccctttatatgaaattgtcatctttacgtcagagactggcatgactgcgtttccactcattgatagtgtggacccccatggcttcatctcctaccgcctattccgggacgccacaagatacatggatggacaccatgtaaaggatatttcatgtctgaatcgggacccagctcgagtagtagttgtggactgcaagaaggaagccttccgcctgcagccctataacggcgttgccctgcggccctgggacggcaactctgatgaccgggtcttgttggatctgtctgccttcctcaagaccattgcactgaatggtgtggaggacgtgcgaaccgtgctggagcactatgccctggaggatgacccgctggcggctttcaaacagcggcaaagccggctagagcaggaggagcagcagcgcctggccgagctctccaagtccaacaagcagaacctcttccttggctccctcaccagccgcttgtggcctcgctccaaacagccctgaactctgggcctcctcaaactcagtgcctgggtccagggccccagtgcttccagaccaagacttgggccaccacttgtccaataaagtacatcccagacgccacacctgctgtgtcccgagagtctccagatgggggcatcagggtgaggtccgggactcttgggtcatcgtcccacagtggctgatcggctgccaagcacagtgggggtgctttgttggatcagagcagatttttcaccctggtctcggaatctaaaaaccctcgctgtgtcttcctgtgtgttgcgtgatctgtgaaaaatacatctccctctgaccacagactcctcatctgtggagaagggaagagaggatggcacttggctttaaagacaggtagctgccaggctactgtggagagaatgtgttatgggcctagtgggcctctggtggaccagagattacccctctcaacaggccagctgctggttggctccagccagtgtggccctggggtaaagggggcctggagttgcttgacacgccagttgttcaaaagaagcaagaacttgggaatatttttttttttttttggagacagggtctcactgttgcccaggctggagcacagtggtgtaactatagctcactgcagtgttgaacttctgggctcaaacaatcttcctgccttggcctccccaaatgctgagattataggagtgagccactctgcccaactacttttaattaaatagccacatgtgtctcctgtattgacagtaccactgtgtattaagagtatgagtcccagattgtgtaagttcaaatccaagctctaccacttctcggctggcttgtgatcctgtgcaagttactttacctctcagtgcctcggtttctacatttataaaataataactgggcaggcacagtggctcatggctgtcatcccaacacttcaggaggccgaggtgggaggatcgcctgaggccaggagttggagagcagcctgggcaacatgggaagagcctgtctcttgcggggggggggagaagaaagttcttgtctcaggctagctttggggaccaaatgaagcactcccattgagcaccttgcgaccccccactcctgcccgccctttgactgtaattttccattaccttcccaaatactataaaacagccccacccctatctcccttcgctgactcttttcggactcagcccacctgcacccaggtgaaataaacagctttattgctcacacaaa

SEQ ID NO: 440212 - DNA, 1780 bp, Homo sapiens
ctcagaggctggagggatcctccgtatgctgaacgctggtcccctgggccccctttatttctttctctatactttgtttctgtgtctttttctcttccaaagtctctcgttccacctaacgagaaacacccacaggtgtggaggggcaacccatcccttcagacaattgggaggtgagggccgattgccttacacggtgagacaagcggcctgactcgtgactatttttttggacaaatcaggcagccactgactcccttcattatggcctcagctttatctctgggcaataagtgtgatcccttccttcgctgcgtcctttgcaggggcggtggcgctctgcaaggcccaagggggcgtggtccagatgactttgaatcccagttgtcgcccccagggtcagccaggagactagtcagaagcaaacgcgcctgcggcaatccgcccgatgcctttggtctctctcgggcttccgtccacccgcccctcccccgcgtttccattggctgtagctccggcccggggcgggcgaagagggagcgagtgggcggggccgcgtggcgtcagcgcaagatggcggcctcggcagcggtgttctcgcgcttgcgaagcgggctccggctcggctcgcggggactgtgcacgaggttggcgacgccgccccgccgggccccagatcaggccgcagagatcgggagccgcgggagcactaaggcgcaagggccacagcagcagccgggctcagagggtcccagctatgccaaaaaagttgcgctctggcttgctgggctgcttggagctggtgggactgtgagcgtcgtctatatctttggaaacaacccggtggacgaaaatggtgccaagattcctgatgagttcgacaatgatccaattctggtacagcagttgcgccggacatacaaatatttcaaagattatagacagatgatcatcgagcccaccagcccttgccttctcccagaccctctgcaggaaccgtactaccagccaccctacacgctcgttttggagctcaccggcgtcctcttgcatcctgagtggtcgctggccactggctggaggtttaagaagcgcccaggcatcgagaccttgttccagcagcttgcccctttatatgaaattgtcatctttacgtcagagactggcatgactgcgtttccactcattgatagtgtggacccccatggcttcatctcctaccgcctattccgggacgccacaagatacatggatggacaccatgtaaaggatatttcatgtctgaatcgggacccagctcgagtagtagttgtggactgcaagaaggaagccttccgcctgcagccctataacggcgttgccctgcggccctgggacggcaactctgatgaccgggtcttgttggatctgtctgccttcctcaagaccattgcactgaatggtgtggaggacgtgcgaaccgtgctggagcactatgccctggaggatgacccgctggcggctttcaaacagcggcaaagccggctagagcaggaggagcagcagcgcctggccgagctctccaagtccaacaagcagaacctcttccttggctccctcaccagccgcttgtggcctcgctccaaacagccctgaactctgggcctcctcaaactcagtgcctgggtccagggccccagtgcttccagaccaagacttgggccaccacttgtccaataaagtacatcccagacgccacaaaaaaaaaaaaaaaaaaaccggggcctttcgggggggaaaa

SEQ ID NO: 440213 - DNA, 2927 bp, Homo sapiens
  misc_feature (4)..(4): n is a, c, g, or t
  misc_feature (31)..(31): n is a, c, g, or t
aaantacggctaggtacgaggcctggttttnaatcggccgaggcggcagcggtgttctcgcgcttgcgaagcgggctccggctcggctcgcggggactgtgcacgaggttggcgacgccgccccgccgggccccagatcaggccgcagagatcgggagccgcgggagcactaaggcgcaagggccacagcagcagccgggctcagagggtcccagctatgccaaaaaagttgcgctctggcttgctgggctgcttggagctggtgggactgtgagcgtcgtctatatctttggaaacaacccggtggacgaaaatggtgccaagattcctgatgagttcgacaatgatccaattctggtacagcagttgcgccggacatacaaatatttcaaagattatagacagatgatcatcgagcccaccagcccttgccttctcccagaccctctgcaggaaccgtactaccagccaccctacacgctcgttttggagctcaccggcgtcctcttgcatcctgagtggtcgctggccactggctggaggtttaagaagcgcccaggcatcgagaccttgttccagcagcttgcccctttatatgaaattgtcatctttacgtcagagactggcatgactgcgtttccactcattgatagtgtggacccccatggcttcatctcctaccgcctattccgggacgccacaagatacatggatggacaccatgtaaaggatatttcatgtctgaatcgggacccagctcgagtagtagttgtggactgcaagaaggaagccttccgcctgcagccctataacggcgttgccctgcggccctgggacggcaactctgatgaccgggtcttgttggatctgtctgccttcctcaagaccattgcactgaatggtgtggaggacgtgcgaaccgtgctggagcactatgccctggaggatgacccgctggcggctttcaaacagcggcaaagccggctagagcaggaggagcagcagcgcctggccgagctctccaagtccaacaagcagaacctcttccttggctccctcaccagccgcttgtggcctcgctccaaacagccctgaactctgggcctcctcaaactcagtgcctgggtccagggccccagtgcttccagaccaagacttgggccaccacttgtccaataaagtacatcccagacgccacacctgctgtgtcccgagagtctccagatgggggcatcagggtgaggtccgggactcttgggtcatcgtcccacagtggctgatcggctgccaagcacagtgggggtgctttgttggatcagagcagatttttcaccctggtctcggaatctaaaaaccctcgctgtgtcttcctgtgtgttgcgtgatctgtgaaaaatacatctccctctgaccacagactcctcatctgtggagaagggaagagaggatggcacttggctttaaagacaggtagctgccaggctactgtggagagaatgtgttatgggcctagtgggcctctggtggaccagagattacccctctcaacaggccagctgctggttggctccagccagtgtggccctggggtaaagggggcctggagttgcttgacacgccagttgttcaaaagaagcaagaacttgggaatatttttttttttttttggagacagggtctcactgttgcccaggctggagcacagtggtgtaactatagctcactgcagtgttgaacttctgggctcaaacaatcttcctgccttggcctccccaaatgctgagattataggagtgagccactctgcccaactacttttaattaaatagccacatgtgtctcctgtattgacagtaccactgtgtattaagagtatgagtcccagattgtgtaagttcaaatccaagctctaccacttctcggctggcttgtgatcctgtgcaagttactttacctctcagtgcctcggtttctacatttataaaataataactgggcaggcacagtggctcatggctgtcatcccaacacttcaggaggccgaggtgggaggatcgcctgaggccaggagttggagagcagcctgggcaacatgggaagagcctgtctcttgcggggggggggagaagaaagttcttgtctcaggctagctttggggaccaaatgaagcactcccatgtaggcactcaaatggaactatgtaaaccttaggcaaggcacctctgcctcagtttcctcatctctaaaatggggtgatggtagtatgttagcagagtggttgtgaggagtgaacgggacagtccgtatgtgggttatatgtatatattcccaggtgcttgctgttaccaggccatatgggttattcacagattgaaatatcttagctgggcacggtggctcacccctataatcccagcactttgggagaccgaggcgggtggatcacctgaggtcaggagttcgagaccagcctggccaacatggtgaaaccctgtctctactaaaaaaatacaaataaattactgggattacaggcgtgtgccactgtcaggcctctgagcccaagccaagccatcgcatcccctgtgccttgcacatatacacccagatggcctgaagtaactgaagaatcacaaaagaagtgaaaaggccctgccccgccttaactgatgacattccaccattgtgatttgttcctgccccaccttaactgagtgattaaccctgcaaattttcttctcctggctcagaagcacccccactgagcaccttgcgaccccccactcctgcccgccctttgactgtaattttccattaccttcccaaatactataaaacagccccacccctatctcccttcgctgactcttttcggactcagcccacctgcacccaggtgaaataaacagctttattgctcacacaaa

SEQ ID NO: 440214 - DNA, 3200 bp, Homo sapiens
aaaaatacggaagtttattgtaggacactcagtgtgaataaatggaatggaaaggcctacacatcgagactcatccatgattgatatgaatttaaaaattacaagcaaagacattttattcatcatgatgctttcttttgtttcttcttttcgttttcttctttttctttttcaatttcagcaacatacttctcaatttcttcaggatttaaaatcttgagggattgatctcgcctcatgacagcaagttcaatgtttttgccacctgactgaaccacttccaggagtgccttgatcaccagcttaatggtcagatcatctgtttcaatggcttcgtcagtatagttcttctccaggaactcacgcactgacttggcaccccggcctatggcattggccttccaggcatggtatgtgcccgaggggtcagtctgatagagcctaggagtgccatcaaagtcgaaacccacgatgagggcagagatgccaaacggcctgcgcccattgctctggcttgctgggctgcttggagctggtgggactgtgagcgtcgtctatatctttggaaacaacccggtggacgaaaatggtgccaagattcctgatgagttcgacaatgatccaattctggtacagcagttgcgccggacatacaaatatttcaaagattatagacagatgatcatcgagcccaccagcccttgccttctcccagaccctctgcaggaaccgtactaccagccaccctacacgctcgttttggagctcaccggcgtcctcttgcatcctgagtggtcgctggccactggctggaggtttaagaagcgcccaggcatcgagaccttgttccagcagcttgcccctttatatgaaattgtcatctttacgtcagagactggcatgactgcgtttccactcattgatagtgtggacccccatggcttcatctcctaccgcctattccgggacgccacaagatacatggatggacaccatgtaaaggatatttcatgtctgaatcgggacccagctcgagtagtagttgtggactgcaagaaggaagccttccgcctgcagccctataacggcgttgccctgcggccctgggacggcaactctgatgaccgggtcttgttggatctgtctgccttcctcaagaccattgcactgaatggtgtggaggacgtgcgaaccgtgctggagcactatgccctggaggatgacccgctggcggctttcaaacagcggcaaagccggctagagcaggaggagcagcagcgcctggccgagctctccaagtccaacaagcagaacctcttccttggctccctcaccagccgcttgtggcctcgctccaaacagccctgaactctgggcctcctcaaactcagtgcctgggtccagggccccagtgcttccagaccaagacttgggccaccacttgtccaataaagtacatcccagacgccacacctgctgtgtcccgagagtctccagatgggggcatcagggtgaggtccgggactcttgggtcatcgtcccacagtggctgatcggctgccaagcacagtgggggtgctttgttggatcagagcagatttttcaccctggtctcggaatctaaaaaccctcgctgtgtcttcctgtgtgttgcgtgatctgtgaaaaatacatctccctctgaccacagactcctcatctgtggagaagggaagagaggatggcacttggctttaaagacaggtagctgccaggctactgtggagagaatgtgttatgggcctagtgggcctctggtggaccagagattacccctctcaacaggccagctgctggttggctccagccagtgtggccctggggtaaagggggcctggagttgcttgacacgccagttgttcaaaagaagcaagaacttgggaatatttttttttttttttggagacagggtctcactgttgcccaggctggagcacagtggtgtaactatagctcactgcagtgttgaacttctgggctcaaacaatcttcctgccttggcctccccaaatgctgagattataggagtgagccactctgcccaactacttttaattaaatagccacatgtgtctcctgtattgacagtaccactgtgtattaagagtatgagtcccagattgtgtaagttcaaatccaagctctaccacttctcggctggcttgtgatcctgtgcaagttactttacctctcagtgcctcggtttctacatttataaaataataactgggcaggcacagtggctcatggctgtcatcccaacacttcaggaggccgaggtgggaggatcgcctgaggccaggagttggagagcagcctgggcaacatgggaagagcctgtctcttgcggggggggggagaagaaagttcttgtctcaggctagctttggggaccaaatgaagcactcccatgtaggcactcaaatggaactatgtaaaccttaggcaaggcacctctgcctcagtttcctcatctctaaaatggggtgatggtagtatgttagcagagtggttgtgaggagtgaacgggacagtccgtatgtgggttatatgtatatattcccaggtgcttgctgttaccaggccatatgggttattcacagattgaaatatcttagctgggcacggtggctcacccctataatcccagcactttgggagaccgaggcgggtggatcacctgaggtcaggagttcgagaccagcctggccaacatggtgaaaccctgtctctactaaaaaaatacaaataaattactgggattacaggcgtgtgccactgtcaggcctctgagcccaagccaagccatcgcatcccctgtgccttgcacatatacacccagatggcctgaagtaactgaagaatcacaaaagaagtgaaaaggccctgccccgccttaactgatgacattccaccattgtgatttgttcctgccccaccttaactgagtgattaaccctgcaaattttcttctcctggctcagaagcacccccactgagcaccttgcgaccccccactcctgcccgccctttgactgtaattttccattaccttcccaaatactataaaacagccccacccctatctcccttcgctgactcttttcggactcagcccacctgcacccaggtgaaataaacagctttattgctcacacaaa

SEQ ID NO: 440215 - DNA, 3408 bp, Homo sapiens
ctcagaggctggagggatcctccgtatgctgaacgctggtcccctgggccccctttatttctttctctatactttgtttctgtgtctttttctcttccaaagtctctcgttccacctaacgagaaacacccacaggtgtggaggggcaacccatcccttcagacaattgggaggtgagggccgattgccttacacggtgagacaagcggcctgactcgtgactatttttttggacaaatcaggcagccactgactcccttcattatggcctcagctttatctctgggcaataagtgtgatcccttccttcgctgcgtcctttgcaggggcggtggcgctctgcaaggcccaagggggcgtggtccagatgactttgaatcccagttgtcgcccccagggtcagccaggagactagtcagaagcaaacgcgcctgcggcaatccgcccgatgcctttggtctctctcgggcttccgtccacccgcccctcccccgcgtttccattggctgtagctccggcccggggcgggcgaagagggagcgagtgggcggggccgcgtggcgtcagcgcaagatggcggcctcggcagcggtgttctcgcgcttgcgaagcgggctccggctcggctcgcggggactgtgcacgaggttggcgacgccgccccgccgggccccagatcaggccgcagagatcgggagccgcgggagcactaaggcgcaagggccacagcagcagccgggctcagagggtcccagctatgccaaaaaagttgcgctctggcttgctgggctgcttggagctggtgggactgtgagcgtcgtctatatctttggaaacaacccggtggacgaaaatggtgccaagattcctgatgagttcgacaatgatgatcatcgagcccaccagcccttgccttctcccagaccctctgcaggaaccgtactaccagccaccctacacgctcgttttggagctcaccggcgtcctcttgcatcctgagtggtcgctggccactggctggaggtttaagaagcgcccaggcatcgagaccttgttccagcagcttgcccctttatatgaaattgtcatctttacgtcagagactggcatgactgcgtttccactcattgatagtgtggacccccatggcttcatctcctaccgcctattccgggacgccacaagatacatggatggacaccatgtaaaggatatttcatgtctgaatcgggacccagctcgagtagtagttgtggactgcaagaaggaagccttccgcctgcagccctataacggcgttgccctgcggccctgggacggcaactctgatgaccgggtcttgttggatctgtctgccttcctcaagaccattgcactgaatggtgtggaggacgtgcgaaccgtgctggagcactatgccctggaggatgacccgctggcggctttcaaacagcggcaaagccggctagagcaggaggagcagcagcgcctggccgagctctccaagtccaacaagcagaacctcttccttggctccctcaccagccgcttgtggcctcgctccaaacagccctgaactctgggcctcctcaaactcagtgcctgggtccagggccccagtgcttccagaccaagacttgggccaccacttgtccaataaagtacatcccagacgccacacctgctgtgtcccgagagtctccagatgggggcatcagggtgaggtccgggactcttgggtcatcgtcccacagtggctgatcggctgccaagcacagtgggggtgctttgttggatcagagcagatttttcaccctggtctcggaatctaaaaaccctcgctgtgtcttcctgtgtgttgcgtgatctgtgaaaaatacatctccctctgaccacagactcctcatctgtggagaagggaagagaggatggcacttggctttaaagacaggtagctgccaggctactgtggagagaatgtgttatgggcctagtgggcctctggtggaccagagattacccctctcaacaggccagctgctggttggctccagccagtgtggccctggggtaaagggggcctggagttgcttgacacgccagttgttcaaaagaagcaagaacttgggaatatttttttttttttttggagacagggtctcactgttgcccaggctggagcacagtggtgtaactatagctcactgcagtgttgaacttctgggctcaaacaatcttcctgccttggcctccccaaatgctgagattataggagtgagccactctgcccaactacttttaattaaatagccacatgtgtctcctgtattgacagtaccactgtgtattaagagtatgagtcccagattgtgtaagttcaaatccaagctctaccacttctcggctggcttgtgatcctgtgcaagttactttacctctcagtgcctcggtttctacatttataaaataataactgggcaggcacagtggctcatggctgtcatcccaacacttcaggaggccgaggtgggaggatcgcctgaggccaggagttggagagcagcctgggcaacatgggaagagcctgtctcttgcggggggggggagaagaaagttcttgtctcaggctagctttggggaccaaatgaagcactcccatgtaggcactcaaatggaactatgtaaaccttaggcaaggcacctctgcctcagtttcctcatctctaaaatggggtgatggtagtatgttagcagagtggttgtgaggagtgaacgggacagtccgtatgtgggttatatgtatatattcccaggtgcttgctgttaccaggccatatgggttattcacagattgaaatatcttagctgggcacggtggctcacccctataatcccagcactttgggagaccgaggcgggtggatcacctgaggtcaggagttcgagaccagcctggccaacatggtgaaaccctgtctctactaaaaaaatacaaataaattactgggattacaggcgtgtgccactgtcaggcctctgagcccaagccaagccatcgcatcccctgtgccttgcacatatacacccagatggcctgaagtaactgaagaatcacaaaagaagtgaaaaggccctgccccgccttaactgatgacattccaccattgtgatttgttcctgccccaccttaactgagtgattaaccctgcaaattttcttctcctggctcagaagcacccccactgagcaccttgcgaccccccactcctgcccgccctttgactgtaattttccattaccttcccaaatactataaaacagccccacccctatctcccttcgctgactcttttcggactcagcccacctgcacccaggtgaaataaacagctttattgctcacacaaa

SEQ ID NO: 440216 - DNA, 2768 bp, Homo sapiens
  misc_feature (14)..(15): n is a, c, g, or t
  misc_feature (21)..(21): n is a, c, g, or t
tcggcacgagggcnncgtctntatctttggaaacaacccggtggacgaaaatggtgccaagattcctgatgagttcgacaatgatccaattctggtacagcaagggccacagcagcagccgggctcagagggtcccagctatgccaaaaaagttgcgctctggcttgctgggctgcttggagctggtgggactgtgagcgtcgtctatatctttggacatacaaatatttcaaagattatagacagatgatcatcgagcccaccagcccttgccttctcccagaccctctgcaggaaccgtactaccagccaccctacacgctcgttttggagctcaccggcgtcctcttgcatcctgagtggtcgctggccactggctggaggtttaagaagcgcccaggcatcgagaccttgttccagcagcttgcccctttatatgaaattgtcatctttacgtcagagactggcatgactgcgtttccactcattgatagtgtggacccccatggcttcatctcctaccgcctattccgggacgccacaagatacatggatggacaccatgtaaaggatatttcatgtctgaatcgggacccagctcgagtagtagttgtggactgcaagaaggaagccttccgcctgcagccctataacggcgttgccctgcggccctgggacggcaactctgatgaccgggtcttgttggatctgtctgccttcctcaagaccattgcactgaatggtgtggaggacgtgcgaaccgtgctggagcactatgccctggaggatgacccgctggcggctttcaaacagcggcaaagccggctagagcaggaggagcagcagcgcctggccgagctctccaagtccaacaagcagaacctcttccttggctccctcaccagccgcttgtggcctcgctccaaacagccctgaactctgggcctcctcaaactcagtgcctgggtccagggccccagtgcttccagaccaagacttgggccaccacttgtccaataaagtacatcccagacgccacacctgctgtgtcccgagagtctccagatgggggcatcagggtgaggtccgggactcttgggtcatcgtcccacagtggctgatcggctgccaagcacagtgggggtgctttgttggatcagagcagatttttcaccctggtctcggaatctaaaaaccctcgctgtgtcttcctgtgtgttgcgtgatctgtgaaaaatacatctccctctgaccacagactcctcatctgtggagaagggaagagaggatggcacttggctttaaagacaggtagctgccaggctactgtggagagaatgtgttatgggcctagtgggcctctggtggaccagagattacccctctcaacaggccagctgctggttggctccagccagtgtggccctggggtaaagggggcctggagttgcttgacacgccagttgttcaaaagaagcaagaacttgggaatatttttttttttttttggagacagggtctcactgttgcccaggctggagcacagtggtgtaactatagctcactgcagtgttgaacttctgggctcaaacaatcttcctgccttggcctccccaaatgctgagattataggagtgagccactctgcccaactacttttaattaaatagccacatgtgtctcctgtattgacagtaccactgtgtattaagagtatgagtcccagattgtgtaagttcaaatccaagctctaccacttctcggctggcttgtgatcctgtgcaagttactttacctctcagtgcctcggtttctacatttataaaataataactgggcaggcacagtggctcatggctgtcatcccaacacttcaggaggccgaggtgggaggatcgcctgaggccaggagttggagagcagcctgggcaacatgggaagagcctgtctcttgcggggggggggagaagaaagttcttgtctcaggctagctttggggaccaaatgaagcactcccatgtaggcactcaaatggaactatgtaaaccttaggcaaggcacctctgcctcagtttcctcatctctaaaatggggtgatggtagtatgttagcagagtggttgtgaggagtgaacgggacagtccgtatgtgggttatatgtatatattcccaggtgcttgctgttaccaggccatatgggttattcacagattgaaatatcttagctgggcacggtggctcacccctataatcccagcactttgggagaccgaggcgggtggatcacctgaggtcaggagttcgagaccagcctggccaacatggtgaaaccctgtctctactaaaaaaatacaaataaattactgggattacaggcgtgtgccactgtcaggcctctgagcccaagccaagccatcgcatcccctgtgccttgcacatatacacccagatggcctgaagtaactgaagaatcacaaaagaagtgaaaaggccctgccccgccttaactgatgacattccaccattgtgatttgttcctgccccaccttaactgagtgattaaccctgcaaattttcttctcctggctcagaagcacccccactgagcaccttgcgaccccccactcctgcccgccctttgactgtaattttccattaccttcccaaatactataaaacagccccacccctatctcccttcgctgactcttttcggactcagcccacctgcacccaggtgaaataaacagctttattgctcacacaaa

SEQ ID NO: 440217 - DNA, 2763 bp, Homo sapiens
aaatctgtgttcctatctggcggtatgtcattgccttctatctttggacctagaaatgagttggttcaaaccaggcagatatgcagacctgtttgtatctggtagataagaaacccctggtttgtctgggaggttgaacagcggcttattgtggaatctctttgtgcctggtgttctcctagatccaattctggtacagcagttgcgccggacatacaaatatttcaaagattatagacagatgatcatcgagcccaccagcccttgccttctcccagaccctctgcaggaaccgtactaccagccaccctacacgctcgttttggagctcaccggcgtcctcttgcatcctgagtggtcgctggccactggctggaggtttaagaagcgcccaggcatcgagaccttgttccagcagcttgcccctttatatgaaattgtcatctttacgtcagagactggcatgactgcgtttccactcattgatagtgtggacccccatggcttcatctcctaccgcctattccgggacgccacaagatacatggatggacaccatgtaaaggatatttcatgtctgaatcgggacccagctcgagtagtagttgtggactgcaagaaggaagccttccgcctgcagccctataacggcgttgccctgcggccctgggacggcaactctgatgaccgggtcttgttggatctgtctgccttcctcaagaccattgcactgaatggtgtggaggacgtgcgaaccgtgctggagcactatgccctggaggatgacccgctggcggctttcaaacagcggcaaagccggctagagcaggaggagcagcagcgcctggccgagctctccaagtccaacaagcagaacctcttccttggctccctcaccagccgcttgtggcctcgctccaaacagccctgaactctgggcctcctcaaactcagtgcctgggtccagggccccagtgcttccagaccaagacttgggccaccacttgtccaataaagtacatcccagacgccacacctgctgtgtcccgagagtctccagatgggggcatcagggtgaggtccgggactcttgggtcatcgtcccacagtggctgatcggctgccaagcacagtgggggtgctttgttggatcagagcagatttttcaccctggtctcggaatctaaaaaccctcgctgtgtcttcctgtgtgttgcgtgatctgtgaaaaatacatctccctctgaccacagactcctcatctgtggagaagggaagagaggatggcacttggctttaaagacaggtagctgccaggctactgtggagagaatgtgttatgggcctagtgggcctctggtggaccagagattacccctctcaacaggccagctgctggttggctccagccagtgtggccctggggtaaagggggcctggagttgcttgacacgccagttgttcaaaagaagcaagaacttgggaatatttttttttttttttggagacagggtctcactgttgcccaggctggagcacagtggtgtaactatagctcactgcagtgttgaacttctgggctcaaacaatcttcctgccttggcctccccaaatgctgagattataggagtgagccactctgcccaactacttttaattaaatagccacatgtgtctcctgtattgacagtaccactgtgtattaagagtatgagtcccagattgtgtaagttcaaatccaagctctaccacttctcggctggcttgtgatcctgtgcaagttactttacctctcagtgcctcggtttctacatttataaaataataactgggcaggcacagtggctcatggctgtcatcccaacacttcaggaggccgaggtgggaggatcgcctgaggccaggagttggagagcagcctgggcaacatgggaagagcctgtctcttgcggggggggggagaagaaagttcttgtctcaggctagctttggggaccaaatgaagcactcccatgtaggcactcaaatggaactatgtaaaccttaggcaaggcacctctgcctcagtttcctcatctctaaaatggggtgatggtagtatgttagcagagtggttgtgaggagtgaacgggacagtccgtatgtgggttatatgtatatattcccaggtgcttgctgttaccaggccatatgggttattcacagattgaaatatcttagctgggcacggtggctcacccctataatcccagcactttgggagaccgaggcgggtggatcacctgaggtcaggagttcgagaccagcctggccaacatggtgaaaccctgtctctactaaaaaaatacaaataaattactgggattacaggcgtgtgccactgtcaggcctctgagcccaagccaagccatcgcatcccctgtgccttgcacatatacacccagatggcctgaagtaactgaagaatcacaaaagaagtgaaaaggccctgccccgccttaactgatgacattccaccattgtgatttgttcctgccccaccttaactgagtgattaaccctgcaaattttcttctcctggctcagaagcacccccactgagcaccttgcgaccccccactcctgcccgccctttgactgtaattttccattaccttcccaaatactataaaacagccccacccctatctcccttcgctgactcttttcggactcagcccacctgcacccaggtgaaataaacagctttattgctcacacaaa

SEQ ID NO: 440218 - DNA, 2561 bp, Homo sapiens
  misc_feature (30)..(30): n is a, c, g, or t
  misc_feature (32)..(32): n is a, c, g, or t
  misc_feature (37)..(37): n is a, c, g, or t
cggacgcgtgggtcgacccacgcgtcggtnanagacnggatgatcatcgagcccaccagcccttgccttctcccagaccctctgcaggaaccgtactaccagccaccctacacgctcgttttggagctcaccggcgtcctcttgcatcctgagtggtcgctggccactggctggaggtttaagaagcgcccaggcatcgagaccttgttccagcagcttgcccctttatatgaaattgtcatctttacgtcagagactggcatgactgcgtttccactcattgatagtgtggacccccatggcttcatctcctaccgcctattccgggacgccacaagatacatggatggacaccatgtaaaggatatttcatgtctgaatcgggacccagctcgagtagtagttgtggactgcaagaaggaagccttccgcctgcagccctataacggcgttgccctgcggccctgggacggcaactctgatgaccgggtcttgttggatctgtctgccttcctcaagaccattgcactgaatggtgtggaggacgtgcgaaccgtgctggagcactatgccctggaggatgacccgctggcggctttcaaacagcggcaaagccggctagagcaggaggagcagcagcgcctggccgagctctccaagtccaacaagcagaacctcttccttggctccctcaccagccgcttgtggcctcgctccaaacagccctgaactctgggcctcctcaaactcagtgcctgggtccagggccccagtgcttccagaccaagacttgggccaccacttgtccaataaagtacatcccagacgccacacctgctgtgtcccgagagtctccagatgggggcatcagggtgaggtccgggactcttgggtcatcgtcccacagtggctgatcggctgccaagcacagtgggggtgctttgttggatcagagcagatttttcaccctggtctcggaatctaaaaaccctcgctgtgtcttcctgtgtgttgcgtgatctgtgaaaaatacatctccctctgaccacagactcctcatctgtggagaagggaagagaggatggcacttggctttaaagacaggtagctgccaggctactgtggagagaatgtgttatgggcctagtgggcctctggtggaccagagattacccctctcaacaggccagctgctggttggctccagccagtgtggccctggggtaaagggggcctggagttgcttgacacgccagttgttcaaaagaagcaagaacttgggaatatttttttttttttttggagacagggtctcactgttgcccaggctggagcacagtggtgtaactatagctcactgcagtgttgaacttctgggctcaaacaatcttcctgccttggcctccccaaatgctgagattataggagtgagccactctgcccaactacttttaattaaatagccacatgtgtctcctgtattgacagtaccactgtgtattaagagtatgagtcccagattgtgtaagttcaaatccaagctctaccacttctcggctggcttgtgatcctgtgcaagttactttacctctcagtgcctcggtttctacatttataaaataataactgggcaggcacagtggctcatggctgtcatcccaacacttcaggaggccgaggtgggaggatcgcctgaggccaggagttggagagcagcctgggcaacatgggaagagcctgtctcttgcggggggggggagaagaaagttcttgtctcaggctagctttggggaccaaatgaagcactcccatgtaggcactcaaatggaactatgtaaaccttaggcaaggcacctctgcctcagtttcctcatctctaaaatggggtgatggtagtatgttagcagagtggttgtgaggagtgaacgggacagtccgtatgtgggttatatgtatatattcccaggtgcttgctgttaccaggccatatgggttattcacagattgaaatatcttagctgggcacggtggctcacccctataatcccagcactttgggagaccgaggcgggtggatcacctgaggtcaggagttcgagaccagcctggccaacatggtgaaaccctgtctctactaaaaaaatacaaataaattactgggattacaggcgtgtgccactgtcaggcctctgagcccaagccaagccatcgcatcccctgtgccttgcacatatacacccagatggcctgaagtaactgaagaatcacaaaagaagtgaaaaggccctgccccgccttaactgatgacattccaccattgtgatttgttcctgccccaccttaactgagtgattaaccctgcaaattttcttctcctggctcagaagcacccccactgagcaccttgcgaccccccactcctgcccgccctttgactgtaattttccattaccttcccaaatactataaaacagccccacccctatctcccttcgctgactcttttcggactcagcccacctgcacccaggtgaaataaacagctttattgctcacacaaa

SEQ ID NO: 440219 - DNA, 1716 bp, Homo sapiens
  misc_feature (1457)..(1457): n is a, c, g, or t
  misc_feature (1459)..(1459): n is a, c, g, or t
  misc_feature (1470)..(1470): n is a, c, g, or t
  misc_feature (1473)..(1473): n is a, c, g, or t
  misc_feature (1478)..(1478): n is a, c, g, or t
  misc_feature (1487)..(1487): n is a, c, g, or t
  misc_feature (1489)..(1489): n is a, c, g, or t
  misc_feature (1499)..(1499): n is a, c, g, or t
  misc_feature (1512)..(1512): n is a, c, g, or t
  misc_feature (1519)..(1519): n is a, c, g, or t
  misc_feature (1528)..(1528): n is a, c, g, or t
  misc_feature (1586)..(1586): n is a, c, g, or t
  misc_feature (1589)..(1589): n is a, c, g, or t
  misc_feature (1616)..(1616): n is a, c, g, or t
  misc_feature (1621)..(1621): n is a, c, g, or t
  misc_feature (1626)..(1626): n is a, c, g, or t
  misc_feature (1630)..(1630): n is a, c, g, or t
  misc_feature (1643)..(1643): n is a, c, g, or t
  misc_feature (1692)..(1692): n is a, c, g, or t
ctcagaggctggagggatcctccgtatgctgaacgctggtcccctgggccccctttatttctttctctatactttgtttctgtgtctttttctcttccaaagtctctcgttccacctaacgagaaacacccacaggtgtggaggggcaacccatcccttcagacaattgggaggtgagggccgattgccttacacggtgagacaagcggcctgactcgtgactatttttttggacaaatcaggcagccactgactcccttcattatggcctcagctttatctctgggcaataagtgtgatcccttccttcgctgcgtcctttgcaggggcggtggcgctctgcaaggcccaagggggcgtggtccagatgactttgaatcccagttgtcgcccccagggtcagccaggagactagtcagaagcaaacgcgcctgcggcaatccgcccgatgcctttggtctctctcgggcttccgtccacccgcccctcccccgcgtttccattggctgtagctccggcccggggcgggcgaagagggagcgagtgggcggggccgcgtggcgtcagcgcaagatggcggcctcggcagcggtgttctcgcgcttgcgaagcgggctccggctcggctcgcggggactgtgcacgaggttggcgacgccgccccgccgggccccagatcaggccgcagagatcgggagccgcgggagcactaaggcgcaagggccacagcagcagccgggctcagagggtcccagctatgccaaaaaagttgcgctctggcttgctgggctgcttggagctggtgggactgtgagcgtcgtctatatctttggaaacaacccggtggacgaaaatggtgccaagattcctgatgagttcgacaatgatccaattctggtacagcagttgcgccggacatacaaatatttcaaagattatagacagatgatcatcgagcccaccagcccttgccttctcccagaccctctgcaggaaccgtactaccagccaccctacacgctcgttttggagctcaccggcgtcctcttgcatcctgagtggtcgctggccactggctggaggtttaagaagcgcccaggcatcgagaccttgttccagcagcttgcccctttatatgaaattgtcatctttacgtcagagactggcatgactgcgtttccactcattgatagtgtggacccccatggcttcatctcctaccgcctattccgggacgccacaagatacatggatggacaccatgtaaaggatatttcatgtctgaatcgggacccagctcgagtagtagttgtggactgcaagaaggaagccttccgcctgcagccctataacggcgttgccctgcggccctgggacggcaactctgatgaccgggtcttgttggatctgtctgccttcctcaagaccaattgcacatgaaatggtgtggaagcgancngctcgccgaanccngtgcntggaggcancntattcgcccntggaaggaatganccccgcntggccggcntcttcaaaacaagcgcgcaaaagccaggcataaaagcaaggaaggaagcaagcaagcnccntggccgaagcctctccaaagatccaanaaagnaaaanaatnaatccttggctcnaaaaaaaaccagattgtagcctcagctccaaaaaagacacataaattanggctctttaaaataatgactggat

SEQ ID NO: 440220 - DNA, 2642 bp, Homo sapiens
aatcgagctcggccgtgtgcacgcacgtgcccggccattaacctcttttcttataattacccatttctttatagcaatgcaagatggcctaatacacagctctagctgactaatataccaccatctcactgaaggcttgcaaaacccagctgagaaagtcttttaataaaagcaacaacattaataaaaacagtgacaactactgagtggctgcccaactgggccaacgcaccgtggtcgctggccactggctggaggtttaagaagcgcccaggcatcgagaccttgttccagcagcttgcccctttatatgaaattgtcatctttacgtcagagactggcatgactgcgtttccactcattgatagtgtggacccccatggcttcatctcctaccgcctattccgggacgccacaagatacatggatggacaccatgtaaaggatatttcatgtctgaatcgggacccagctcgagtagtagttgtggactgcaagaaggaagccttccgcctgcagccctataacggcgttgccctgcggccctgggacggcaactctgatgaccgggtcttgttggatctgtctgccttcctcaagaccattgcactgaatggtgtggaggacgtgcgaaccgtgctggagcactatgccctggaggatgacccgctggcggctttcaaacagcggcaaagccggctagagcaggaggagcagcagcgcctggccgagctctccaagtccaacaagcagaacctcttccttggctccctcaccagccgcttgtggcctcgctccaaacagccctgaactctgggcctcctcaaactcagtgcctgggtccagggccccagtgcttccagaccaagacttgggccaccacttgtccaataaagtacatcccagacgccacacctgctgtgtcccgagagtctccagatgggggcatcagggtgaggtccgggactcttgggtcatcgtcccacagtggctgatcggctgccaagcacagtgggggtgctttgttggatcagagcagatttttcaccctggtctcggaatctaaaaaccctcgctgtgtcttcctgtgtgttgcgtgatctgtgaaaaatacatctccctctgaccacagactcctcatctgtggagaagggaagagaggatggcacttggctttaaagacaggtagctgccaggctactgtggagagaatgtgttatgggcctagtgggcctctggtggaccagagattacccctctcaacaggccagctgctggttggctccagccagtgtggccctggggtaaagggggcctggagttgcttgacacgccagttgttcaaaagaagcaagaacttgggaatatttttttttttttttggagacagggtctcactgttgcccaggctggagcacagtggtgtaactatagctcactgcagtgttgaacttctgggctcaaacaatcttcctgccttggcctccccaaatgctgagattataggagtgagccactctgcccaactacttttaattaaatagccacatgtgtctcctgtattgacagtaccactgtgtattaagagtatgagtcccagattgtgtaagttcaaatccaagctctaccacttctcggctggcttgtgatcctgtgcaagttactttacctctcagtgcctcggtttctacatttataaaataataactgggcaggcacagtggctcatggctgtcatcccaacacttcaggaggccgaggtgggaggatcgcctgaggccaggagttggagagcagcctgggcaacatgggaagagcctgtctcttgcggggggggggagaagaaagttcttgtctcaggctagctttggggaccaaatgaagcactcccatgtaggcactcaaatggaactatgtaaaccttaggcaaggcacctctgcctcagtttcctcatctctaaaatggggtgatggtagtatgttagcagagtggttgtgaggagtgaacgggacagtccgtatgtgggttatatgtatatattcccaggtgcttgctgttaccaggccatatgggttattcacagattgaaatatcttagctgggcacggtggctcacccctataatcccagcactttgggagaccgaggcgggtggatcacctgaggtcaggagttcgagaccagcctggccaacatggtgaaaccctgtctctactaaaaaaatacaaataaattactgggattacaggcgtgtgccactgtcaggcctctgagcccaagccaagccatcgcatcccctgtgccttgcacatatacacccagatggcctgaagtaactgaagaatcacaaaagaagtgaaaaggccctgccccgccttaactgatgacattccaccattgtgatttgttcctgccccaccttaactgagtgattaaccctgcaaattttcttctcctggctcagaagcacccccactgagcaccttgcgaccccccactcctgcccgccctttgactgtaattttccattaccttcccaaatactataaaacagccccacccctatctcccttcgctgactcttttcggactcagcccacctgcacccaggtgaaataaacagctttattgctcacacaaa

SEQ ID NO: 440221 - DNA, 2336 bp, Homo sapiens
  misc_feature (30)..(30): n is a, c, g, or t
  misc_feature (32)..(32): n is a, c, g, or t
  misc_feature (37)..(37): n is a, c, g, or t
cggacgcgtgggtcgacccacgcgtcggtnanagacnggactgcgtttccactcattgatagtgtggacccccatggcttcatctcctaccgcctattccgggacgccacaagatacatggatggacaccatgtaaaggatatttcatgtctgaatcgggacccagctcgagtagtagttgtggactgcaagaaggaagccttccgcctgcagccctataacggcgttgccctgcggccctgggacggcaactctgatgaccgggtcttgttggatctgtctgccttcctcaagaccattgcactgaatggtgtggaggacgtgcgaaccgtgctggagcactatgccctggaggatgacccgctggcggctttcaaacagcggcaaagccggctagagcaggaggagcagcagcgcctggccgagctctccaagtccaacaagcagaacctcttccttggctccctcaccagccgcttgtggcctcgctccaaacagccctgaactctgggcctcctcaaactcagtgcctgggtccagggccccagtgcttccagaccaagacttgggccaccacttgtccaataaagtacatcccagacgccacacctgctgtgtcccgagagtctccagatgggggcatcagggtgaggtccgggactcttgggtcatcgtcccacagtggctgatcggctgccaagcacagtgggggtgctttgttggatcagagcagatttttcaccctggtctcggaatctaaaaaccctcgctgtgtcttcctgtgtgttgcgtgatctgtgaaaaatacatctccctctgaccacagactcctcatctgtggagaagggaagagaggatggcacttggctttaaagacaggtagctgccaggctactgtggagagaatgtgttatgggcctagtgggcctctggtggaccagagattacccctctcaacaggccagctgctggttggctccagccagtgtggccctggggtaaagggggcctggagttgcttgacacgccagttgttcaaaagaagcaagaacttgggaatatttttttttttttttggagacagggtctcactgttgcccaggctggagcacagtggtgtaactatagctcactgcagtgttgaacttctgggctcaaacaatcttcctgccttggcctccccaaatgctgagattataggagtgagccactctgcccaactacttttaattaaatagccacatgtgtctcctgtattgacagtaccactgtgtattaagagtatgagtcccagattgtgtaagttcaaatccaagctctaccacttctcggctggcttgtgatcctgtgcaagttactttacctctcagtgcctcggtttctacatttataaaataataactgggcaggcacagtggctcatggctgtcatcccaacacttcaggaggccgaggtgggaggatcgcctgaggccaggagttggagagcagcctgggcaacatgggaagagcctgtctcttgcggggggggggagaagaaagttcttgtctcaggctagctttggggaccaaatgaagcactcccatgtaggcactcaaatggaactatgtaaaccttaggcaaggcacctctgcctcagtttcctcatctctaaaatggggtgatggtagtatgttagcagagtggttgtgaggagtgaacgggacagtccgtatgtgggttatatgtatatattcccaggtgcttgctgttaccaggccatatgggttattcacagattgaaatatcttagctgggcacggtggctcacccctataatcccagcactttgggagaccgaggcgggtggatcacctgaggtcaggagttcgagaccagcctggccaacatggtgaaaccctgtctctactaaaaaaatacaaataaattactgggattacaggcgtgtgccactgtcaggcctctgagcccaagccaagccatcgcatcccctgtgccttgcacatatacacccagatggcctgaagtaactgaagaatcacaaaagaagtgaaaaggccctgccccgccttaactgatgacattccaccattgtgatttgttcctgccccaccttaactgagtgattaaccctgcaaattttcttctcctggctcagaagcacccccactgagcaccttgcgaccccccactcctgcccgccctttgactgtaattttccattaccttcccaaatactataaaacagccccacccctatctcccttcgctgactcttttcggactcagcccacctgcacccaggtgaaataaacagctttattgctcacacaaa

SEQ ID NO: 440222 - DNA, 2254 bp, Homo sapiens
ttgatggggggagagttgggcacagatgttgacctgatctgtcactcacttccagggatatttcatgtctgaatcgggacccagctcgagtagtagttgtggactgcaagaaggaagccttccgcctgcagccctataacggcgttgccctgcggccctgggacggcaactctgatgaccgggtcttgttggatctgtctgccttcctcaagaccattgcactgaatggtgtggaggacgtgcgaaccgtgctggagcactatgccctggaggatgacccgctggcggctttcaaacagcggcaaagccggctagagcaggaggagcagcagcgcctggccgagctctccaagtccaacaagcagaacctcttccttggctccctcaccagccgcttgtggcctcgctccaaacagccctgaactctgggcctcctcaaactcagtgcctgggtccagggccccagtgcttccagaccaagacttgggccaccacttgtccaataaagtacatcccagacgccacacctgctgtgtcccgagagtctccagatgggggcatcagggtgaggtccgggactcttgggtcatcgtcccacagtggctgatcggctgccaagcacagtgggggtgctttgttggatcagagcagatttttcaccctggtctcggaatctaaaaaccctcgctgtgtcttcctgtgtgttgcgtgatctgtgaaaaatacatctccctctgaccacagactcctcatctgtggagaagggaagagaggatggcacttggctttaaagacaggtagctgccaggctactgtggagagaatgtgttatgggcctagtgggcctctggtggaccagagattacccctctcaacaggccagctgctggttggctccagccagtgtggccctggggtaaagggggcctggagttgcttgacacgccagttgttcaaaagaagcaagaacttgggaatatttttttttttttttggagacagggtctcactgttgcccaggctggagcacagtggtgtaactatagctcactgcagtgttgaacttctgggctcaaacaatcttcctgccttggcctccccaaatgctgagattataggagtgagccactctgcccaactacttttaattaaatagccacatgtgtctcctgtattgacagtaccactgtgtattaagagtatgagtcccagattgtgtaagttcaaatccaagctctaccacttctcggctggcttgtgatcctgtgcaagttactttacctctcagtgcctcggtttctacatttataaaataataactgggcaggcacagtggctcatggctgtcatcccaacacttcaggaggccgaggtgggaggatcgcctgaggccaggagttggagagcagcctgggcaacatgggaagagcctgtctcttgcggggggggggagaagaaagttcttgtctcaggctagctttggggaccaaatgaagcactcccatgtaggcactcaaatggaactatgtaaaccttaggcaaggcacctctgcctcagtttcctcatctctaaaatggggtgatggtagtatgttagcagagtggttgtgaggagtgaacgggacagtccgtatgtgggttatatgtatatattcccaggtgcttgctgttaccaggccatatgggttattcacagattgaaatatcttagctgggcacggtggctcacccctataatcccagcactttgggagaccgaggcgggtggatcacctgaggtcaggagttcgagaccagcctggccaacatggtgaaaccctgtctctactaaaaaaatacaaataaattactgggattacaggcgtgtgccactgtcaggcctctgagcccaagccaagccatcgcatcccctgtgccttgcacatatacacccagatggcctgaagtaactgaagaatcacaaaagaagtgaaaaggccctgccccgccttaactgatgacattccaccattgtgatttgttcctgccccaccttaactgagtgattaaccctgcaaattttcttctcctggctcagaagcacccccactgagcaccttgcgaccccccactcctgcccgccctttgactgtaattttccattaccttcccaaatactataaaacagccccacccctatctcccttcgctgactcttttcggactcagcccacctgcacccaggtgaaataaacagctttattgctcacacaaa

SEQ ID NO: 440223 - DNA, 1663 bp, Homo sapiens
ctcagaggctggagggatcctccgtatgctgaacgctggtcccctgggccccctttatttctttctctatactttgtttctgtgtctttttctcttccaaagtctctcgttccacctaacgagaaacacccacaggtgtggaggggcaacccatcccttcagacaattgggaggtgagggccgattgccttacacggtgagacaagcggcctgactcgtgactatttttttggacaaatcaggcagccactgactcccttcattatggcctcagctttatctctgggcaataagtgtgatcccttccttcgctgcgtcctttgcaggggcggtggcgctctgcaaggcccaagggggcgtggtccagatgactttgaatcccagttgtcgcccccagggtcagccaggagactagtcagaagcaaacgcgcctgcggcaatccgcccgatgcctttggtctctctcgggcttccgtccacccgcccctcccccgcgtttccattggctgtagctccggcccggggcgggcgaagagggagcgagtgggcggggccgcgtggcgtcagcgcaagatggcggcctcggcagcggtgttctcgcgcttgcgaagcgggctccggctcggctcgcggggactgtgcacgaggttggcgacgccgccccgccgggccccagatcaggccgcagagatcgggagccgcgggagcactaaggcgcaagggccacagcagcagccgggctcagagggtcccagctatgccaaaaaagttgcgctctggcttgctgggctgcttggagctggtgggactgtgagcgtcgtctatatctttggaaacaacccggtggacgaaaatggtgccaagattcctgatgagttcgacaatgatccaattctggtacagcagttgcgccggacatacaaatatttcaaagattatagacagatgatcatcgagcccaccagcccttgccttctcccagaccctctgcaggaaccgtactaccagccaccctacacgctcgttttggagctcaccggcgtcctcttgcatcctgagtggtcgctggccactggctggaggtttaagaagcgcccaggcatcgagaccttgttccagcagcttgcccctttatatgaaattgtcatctttacgtcagagactggcatgactgcgtttccactcattgatagtgtggacccccatggcttcatctcctaccgcctattccgggacgccacaagatacatggatggacaccatgtaaaggtgccgtgggttcatgggtgggcctctgggatttggcggagttggcaccacctgagggaaggagggcccagctctgaccctagcctcacctggcttatggttctgcccagattcgattcctgctggcaggcacatgcctgcctctagccttggccagacatctgcacccttctttgttccctggaatctgggtgtgggagtggggggaaatggggtctctctaaagaagacagttgggggttagtggtaaggtcgtacgatttagaagctggttttatcttgctgtgtctgtaacttagtgtttctgggaaggtttgcttatagttgtacatatgagactggttggggtttgtttgacccgggctctgttactgtggccagtgctgtattcagg

SEQ ID NO: 440224 - DNA, 1665 bp, Homo sapiens
  misc_feature (4)..(4): n is a, c, g, or t
  misc_feature (31)..(31): n is a, c, g, or t
aaantacggctaggtacgaggcctggttttnaatcggccgaggctcggtttctacatttataaaataataactgggcaggcacagtggctcatggctgtcatcccaacacttcaggaggccgaggtgggaggatcgcctgaggccaggagttggagagcagcctgggcaacatgggaagagcctgtctcttgcggggggggggagaagaaagttcttgtctcaggctagctttggggaccaaatgaagcactcccatgtaggcactcaaatggaactatgtaaaccttaggcaaggcacctctgcctcagtttcctcatctctaaaatggggtgatggtagtatgttagcagagtggttgtgaggagtgaacgggacagtccgtatgtgggttatatgtatatattcccaggtgcttgctgttaccaggccatatgggttattcacagattgaaatatcttagctgggcacggtggctcacccctataatcccagcactttgggagaccgaggcgggtggatcacctgaggtcaggagttcgagaccagcctggccaacatggtgaaaccctgtctctactaaaaaaatacaaataaattagctgggcatggtggtgggtgcctgtagtcccagctacttgggaggctgaggcaggagaatcgattaaacccaggaggcagaggttgcagtgagctgagatcacaccattgcactccagcctgggcgacagagtaaggctctgtctccaaaaaaaaaaaaaaaaaaaaaaacaaaaaaaaaaccagtttgactttatctccctcgccctgcctccatccccacattgccccccactatcccagtctctcctactccagccttcatctagtgctaactgattaaatattctaagatgaccttctctggtgtgtgtgatgataattaaaaggcattcagaactgtgtggaccagactgaacctctgcactctagatttttttttttttgaagcctctacaaaggataattaaaatttacaccatgactctttgtcctggggtgcactgtctgtaagccggtggagttatttcccaaaatccttggtccttcccagcttgaggaagtctgcaggactgagggaggggacctgtgctttttttttggtttttttggagatggagtctctgttgcccaggctggagtgcagtggggcgatctcggctcactgcaccctgcacctcctgggttcaagtgattctcctgcctcaggctcccaagtagctgggattacaggcgtgtgccactgtcaggcctctgagcccaagccaagccatcgcatcccctgtgccttgcacatatacacccagatggcctgaagtaactgaagaatcacaaaagaagtgaaaaggccctgccccgccttaactgatgacattccaccattgtgatttgttcctgccccaccttaactgagtgattaaccctgcaaattttcttctcctggctcagaagcacccccactgagcaccttgcgaccccccactcctgcccgccctttgactgtaattttccattaccttcccaaatactataaaacagccccacccctatctcccttcgctgactcttttcggactcagcccacctgcacccaggtgaaataaacagctttattgctcacacaaa

SEQ ID NO: 440225 - DNA, 1558 bp, Homo sapiens
  misc_feature (4)..(4): n is a, c, g, or t
  misc_feature (31)..(31): n is a, c, g, or t
aaantacggctaggtacgaggcctggttttnaatcggccgaggttggagagcagcctgggcaacatgggaagagcctgtctcttgcggggggggggagaagaaagttcttgtctcaggctagctttggggaccaaatgaagcactcccatgtaggcactcaaatggaactatgtaaaccttaggcaaggcacctctgcctcagtttcctcatctctaaaatggggtgatggtagtatgttagcagagtggttgtgaggagtgaacgggacagtccgtatgtgggttatatgtatatattcccaggtgcttgctgttaccaggccatatgggttattcacagattgaaatatcttagctgggcacggtggctcacccctataatcccagcactttgggagaccgaggcgggtggatcacctgaggtcaggagttcgagaccagcctggccaacatggtgaaaccctgtctctactaaaaaaatacaaataaattagctgggcatggtggtgggtgcctgtagtcccagctacttgggaggctgaggcaggagaatcgattaaacccaggaggcagaggttgcagtgagctgagatcacaccattgcactccagcctgggcgacagagtaaggctctgtctccaaaaaaaaaaaaaaaaaaaaaaacaaaaaaaaaaccagtttgactttatctccctcgccctgcctccatccccacattgccccccactatcccagtctctcctactccagccttcatctagtgctaactgattaaatattctaagatgaccttctctggtgtgtgtgatgataattaaaaggcattcagaactgtgtggaccagactgaacctctgcactctagatttttttttttttgaagcctctacaaaggataattaaaatttacaccatgactctttgtcctggggtgcactgtctgtaagccggtggagttatttcccaaaatccttggtccttcccagcttgaggaagtctgcaggactgagggaggggacctgtgctttttttttggtttttttggagatggagtctctgttgcccaggctggagtgcagtggggcgatctcggctcactgcaccctgcacctcctgggttcaagtgattctcctgcctcaggctcccaagtagctgggattacaggcgtgtgccactgtcaggcctctgagcccaagccaagccatcgcatcccctgtgccttgcacatatacacccagatggcctgaagtaactgaagaatcacaaaagaagtgaaaaggccctgccccgccttaactgatgacattccaccattgtgatttgttcctgccccaccttaactgagtgattaaccctgcaaattttcttctcctggctcagaagcacccccactgagcaccttgcgaccccccactcctgcccgccctttgactgtaattttccattaccttcccaaatactataaaacagccccacccctatctcccttcgctgactcttttcggactcagcccacctgcacccaggtgaaataaacagctttattgctcacacaaa

SEQ ID NO: 440226 - DNA, 3467 bp, Homo sapiens
ctcagaggctggagggatcctccgtatgctgaacgctggtcccctgggccccctttatttctttctctatactttgtttctgtgtctttttctcttccaaagtctctcgttccacctaacgagaaacacccacaggtgtggaggggcaacccatcccttcagacaattgggaggtgagggccgattgccttacacggtgagacaagcggcctgactcgtgactatttttttggacaaatcaggcagccactgactcccttcattatggcctcagctttatctctgggcaataagtgtgatcccttccttcgctgcgtcctttgcaggggcggtggcgctctgcaaggcccaagggggcgtggtccagatgactttgaatcccagttgtcgcccccagggtcagccaggagactagtcagaagcaaacgcgcctgcggcaatccgcccgatgcctttggtctctctcgggcttccgtccacccgcccctcccccgcgtttccattggctgtagctccggcccggggcgggcgaagagggagcgagtgggcggggccgcgtggcgtcagcgcaagatggcggcctcggcagcggtgttctcgcgcttgcgaagcgggctccggctcggctcgcggggactgtgcacgaggttggcgacgccgccccgccgggccccagatcaggccgcagagatcgggagccgcgggagcactaaggcgcaagggccacagcagcagccgggctcagagggtcccagctatgccaaaaaagttgcgctctggcttgctgggctgcttggagctggtgggactgtgagcgtcgtctatatctttggaaacaacccggtggacgaaaatggtgccaagattcctgatgagttcgacaatgatccaattctggtacagcagttgcgccggacatacaaatatttcaaagattatagacagatgatcatcgagcccaccagcccttgccttctcccagaccctctgcaggaaccgtactaccagccaccctacacgctcgttttggagctcaccggcgtcctcttgcatcctgagtggtcgctggccactggctggaggtttaagaagcgcccaggcatcgagaccttgttccagcagcttgcccctttatatgaaattgtcatctttacgtcagagactggcatgactgcgtttccactcattgatagtgtggacccccatggcttcatctcctaccgcctattccgggacgccacaagatacatggatggacaccatgtaaaggatatttcatgtctgaatcgggacccagctcgagtagtagttgtggactgcaagaaggaagccttccgcctgcagccctataacggcgttgccctgcggccctgggacggcaactctgatgaccgggtcttgttggatctgtctgccttcctcaagaccattgcactgaatggtgtggaggacgtgcgaaccgtgctggagcactatgccctggaggatgacccgctggcggctttcaaacagcggcaaagccggctagagcaggaggagcagcagcgcctggccgagctctccaagtccaacaagcagaacctcttccttggctccctcaccagccgcttgtggcctcgctccaaacagccctgaactctgggcctcctcaaactcagtgcctgggtccagggccccagtgcttccagaccaagacttgggccaccacttgtccaataaagtacatcccagacgccacacctgctgtgtcccgagagtctccagatgggggcatcagggtgaggtccgggactcttgggtcatcgtcccacagtggctgatcggctgccaagcacagtgggggtgctttgttggatcagagcagatttttcaccctggtctcggaatctaaaaaccctcgctgtgtcttcctgtgtgttgcgtgatctgtgaaaaatacatctccctctgaccacagactcctcatctgtggagaagggaagagaggatggcacttggctttaaagacaggtagctgccaggctactgtggagagaatgtgttatgggcctagtgggcctctggtggaccagagattacccctctcaacaggccagctgctggttggctccagccagtgtggccctggggtaaagggggcctggagttgcttgacacgccagttgttcaaaagaagcaagaacttgggaatatttttttttttttttggagacagggtctcactgttgcccaggctggagcacagtggtgtaactatagctcactgcagtgttgaacttctgggctcaaacaatcttcctgccttggcctccccaaatgctgagattataggagtgagccactctgcccaactacttttaattaaatagccacatgtgtctcctgtattgacagtaccactgtgtattaagagtatgagtcccagattgtgtaagttcaaatccaagctctaccacttctcggctggcttgtgatcctgtgcaagttactttacctctcagtgcctcggtttctacatttataaaataataactgggcaggcacagtggctcatggctgtcatcccaacacttcaggaggccgaggtgggaggatcgcctgaggccaggagttggagagcagcctgggcaacatgggaagagcctgtctcttgcggggggggggagaagaaagttcttgtctcaggctagctttggggaccaaatgaagcactcccatgtaggcactcaaatggaactatgtaaaccttaggcaaggcacctctgcctcagtttcctcatctctaaaatggggtgatggtagtatgttagcagagtggttgtgaggagtgaacgggacagtccgtatgtgggttatatgtatatattcccaggtgcttgctgttaccaggccatatgggttattcacagattgaaatatcttagctgggcacggtggctcacccctataatcccagcactttgggagaccgaggcgggtggatcacctgaggtcaggagttcgagaccagcctggccaacatggtgaaaccctgtctctactaaaaaaatacaaataaattactgggattacaggcgtgtgccactgtcaggcctctgagcccaagccaagccatcgcatcccctgtgccttgcacatatacacccagatggcctgaagtaactgaagaatcacaaaagaagtgaaaaggccctgccccgccttaactgatgacattccaccattgtgatttgttcctgccccaccttaactgagtgattaaccctgcaaattttcttctcctggctcagaagcacccccactgagcaccttgcgaccccccactcctgcccgccctttgactgtaattttccattaccttcccaaatactataaaacagccccacccctatctcccttcgctgactcttttcggactcagcccacctgcacccaggtgaaataaacagctttattgctcacacaaa

SEQ ID NO: 440227 - DNA, 3064 bp, Homo sapiens
ctcagaggctggagggatcctccgtatgctgaacgctggtcccctgggccccctttatttctttctctatactttgtttctgtgtctttttctcttccaaagtctctcgttccacctaacgagaaacacccacaggtgtggaggggcaacccatcccttcagacaattgggaggtgagggccgattgccttacacggtgagacaagcggcctgactcgtgactatttttttggacaaatcaggcagccactgactcccttcattatggcctcagctttatctctgggcaataagtgtgatcccttccttcgctgcgtcctttgcaggggcggtggcgctctgcaaggcccaagggggcgtggtccagatgactttgaatcccagttgtcgcccccagggtcagccaggagactagtcagaagcaaacgcgcctgcggcaatccgcccgatgcctttggtctctctcgggcttccgtccacccgcccctcccccgcgtttccattggctgtagctccggcccggggcgggcgaagagggagcgagtgggcggggccgcgtggcgtcagcgcaagatggcggcctcggcagcggtgttctcgcgcttgcgaagcgggctccggctcggctcgcggggactgtgcacgaggttggcgacgccgccccgccgggccccagatcaggccgcagagatcgggagccgcgggagcactaaggcgcaagggccacagcagcagccgggctcagagggtcccagctatgccaaaaaagttgcgctctggcttgctgggctgcttggagctggtgggactgtgagcgtcgtctatatctttggaaacaacccggtggacgaaaatggtgccaagattcctgatgagttcgacaatgatccaattctggtacagcagttgcgccggacatacaaatatttcaaagattatagacagatgatcatcgagcccaccagcccttgccttctcccagaccctctgcaggaaccgtactaccagccaccctacacgctcgttttggagctcaccggcgtcctcttgcatcctgagtggtcgctggccactggctggaggtttaagaagcgcccaggcatcgagaccttgttccagcagcttgcccctttatatgaaattgtcatctttacgtcagagactggcatgactgcgtttccactcattgatagtgtggacccccatggcttcatctcctaccgcctattccgggacgccacaagatacatggatggacaccatgtaaaggatatttcatgtctgaatcgggacccagctcgagtagtagttgtggactgcaagaaggaagccttccgcctgcagccctataacggcgttgccctgcggccctgggacggcaactctgatgaccgggtcttgttggatctgtctgccttcctcaagaccattgcactgaatggtgtggaggacgtgcgaaccgtgctggagcactatgccctggaggatgacccgctggcggctttcaaacagcggcaaagccggctagagcaggaggagcagcagcgcctggccgagctctccaagtccaacaagcagaacctcttccttggctccctcaccagccgcttgtggcctcgctccaaacagccctgaactctgggcctcctcaaactcagtgcctgggtccagggccccagtgcttccagaccaagacttgggccaccacttgtccaataaagtacatcccagacgccacacctgctgtgtcccgagagtctccagatgggggcatcagggtgaggtccgggactcttgggtcatcgtcccacagtggctgatcggctgccaagcacagtgggggtgctttgttggatcagagcagatttttcaccctggtctcggaatctaaaaaccctcgctgtgtcttcctgtgtgttgcgtgatctgtgaaaaatacatctccctctgaccacagactcctcatctgtggagaagggaagagaggatggcacttggctttaaagacaggtagctgccaggctactgtggagagaatgtgttatgggcctagtgggcctctggtggaccagagattacccctctcaacaggccagctgctggttggctccagccagtgtggccctggggtaaagggggcctggagttgcttgacacgccagttgttcaaaagaagcaagaacttgggaatatttttttttttttttggagacagggtctcactgttgcccaggctggagcacagtggtgtaactatagctcactgcagtgttgaacttctgggctcaaacaatcttcctgccttggcctccccaaatgctgagattataggagtgagccactctgcccaactacttttaattaaatagccacatgtgtctcctgtattgacagtaccactgtgtattaagagtatgagtcccagattgtgtaagttcaaatccaagctctaccacttctcggctggcttgtgatcctgtgcaagttactttacctctcagtgcctcggtttctacatttataaaataataactgggcaggcacagtggctcatggctgtcatcccaacacttcaggaggccgaggtgggaggatcgcctgaggccaggagttggagagcagcctgggcaacatgggaagagcctgtctcttgcggggggggggagaagaaagttcttgtctcaggctagctttggggaccaaatgaagcactcccatgtaggcactcaaatggaactatgtaaaccttaggcaaggcacctctgcctcagtttcctcatctctaaaatggggtgatggtagtatgttagcagagtggttgtgaggagtgaacgggacagtccgtatgtgggttatatgtatatattcccaggtgcttgctgttaccaggccatatgggttattcacagattgaaatatcttagctgggattgcaggcatgagccaccatgcctggccccacataaagtttctgagcacttgaaatgtggctagtgtgactgagaaactgaatttttaatttcgtttgagactgggcacagtggctcacgcctgtagtcctgac

SEQ ID NO: 440228 - DNA, 3012 bp, Homo sapiens
ctcagaggctggagggatcctccgtatgctgaacgctggtcccctgggccccctttatttctttctctatactttgtttctgtgtctttttctcttccaaagtctctcgttccacctaacgagaaacacccacaggtgtggaggggcaacccatcccttcagacaattgggaggtgagggccgattgccttacacggtgagacaagcggcctgactcgtgactatttttttggacaaatcaggcagccactgactcccttcattatggcctcagctttatctctgggcaataagtgtgatcccttccttcgctgcgtcctttgcaggggcggtggcgctctgcaaggcccaagggggcgtggtccagatgactttgaatcccagttgtcgcccccagggtcagccaggagactagtcagaagcaaacgcgcctgcggcaatccgcccgatgcctttggtctctctcgggcttccgtccacccgcccctcccccgcgtttccattggctgtagctccggcccggggcgggcgaagagggagcgagtgggcggggccgcgtggcgtcagcgcaagatggcggcctcggcagcggtgttctcgcgcttgcgaagcgggctccggctcggctcgcggggactgtgcacgaggttggcgacgccgccccgccgggccccagatcaggccgcagagatcgggagccgcgggagcactaaggcgcaagggccacagcagcagccgggctcagagggtcccagctatgccaaaaaagttgcgctctggcttgctgggctgcttggagctggtgggactgtgagcgtcgtctatatctttggaaacaacccggtggacgaaaatggtgccaagattcctgatgagttcgacaatgatccaattctggtacagcagttgcgccggacatacaaatatttcaaagattatagacagatgatcatcgagcccaccagcccttgccttctcccagaccctctgcaggaaccgtactaccagccaccctacacgctcgttttggagctcaccggcgtcctcttgcatcctgagtggtcgctggccactggctggaggtttaagaagcgcccaggcatcgagaccttgttccagcagcttgcccctttatatgaaattgtcatctttacgtcagagactggcatgactgcgtttccactcattgatagtgtggacccccatggcttcatctcctaccgcctattccgggacgccacaagatacatggatggacaccatgtaaaggatatttcatgtctgaatcgggacccagctcgagtagtagttgtggactgcaagaaggaagccttccgcctgcagccctataacggcgttgccctgcggccctgggacggcaactctgatgaccgggtcttgttggatctgtctgccttcctcaagaccattgcactgaatggtgtggaggacgtgcgaaccgtgctggagcactatgccctggaggatgacccgctggcggctttcaaacagcggcaaagccggctagagcaggaggagcagcagcgcctggccgagctctccaagtccaacaagcagaacctcttccttggctccctcaccagccgcttgtggcctcgctccaaacagccctgaactctgggcctcctcaaactcagtgcctgggtccagggccccagtgcttccagaccaagacttgggccaccacttgtccaataaagtacatcccagacgccacacctgctgtgtcccgagagtctccagatgggggcatcagggtgaggtccgggactcttgggtcatcgtcccacagtggctgatcggctgccaagcacagtgggggtgctttgttggatcagagcagatttttcaccctggtctcggaatctaaaaaccctcgctgtgtcttcctgtgtgttgcgtgatctgtgaaaaatacatctccctctgaccacagactcctcatctgtggagaagggaagagaggatggcacttggctttaaagacaggtagctgccaggctactgtggagagaatgtgttatgggcctagtgggcctctggtggaccagagattacccctctcaacaggccagctgctggttggctccagccagtgtggccctggggtaaagggggcctggagttgcttgacacgccagttgttcaaaagaagcaagaacttgggaatatttttttttttttttggagacagggtctcactgttgcccaggctggagtgcattgatgtgatcttagcttacaacagccttgacctcccggctcaagtgatctccaagtgaccctcctgcctcagcctcctgagtaccctcctggggactacaggtgcgtgctaccatacccagctaatttaaacaaattttttttttgtagagatggggtcttggtgcccaagctggtctcaaactcctagtcttaagcaatcttcctgctttggcctcccaaggcgctgggattccaggtgtgagctactgtgcccagctaaaatagggatttttatattaaatctccctattttaaaatgttggctcctagcggggcgcagtggctcacgcctgtaatcccagcactttgggaggctgaggtgggtggatcacctgaggtcaggagttcaagaccagcctcaacatggagaaaccccatctctactaaaaatacaaaattagctgggcattacaggcgcacaccaccacgcccggctaatttttgtatttttttagtagagacagggtttcaccatgttggttaggctggtctcgaactcctgacctcgtgatccgcccgcctcggcctcccagggtgctgggattgcaggcatgagccaccatgcctggccccacataaagtttctgagcacttgaaatgtggctagtgtgactgagaaactgaatttttaattttgtttgagactgggcacagtggctcacgcctgtaatcctgacactttgggaggccgaagcaggaggattgcttgaatccaggagtacgaga

SEQ ID NO: 440229 - DNA, 2709 bp, Homo sapiens
ctcagaggctggagggatcctccgtatgctgaacgctggtcccctgggccccctttatttctttctctatactttgtttctgtgtctttttctcttccaaagtctctcgttccacctaacgagaaacacccacaggtgtggaggggcaacccatcccttcagacaattgggaggtgagggccgattgccttacacggtgagacaagcggcctgactcgtgactatttttttggacaaatcaggcagccactgactcccttcattatggcctcagctttatctctgggcaataagtgtgatcccttccttcgctgcgtcctttgcaggggcggtggcgctctgcaaggcccaagggggcgtggtccagatgactttgaatcccagttgtcgcccccagggtcagccaggagactagtcagaagcaaacgcgcctgcggcaatccgcccgatgcctttggtctctctcgggcttccgtccacccgcccctcccccgcgtttccattggctgtagctccggcccggggcgggcgaagagggagcgagtgggcggggccgcgtggcgtcagcgcaagatggcggcctcggcagcggtgttctcgcgcttgcgaagcgggctccggctcggctcgcggggactgtgcacgaggttggcgacgccgccccgccgggccccagatcaggccgcagagatcgggagccgcgggagcactaaggcgcaagggccacagcagcagccgggctcagagggtcccagctatgccaaaaaagttgcgctctggcttgctgggctgcttggagctggtgggactgtgagcgtcgtctatatctttggaaacaacccggtggacgaaaatggtgccaagattcctgatgagttcgacaatgatccaattctggtacagcagttgcgccggacatacaaatatttcaaagattatagacagatgatcatcgagcccaccagcccttgccttctcccagaccctctgcaggaaccgtactaccagccaccctacacgctcgttttggagctcaccggcgtcctcttgcatcctgagtggtcgctggccactggctggaggtttaagaagcgcccaggcatcgagaccttgttccagcagcttgcccctttatatgaaattgtcatctttacgtcagagactggcatgactgcgtttccactcattgatagtgtggacccccatggcttcatctcctaccgcctattccgggacgccacaagatacatggatggacaccatgtaaaggatatttcatgtctgaatcgggacccagctcgagtagtagttgtggactgcaagaaggaagccttccgcctgcagccctataacggcgttgccctgcggccctgggacggcaactctgatgaccgggtcttgttggatctgtctgccttcctcaagaccattgcactgaatggtgtggaggacgtgcgaaccgtgctggagcactatgccctggaggatgacccgctggcggctttcaaacagcggcaaagccggctagagcaggaggagcagcagcgcctggccgagctctccaagtccaacaagcagaacctcttccttggctccctcaccagccgcttgtggcctcgctccaaacagccctgaactctgggcctcctcaaactcagtgcctgggtccagggccccagtgcttccagaccaagacttgggccaccacttgtccaataaagtacatcccagacgccacacctgctgtgtcccgagagttccagcctgggcgacagagtaaggctctgtctccaaaaaaaaaaaaaaaaaaaaaaacaaaaaaaaaaccagtttgactttatctccctcgccctgcctccatccccacattgccccccactatcccagtctctcctactccagccttcatctagtgctaactgattaaatattctaagatgaccttctctggtgtgtgtgatgataattaaaaggcattcagaactgtgtggaccagactgaacctctgcactctagatttttttttttttgaagcctctacaaaggataattaaaatttacaccatgactctttgtcctggggtgcactgtctgtaagccggtggagttatttcccaaaatccttggtccttcccagcttgaggaagtctgcaggactgagggaggggacctgtgctttttttttggtttttttggagatggagtctctgttgcccaggctggagtgcagtggggcgatctcggctcactgcaccctgcacctcctgggttcaagtgattctcctgcctcaggctcccaagtagctgggattacaggcgtgtgccactgtcaggcctctgagcccaagccaagccatcgcatcccctgtgccttgcacatatacacccagatggcctgaagtaactgaagaatcacaaaagaagtgaaaaggccctgccccgccttaactgatgacattccaccattgtgatttgttcctgccccaccttaactgagtgattaaccctgcaaattttcttctcctggctcagaagcacccccactgagcaccttgcgaccccccactcctgcccgccctttgactgtaattttccattaccttcccaaatactataaaacagccccacccctatctcccttcgctgactcttttcggactcagcccacctgcacccaggtgaaataaacagctttattgctcacacaaa

SEQ ID NO: 440230 - DNA, 2878 bp, Homo sapiens
ctcaggtgatacttgagcaggaggggcctgggacgctggagtcccagtctggccgtgggagttattttctctgtggcgttggtggtggcgaggccgcagagatcgggagccgcgggagcactaaggcgcaagggccacagcagcagccgggctcagagggtcccagctatgccaaaaaagttgcgctctggcttgctgggctgcttggagctggtgggactgtgagcgtcgtctatatctttggaaacaacccggtggacgaaaatggtgccaagattcctgatgagttcgacaatgatccaattctggtacagcagttgcgccggacatacaaatatttcaaagattatagacagatgatcatcgagcccaccagcccttgccttctcccagaccctctgcaggaaccgtactaccagccaccctacacgctcgttttggagctcaccggcgtcctcttgcatcctgagtggtcgctggccactggctggaggtttaagaagcgcccaggcatcgagaccttgttccagcagcttgcccctttatatgaaattgtcatctttacgtcagagactggcatgactgcgtttccactcattgatagtgtggacccccatggcttcatctcctaccgcctattccgggacgccacaagatacatggatggacaccatgtaaaggatatttcatgtctgaatcgggacccagctcgagtagtagttgtggactgcaagaaggaagccttccgcctgcagccctataacggcgttgccctgcggccctgggacggcaactctgatgaccgggtcttgttggatctgtctgccttcctcaagaccattgcactgaatggtgtggaggacgtgcgaaccgtgctggagcactatgccctggaggatgacccgctggcggctttcaaacagcggcaaagccggctagagcaggaggagcagcagcgcctggccgagctctccaagtccaacaagcagaacctcttccttggctccctcaccagccgcttgtggcctcgctccaaacagccctgaactctgggcctcctcaaactcagtgcctgggtccagggccccagtgcttccagaccaagacttgggccaccacttgtccaataaagtacatcccagacgccacacctgctgtgtcccgagagtctccagatgggggcatcagggtgaggtccgggactcttgggtcatcgtcccacagtggctgatcggctgccaagcacagtgggggtgctttgttggatcagagcagatttttcaccctggtctcggaatctaaaaaccctcgctgtgtcttcctgtgtgttgcgtgatctgtgaaaaatacatctccctctgaccacagactcctcatctgtggagaagggaagagaggatggcacttggctttaaagacaggtagctgccaggctactgtggagagaatgtgttatgggcctagtgggcctctggtggaccagagattacccctctcaacaggccagctgctggttggctccagccagtgtggccctggggtaaagggggcctggagttgcttgacacgccagttgttcaaaagaagcaagaacttgggaatatttttttttttttttggagacagggtctcactgttgcccaggctggagcacagtggtgtaactatagctcactgcagtgttgaacttctgggctcaaacaatcttcctgccttggcctccccaaatgctgagattataggagtgagccactctgcccaactacttttaattaaatagccacatgtgtctcctgtattgacagtaccactgtgtattaagagtatgagtcccagattgtgtaagttcaaatccaagctctaccacttctcggctggcttgtgatcctgtgcaagttactttacctctcagtgcctcggtttctacatttataaaataataactgggcaggcacagtggctcatggctgtcatcccaacacttcaggaggccgaggtgggaggatcgcctgaggccaggagttggagagcagcctgggcaacatgggaagagcctgtctcttgcggggggggggagaagaaagttcttgtctcaggctagctttggggaccaaatgaagcactcccatgtaggcactcaaatggaactatgtaaaccttaggcaaggcacctctgcctcagtttcctcatctctaaaatggggtgatggtagtatgttagcagagtggttgtgaggagtgaacgggacagtccgtatgtgggttatatgtatatattcccaggtgcttgctgttaccaggccatatgggttattcacagattgaaatatcttagctgggcacggtggctcacccctataatcccagcactttgggagaccgaggcgggtggatcacctgaggtcaggagttcgagaccagcctggccaacatggtgaaaccctgtctctactaaaaaaatacaaataaattactgggattacaggcgtgtgccactgtcaggcctctgagcccaagccaagccatcgcatcccctgtgccttgcacatatacacccagatggcctgaagtaactgaagaatcacaaaagaagtgaaaaggccctgccccgccttaactgatgacattccaccattgtgatttgttcctgccccaccttaactgagtgattaaccctgcaaattttcttctcctggctcagaagcacccccactgagcaccttgcgaccccccactcctgcccgccctttgactgtaattttccattaccttcccaaatactataaaacagccccacccctatctcccttcgctgactcttttcggactcagcccacctgcacccaggtgaaataaacagctttattgctcacacaaa

SEQ ID NO: 440231 - DNA, 3514 bp, Homo sapiens
ctcagaggctggagggatcctccgtatgctgaacgctggtcccctgggccccctttatttctttctctatactttgtttctgtgtctttttctcttccaaagtctctcgttccacctaacgagaaacacccacaggtgtggaggggcaacccatcccttcagacaattgggaggtgagggccgattgccttacacggtgagacaagcggcctgactcgtgactatttttttggacaaatcaggcagccactgactcccttcattatggcctcagctttatctctgggcaataagtgtgatcccttccttcgctgcgtcctttgcaggggcggtggcgctctgcaaggcccaagggggcgtggtccagatgactttgaatcccagttgtcgcccccagggtcagccaggagactagtcagaagcaaacgcgcctgcggcaatccgcccgatgcctttggtctctctcgggcttccgtccacccgcccctcccccgcgtttccattggctgtagctccggcccggggcgggcgaagagggagcgagtgggcggggccgcgtggcgtcagcgcaagatggcggcctcggcagcggtgttctcgcgcttgcgaagcgggctccggctcggctcgcggggactgtgcacgaggttggcgacgccgccccgccgggccccagatcaggccgcagagatcgggagccgcgggagcactaaggcgcaagggccacagcagcagccgggctcagagggtcccagctatgccaaaaaagttgcgctctggcttgctgggctgcttggagctggtgggactgtgagcgtcgtctatatctttggaaacaacccggtggacgaaaatggtgccaaggtgagggggaaagagaccgaggccttgccaggagtcctagtctgtggattcctgatgagttcgacaatgatccaattctggtacagcagttgcgccggacatacaaatatttcaaagattatagacagatgatcatcgagcccaccagcccttgccttctcccagaccctctgcaggaaccgtactaccagccaccctacacgctcgttttggagctcaccggcgtcctcttgcatcctgagtggtcgctggccactggctggaggtttaagaagcgcccaggcatcgagaccttgttccagcagcttgcccctttatatgaaattgtcatctttacgtcagagactggcatgactgcgtttccactcattgatagtgtggacccccatggcttcatctcctaccgcctattccgggacgccacaagatacatggatggacaccatgtaaaggatatttcatgtctgaatcgggacccagctcgagtagtagttgtggactgcaagaaggaagccttccgcctgcagccctataacggcgttgccctgcggccctgggacggcaactctgatgaccgggtcttgttggatctgtctgccttcctcaagaccattgcactgaatggtgtggaggacgtgcgaaccgtgctggagcactatgccctggaggatgacccgctggcggctttcaaacagcggcaaagccggctagagcaggaggagcagcagcgcctggccgagctctccaagtccaacaagcagaacctcttccttggctccctcaccagccgcttgtggcctcgctccaaacagccctgaactctgggcctcctcaaactcagtgcctgggtccagggccccagtgcttccagaccaagacttgggccaccacttgtccaataaagtacatcccagacgccacacctgctgtgtcccgagagtctccagatgggggcatcagggtgaggtccgggactcttgggtcatcgtcccacagtggctgatcggctgccaagcacagtgggggtgctttgttggatcagagcagatttttcaccctggtctcggaatctaaaaaccctcgctgtgtcttcctgtgtgttgcgtgatctgtgaaaaatacatctccctctgaccacagactcctcatctgtggagaagggaagagaggatggcacttggctttaaagacaggtagctgccaggctactgtggagagaatgtgttatgggcctagtgggcctctggtggaccagagattacccctctcaacaggccagctgctggttggctccagccagtgtggccctggggtaaagggggcctggagttgcttgacacgccagttgttcaaaagaagcaagaacttgggaatatttttttttttttttggagacagggtctcactgttgcccaggctggagcacagtggtgtaactatagctcactgcagtgttgaacttctgggctcaaacaatcttcctgccttggcctccccaaatgctgagattataggagtgagccactctgcccaactacttttaattaaatagccacatgtgtctcctgtattgacagtaccactgtgtattaagagtatgagtcccagattgtgtaagttcaaatccaagctctaccacttctcggctggcttgtgatcctgtgcaagttactttacctctcagtgcctcggtttctacatttataaaataataactgggcaggcacagtggctcatggctgtcatcccaacacttcaggaggccgaggtgggaggatcgcctgaggccaggagttggagagcagcctgggcaacatgggaagagcctgtctcttgcggggggggggagaagaaagttcttgtctcaggctagctttggggaccaaatgaagcactcccatgtaggcactcaaatggaactatgtaaaccttaggcaaggcacctctgcctcagtttcctcatctctaaaatggggtgatggtagtatgttagcagagtggttgtgaggagtgaacgggacagtccgtatgtgggttatatgtatatattcccaggtgcttgctgttaccaggccatatgggttattcacagattgaaatatcttagctgggcacggtggctcacccctataatcccagcactttgggagaccgaggcgggtggatcacctgaggtcaggagttcgagaccagcctggccaacatggtgaaaccctgtctctactaaaaaaatacaaataaattactgggattacaggcgtgtgccactgtcaggcctctgagcccaagccaagccatcgcatcccctgtgccttgcacatatacacccagatggcctgaagtaactgaagaatcacaaaagaagtgaaaaggccctgccccgccttaactgatgacattccaccattgtgatttgttcctgccccaccttaactgagtgattaaccctgcaaattttcttctcctggctcagaagcacccccactgagcaccttgcgaccccccactcctgcccgccctttgactgtaattttccattaccttcccaaatactataaaacagccccacccctatctcccttcgctgactcttttcggactcagcccacctgcacccaggtgaaataaacagctttattgctcacacaaa

SEQ ID NO: 440232 - DNA, 3666 bp, Homo sapiens
ctcagaggctggagggatcctccgtatgctgaacgctggtcccctgggccccctttatttctttctctatactttgtttctgtgtctttttctcttccaaagtctctcgttccacctaacgagaaacacccacaggtgtggaggggcaacccatcccttcagacaattgggaggtgagggccgattgccttacacggtgagacaagcggcctgactcgtgactatttttttggacaaatcaggcagccactgactcccttcattatggcctcagctttatctctgggcaataagtgtgatcccttccttcgctgcgtcctttgcaggggcggtggcgctctgcaaggcccaagggggcgtggtccagatgactttgaatcccagttgtcgcccccagggtcagccaggagactagtcagaagcaaacgcgcctgcggcaatccgcccgatgcctttggtctctctcgggcttccgtccacccgcccctcccccgcgtttccattggctgtagctccggcccggggcgggcgaagagggagcgagtgggcggggccgcgtggcgtcagcgcaagatggcggcctcggcagcggtgttctcgcgcttgcgaagcgggctccggctcggctcgcggggactgtgcacgaggttggcgacgccgccccgccgggccccagatcaggccgcagagatcgggagccgcgggagcactaaggcgcaagggccacagcagcagccgggctcagagggtcccagctatgccaaaaaagttgcgctctggcttgctgggctgcttggagctggtgggactgtgagcgtcgtctatatctttggaaacaacccggtggacgaaaatggtgccaagattcctgatgagttcgacaatgattcagcacactggattaaagtgggcagatctggaagcctagtgattcaaagtgggcaaaatacagtggcataaattaggtgtggtggctcacgcctgtaatcccaacactttgggaggccaaggcgggaggatcacttgagcccaggagttcaagaccagcccggtcaacagagcaagaccctgtctctattaaaaaaatccaattctggtacagcagttgcgccggacatacaaatatttcaaagattatagacagatgatcatcgagcccaccagcccttgccttctcccagaccctctgcaggaaccgtactaccagccaccctacacgctcgttttggagctcaccggcgtcctcttgcatcctgagtggtcgctggccactggctggaggtttaagaagcgcccaggcatcgagaccttgttccagcagcttgcccctttatatgaaattgtcatctttacgtcagagactggcatgactgcgtttccactcattgatagtgtggacccccatggcttcatctcctaccgcctattccgggacgccacaagatacatggatggacaccatgtaaaggatatttcatgtctgaatcgggacccagctcgagtagtagttgtggactgcaagaaggaagccttccgcctgcagccctataacggcgttgccctgcggccctgggacggcaactctgatgaccgggtcttgttggatctgtctgccttcctcaagaccattgcactgaatggtgtggaggacgtgcgaaccgtgctggagcactatgccctggaggatgacccgctggcggctttcaaacagcggcaaagccggctagagcaggaggagcagcagcgcctggccgagctctccaagtccaacaagcagaacctcttccttggctccctcaccagccgcttgtggcctcgctccaaacagccctgaactctgggcctcctcaaactcagtgcctgggtccagggccccagtgcttccagaccaagacttgggccaccacttgtccaataaagtacatcccagacgccacacctgctgtgtcccgagagtctccagatgggggcatcagggtgaggtccgggactcttgggtcatcgtcccacagtggctgatcggctgccaagcacagtgggggtgctttgttggatcagagcagatttttcaccctggtctcggaatctaaaaaccctcgctgtgtcttcctgtgtgttgcgtgatctgtgaaaaatacatctccctctgaccacagactcctcatctgtggagaagggaagagaggatggcacttggctttaaagacaggtagctgccaggctactgtggagagaatgtgttatgggcctagtgggcctctggtggaccagagattacccctctcaacaggccagctgctggttggctccagccagtgtggccctggggtaaagggggcctggagttgcttgacacgccagttgttcaaaagaagcaagaacttgggaatatttttttttttttttggagacagggtctcactgttgcccaggctggagcacagtggtgtaactatagctcactgcagtgttgaacttctgggctcaaacaatcttcctgccttggcctccccaaatgctgagattataggagtgagccactctgcccaactacttttaattaaatagccacatgtgtctcctgtattgacagtaccactgtgtattaagagtatgagtcccagattgtgtaagttcaaatccaagctctaccacttctcggctggcttgtgatcctgtgcaagttactttacctctcagtgcctcggtttctacatttataaaataataactgggcaggcacagtggctcatggctgtcatcccaacacttcaggaggccgaggtgggaggatcgcctgaggccaggagttggagagcagcctgggcaacatgggaagagcctgtctcttgcggggggggggagaagaaagttcttgtctcaggctagctttggggaccaaatgaagcactcccatgtaggcactcaaatggaactatgtaaaccttaggcaaggcacctctgcctcagtttcctcatctctaaaatggggtgatggtagtatgttagcagagtggttgtgaggagtgaacgggacagtccgtatgtgggttatatgtatatattcccaggtgcttgctgttaccaggccatatgggttattcacagattgaaatatcttagctgggcacggtggctcacccctataatcccagcactttgggagaccgaggcgggtggatcacctgaggtcaggagttcgagaccagcctggccaacatggtgaaaccctgtctctactaaaaaaatacaaataaattactgggattacaggcgtgtgccactgtcaggcctctgagcccaagccaagccatcgcatcccctgtgccttgcacatatacacccagatggcctgaagtaactgaagaatcacaaaagaagtgaaaaggccctgccccgccttaactgatgacattccaccattgtgatttgttcctgccccaccttaactgagtgattaaccctgcaaattttcttctcctggctcagaagcacccccactgagcaccttgcgaccccccactcctgcccgccctttgactgtaattttccattaccttcccaaatactataaaacagccccacccctatctcccttcgctgactcttttcggactcagcccacctgcacccaggtgaaataaacagctttattgctcacacaaa

SEQ ID NO: 440233 - DNA, 3386 bp, Homo sapiens
ctcagaggctggagggatcctccgtatgctgaacgctggtcccctgggccccctttatttctttctctatactttgtttctgtgtctttttctcttccaaagtctctcgttccacctaacgagaaacacccacaggtgtggaggggcaacccatcccttcagacaattgggaggtgagggccgattgccttacacggtgagacaagcggcctgactcgtgactatttttttggacaaatcaggcagccactgactcccttcattatggcctcagctttatctctgggcaataagtgtgatcccttccttcgctgcgtcctttgcaggggcggtggcgctctgcaaggcccaagggggcgtggtccagatgactttgaatcccagttgtcgcccccagggtcagccaggagactagtcagaagcaaacgcgcctgcggcaatccgcccgatgcctttggtctctctcgggcttccgtccacccgcccctcccccgcgtttccattggctgtagctccggcccggggcgggcgaagagggagcgagtgggcggggccgcgtggcgtcagcgcaagatggcggcctcggcagcggtgttctcgcgcttgcgaagcgggctccggctcggctcgcggggactgtgcacgaggttggcgacgccgccccgccgggccccagatcaggccgcagagatcgggagccgcgggagcactaaggcgcaagggccacagcagcagccgggctcagagggtcccagctatgccaaaaaagttgcgctctggcttgctgggctgcttggagctggtgggactgtgagcgtcgtctatatctttggaaacaacccggtggacgaaaatggtgccaagatgatcatcgagcccaccagcccttgccttctcccagaccctctgcaggaaccgtactaccagccaccctacacgctcgttttggagctcaccggcgtcctcttgcatcctgagtggtcgctggccactggctggaggtttaagaagcgcccaggcatcgagaccttgttccagcagcttgcccctttatatgaaattgtcatctttacgtcagagactggcatgactgcgtttccactcattgatagtgtggacccccatggcttcatctcctaccgcctattccgggacgccacaagatacatggatggacaccatgtaaaggatatttcatgtctgaatcgggacccagctcgagtagtagttgtggactgcaagaaggaagccttccgcctgcagccctataacggcgttgccctgcggccctgggacggcaactctgatgaccgggtcttgttggatctgtctgccttcctcaagaccattgcactgaatggtgtggaggacgtgcgaaccgtgctggagcactatgccctggaggatgacccgctggcggctttcaaacagcggcaaagccggctagagcaggaggagcagcagcgcctggccgagctctccaagtccaacaagcagaacctcttccttggctccctcaccagccgcttgtggcctcgctccaaacagccctgaactctgggcctcctcaaactcagtgcctgggtccagggccccagtgcttccagaccaagacttgggccaccacttgtccaataaagtacatcccagacgccacacctgctgtgtcccgagagtctccagatgggggcatcagggtgaggtccgggactcttgggtcatcgtcccacagtggctgatcggctgccaagcacagtgggggtgctttgttggatcagagcagatttttcaccctggtctcggaatctaaaaaccctcgctgtgtcttcctgtgtgttgcgtgatctgtgaaaaatacatctccctctgaccacagactcctcatctgtggagaagggaagagaggatggcacttggctttaaagacaggtagctgccaggctactgtggagagaatgtgttatgggcctagtgggcctctggtggaccagagattacccctctcaacaggccagctgctggttggctccagccagtgtggccctggggtaaagggggcctggagttgcttgacacgccagttgttcaaaagaagcaagaacttgggaatatttttttttttttttggagacagggtctcactgttgcccaggctggagcacagtggtgtaactatagctcactgcagtgttgaacttctgggctcaaacaatcttcctgccttggcctccccaaatgctgagattataggagtgagccactctgcccaactacttttaattaaatagccacatgtgtctcctgtattgacagtaccactgtgtattaagagtatgagtcccagattgtgtaagttcaaatccaagctctaccacttctcggctggcttgtgatcctgtgcaagttactttacctctcagtgcctcggtttctacatttataaaataataactgggcaggcacagtggctcatggctgtcatcccaacacttcaggaggccgaggtgggaggatcgcctgaggccaggagttggagagcagcctgggcaacatgggaagagcctgtctcttgcggggggggggagaagaaagttcttgtctcaggctagctttggggaccaaatgaagcactcccatgtaggcactcaaatggaactatgtaaaccttaggcaaggcacctctgcctcagtttcctcatctctaaaatggggtgatggtagtatgttagcagagtggttgtgaggagtgaacgggacagtccgtatgtgggttatatgtatatattcccaggtgcttgctgttaccaggccatatgggttattcacagattgaaatatcttagctgggcacggtggctcacccctataatcccagcactttgggagaccgaggcgggtggatcacctgaggtcaggagttcgagaccagcctggccaacatggtgaaaccctgtctctactaaaaaaatacaaataaattactgggattacaggcgtgtgccactgtcaggcctctgagcccaagccaagccatcgcatcccctgtgccttgcacatatacacccagatggcctgaagtaactgaagaatcacaaaagaagtgaaaaggccctgccccgccttaactgatgacattccaccattgtgatttgttcctgccccaccttaactgagtgattaaccctgcaaattttcttctcctggctcagaagcacccccactgagcaccttgcgaccccccactcctgcccgccctttgactgtaattttccattaccttcccaaatactataaaacagccccacccctatctcccttcgctgactcttttcggactcagcccacctgcacccaggtgaaataaacagctttattgctcacacaaa

SEQ ID NO: 440234 - DNA, 2587 bp, Homo sapiens
gtgcgggacatccctcatatatttcaaacgtagttatgcatgcgatgatcgatcgcatggccccgatgatcatcgagcccaccagcccttgccttctcccagaccctctgcaggaaccgtactaccagccaccctacacgctcgttttggagctcaccggcgtcctcttgcatcctgagtggtcgctggccactggctggaggtttaagaagcgcccaggcatcgagaccttgttccagcagcttgcccctttatatgaaattgtcatctttacgtcagagactggcatgactgcgtttccactcattgatagtgtggacccccatggcttcatctcctaccgcctattccgggacgccacaagatacatggatggacaccatgtaaaggatatttcatgtctgaatcgggacccagctcgagtagtagttgtggactgcaagaaggaagccttccgcctgcagccctataacggcgttgccctgcggccctgggacggcaactctgatgaccgggtcttgttggatctgtctgccttcctcaagaccattgcactgaatggtgtggaggacgtgcgaaccgtgctggagcactatgccctggaggatgacccgctggcggctttcaaacagcggcaaagccggctagagcaggaggagcagcagcgcctggccgagctctccaagtccaacaagcagaacctcttccttggctccctcaccagccgcttgtggcctcgctccaaacagccctgaactctgggcctcctcaaactcagtgcctgggtccagggccccagtgcttccagaccaagacttgggccaccacttgtccaataaagtacatcccagacgccacacctgctgtgtcccgagagtctccagatgggggcatcagggtgaggtccgggactcttgggtcatcgtcccacagtggctgatcggctgccaagcacagtgggggtgctttgttggatcagagcagatttttcaccctggtctcggaatctaaaaaccctcgctgtgtcttcctgtgtgttgcgtgatctgtgaaaaatacatctccctctgaccacagactcctcatctgtggagaagggaagagaggatggcacttggctttaaagacaggtagctgccaggctactgtggagagaatgtgttatgggcctagtgggcctctggtggaccagagattacccctctcaacaggccagctgctggttggctccagccagtgtggccctggggtaaagggggcctggagttgcttgacacgccagttgttcaaaagaagcaagaacttgggaatatttttttttttttttggagacagggtctcactgttgcccaggctggagcacagtggtgtaactatagctcactgcagtgttgaacttctgggctcaaacaatcttcctgccttggcctccccaaatgctgagattataggagtgagccactctgcccaactacttttaattaaatagccacatgtgtctcctgtattgacagtaccactgtgtattaagagtatgagtcccagattgtgtaagttcaaatccaagctctaccacttctcggctggcttgtgatcctgtgcaagttactttacctctcagtgcctcggtttctacatttataaaataataactgggcaggcacagtggctcatggctgtcatcccaacacttcaggaggccgaggtgggaggatcgcctgaggccaggagttggagagcagcctgggcaacatgggaagagcctgtctcttgcggggggggggagaagaaagttcttgtctcaggctagctttggggaccaaatgaagcactcccatgtaggcactcaaatggaactatgtaaaccttaggcaaggcacctctgcctcagtttcctcatctctaaaatggggtgatggtagtatgttagcagagtggttgtgaggagtgaacgggacagtccgtatgtgggttatatgtatatattcccaggtgcttgctgttaccaggccatatgggttattcacagattgaaatatcttagctgggcacggtggctcacccctataatcccagcactttgggagaccgaggcgggtggatcacctgaggtcaggagttcgagaccagcctggccaacatggtgaaaccctgtctctactaaaaaaatacaaataaattactgggattacaggcgtgtgccactgtcaggcctctgagcccaagccaagccatcgcatcccctgtgccttgcacatatacacccagatggcctgaagtaactgaagaatcacaaaagaagtgaaaaggccctgccccgccttaactgatgacattccaccattgtgatttgttcctgccccaccttaactgagtgattaaccctgcaaattttcttctcctggctcagaagcacccccactgagcaccttgcgaccccccactcctgcccgccctttgactgtaattttccattaccttcccaaatactataaaacagccccacccctatctcccttcgctgactcttttcggactcagcccacctgcacccaggtgaaataaacagctttattgctcacacaaa

SEQ ID NO: 440235 - DNA, 2593 bp, Homo sapiens
caggcacgctataagtgccacaaaggagccagacccgcagtcacagcctatgaacttcttgacctccaagagccacagagacagagggagagaactctgttctgggaatcccccaggctggatctttgtcctcttggggactctgaggacctctgggtcttggtgtttcactgtcctcactgtcttcccagctggccactggctggaggtttaagaagcgcccaggcatcgagaccttgttccagcagcttgcccctttatatgaaattgtcatctttacgtcagagactggcatgactgcgtttccactcattgatagtgtggacccccatggcttcatctcctaccgcctattccgggacgccacaagatacatggatggacaccatgtaaaggatatttcatgtctgaatcgggacccagctcgagtagtagttgtggactgcaagaaggaagccttccgcctgcagccctataacggcgttgccctgcggccctgggacggcaactctgatgaccgggtcttgttggatctgtctgccttcctcaagaccattgcactgaatggtgtggaggacgtgcgaaccgtgctggagcactatgccctggaggatgacccgctggcggctttcaaacagcggcaaagccggctagagcaggaggagcagcagcgcctggccgagctctccaagtccaacaagcagaacctcttccttggctccctcaccagccgcttgtggcctcgctccaaacagccctgaactctgggcctcctcaaactcagtgcctgggtccagggccccagtgcttccagaccaagacttgggccaccacttgtccaataaagtacatcccagacgccacacctgctgtgtcccgagagtctccagatgggggcatcagggtgaggtccgggactcttgggtcatcgtcccacagtggctgatcggctgccaagcacagtgggggtgctttgttggatcagagcagatttttcaccctggtctcggaatctaaaaaccctcgctgtgtcttcctgtgtgttgcgtgatctgtgaaaaatacatctccctctgaccacagactcctcatctgtggagaagggaagagaggatggcacttggctttaaagacaggtagctgccaggctactgtggagagaatgtgttatgggcctagtgggcctctggtggaccagagattacccctctcaacaggccagctgctggttggctccagccagtgtggccctggggtaaagggggcctggagttgcttgacacgccagttgttcaaaagaagcaagaacttgggaatatttttttttttttttggagacagggtctcactgttgcccaggctggagcacagtggtgtaactatagctcactgcagtgttgaacttctgggctcaaacaatcttcctgccttggcctccccaaatgctgagattataggagtgagccactctgcccaactacttttaattaaatagccacatgtgtctcctgtattgacagtaccactgtgtattaagagtatgagtcccagattgtgtaagttcaaatccaagctctaccacttctcggctggcttgtgatcctgtgcaagttactttacctctcagtgcctcggtttctacatttataaaataataactgggcaggcacagtggctcatggctgtcatcccaacacttcaggaggccgaggtgggaggatcgcctgaggccaggagttggagagcagcctgggcaacatgggaagagcctgtctcttgcggggggggggagaagaaagttcttgtctcaggctagctttggggaccaaatgaagcactcccatgtaggcactcaaatggaactatgtaaaccttaggcaaggcacctctgcctcagtttcctcatctctaaaatggggtgatggtagtatgttagcagagtggttgtgaggagtgaacgggacagtccgtatgtgggttatatgtatatattcccaggtgcttgctgttaccaggccatatgggttattcacagattgaaatatcttagctgggcacggtggctcacccctataatcccagcactttgggagaccgaggcgggtggatcacctgaggtcaggagttcgagaccagcctggccaacatggtgaaaccctgtctctactaaaaaaatacaaataaattactgggattacaggcgtgtgccactgtcaggcctctgagcccaagccaagccatcgcatcccctgtgccttgcacatatacacccagatggcctgaagtaactgaagaatcacaaaagaagtgaaaaggccctgccccgccttaactgatgacattccaccattgtgatttgttcctgccccaccttaactgagtgattaaccctgcaaattttcttctcctggctcagaagcacccccactgagcaccttgcgaccccccactcctgcccgccctttgactgtaattttccattaccttcccaaatactataaaacagccccacccctatctcccttcgctgactcttttcggactcagcccacctgcacccaggtgaaataaacagctttattgctcacacaaa

SEQ ID NO: 440236 - DNA, 2879 bp, Homo sapiens
ctcagaggctggagggatcctccgtatgctgaacgctggtcccctgggccccctttatttctttctctatactttgtttctgtgtctttttctcttccaaagtctctcgttccacctaacgagaaacacccacaggtgtggaggggcaacccatcccttcagacaattgggaggtgagggccgattgccttacacggtgagacaagcggcctgactcgtgactatttttttggacaaatcaggcagccactgactcccttcattatggcctcagctttatctctgggcaataagtgtgatcccttccttcgctgcgtcctttgcaggggcggtggcgctctgcaaggcccaagggggcgtggtccagatgactttgaatcccagttgtcgcccccagggtcagccaggagactagtcagaagcaaacgcgcctgcggcaatccgcccgatgcctttggtctctctcgggcttccgtccacccgcccctcccccgcgtttccattggctgtagctccggcccggggcgggcgaagagggagcgagtgggcggggccgcgtggcgtcagcgcaagatggcggcctcggcagcggtgttctcgcgcttgcgaagcgggctccggctcggctcgcggggactgtgcacgaggttggcgacgccgccccgccgggccccagatcaggatatttcatgtctgaatcgggacccagctcgagtagtagttgtggactgcaagaaggaagccttccgcctgcagccctataacggcgttgccctgcggccctgggacggcaactctgatgaccgggtcttgttggatctgtctgccttcctcaagaccattgcactgaatggtgtggaggacgtgcgaaccgtgctggagcactatgccctggaggatgacccgctggcggctttcaaacagcggcaaagccggctagagcaggaggagcagcagcgcctggccgagctctccaagtccaacaagcagaacctcttccttggctccctcaccagccgcttgtggcctcgctccaaacagccctgaactctgggcctcctcaaactcagtgcctgggtccagggccccagtgcttccagaccaagacttgggccaccacttgtccaataaagtacatcccagacgccacacctgctgtgtcccgagagtctccagatgggggcatcagggtgaggtccgggactcttgggtcatcgtcccacagtggctgatcggctgccaagcacagtgggggtgctttgttggatcagagcagatttttcaccctggtctcggaatctaaaaaccctcgctgtgtcttcctgtgtgttgcgtgatctgtgaaaaatacatctccctctgaccacagactcctcatctgtggagaagggaagagaggatggcacttggctttaaagacaggtagctgccaggctactgtggagagaatgtgttatgggcctagtgggcctctggtggaccagagattacccctctcaacaggccagctgctggttggctccagccagtgtggccctggggtaaagggggcctggagttgcttgacacgccagttgttcaaaagaagcaagaacttgggaatatttttttttttttttggagacagggtctcactgttgcccaggctggagcacagtggtgtaactatagctcactgcagtgttgaacttctgggctcaaacaatcttcctgccttggcctccccaaatgctgagattataggagtgagccactctgcccaactacttttaattaaatagccacatgtgtctcctgtattgacagtaccactgtgtattaagagtatgagtcccagattgtgtaagttcaaatccaagctctaccacttctcggctggcttgtgatcctgtgcaagttactttacctctcagtgcctcggtttctacatttataaaataataactgggcaggcacagtggctcatggctgtcatcccaacacttcaggaggccgaggtgggaggatcgcctgaggccaggagttggagagcagcctgggcaacatgggaagagcctgtctcttgcggggggggggagaagaaagttcttgtctcaggctagctttggggaccaaatgaagcactcccatgtaggcactcaaatggaactatgtaaaccttaggcaaggcacctctgcctcagtttcctcatctctaaaatggggtgatggtagtatgttagcagagtggttgtgaggagtgaacgggacagtccgtatgtgggttatatgtatatattcccaggtgcttgctgttaccaggccatatgggttattcacagattgaaatatcttagctgggcacggtggctcacccctataatcccagcactttgggagaccgaggcgggtggatcacctgaggtcaggagttcgagaccagcctggccaacatggtgaaaccctgtctctactaaaaaaatacaaataaattactgggattacaggcgtgtgccactgtcaggcctctgagcccaagccaagccatcgcatcccctgtgccttgcacatatacacccagatggcctgaagtaactgaagaatcacaaaagaagtgaaaaggccctgccccgccttaactgatgacattccaccattgtgatttgttcctgccccaccttaactgagtgattaaccctgcaaattttcttctcctggctcagaagcacccccactgagcaccttgcgaccccccactcctgcccgccctttgactgtaattttccattaccttcccaaatactataaaacagccccacccctatctcccttcgctgactcttttcggactcagcccacctgcacccaggtgaaataaacagctttattgctcacacaaa

SEQ ID NO: 440237 - DNA, 2559 bp, Homo sapiens
atggtgttcacgatcacatttccactcacggcaccagtgggcatgctcgtcccagtaacggagtgttttaatggttcctgccagtacggctgcactgccccccgtcgtgattgcgggctgcgccttcgctggggcctgcacaggctgtggctgggtctggggctgtggctggggttggggctggacagctggtggccctgctggcggctggctgcccgctgcctgtggttgtggcagcggtggcggtggctgctgcgggggtggtgggggctgcggctggggcgggggtggctgggccacggccggctgctgtgccttctgctgatcagccagagcctttttctcttttgcgattcgctctgatatttcatgtctgaatcgggacccagctcgagtagtagttgtggactgcaagaaggaagccttccgcctgcagccctataacggcgttgccctgcggccctgggacggcaactctgatgaccgggtcttgttggatctgtctgccttcctcaagaccattgcactgaatggtgtggaggacgtgcgaaccgtgctggagcactatgccctggaggatgacccgctggcggctttcaaacagcggcaaagccggctagagcaggaggagcagcagcgcctggccgagctctccaagtccaacaagcagaacctcttccttggctccctcaccagccgcttgtggcctcgctccaaacagccctgaactctgggcctcctcaaactcagtgcctgggtccagggccccagtgcttccagaccaagacttgggccaccacttgtccaataaagtacatcccagacgccacacctgctgtgtcccgagagtctccagatgggggcatcagggtgaggtccgggactcttgggtcatcgtcccacagtggctgatcggctgccaagcacagtgggggtgctttgttggatcagagcagatttttcaccctggtctcggaatctaaaaaccctcgctgtgtcttcctgtgtgttgcgtgatctgtgaaaaatacatctccctctgaccacagactcctcatctgtggagaagggaagagaggatggcacttggctttaaagacaggtagctgccaggctactgtggagagaatgtgttatgggcctagtgggcctctggtggaccagagattacccctctcaacaggccagctgctggttggctccagccagtgtggccctggggtaaagggggcctggagttgcttgacacgccagttgttcaaaagaagcaagaacttgggaatatttttttttttttttggagacagggtctcactgttgcccaggctggagcacagtggtgtaactatagctcactgcagtgttgaacttctgggctcaaacaatcttcctgccttggcctccccaaatgctgagattataggagtgagccactctgcccaactacttttaattaaatagccacatgtgtctcctgtattgacagtaccactgtgtattaagagtatgagtcccagattgtgtaagttcaaatccaagctctaccacttctcggctggcttgtgatcctgtgcaagttactttacctctcagtgcctcggtttctacatttataaaataataactgggcaggcacagtggctcatggctgtcatcccaacacttcaggaggccgaggtgggaggatcgcctgaggccaggagttggagagcagcctgggcaacatgggaagagcctgtctcttgcggggggggggagaagaaagttcttgtctcaggctagctttggggaccaaatgaagcactcccatgtaggcactcaaatggaactatgtaaaccttaggcaaggcacctctgcctcagtttcctcatctctaaaatggggtgatggtagtatgttagcagagtggttgtgaggagtgaacgggacagtccgtatgtgggttatatgtatatattcccaggtgcttgctgttaccaggccatatgggttattcacagattgaaatatcttagctgggcacggtggctcacccctataatcccagcactttgggagaccgaggcgggtggatcacctgaggtcaggagttcgagaccagcctggccaacatggtgaaaccctgtctctactaaaaaaatacaaataaattactgggattacaggcgtgtgccactgtcaggcctctgagcccaagccaagccatcgcatcccctgtgccttgcacatatacacccagatggcctgaagtaactgaagaatcacaaaagaagtgaaaaggccctgccccgccttaactgatgacattccaccattgtgatttgttcctgccccaccttaactgagtgattaaccctgcaaattttcttctcctggctcagaagcacccccactgagcaccttgcgaccccccactcctgcccgccctttgactgtaattttccattaccttcccaaatactataaaacagccccacccctatctcccttcgctgactcttttcggactcagcccacctgcacccaggtgaaataaacagctttattgctcacacaaa

SEQ ID NO: 440238 - DNA, 1057 bp, Homo sapiens
agcgggttgttcccttttcggctctgcaacaccgcctagaccgaccggatacacgggtagggcttccgctttacccgtctccctcctggcgcttgtcctcctctcccagtcggcaccacagcggtggctgccgggcgtggtgtcggtgggtcggttggtttttgtctcaccgttggtgtccgtgccgttcagttgcccgccatggctgagctggatccgttcggcgcccctgccggcgcccctggcggtcccgcgctggggaacggagtggccggcgccggcgaagaagacccggctgcggccttcttggcgcagcaagagagcgagattgcgggcatcgagaacgacgaggccttcgccatcctggacggcggcgcccccgggccccagccgcacggcgagccgccggggggtccggatgctgttgatggagtaatgaatggtgaatactaccaggaaagtaatggtccaacagacagttatgcagctatttcacaagtggatcgattgcagtcagagcctgaaagtatccgtaaatggagagaagaacaaatggaacgcttggaagcccttgatgccaattctcggaagcaagaagcagagtggaaagaaaaggcaataaaggagctagaagaatggtatgcaagacaggacgagcagctacagaaaacaaaagcaaacaacagggtggcagatgaagctttctacaaacaacccttcgctgacgtgattggttatgtggcagcagaagaagcctttgtaaatgacattgacgagtcgtccccaggcactgagtgggaacgggtggcccggctgtgtgactttaaccccaaacagtcattggattaattatgttgagttcttttggaccaaacctttttgtctttagagttgttcattgtttgtgattgcatgtttccttccttcaactgtgttctccctggcattcagagaggagggagaggaggaagaggaaggggagggaagcttcccaagagtagcctcaacctgtgcttctgtgcattattctgagaataaatttctgtttcaaactgta

SEQ ID NO: 440239 - DNA, 1043 bp, Homo sapiens
  misc_feature (3)..(3): n is a, c, g, or t
  misc_feature (17)..(17): n is a, c, g, or t
  misc_feature (922)..(924): n is a, c, g, or t
  misc_feature (927)..(927): n is a, c, g, or t
  misc_feature (934)..(934): n is a, c, g, or t
  misc_feature (950)..(950): n is a, c, g, or t
atngctagtacgaggcntggtgttgaatcggccgagtctccctcctggcgcttgtcctcctctcccagtcggcaccacagcggtggctgccgggcgtggtgtcggtgggtcggttggtttttgtctcaccgttggtgtccgtgccgttcagttgcccgccatggctgagctggatccgttcggcgcccctgccggcgcccctggcggtcccgcgctggggaacggagtggccggcgccggcgaagaagacccggctgcggccttcttggcgcagcaagagagcgagattgcgggcatcgagaacgacgaggccttcgccatcctggacggcggcgcccccgggccccagccgcacggcgagccgccggggggtccggatgctgttgatggagtaatgaatggtgaatactaccaggaaagtaatggtccaacagacagttatgcagctatttcacaagtggatcgattgcagtcagagcctgaaagtatccgtaaatggagagaagaacaaatggaacgcttggaagcccttgatgccaattctcggaagcaagaagcagagtggaaagaaaaggcaataaaggagctagaagaatggtatgcaagacaggacgagcagctacagaaaacaaaagcaaacaacagggcagcagaagaagcctttgtaaatgacattgacgagtcgtccccaggcactgagtgggaacgggtggcccggctgtgtgactttaaccccaagtctagcaagcaggccaaagatgtctcccgcatgcgctcagtcctcatctccctcaagcaggccccgctggtgcactgaagagccaccctgtggaaacactacatctgcaatatcttaatcctactcagtgaagctcttcccagcctgggttataagtcgggctttgggccaccttgttaaatnnnacngggaagngtctcaaggtcccggntaaaggaagaaaaagagaacacaaacaagagtggtataaatttagaaaaaggtaacgagacacaaaacagaaaggaagaatacaaactagtta

SEQ ID NO: 440240 - DNA, 1058 bp, Homo sapiens
  misc_feature (9)..(9): n is a, c, g, or t
  misc_feature (1058)..(1058): n is a, c, g, or t
gagggcaanaaaaacgaaataggctaggtacgaggctgggtgttggtctccctcctggcgcttgtcctcctctcccagtcggcaccacagcggtggctgccgggcgtggtgtcggtgggtcggttggtttttgtctcaccgttggtgtccgtgccgttcagttgcccgccatggctgagctggatccgttcggcgcccctgccggcgcccctggcggtcccgcgctggggaacggagtggccggcgccggcgaagaagacccggctgcggccttcttggcgcagcaagagagcgagattgcgggcatcgagaacgacgaggccttcgccatcctggacggcggcgcccccgggccccagccgcacggcgagccgccggggggtccggatgctgttgatggagtaatgaatggtgaatactaccaggaaagtaatggtccaacagacagttatgcagctatttcacaagtggatcgattgcagtcagagcctgaaagtatccgtaaatggagagaagaacaaatggaacgcttggaagcccttgatgccaattctcggaagcaagaagcagagtggaaagaaaaggcaataaaggagctagaagaatggtatgcaagacaggacgagcagctacagaaaacaaaagcaaacaacagggcagcagaagaagcctttgtaaatgacattgacgagtcgtccccaggcactgagtgggaacgggtggcccggctgtgtgactttaaccccaagtctagcaagcaggccaaagatgtctcccgcatgcgctcagtcctcatctccctcaagcaggccccgctggtgcactgaagagccaccctgatatttatctatcagtgagtctcaagtcatgttatttgttggtctttggccaaccttgttttagtgtcatgttgggatggtggcctcttaaggttccgggctaagaggcgggggggagggggggccagaccacacggttggtttgaaattggcgggaaaaaacgtttgggaagatgggtgtccttttgcttagccttttatgggccggatctataaccn

SEQ ID NO: 440241 - DNA, 1014 bp, Homo sapiens
  misc_feature (9)..(9): n is a, c, g, or t
  misc_feature (971)..(971): n is a, c, g, or t
  misc_feature (974)..(974): n is a, c, g, or t
  misc_feature (982)..(982): n is a, c, g, or t
  misc_feature (985)..(985): n is a, c, g, or t
gagggcaanaaaaacgaaataggctaggtacgaggctgggtgttgcagcggtggctgccgggcgtggtgtcggtgggtcggttggtttttgtctcaccgttggtgtccgtgccgttcagttgcccgccatggctgagctggatccgttcggcgcccctgccggcgcccctggcggtcccgcgctggggaacggagtggccggcgccggcgaagaagacccggctgcggccttcttggcgcagcaagagagcgagattgcgggcatcgagaacgacgaggccttcgccatcctggacggcggcgcccccgggccccagccgcacggcgagccgccggggggtccggatgctgttgatggagtaatgaatggtgaatactaccaggaaagtaatggtccaacagacagttatgcagctatttcacaagtggatcgattgcagtcagagcctgaaagtatccgtaaatggagagaagaacaaatggaacgcttggaagcccttgatgccaattctcggaagcaagaagcagagtggaaagaaaaggcaataaaggagctagaagaatggtatgcaagacaggacgagcagctacagaaaacaaaagcaaacaacagggcagcagaagaagcctttgtaaatgacattgacgagtcgtccccaggcactgagtgggaacgggtggcccggctgtgtgactttaaccccaagtctagcaagcaggccaaagatgtctcccgcatgcgctcagtcctcatctccctcaagcaggccccgctggtgcactgaagagccaccctgtggaaacactacatctgcaatatcttaatcctactcagtgaagctcttcacagtcattggattaattatgttgagttcttttggaccaaacctttttgtctgtctggtgggatgcgcgttcctctcaagggtttccggctcaaaggggggggagagggggggccccaaaacccnggngggtttgnaantgtgggaaaaaacggttttgggggagggg

SEQ ID NO: 440242 - DNA, 551 bp, Homo sapiens
  misc_feature (71)..(71): n is a, c, g, or t
  misc_feature (78)..(78): n is a, c, g, or t
  misc_feature (91)..(92): n is a, c, g, or t
aagagcgcccccaacaataaggggattttgggcccctcgagggccaagtatttcgggcgcagggcaggctncagaaancaaaagcaaacannagggcagcagaagaagcctttgtaaatgacattgacgagtcgtccccaggcactgagtgggaacgggtggcccggctgtgtgactttaaccccaagtctagcaagcaggccaaagatgtctcccgcatgcgctcagtcctcatctccctcaagcaggccccgctggtgcactgaagagccaccctgtggaaacactacatctgcaatatcttaatcctactcagtgaagctcttcacagtcattggattaattatgttgagttcttttggaccaaacctttttgtctttagagttgttcattgtttgtgattgcatgtttccttccttcaactgtgttctccctggcattcagagaggagggagaggaggaagaggaaggggagggaagcttcccaagagtagcctcaacctgtgcttctgtgcattattctgagaataaatttctgtttcaaactgta

SEQ ID NO: 440243 - DNA, 510 bp, Homo sapiens
cgagtggaggaagagaaacaaaatcgaaaaaaagggggggcgctgggcgaaaaggcagcagaagaagcctttgtaaatgacattgacgagtcgtccccaggcactgagtgggaacgggtggcccggctgtgtgactttaaccccaagtctagcaagcaggccaaagatgtctcccgcatgcgctcagtcctcatctccctcaagcaggccccgctggtgcactgaagagccaccctgtggaaacactacatctgcaatatcttaatcctactcagtgaagctcttcacagtcattggattaattatgttgagttcttttggaccaaacctttttgtctttagagttgttcattgtttgtgattgcatgtttccttccttcaactgtgttctccctggcattcagagaggagggagaggaggaagaggaaggggagggaagcttcccaagagtagcctcaacctgtgcttctgtgcattattctgagaataaatttctgtttcaaactgta

SEQ ID NO: 440244 - DNA, 514 bp, Homo sapiens
cacaaacacactgcagaccaagtaggagtagatgctttgtggtcctctctagtgctaatattctgtgttctatcattctctggttcctgaatcatctctacctttggtaattgtcctaatagcaccctgcctcacagaagtgcttctaccatatttagttatgagagtgccaccttgtgttccacaaaaccattgtcaaacctggaatatggactagtttgggagaagaggtaaaagattaagatgaataccctactatgaactaatattggcagcattggtaaagaatcatctataattgtttctcccccaattggtgcccagaaggcttttttcctattaataatagaagtcagtatttccacatacacccttctcttttgctctgcccaaaacaagacaaaacaaaactaatgacccactaagatgtcagtggactgggataagaccaggaataggactgtgggaaagaccaggcaggaatagaagcactgaaatcagagttggttgtgca

SEQ ID NO: 440245 - DNA, 1143 bp, Homo sapiens
agcgggttgttcccttttcggctctgcaacaccgcctagaccgaccggatacacgggtagggcttccgctttacccgtctccctcctggcgcttgtcctcctctcccagtcggcaccacagcggtggctgccgggcgtggtgtcggtgggtcggttggtttttgtctcaccgttggtgtccgtgccgttcagttgcccgccatggctgagctggatccgttcggcgcccctgccggcgcccctggcggtcccgcgctggggaacggagtggccggcgccggcgaagaagacccggctgcggccttcttggcgcagcaagagagcgagattgcgggcatcgagaacgacgaggccttcgccatcctggacggcggcgcccccgggccccagccgcacggcgagccgccggggggtccggatgctgttgatggagtaatgaatggtgaatactaccaggaaagtaatggtccaacagacagttatgcagctatttcacaagtggatcgattgcagtcagagcctgaaagtatccgtaaatggagagaagaacaaatggaacgcttggaagcccttgatgccaattctcggaagcaagaagcagagtggaaagaaaaggcaataaaggagctagaagaatggtatgcaagacaggacgagcagctacagaaaacaaaagcaaacaacagggcagcagaagaagcctttgtaaatgacattgacgagtcgtccccaggcactgagtgggaacgggtggcccggctgtgtgactttaaccccaagtctagcaagcaggccaaagatgtctcccgcatgcgctcagtcctcatctccctcaagcaggccccgctggtgcactgaagagccaccctgtggaaacactacatctgcaatatcttaatcctactcagtgaagctcttcacagtcattggattaattatgttgagttcttttggaccaaacctttttgtctttagagttgttcattgtttgtgattgcatgtttccttccttcaactgtgttctccctggcattcagagaggagggagaggaggaagaggaaggggagggaagcttcccaagagtagcctcaacctgtgcttctgtgcattattctgagaataaatttctgtttcaaactgta

SEQ ID NO: 440246 - DNA, 1112 bp, Homo sapiens
  misc_feature (9)..(9): n is a, c, g, or t
gagggcaanaaaaacgaaataggctaggtacgaggctgggtgttggtctccctcctggcgcttgtcctcctctcccagtcggcaccacagcggtggctgccgggcgtggtgtcggtgggtcggttggtttttgtctcaccgttggtgtccgtgccgttcagttgcccgccatggctgagctggatccgttcggcgcccctgccggcgcccctggcggtcccgcgctggggaacggagtggccggcgccggcgaagaagacccggctgcggccttcttggcgcagcaagagagcgagattgcgggcatcgagaacgacgaggccttcgccatcctggacggcggcgcccccgggccccagccgcacggcgagccgccggggggtccggatgctgttgatggagtaatgaatggtgaatactaccaggaaagtaatggtccaacagacagttatgcagctatttcacaagtggatcgattgcagtcagagcctgaaagtatccgtaaatggagagaagaacaaatggaacgcttggaagcccttgatgccaattctcggaagcaagaagcagagtggaaagaaaaggcaataaaggagctagaagaatggtatgcaagacaggacgagcagctacagaaaacaaaagcaaacaacagggcagcagaagaagcctttgtaaatgacattgacgagtcgtccccaggcactgagtgggaacgggtggcccggctgtgtgactttaaccccaagtctagcaagcaggccaaagatgtctcccgcatgcgctcagtcctcatctccctcaagcaggccccgctggtgcactgaagagccaccctgtggaaacactacatctgcaatatcttaatcctactcagtgaagctcttcacagtcattggattaattatgttgagttcttttggaccaaacctttttgtctttagagttgttcattgtttgtgattgcatgtttccttccttcaactgtgttctccctggcattcagagaggagggagaggaggaagaggaaggggagggaagcttcccaagagtagcctcaacctgtgcttctgtgcattattctgagaataaatttctgtttcaaactgta

SEQ ID NO: 440247 - DNA, 1285 bp, Homo sapiens
  misc_feature (1234)..(1234): n is a, c, g, or t
  misc_feature (1243)..(1243): n is a, c, g, or t
  misc_feature (1247)..(1247): n is a, c, g, or t
  misc_feature (1260)..(1260): n is a, c, g, or t
  misc_feature (1272)..(1272): n is a, c, g, or t
  misc_feature (1279)..(1279): n is a, c, g, or t
  misc_feature (1282)..(1282): n is a, c, g, or t
agcgggttgttcccttttcggctctgcaacaccgcctagaccgaccggatacacgggtagggcttccgctttacccgtctccctcctggcgcttgtcctcctctcccagtcggcaccacagcggtggctgccgggcgtggtgtcggtgggtcggttggtttttgtctcaccgttggtgtccgtgccgttcagttgcccgccatggctgagctggatccgttcggcgcccctgccggcgcccctggcggtcccgcgctggggaacggagtggccggcgccggcgaagaagacccggctgcggccttcttggcgcagcaagagagcgagattgcgggcatcgagaacgacgaggccttcgccatcctggacggcggcgcccccgggccccagccgcacggcgagccgccggggggtccggatgctgttgatggagtaatgaatggtgaatactaccaggaaagtaatggtccaacagacagttatgcagctatttcacaagtggatcgattgcagtcagagcctgaaagtatccgtaaatggagagaagaacaaatggaacgcttggaagcccttgatgccaattctcggaagcaagaagcagagtggaaagaaaaggcaataaaggagctagaagaatggtatgcaagacaggacgagcagctacagaaaacaaaagcaaacaacagggcagcagaagaagcctttgtaaatgacattgacgagtcgtccccaggcactgagtgggaacgggtggcccggctgtgtgactttaaccccaagtctagcaagcaggccaaagatgtctcccgcatgcgctcagtcctcatctccctcaagcaggccccgctggtgcactgaagagccaccctgtggaaacactacatctgcaatatcttaatcctactcagtgaagctcttcacagtcattggattaattatgttgagttcttttggaccaaacctttttgtctttagagttgttcattgtttgtgattgcatgtttccttccttcaactgtgttctccctggcattcagagaggagggagaggaggaagaggaaggggagggaagcttcccaagagtagcctcaacctgtgcttctgtgcattattctgagaataaatttctgtttcaaactgtaaaaaaaaaaaaaaaaaaaaaacaaaaaaaaaaaaaaaaaaaaaaaaaaaaaaacaaacacacaaaaacacaaaaacacaaaaaaaaaaacnaaaacacanaaancaaacacacacanacaccacaccancaaaaancanaca

SEQ ID NO: 440248 - DNA, 1391 bp, Homo sapiens
agcgggttgttcccttttcggctctgcaacaccgcctagaccgaccggatacacgggtagggcttccgctttacccgtctccctcctggcgcttgtcctcctctcccagtcggcaccacagcggtggctgccgggcgtggtgtcggtgggtcggttggtttttgtctcaccgttggtgtccgtgccgttcagttgcccgccatggctgagctggatccgttcggcgcccctgccggcgcccctggcggtcccgcgctggggaacggagtggccggcgccggcgaagaagacccggctgcggccttcttggcgcagcaagagagcgagattgcgggcatcgagaacgacgaggccttcgccatcctggacggcggcgcccccgggccccagccgcacggcgagccgccggggggtccggatgctgttgatggagtaatgaatggtgaatactaccaggaaagtaatggtccaacagacagttatgcagctatttcacaagtggatcgattgcagtcagagcctgaaagtatccgtaaatggagagaagaacaaatggaacgcttggaagcccttgatgccaattctcggaagcaagaagcagagtggaaagaaaaggcaataaaggagctagaagaatggtatgcaagacaggacgagcagctacagaaaacaaaagcaaacaacagggcagcagaagaagcctttgtaaatgacattgacgagtcgtccccaggcactgagtgggaacgggtggcccggctgtgtgactttaaccccaagtctagcaagcaggccaaagatgtctcccgcatgcgctcagtcctcatctccctcaagcaggccccgctggtgcactgaagagccaccctgtggaaacactacatctgcaatatcttaatcctactcagtgaagctcttcacagtcattggattaattatgttgagttcttttggaccaaacctttttgtctttagagttgttcattgtttgtgattgcatgtttccttccttcaactgtgttctccctggcattcagagaggagggagaggaggaagaggaaggggagggaagcttcccaagagtagcctcaacctgtgcttctgtgcattattctgagaataaatttctgtttcaaactgtataacaaaaaaaaaaacaccaaaacaaccaccagcagactccacaccagtaaaaaacaactagcaacccgacggcaaataccgggacgcacgagcaaaacgacgggagcacaaaagcgcacacacagcgaaagaaggggagacagaggacagacgagctgcgagcaacaagagggggaaacacgcccgcacacccacacacaagagagacggcaaaaccgacaaggaggcggagtacggcacaaagaaa

SEQ ID NO: 440249 - DNA, 1060 bp, Homo sapiens
  misc_feature (3)..(3): n is a, c, g, or t
  misc_feature (17)..(17): n is a, c, g, or t
atngctagtacgaggcntggtgttgaatcggccgacagcggtggctgccgggcgtggtgtcggtgggtcggttggtttttgtctcaccgttggtgtccgtgccgttcagttgcccgccatggctgagctggatccgttcggcgcccctgccggcgcccctggcggtcccgcgctggggaacggagtggccggcgccggcgaagaagacccggctgcggccttcttggcgcagcaagagagcgagattgcgggcatcgagaacgacgaggccttcgccatcctggacggcggcgcccccgggccccagccgcacggcgagccgccggggggtccggatgctgttgatggagtaatgaatggtgaatactaccaggaaagtaatggtccaacagacagttatgcagctatttcacaagtggatcgattgcagtcagagcctgaaagtatccgtaaatggagagaagaacaaatggaacgcttggaagcccttgatgccaattctcggaagcaagaagcagagtggaaagaaaaggcaataaaggagctagaagaatggtatgcaagacaggacgagcagctacagaaaacaaaagcaaacaacagggcagcagaagaagcctttgtaaatgacattgacgagtcgtccccaggcactgagtgggaacgggtggcccggctgtgtgactttaaccccaagtctagcaagcaggccaaagatgtctcccgcatgcgctcagtcctcatctccctcaagcaggccccgctggtgcactgaagagccaccctgtggaaacactacatctgcaatatcttaatcctactcagtgaagctcttcacagtcattggattaattatgttgagttcttttggaccaaacctttttgtctttagagttgttcattgtttgtgattgcatgtttccttccttcaactgtgttctccctggcattcagagaggagggagaggaggaagaggaaggggagggaagcttcccaagagtagcctcaacctgtgcttctgtgcattattctgagaataaatttctgtttcaaactgta

SEQ ID NO: 440250 - DNA, 1087 bp, Homo sapiens
  misc_feature (1044)..(1044): n is a, c, g, or t
  misc_feature (1047)..(1047): n is a, c, g, or t
  misc_feature (1055)..(1055): n is a, c, g, or t
  misc_feature (1058)..(1058): n is a, c, g, or t
agcgggttgttcccttttcggctctgcaacaccgcctagaccgaccggatacacgggtagggcttccgctttacccgtctccctcctggcgcttgtcctcctctcccagtcggcaccacagcggtggctgccgggcgtggtgtcggtgggtcggttggtttttgtctcaccgttggtgtccgtgccgttcagttgcccgccatggctgagctggatccgttcggcgcccctgccggcgcccctggcggtcccgcgctggggaacggagtggccggcgccggcgaagaagacccggctgcggccttcttggcgcagcaagagagcgagattgcgggcatcgagaacgacgaggccttcgccatcctggacggcggcgcccccgggccccagccgcacggcgagccgccggggggtccggatgctgttgatggagtaatgaatggtgaatactaccaggaaagtaatggtccaacagacagttatgcagctatttcacaagtggatcgattgcagtcagagcctgaaagtatccgtaaatggagagaagaacaaatggaacgcttggaagcccttgatgccaattctcggaagcaagaagcagagtggaaagaaaaggcaataaaggagctagaagaatggtatgcaagacaggacgagcagctacagaaaacaaaagcaaacaacagggcagcagaagaagcctttgtaaatgacattgacgagtcgtccccaggcactgagtgggaacgggtggcccggctgtgtgactttaaccccaagtctagcaagcaggccaaagatgtctcccgcatgcgctcagtcctcatctccctcaagcaggccccgctggtgcactgaagagccaccctgtggaaacactacatctgcaatatcttaatcctactcagtgaagctcttcacagtcattggattaattatgttgagttcttttggaccaaacctttttgtctgtctggtgggatgcgcgttcctctcaagggtttccggctcaaaggggggggagagggggggccccaaaacccnggngggtttgnaantgtgggaaaaaacggttttgggggagggg

SEQ ID NO: 440251 - DNA, 3475 bp, Homo sapiens
  misc_feature (1149)..(1149): n is a, c, g, or t
  misc_feature (1612)..(1612): n is a, c, g, or t
  misc_feature (2195)..(2195): n is a, c, g, or t
agcgggttgttcccttttcggctctgcaacaccgcctagaccgaccggatacacgggtagggcttccgctttacccgtctccctcctggcgcttgtcctcctctcccagtcggcaccacagcggtggctgccgggcgtggtgtcggtgggtcggttggtttttgtctcaccgttggtgtccgtgccgttcagttgcccgccatggctgagctggatccgttcggcgcccctgccggcgcccctggcggtcccgcgctggggaacggagtggccggcgccggcgaagaagacccggctgcggccttcttggcgcagcaagagagcgagattgcgggcatcgagaacgacgaggccttcgccatcctggacggcggcgcccccgggccccagccgcacggcgagccgccggggggtccggatgctgttgatggagtaatgaatggtgaatactaccaggaaagtaatggtccaacagacagttatgcagctatttcacaagtggatcgattgcagtcagagcctgaaagtatccgtaaatggagagaagaacaaatggaacgcttggaagcccttgatgccaattctcggaagcaagaagcagagtggaaagaaaaggcaataaaggagctagaagaatggtatgcaagacaggacgagcagctacagaaaacaaaagcaaacaacagggtggcagatgaagctttctacaaacaacccttcgctgacgtgattggttatgtgtatgttgcaaaactaattcctttttctacatctgattctttctacttttgtttagagttaatgctccttttatgtcacaagttgctttgctttttaaattatttcaaattggcactttgggggctgcctaagaattgataagcggggtatgatctgttgatgaatcttccagatttgtgactccctgcatcctctgatggccatttttcatatttggggttttggagggaagaaagctaactcgctttcaaaatgtgtcatttgcgatcttatctgggaacggtttgaggctcgggggaactctgctctcttgctcttggctgccatcactgctgccatgccctgttgcctgcctgcctcaggtgggaaggaggtttccccacctgggagcaggtggcagtcccaggnggttaggagccagtgagcagcagcaccttgcattgccaaaatcagagctgtggggcagcattttccatacttggttcattcaaacaatgtggggtcgtttgcctctccctcaggcagaagagtccagagcagagggggttgtctccagtgggtgtctataattgttcctctgtggtcttgcatgtcagaaattgctatttagtggtcagcttctgatgtcctgtctcctagcacagggaagcccccagctttgagatcaggatagtcaaagtgtcttgatacgggccacttgggcttctccccctgacccccccaaaagaaacctgcatcttctctggagaaggtgtttttcttattcttttttttttctttttttcttttttcttttttttaaggatttcttttatcaaagcagtattgctgaagagttggaaacagttctcattgtctcctccttaaaaanagggctggctttacatgagaagtaagggtggaatggaagaggagaggaacctgtggaaggtgggcgatgagctcaggtctgtagagcctctcagggcctatgaccttgagatgttcatccccttagaagatagaactgggtttcctgggcccccagatgcatttgcagtgagacttgtgaaatgctggacttacaggtggtgtttgatttgatttctgcacattctctctggagtagaaatggagactggaaaggtcgagtctggttttgctgggcagctgggtggccagcaaagccagctgcacgtccccaagcacagatagagtggcaagggcatgtccagcttactgaccatctgcattgagctcattctcattttctatatctgacttaaagtttctctcgtttcttttcttctcttcacctttaagcacaaacataaaccatccttgctacagcctagaacagttaagtaaacctttctcactgcccctaactgtgtgtgccatgaagtcgcagtgttgtagtggctctgggcttcagcggtgtttgccacggccatccctgtgatagtgccacctcngtccccacagaccagtcatctccattgcttttctttgcccgtgatgcttgttggagtagatgaatatagtgtgtcttagcgctgtcctttccggctgtagctcccaccagttaattccgaactgggggtgggctgaccttgatgtgaaagaatgttggagcagcatcctgccaaaaagcaactcacgttggctctcctgccagtgtgccctgagtggccccaaggcacctggctggagggaaaatggcaaacttttggctgaactggagaatgtcctaacaaacccccttccagaatggctttagtctctagtgcttgctagcatgggagctttgtcttgaattccttttgatctgccccgtttctctccagccttaggaataaatctagaggctattgtgcaatgatctgtgggctttttagaagtctctaaatttccttgaaattcagtacagcccagcataaactactcaagttcttgatcagcctgctgctttgttcttattaataaaagcagtgtgtagctggctaaggacttgttttattaatgctccacaggagcagagacagacagagagacatagtgagccttgaaccaaacacctgtattccaacattttacacagcggtctgggcaccctgtgcctaggagagccagctacgtgtctacctgagtctgacctgggccaggggctgttatcttgggaaagccagaatgtcattaagaaagggacaaataggcagttgcttgtgtagcaaggcagccaccaggttgctcaaagggggttctgcataaaccaacatattttgttgttgcttccagggcagcagaagaagcctttgtaaatgacattgacgagtcgtccccaggcactgagtgggaacgggtggcccggctgtgtgactttaaccccaagtctagcaagcaggccaaagatgtctcccgcatgcgctcagtcctcatctccctcaagcaggccccgctggtgcactgaagagccaccctgtggaaacactacatctgcaatatcttaatcctactcagtgaagctcttcacagtcattggattaattatgttgagttcttttggaccaaacctttttgtctttagagttgttcattgtttgtgattgcatgtttccttccttcaactgtgttctccctggcattcagagaggagggagaggaggaagaggaaggggagggaagcttcccaagagtagcctcaacctgtgcttctgtgcattattctgagaataaatttctgtttcaaactgta

SEQ ID NO: 440252 - DNA, 2172 bp, Homo sapiens
  misc_feature (892)..(892): n is a, c, g, or t
agcgggttgttcccttttcggctctgcaacaccgcctagaccgaccggatacacgggtagggcttccgctttacccgtctccctcctggcgcttgtcctcctctcccagtcggcaccacagcggtggctgccgggcgtggtgtcggtgggtcggttggtttttgtctcaccgttggtgtccgtgccgttcagttgcccgccatggctgagctggatccgttcggcgcccctgccggcgcccctggcggtcccgcgctggggaacggagtggccggcgccggcgaagaagacccggctgcggccttcttggcgcagcaagagagcgagattgcgggcatcgagaacgacgaggccttcgccatcctggacggcggcgcccccgggccccagccgcacggcgagccgccggggggtccggatgctgttgatggagtaatgaatggtgaatactaccaggaaagtaatggtccaacagacagttatgcagctatttcacaagtggatcgattgcagtcagagcctgaaagtatccgtaaatggagagaagaacaaatggaacgcttggaagcccttgatgccaattctcggaagcaagaagcagagtggaaagaaaaggcaataaaggagctagaagaatggtatgcaagacaggacgagcagctacagaaaacaaaagcaaacaacagggtggcagatgaagctttctacaaacaacccttcgctgacgtgattggttatgtcacaaacataaaccatccttgctacagcctagaacagttaagtaaacctttctcactgcccctaactgtgtgtgccatgaagtcgcagtgttgtagtggctctgggcttcagcggtgtttgccacggccatccctgtgatagtgccacctcngtccccacagaccagtcatctccattgcttttctttgcccgtgatgcttgttggagtagatgaatatagtgtgtcttagcgctgtcctttccggctgtagctcccaccagttaattccgaactgggggtgggctgaccttgatgtgaaagaatgttggagcagcatcctgccaaaaagcaactcacgttggctctcctgccagtgtgccctgagtggccccaaggcacctggctggagggaaaatggcaaacttttggctgaactggagaatgtcctaacaaacccccttccagaatggctttagtctctagtgcttgctagcatgggagctttgtcttgaattccttttgatctgccccgtttctctccagccttaggaataaatctagaggctattgtgcaatgatctgtgggctttttagaagtctctaaatttccttgaaattcagtacagcccagcataaactactcaagttcttgatcagcctgctgctttgttcttattaataaaagcagtgtgtagctggctaaggacttgttttattaatgctccacaggagcagagacagacagagagacatagtgagccttgaaccaaacacctgtattccaacattttacacagcggtctgggcaccctgtgcctaggagagccagctacgtgtctacctgagtctgacctgggccaggggctgttatcttgggaaagccagaatgtcattaagaaagggacaaataggcagttgcttgtgtagcaaggcagccaccaggttgctcaaagggggttctgcataaaccaacatattttgttgttgcttccagggcagcagaagaagcctttgtaaatgacattgacgagtcgtccccaggcactgagtgggaacgggtggcccggctgtgtgactttaaccccaagtctagcaagcaggccaaagatgtctcccgcatgcgctcagtcctcatctccctcaagcaggccccgctggtgcactgaagagccaccctgtggaaacactacatctgcaatatcttaatcctactcagtgaagctcttcacagtcattggattaattatgttgagttcttttggaccaaacctttttgtctttagagttgttcattgtttgtgattgcatgtttccttccttcaactgtgttctccctggcattcagagaggagggagaggaggaagaggaaggggagggaagcttcccaagagtagcctcaacctgtgcttctgtgcattattctgagaataaatttctgtttcaaactgta

SEQ ID NO: 440253 - DNA, 1105 bp, Homo sapiens
agcgggttgttcccttttcggctctgcaacaccgcctagaccgaccggatacacgggtagggcttccgctttacccgtctccctcctggcgcttgtcctcctctcccagtcggcaccacagcggtggctgccgggcgtggtgtcggtgggtcggttggtttttgtctcaccgttggtgtccgtgccgttcagttgcccgccatggctgagctggatccgttcggcgcccctgccggcgcccctggcggtcccgcgctggggaacggagtggccggcgccggcgaagaagacccggctgcggccttcttggcgcagcaagagagcgagattgcgggcatcgagaacgacgaggccttcgccatcctggacggcggcgcccccgggccccagccgcacggcgagccgccggggggtccgggaaagtaatggtccaacagacagttatgcagctatttcacaagtggatcgattgcagtcagagcctgaaagtatccgtaaatggagagaagaacaaatggaacgcttggaagcccttgatgccaattctcggaagcaagaagcagagtggaaagaaaaggcaataaaggagctagaagaatggtatgcaagacaggacgagcagctacagaaaacaaaagcaaacaacagggcagcagaagaagcctttgtaaatgacattgacgagtcgtccccaggcactgagtgggaacgggtggcccggctgtgtgactttaaccccaagtctagcaagcaggccaaagatgtctcccgcatgcgctcagtcctcatctccctcaagcaggccccgctggtgcactgaagagccaccctgtggaaacactacatctgcaatatcttaatcctactcagtgaagctcttcacagtcattggattaattatgttgagttcttttggaccaaacctttttgtctttagagttgttcattgtttgtgattgcatgtttccttccttcaactgtgttctccctggcattcagagaggagggagaggaggaagaggaaggggagggaagcttcccaagagtagcctcaacctgtgcttctgtgcattattctgagaataaatttctgtttcaaactgta

SEQ ID NO: 440254 - DNA, 1189 bp, Homo sapiens
agcgggttgttcccttttcggctctgcaacaccgcctagaccgaccggatacacgggtagggcttccgctttacccgtctccctcctggcgcttgtcctcctctcccagtcggcaccacagcggtggctgccgggcgtggtgtcggtgggtcggttggtttttgtctcaccgttggtgtccgtgccgttcagttgcccgccatggctgagctggatccgttcggcgcccctgccggcgcccctggcggtcccgcgctggggaacggagtggccggcgccggcgaagaagacccggctgcggccttcttggcgcagcaagagagcgagattgcgggcatcgagaacgacgaggccttcgccatcctggacggcggcgcccccgggccccagccgcacggcgagccgccggggggtccggatgctgttgatggagtaatgaatggtgaatactaccaggaaagtaatggtccaacagacagttatgcagctatttcacaagtggatcgattgcagtcagagcctgaaagtatccgtaaatggagagaagaacaaatggaacgcttggaagcccttgatgccaattctcggaagcaagaagcagagtggaaagaaaaggcaataaaggagctagaagaatggtatgcaagacaggacgagcagctacagaaaacaaaagcaaacaacagggcagcagaagaagcctttgtaaatgacattgacgagtcgtccccaggcactgagtgggaacgggtggcccggctgtgtgactttaaccccaagtctagcaagcaggccaaagatgtctcccgcatgcgctcagtcctcatctccctcaagcaggccccgctggtgcactgaagagccaccccatcgataaacaccggtgtttatcgatgccacccctggccttcttttgcccgaccaggggtggctggcagataccacccgagagattaagagctgttctctggagttccaatcccacctttaccgtttaatagctgtgtgactttaggtaagttacttaacctctctgtgctttatttcctcacctgtcaaatggtaatcataataggacccaccttagaagaattaaatgggaccatataagctaagtgcttagacatattattctcttccagacatgaaataagcctcttggcctcccgagttacccaagaagatgtgg

SEQ ID NO: 440255 - DNA, 1197 bp, Homo sapiens
agcgggttgttcccttttcggctctgcaacaccgcctagaccgaccggatacacgggtagggcttccgctttacccgtctccctcctggcgcttgtcctcctctcccagtcggcaccacagcggtggctgccgggcgtggtgtcggtgggtcggttggtttttgtctcaccgttggtgtccgtgccgttcagttgcccgccatggctgagctggatccgttcggcgcccctgccggcgcccctggcggtcccgcgctggggaacggagtggccggcgccggcgaagaagacccggctgcggccttcttggcgcagcaagagagcgagattgcgggcatcgagaacgacgaggccttcgccatcctggacggcggcgcccccgggccccagccgcacggcgagccgccggggggtccggatgctgttgatggagtaatgaatggtgaatactaccaggaaagtaatggtccaacagacagttatgcagctatttcacaagtggatcgattgcagtcagagcctgaaagtatccgtaaatggagagaagaacaaatggaacgcttggaagcccttgatgccaattctcggaagcaagaagcagagtggaaagaaaaggcaataaaggagctagaagaatggtatgcaagacaggacgagcagctacagaaaacaaaagcaaacaacagggtggcagatgaagctttctacaaacaacccttcgctgacgtgattggttatgtggcagcagaagaagcctttgtaaatgacattgacgagtcgtccccaggcactgagtgggaacgggtggcccggctgtgtgactttaaccccaagtctagcaagcaggccaaagatgtctcccgcatgcgctcagtcctcatctccctcaagcaggccccgctggtgcactgaagagccaccctgtggaaacactacatctgcaatatcttaatcctactcagtgaagctcttcacagtcattggattaattatgttgagttcttttggaccaaacctttttgtctttagagttgttcattgtttgtgattgcatgtttccttccttcaactgtgttctccctggcattcagagaggagggagaggaggaagaggaaggggagggaagcttcccaagagtagcctcaacctgtgcttctgtgcattattctgagaataaatttctgtttcaaactgta

SEQ ID NO: 440256 - DNA, 3587 bp, Homo sapiens
  misc_feature (1149)..(1149): n is a, c, g, or t
  misc_feature (1612)..(1612): n is a, c, g, or t
  misc_feature (2195)..(2195): n is a, c, g, or t
  misc_feature (3536)..(3536): n is a, c, g, or t
  misc_feature (3545)..(3545): n is a, c, g, or t
  misc_feature (3549)..(3549): n is a, c, g, or t
  misc_feature (3562)..(3562): n is a, c, g, or t
  misc_feature (3574)..(3574): n is a, c, g, or t
  misc_feature (3581)..(3581): n is a, c, g, or t
  misc_feature (3584)..(3584): n is a, c, g, or t
agcgggttgttcccttttcggctctgcaacaccgcctagaccgaccggatacacgggtagggcttccgctttacccgtctccctcctggcgcttgtcctcctctcccagtcggcaccacagcggtggctgccgggcgtggtgtcggtgggtcggttggtttttgtctcaccgttggtgtccgtgccgttcagttgcccgccatggctgagctggatccgttcggcgcccctgccggcgcccctggcggtcccgcgctggggaacggagtggccggcgccggcgaagaagacccggctgcggccttcttggcgcagcaagagagcgagattgcgggcatcgagaacgacgaggccttcgccatcctggacggcggcgcccccgggccccagccgcacggcgagccgccggggggtccggatgctgttgatggagtaatgaatggtgaatactaccaggaaagtaatggtccaacagacagttatgcagctatttcacaagtggatcgattgcagtcagagcctgaaagtatccgtaaatggagagaagaacaaatggaacgcttggaagcccttgatgccaattctcggaagcaagaagcagagtggaaagaaaaggcaataaaggagctagaagaatggtatgcaagacaggacgagcagctacagaaaacaaaagcaaacaacagggtggcagatgaagctttctacaaacaacccttcgctgacgtgattggttatgtgtatgttgcaaaactaattcctttttctacatctgattctttctacttttgtttagagttaatgctccttttatgtcacaagttgctttgctttttaaattatttcaaattggcactttgggggctgcctaagaattgataagcggggtatgatctgttgatgaatcttccagatttgtgactccctgcatcctctgatggccatttttcatatttggggttttggagggaagaaagctaactcgctttcaaaatgtgtcatttgcgatcttatctgggaacggtttgaggctcgggggaactctgctctcttgctcttggctgccatcactgctgccatgccctgttgcctgcctgcctcaggtgggaaggaggtttccccacctgggagcaggtggcagtcccaggnggttaggagccagtgagcagcagcaccttgcattgccaaaatcagagctgtggggcagcattttccatacttggttcattcaaacaatgtggggtcgtttgcctctccctcaggcagaagagtccagagcagagggggttgtctccagtgggtgtctataattgttcctctgtggtcttgcatgtcagaaattgctatttagtggtcagcttctgatgtcctgtctcctagcacagggaagcccccagctttgagatcaggatagtcaaagtgtcttgatacgggccacttgggcttctccccctgacccccccaaaagaaacctgcatcttctctggagaaggtgtttttcttattcttttttttttctttttttcttttttcttttttttaaggatttcttttatcaaagcagtattgctgaagagttggaaacagttctcattgtctcctccttaaaaanagggctggctttacatgagaagtaagggtggaatggaagaggagaggaacctgtggaaggtgggcgatgagctcaggtctgtagagcctctcagggcctatgaccttgagatgttcatccccttagaagatagaactgggtttcctgggcccccagatgcatttgcagtgagacttgtgaaatgctggacttacaggtggtgtttgatttgatttctgcacattctctctggagtagaaatggagactggaaaggtcgagtctggttttgctgggcagctgggtggccagcaaagccagctgcacgtccccaagcacagatagagtggcaagggcatgtccagcttactgaccatctgcattgagctcattctcattttctatatctgacttaaagtttctctcgtttcttttcttctcttcacctttaagcacaaacataaaccatccttgctacagcctagaacagttaagtaaacctttctcactgcccctaactgtgtgtgccatgaagtcgcagtgttgtagtggctctgggcttcagcggtgtttgccacggccatccctgtgatagtgccacctcngtccccacagaccagtcatctccattgcttttctttgcccgtgatgcttgttggagtagatgaatatagtgtgtcttagcgctgtcctttccggctgtagctcccaccagttaattccgaactgggggtgggctgaccttgatgtgaaagaatgttggagcagcatcctgccaaaaagcaactcacgttggctctcctgccagtgtgccctgagtggccccaaggcacctggctggagggaaaatggcaaacttttggctgaactggagaatgtcctaacaaacccccttccagaatggctttagtctctagtgcttgctagcatgggagctttgtcttgaattccttttgatctgccccgtttctctccagccttaggaataaatctagaggctattgtgcaatgatctgtgggctttttagaagtctctaaatttccttgaaattcagtacagcccagcataaactactcaagttcttgatcagcctgctgctttgttcttattaataaaagcagtgtgtagctggctaaggacttgttttattaatgctccacaggagcagagacagacagagagacatagtgagccttgaaccaaacacctgtattccaacattttacacagcggtctgggcaccctgtgcctaggagagccagctacgtgtctacctgagtctgacctgggccaggggctgttatcttgggaaagccagaatgtcattaagaaagggacaaataggcagttgcttgtgtagcaaggcagccaccaggttgctcaaagggggttctgcataaaccaacatattttgttgttgcttccagggcagcagaagaagcctttgtaaatgacattgacgagtcgtccccaggcactgagtgggaacgggtggcccggctgtgtgactttaaccccaagtctagcaagcaggccaaagatgtctcccgcatgcgctcagtcctcatctccctcaagcaggccccgctggtgcactgaagagccaccctgtggaaacactacatctgcaatatcttaatcctactcagtgaagctcttcacagtcattggattaattatgttgagttcttttggaccaaacctttttgtctttagagttgttcattgtttgtgattgcatgtttccttccttcaactgtgttctccctggcattcagagaggagggagaggaggaagaggaaggggagggaagcttcccaagagtagcctcaacctgtgcttctgtgcattattctgagaataaatttctgtttcaaactgtaaaaaaaaaaaaaaaaaaaaaaaacaaacacacaaaaacacaaaaacacaaaaaaaaaaacnaaaacacanaaancaaacacacacanacaccacaccancaaaaancanaca

SEQ ID NO: 440257 - DNA, 1147 bp, Homo sapiens
  misc_feature (1096)..(1096): n is a, c, g, or t
  misc_feature (1105)..(1105): n is a, c, g, or t
  misc_feature (1109)..(1109): n is a, c, g, or t
  misc_feature (1122)..(1122): n is a, c, g, or t
  misc_feature (1134)..(1134): n is a, c, g, or t
  misc_feature (1141)..(1141): n is a, c, g, or t
  misc_feature (1144)..(1144): n is a, c, g, or t
agcgggttgttcccttttcggctctgcaacaccgcctagaccgaccggatacacgggtagggcttccgctttacccgtctccctcctggcgcttgtcctcctctcccagtcggcaccacagcggtggctgccgggcgtggtgtcggtgggtcggttggtttttgtctcaccgttggtgtccgtgccgttcagttgcccgccatggctgagctggatccgttcggcgcccctgccggcgcccctggcggtcccgcgctggggaacggagtggccggcgccggcgaagaagacccggctgcggccttcttggcgcagcaagagagcgagattgcgggcatcgagaacgacgaggccttcgccatcctggacggcggcgcccccgggccccagccgcacggcgagccgccggggggtccggatgctgttgatggagtaatgaatggtgaatactaccaggaaagtaatggtccaacagacagttatgcagctatttcacaagtggatcgattgcagtcagagcctgaaagtatccgtaaatggagagaagaacaaatggaacgcttggaagcccttgatgccaattctcggaagcaagaagcagagtggaaagaaaaggcaataaaggagctagaagaatggtatgcaagacaggacgagcagctacagaaaacaaaagcaaacaacagggcagcagaagaagcctttgtaaatgacattgacgagtcgtccccaggcactgagtgggaacgggtggcccggctgtgtgactttaaccccaagtctagcaagcaggccaaagatgtctcccgcaacagtcattggattaattatgttgagttcttttggaccaaacctttttgtctttagagttgttcattgtttgtgattgcatgtttccttccttcaactgtgttctccctggcattcagagaggagggagaggaggaagaggaaggggagggaagcttcccaagagtagcctcaacctgtgcttctgtgcattattctgagaataaatttctgtttcaaactgtaaaaaaaaaaaaaaaaaaaaaaaacaaacacacaaaaacacaaaaacacaaaaaaaaaaacnaaaacacanaaancaaacacacacanacaccacaccancaaaaancanaca

SEQ ID NO: 440258 - DNA, 979 bp, Homo sapiens
agcgggttgttcccttttcggctctgcaacaccgcctagaccgaccggatacacgggtagggcttccgctttacccgtctccctcctggcgcttgtcctcctctcccagtcggcaccacagcggtggctgccgggcgtggtgtcggtgggtcggttggtttttgtctcaccgttggtgtccgtgccgttcagttgcccgccatggctgagctggatccgttcggcgcccctgccggcgcccctggcggtcccgcgctggggaacggagtggccggcgccggcgaagaagacccggctgcggccttcttggcgcagcaagagagcgagattgcgggcatcgagaacgacgaggccttcgccatcctggacggcggcgcccccgggccccagccgcacggcgagccgccggggggtccggatgctgttgatggagtaatgaatggtgaatactaccaggaaagtaatggtccaacagacagttatgcagctatttcacaagtggatcgattgcagtcagagcctgaaagtatccgtaaatggagagaagaacaaatggaacgcttggaagcccttgatgccaattctcggaagcaagaagcagagtggaaagaaaaggcaataaaggagctagaagaatggtatgcaagacaggacgagcagctacagaaaacaaaagcaaacaacagggcagcagaagaagcctttgtaaatgacattgacgagtcgtccccaggcactgagtgggaacgggtggcccggctgtgtgactttaaccccaagtctagcaagcaggccaaagatgtctcccgcacggtgggccagctatttctcagaggccgggggctgagacccggtggactattgggttacttccggggcccagcttgttttgtggccttgccccttgttggtgccttgggggtcccggtccggaggggggggggggcccccctggtttgtgtcaaaagcgcctgggtgg

SEQ ID NO: 440259 - DNA, 1077 bp, Homo sapiens
agcgggttgttcccttttcggctctgcaacaccgcctagaccgaccggatacacgggtagggcttccgctttacccgtctccctcctggcgcttgtcctcctctcccagtcggcaccacagcggtggctgccgggcgtggtgtcggtgggtcggttggtttttgtctcaccgttggtgtccgtgccgttcagttgcccgccatggctgagctggatccgttcggcgcccctgccggcgcccctggcggtcccgcgctggggaacggagtggccggcgccggcgaagaagacccggctgcggccttcttggcgcagcaagagagcgagattgcgggcatcgagaacgacgaggccttcgccatcctggacggcggcgcccccgggccccagccgcacggcgagccgccggggggtccggatgccaattctcggaagcaagaagcagagtggaaagaaaaggcaataaaggagctagaagaatggtatgcaagacaggacgagcagctacagaaaacaaaagcaaacaacagggtggcagatgaagctttctacaaacaacccttcgctgacgtgattggttatgtcacaaacataaaccatccttgctacagcctagaacaggcagcagaagaagcctttgtaaatgacattgacgagtcgtccccaggcactgagtgggaacgggtggcccggctgtgtgactttaaccccaagtctagcaagcaggccaaagatgtctcccgcatgcgctcagtcctcatctccctcaagcaggccccgctggtgcactgaagagccaccctgtggaaacactacatctgcaatatcttaatcctactcagtgaagctcttcacagtcattggattaattatgttgagttcttttggaccaaacctttttgtctttagagttgttcattgtttgtgattgcatgtttccttccttcaactgtgttctccctggcattcagagaggagggagaggaggaagaggaaggggagggaagcttcccaagagtagcctcaacctgtgcttctgtgcattattctgagaataaatttctgtttcaaactgta

SEQ ID NO: 440260 - DNA, 1195 bp, Homo sapiens
agcgggttgttcccttttcggctctgcaacaccgcctagaccgaccggatacacgggtagggcttccgctttacccgtctccctcctggcgcttgtcctcctctcccagtcggcaccacagcggtggctgccgggcgtggtgtcggtgggtcggttggtttttgtctcaccgttggtgtccgtgccgttcagttgcccgccatggctgagctggatccgttcggcgcccctgccggcgcccctggcggtcccgcgctggggaacggagtggccggcgccggcgaagaagacccggctgcggccttcttggcgcagcaagagagcgagattgcgggcatcgagaacgacgaggccttcgccatcctggacggcggcgcccccgggccccagccgcacggcgagccgccggggggtccgggaaagtaatggtccaacagacagttatgcagctatttcacaagtggatcgattgcagtcagagcctgaaagtatccgtaaatggagagaagaacaaatggaacgcttggaagcccttgatgccaattctcggaagcaagaagcagagtggaaagaaaaggcaataaaggagctagaagaatggtatgcaagacaggacgagcagctacagaaaacaaaagcaaacaacagggtggcagatgaagctttctacaaacaacccttcgctgacgtgattggttatgtcacaaacataaaccatccttgctacagcctagaacaggcagcagaagaagcctttgtaaatgacattgacgagtcgtccccaggcactgagtgggaacgggtggcccggctgtgtgactttaaccccaagtctagcaagcaggccaaagatgtctcccgcatgcgctcagtcctcatctccctcaagcaggccccgctggtgcactgaagagccaccctgtggaaacactacatctgcaatatcttaatcctactcagtgaagctcttcacagtcattggattaattatgttgagttcttttggaccaaacctttttgtctttagagttgttcattgtttgtgattgcatgtttccttccttcaactgtgttctccctggcattcagagaggagggagaggaggaagaggaaggggagggaagcttcccaagagtagcctcaacctgtgcttctgtgcattattctgagaataaatttctgtttcaaactgta

SEQ ID NO: 440261 - DNA, 1058 bp, Homo sapiens
  misc_feature (932)..(932): n is a, c, g, or t
  misc_feature (1058)..(1058): n is a, c, g, or t
agcgggttgttcccttttcggctctgcaacaccgcctagaccgaccggatacacgggtagggcttccgctttacccgtctccctcctggcgcttgtcctcctctcccagtcggcaccacagcggtggctgccgggcgtggtgtcggtgggtcggttggtttttgtctcaccgttggtgtccgtgccgttcagttgcccgccatggctgagctggatccgttcggcgcccctgccggcgcccctggcggtcccgcgctggggaacggagtggccggcgccggcgaagaagacccggctgcggccttcttggcgcagcaagagagcgagattgcgggcatcgagaacgacgaggccttcgccatcctggacggcggcgcccccgggccccagccgcacggcgagccgccggggggtccggatgctgttgatggagtaatgaatggtgaatactaccaggaaagtaatggtccaacagacagttatgcagctatttcacaagtggatcgattgcagtcagagcctgaaagtatccgtaaatggagagaagaacaaatggaacgcttggaagcccttgatgccaattctcggaagcaagaagcagagtggaaagaaaaggcaataaaggagctagaagaatggtatgcaagacaggacgagcagctacagaaaacaaaagcaaacaacagctgtgcttctgtgcattattctgagaataaatttctgtttcaaactgtaaaaaaaataacgacaaaaaaacaaaaacgtgggcgcttttatgtcgggggggggaaaaaaaaggggtattgaagggggcgtggggcaattggttgtttccgtgcacccggtttttgtgtacagggggactctgggggggcccataagggagaggggataaattgaaacgcgggttacctgtgtgtttgtggtgaaangaagagaaaaaaagaagtgagtataaatttacaaagaggtagagagaggaaacaagtatatatgcagaaaaaaagaatatcgataataataagagaagagtaaagagaaggtgagagatactaagn

SEQ ID NO: 440262 - DNA, 693 bp, Homo sapiens
  misc_feature (71)..(71): n is a, c, g, or t
  misc_feature (78)..(78): n is a, c, g, or t
  misc_feature (91)..(92): n is a, c, g, or t
  misc_feature (642)..(642): n is a, c, g, or t
  misc_feature (651)..(651): n is a, c, g, or t
  misc_feature (655)..(655): n is a, c, g, or t
  misc_feature (668)..(668): n is a, c, g, or t
  misc_feature (680)..(680): n is a, c, g, or t
  misc_feature (687)..(687): n is a, c, g, or t
  misc_feature (690)..(690): n is a, c, g, or t
aagagcgcccccaacaataaggggattttgggcccctcgagggccaagtatttcgggcgcagggcaggctncagaaancaaaagcaaacannagggcagcagaagaagcctttgtaaatgacattgacgagtcgtccccaggcactgagtgggaacgggtggcccggctgtgtgactttaaccccaagtctagcaagcaggccaaagatgtctcccgcatgcgctcagtcctcatctccctcaagcaggccccgctggtgcactgaagagccaccctgtggaaacactacatctgcaatatcttaatcctactcagtgaagctcttcacagtcattggattaattatgttgagttcttttggaccaaacctttttgtctttagagttgttcattgtttgtgattgcatgtttccttccttcaactgtgttctccctggcattcagagaggagggagaggaggaagaggaaggggagggaagcttcccaagagtagcctcaacctgtgcttctgtgcattattctgagaataaatttctgtttcaaactgtaaaaaaaaaaaaaaaaaaaaaacaaaaaaaaaaaaaaaaaaaaaaaaaaaaaaacaaacacacaaaaacacaaaaacacaaaaaaaaaaacnaaaacacanaaancaaacacacacanacaccacaccancaaaaancanaca

SEQ ID NO: 440263 - DNA, 767 bp, Homo sapiens
  misc_feature (605)..(605): n is a, c, g, or t
agcgggttgttcccttttcggctctgcaacaccgcctagaccgaccggatacacgggtagggcttccgctttacccgtctccctcctggcgcttgtcctcctctcccagtcggcaccacagcggtggctgccgggcgtggtgtcggtgggtcggttggtttttgtctcaccgttggtgtccgtgccgttcagttgcccgccatggctgagctggatccgttcggcgcccctgccggcgcccctggcggtcccgcgctggggaacggagtggccggcgccggcgaagaagacccggctgcggccttcttggcgcagcaagagagcgagattgcgggcatcgagaacgacgaggccttcgccatcctggacggcggcgcccccgggccccagccgcacggcgagccgccggggggtccggatgctgttgatggagtaatgaatggtgaatactaccaggaaagtaatggtccaacagacagttatgcagctatttcacaagtggatcgattgcagtcagagccttccaattctcttaaccaataacatactcgtacaattatacaatatatgatctacaataatggtattcaacacatgacgatcancttcttaatacatttacaaaccaacattcaccatataagcctttctaataacatttactattctcctcaacacttataggaacatgtaccccacttattactttaacccaatcttacaacatccacaaattctcaccatcactaatcctcatttgcttaact

SEQ ID NO: 440264 - DNA, 166 bp, Homo sapiens
atgctgttgatggagtaatgaatggtgaatactaccaggtacagagtactctgattctgttcattgatagtgattgagaatcttcctttcctgtgattttaattgactgacctagaaagaaaccccagtcctttgactttcctgaatgtattactggctggtgtgt

SEQ ID NO: 440265 - DNA, 387 bp, Homo sapiens
agaccaggcaggaatagaagcactgaaatcagagttggttgtgcaaacagagaaaacagaagtttatcttcccctctctactcttctcccccaacaggcacacagacatggacctgcacccaccacaagttcagcaagaccaaaataaactgatgaacttcagtttgcactttgcctcaattgtattgtctttctcttctctcccttcaaagatgccaattctcggaagcaagaagcagagtggaaagaaaaggcaataaaggagctagaagaatggtatgcaagacaggacgagcagctacagaaaacaaaagcaaacaacaggtcagtccgtggtggttgtagcacactttgttttccaaaattgaatcaaatccattctcagca

SEQ ID NO: 440266 - DNA, 1086 bp, Homo sapiens
cggtgcctctcgccccgtttgtccccccgccggctggtccggtccggccttcccgggctcgcagcggtggctgccgggcgtggtgtcggtgggtcggttggtttttgtctcaccgttggtgtccgtgccgttcagttgcccgccatggctgagctggatccgttcggcgcccctgccggcgcccctggcggtcccgcgctggggaacggagtggccggcgccggcgaagaagacccggctgcggccttcttggcgcagcaagagagcgagattgcgggcatcgagaacgacgaggccttcgccatcctggacggcggcgcccccgggccccagccgcacggcgagccgccggggggtccggatgctgttgatggagtaatgaatggtgaatactaccaggaaagtaatggtccaacagacagttatgcagctatttcacaagtggatcgattgcagtcagagcctgaaagtatccgtaaatggagagaagaacaaatggaacgcttggaagcccttgatgccaattctcggaagcaagaagcagagtggaaagaaaaggcaataaaggagctagaagaatggtatgcaagacaggacgagcagctacagaaaacaaaagcaaacaacagggcagcagaagaagcctttgtaaatgacattgacgagtcgtccccaggcactgagtgggaacgggtggcccggctgtgtgactttaaccccaagtctagcaagcaggccaaagatgtctcccgcatgcgctcagtcctcatctccctcaagcaggccccgctggtgcactgaagagccaccctgtggaaacactacatctgcaatatcttaatcctactcagtgaagctcttcacagtcattggattaattatgttgagttcttttggaccaaacctttttgtctttagagttgttcattgtttgtgattgcatgtttccttccttcaactgtgttctccctggcattcagagaggagggagaggaggaagaggaaggggagggaagcttcccaagagtagcctcaacctgtgcttctgtgcattattctgagaataaatttctgtttcaaactgta

SEQ ID NO: 440267 - DNA, 909 bp, Homo sapiens
  misc_feature (9)..(9): n is a, c, g, or t
gagggcaanaaaaacgaaataggctaggtacgaggctgggtgttggtctccctcctggcgcttgtcctcctctcccagtcggcaccacagcggtggctgccgggcgtggtgtcggtgggtcggttggtttttgtctcaccgttggtgtccgtgccgttcagttgcccgccatggctgagctggatccgttcggcgcccctgccggcgcccctggcggtcccgcgctggggaacggagtggccggcgccggcgaagaagacccggctgcggccttcttggcgcagcaagagagcgagattgcgggcatcgagaacgacgaggccttcgccatcctggacggcggcgcccccgggccccagccgcacggcgagccgccggggggtccggatgctgttgatggagtaatgaatggtgaatactaccaggaaagtaatggtccaacagacagttatgcagctatttcacaagtggatcgattgcagtcagagcctgaaagtatccgtaaatggagagaagaacaaatggaacgcttggaagcccttgatgccaattctcggaagcaagaagcagagtggaaagaaaaggcaataaaggagctagaagaatggtatgcaagacaggacgagcagctacagaaaacaaaagcaaacaacagggcagcagaagaagcctttgtaaatgacattgacgagtcgtccccaggcactgagtgggaacgggtggcccggctgtgtgactttaaccccaagtctagcaagcaggccaaagatgtctcccgcatgcgctcagtcctcatctccctcaagcaggccccgctggtgcactgaagagccacccttgaggccccgtggacctcctggttttaccccggggcctccgctgggttttgggttggcccttgttggcttt

SEQ ID NO: 440268 - DNA, 948 bp, Homo sapiens
  misc_feature (9)..(9): n is a, c, g, or t
gagggcaanaaaaacgaaataggctaggtacgaggctgggtgttggtctccctcctggcgcttgtcctcctctcccagtcggcaccacagcggtggctgccgggcgtggtgtcggtgggtcggttggtttttgtctcaccgttggtgtccgtgccgttcagttgcccgccatggctgagctggatccgttcggcgcccctgccggcgcccctggcggtcccgcgctggggaacggagtggccggcgccggcgaagaagacccggctgcggccttcttggcgcagcaagagagcgagattgcgggcatcgagaacgacgaggccttcgccatcctggacggcggcgcccccgggccccagccgcacggcgagccgccggggggtccggatgctgttgatggagtaatgaatggtgaatactaccaggaaagtaatggtccaacagacagttatgcagctatttcacaagtggatcgattgcagtcagagcctgaaagtatccgtaaatggagagaagaacaaatggaacgcttggaagcccttgatgccaattctcggaagcaagaagcagagtggaaagaaaaggcaataaaggagctagaagaatggtatgcaagacaggacgagcagctacagaaaacaaaagcaaacaacagggcagcagaagaagcctttgtaaatgacattgacgagtcgtccccaggcactgagtgggaacgggtggcccggctgtgtgactttaaccccaagtctagcaagcaggccaaagatgtctcccgcacggtgggccagctatttctcagaggccgggggctgagacccggtggactattgggttacttccggggcccagcttgttttgtggccttgccccttgttggtgccttgggggtcccggtccggaggggggggggggcccccctggtttgtgtcaaaagcgcctgggtgg

SEQ ID NO: 440269 - DNA, 1102 bp, Homo sapiens
  misc_feature (3)..(3): n is a, c, g, or t
  misc_feature (17)..(17): n is a, c, g, or t
atngctagtacgaggcntggtgttgaatcggccgagtctccctcctggcgcttgtcctcctctcccagtcggcaccacagcggtggctgccgggcgtggtgtcggtgggtcggttggtttttgtctcaccgttggtgtccgtgccgttcagttgcccgccatggctgagctggatccgttcggcgcccctgccggcgcccctggcggtcccgcgctggggaacggagtggccggcgccggcgaagaagacccggctgcggccttcttggcgcagcaagagagcgagattgcgggcatcgagaacgacgaggccttcgccatcctggacggcggcgcccccgggccccagccgcacggcgagccgccggggggtccggatgctgttgatggagtaatgaatggtgaatactaccaggaaagtaatggtccaacagacagttatgcagctatttcacaagtggatcgattgcagtcagagcctgaaagtatccgtaaatggagagaagaacaaatggaacgcttggaagcccttgatgccaattctcggaagcaagaagcagagtggaaagaaaaggcaataaaggagctagaagaatggtatgcaagacaggacgagcagctacagaaaacaaaagcaaacaacagggcagcagaagaagcctttgtaaatgacattgacgagtcgtccccaggcactgagtgggaacgggtggcccggctgtgtgactttaaccccaagtctagcaagcaggccaaagatgtctcccgcatgcgctcagtcctcatctccctcaagcaggccccgctggtgcactgaagagccaccctgtggaaacactacatctgcaatatcttaatcctactcagtgaagctcttcacagtcattggattaattatgttgagttcttttggaccaaacctttttgtctttagagttgttcattgtttgtgattgcatgtttccttccttcaactgtgttctccctggcattcagagaggagggagaggaggaagaggaaggggagggaagcttcccaagagtagcctcaacctgtgcttctgtgcattattctgagaataaatttctgtttcaaactgta

SEQ ID NO: 440270 - DNA, 1255 bp, Homo sapiens
  misc_feature (1204)..(1204): n is a, c, g, or t
  misc_feature (1213)..(1213): n is a, c, g, or t
  misc_feature (1217)..(1217): n is a, c, g, or t
  misc_feature (1230)..(1230): n is a, c, g, or t
  misc_feature (1242)..(1242): n is a, c, g, or t
  misc_feature (1249)..(1249): n is a, c, g, or t
  misc_feature (1252)..(1252): n is a, c, g, or t
agcgggttgttcccttttcggctctgcaacaccgcctagaccgaccggatacacgggtagggcttccgctttacccgtctccctcctggcgcttgtcctcctctcccagtcggcaccacagcggtggctgccgggcgtggtgtcggtgggtcggttggtttttgtctcaccgttggtgtccgtgccgttcagttgcccgccatggctgagctggatccgttcggcgcccctgccggcgcccctggcggtcccgcgctggggaacggagtggccggcgccggcgaagaagacccggctgcggccttcttggcgcagcaagagagcgagattgcgggcatcgagaacgacgaggccttcgccatcctggacggcggcgcccccgggccccagccgcacggcgagccgccggggggtccggatgctgttgatggagtaatgaatggtgaatactaccaggaaagtaatggtccaacagacagttatgcagctatttcacaagtggatcgattgcagtcagagcctgaaagtatccgtaaatggagagaagaacaaatggaacgcttggaagcccttgatgccaattctcggaagcaagaagcagagtggaaagaaaaggcaataaaggagctagaagaatggtatgcaagacaggacgagcagctacagaaaacaaaagcaaacaacagggcagcagaagaagcctttgtaaatgacattgacgagtcgtccccaggcactgagtgggaacgggtggcccggctgtgtgactttaaccccaagtctagcaagcaggccaaagatgtctcccgcatgcgctcagtcctcatctccctcaagcaggccccgctggtgcactgaagagccaccctgtggaaacactacatctgcaatatcttaatcctactcagtgaagctcttcacagtcattggattaattatgttgagttcttttggaccaaacctttttgtctttagagttgttcattgtttgtgattgcatgtttccttccttcaactgtgttctccctggcattcagagaggagggagaggaggaagaggaaggggagggaagcttcccaagagtagcctcaacctgtgcttctgtgcattattctgagaataaatttctgtttcaaactgtaaaaaaaaaaaaaaaaaaaaaaaacaaacacacaaaaacacaaaaacacaaaaaaaaaaacnaaaacacanaaancaaacacacacanacaccacaccancaaaaancanaca

SEQ ID NO: 440271 - DNA, 1056 bp, Homo sapiens
tggctgtgagcctggagtaatcggcgaggcacagcggtggctgccgggcgtggtgtcggtgggtcggttggtttttgtctcaccgttggtgtccgtgccgttcagttgcccgccatggctgagctggatccgttcggcgcccctgccggcgcccctggcggtcccgcgctggggaacggagtggccggcgccggcgaagaagacccggctgcggccttcttggcgcagcaagagagcgagattgcgggcatcgagaacgacgaggccttcgccatcctggacggcggcgcccccgggccccagccgcacggcgagccgccggggggtccggatgctgttgatggagtaatgaatggtgaatactaccaggaaagtaatggtccaacagacagttatgcagctatttcacaagtggatcgattgcagtcagagcctgaaagtatccgtaaatggagagaagaacaaatggaacgcttggaagcccttgatgccaattctcggaagcaagaagcagagtggaaagaaaaggcaataaaggagctagaagaatggtatgcaagacaggacgagcagctacagaaaacaaaagcaaacaacagggcagcagaagaagcctttgtaaatgacattgacgagtcgtccccaggcactgagtgggaacgggtggcccggctgtgtgactttaaccccaagtctagcaagcaggccaaagatgtctcccgcatgcgctcagtcctcatctccctcaagcaggccccgctggtgcactgaagagccaccctgtggaaacactacatctgcaatatcttaatcctactcagtgaagctcttcacagtcattggattaattatgttgagttcttttggaccaaacctttttgtctttagagttgttcattgtttgtgattgcatgtttccttccttcaactgtgttctccctggcattcagagaggagggagaggaggaagaggaaggggagggaagcttcccaagagtagcctcaacctgtgcttctgtgcattattctgagaataaatttctgtttcaaactgta

SEQ ID NO: 440272 - DNA, 1070 bp, Homo sapiens
  misc_feature (9)..(9): n is a, c, g, or t
gagggcaanaaaaacgaaataggctaggtacgaggctgggtgttgcagcggtggctgccgggcgtggtgtcggtgggtcggttggtttttgtctcaccgttggtgtccgtgccgttcagttgcccgccatggctgagctggatccgttcggcgcccctgccggcgcccctggcggtcccgcgctggggaacggagtggccggcgccggcgaagaagacccggctgcggccttcttggcgcagcaagagagcgagattgcgggcatcgagaacgacgaggccttcgccatcctggacggcggcgcccccgggccccagccgcacggcgagccgccggggggtccggatgctgttgatggagtaatgaatggtgaatactaccaggaaagtaatggtccaacagacagttatgcagctatttcacaagtggatcgattgcagtcagagcctgaaagtatccgtaaatggagagaagaacaaatggaacgcttggaagcccttgatgccaattctcggaagcaagaagcagagtggaaagaaaaggcaataaaggagctagaagaatggtatgcaagacaggacgagcagctacagaaaacaaaagcaaacaacagggcagcagaagaagcctttgtaaatgacattgacgagtcgtccccaggcactgagtgggaacgggtggcccggctgtgtgactttaaccccaagtctagcaagcaggccaaagatgtctcccgcatgcgctcagtcctcatctccctcaagcaggccccgctggtgcactgaagagccaccctgtggaaacactacatctgcaatatcttaatcctactcagtgaagctcttcacagtcattggattaattatgttgagttcttttggaccaaacctttttgtctttagagttgttcattgtttgtgattgcatgtttccttccttcaactgtgttctccctggcattcagagaggagggagaggaggaagaggaaggggagggaagcttcccaagagtagcctcaacctgtgcttctgtgcattattctgagaataaatttctgtttcaaactgta

SEQ ID NO: 440273 - DNA, 1084 bp, Homo sapiens
  misc_feature (963)..(965): n is a, c, g, or t
  misc_feature (968)..(968): n is a, c, g, or t
  misc_feature (975)..(975): n is a, c, g, or t
  misc_feature (991)..(991): n is a, c, g, or t
agcgggttgttcccttttcggctctgcaacaccgcctagaccgaccggatacacgggtagggcttccgctttacccgtctccctcctggcgcttgtcctcctctcccagtcggcaccacagcggtggctgccgggcgtggtgtcggtgggtcggttggtttttgtctcaccgttggtgtccgtgccgttcagttgcccgccatggctgagctggatccgttcggcgcccctgccggcgcccctggcggtcccgcgctggggaacggagtggccggcgccggcgaagaagacccggctgcggccttcttggcgcagcaagagagcgagattgcgggcatcgagaacgacgaggccttcgccatcctggacggcggcgcccccgggccccagccgcacggcgagccgccggggggtccggatgctgttgatggagtaatgaatggtgaatactaccaggaaagtaatggtccaacagacagttatgcagctatttcacaagtggatcgattgcagtcagagcctgaaagtatccgtaaatggagagaagaacaaatggaacgcttggaagcccttgatgccaattctcggaagcaagaagcagagtggaaagaaaaggcaataaaggagctagaagaatggtatgcaagacaggacgagcagctacagaaaacaaaagcaaacaacagggcagcagaagaagcctttgtaaatgacattgacgagtcgtccccaggcactgagtgggaacgggtggcccggctgtgtgactttaaccccaagtctagcaagcaggccaaagatgtctcccgcatgcgctcagtcctcatctccctcaagcaggccccgctggtgcactgaagagccaccctgtggaaacactacatctgcaatatcttaatcctactcagtgaagctcttcccagcctgggttataagtcgggctttgggccaccttgttaaatnnnacngggaagngtctcaaggtcccggntaaaggaagaaaaagagaacacaaacaagagtggtataaatttagaaaaaggtaacgagacacaaaacagaaaggaagaatacaaactagtta

SEQ ID NO: 440274 - DNA, 1233 bp, Homo sapiens
agcgggttgttcccttttcggctctgcaacaccgcctagaccgaccggatacacgggtagggcttccgctttacccgtctccctcctggcgcttgtcctcctctcccagtcggcaccacagcggtggctgccgggcgtggtgtcggtgggtcggttggtttttgtctcaccgttggtgtccgtgccgttcagttgcccgccatggctgagctggatccgttcggcgcccctgccggcgcccctggcggtcccgcgctggggaacggagtggccggcgccggcgaagaagacccggctgcggccttcttggcgcagcaagagagcgagattgcgggcatcgagaacgacgaggccttcgccatcctggacggcggcgcccccgggccccagccgcacggcgagccgccggggggtccggatgctgttgatggagtaatgaatggtgaatactaccaggaaagtaatggtccaacagacagttatgcagctatttcacaagtggatcgattgcagtcagagcctgaaagtatccgtaaatggagagaagaacaaatggaacgcttggaagcccttgatgccaattctcggaagcaagaagcagagtggaaagaaaaggcaataaaggagctagaagaatggtatgcaagacaggacgagcagctacagaaaacaaaagcaaacaacagggtggcagatgaagctttctacaaacaacccttcgctgacgtgattggttatgtcacaaacataaaccatccttgctacagcctagaacaggcagcagaagaagcctttgtaaatgacattgacgagtcgtccccaggcactgagtgggaacgggtggcccggctgtgtgactttaaccccaagtctagcaagcaggccaaagatgtctcccgcatgcgctcagtcctcatctccctcaagcaggccccgctggtgcactgaagagccaccctgtggaaacactacatctgcaatatcttaatcctactcagtgaagctcttcacagtcattggattaattatgttgagttcttttggaccaaacctttttgtctttagagttgttcattgtttgtgattgcatgtttccttccttcaactgtgttctccctggcattcagagaggagggagaggaggaagaggaaggggagggaagcttcccaagagtagcctcaacctgtgcttctgtgcattattctgagaataaatttctgtttcaaactgta

SEQ ID NO: 440275 - DNA, 1194 bp, Homo sapiens
agcgggttgttcccttttcggctctgcaacaccgcctagaccgaccggatacacgggtagggcttccgctttacccgtctccctcctggcgcttgtcctcctctcccagtcggcaccacagcggtggctgccgggcgtggtgtcggtgggtcggttggtttttgtctcaccgttggtgtccgtgccgttcagttgcccgccatggctgagctggatccgttcggcgcccctgccggcgcccctggcggtcccgcgctggggaacggagtggccggcgccggcgaagaagacccggctgcggccttcttggcgcagcaagagagcgagattgcgggcatcgagaacgacgaggccttcgccatccctgggaccgggccgggggccgggccacaccccctgggtggcacccgcccaagggccccggccaaaccgggggtccggaaaggcccgccccggggggggtccgggatgctgttgatggagtaatgaatgggtgaatactaccaggaaagtaatggtccaacagacagttatgcagctatttcacaagtggatcgattgcagtcagagcctgaaagtatccgtaaatggagagaagaacaaatggaacgcttggaagcccttgatgccaattctcggaagcaagaagcagagtggaaagaaaaggcaataaaggagctagaagaatggtatgcaagacaggacgagcagctacagaaaacaaaagcaaacaacagggcagcagaagaagcctttgtaaatgacattgacgagtcgtccccaggcactgagtgggaacgggtggcccggctgtgtgactttaaccccaagtctagcaagcaggccaaagatgtctcccgcatgcgctcagtcctcatctccctcaagcaggccccgctggtgcactgaagagccaccctgtggaaacactacatctgcaatatcttaatcctactcagtgaagctcttcacagtcattggattaattatgttgagttcttttggaccaaacctttttgtctttagagttgttcattgtttgtgattgcatgtttccttccttcaactgtgttctccctggcattcagagaggagggagaggaggaagaggaaggggagggaagcttcccaagagtagcctcaacctgtgcttctgtgcattattctgagaataaatttctgtttcaaactgta

SEQ ID NO: 440276 - DNA, 3319 bp, Homo sapiens
  misc_feature (993)..(993): n is a, c, g, or t
  misc_feature (1456)..(1456): n is a, c, g, or t
  misc_feature (2039)..(2039): n is a, c, g, or t
agcgggttgttcccttttcggctctgcaacaccgcctagaccgaccggatacacgggtagggcttccgctttacccgtctccctcctggcgcttgtcctcctctcccagtcggcaccacagcggtggctgccgggcgtggtgtcggtgggtcggttggtttttgtctcaccgttggtgtccgtgccgttcagttgcccgccatggctgagctggatccgttcggcgcccctgccggcgcccctggcggtcccgcgctggggaacggagtggccggcgccggcgaagaagacccggctgcggccttcttggcgcagcaagagagcgagattgcgggcatcgagaacgacgaggccttcgccatcctggacggcggcgcccccgggccccagccgcacggcgagccgccggggggtccggatgccaattctcggaagcaagaagcagagtggaaagaaaaggcaataaaggagctagaagaatggtatgcaagacaggacgagcagctacagaaaacaaaagcaaacaacagggtggcagatgaagctttctacaaacaacccttcgctgacgtgattggttatgtgtatgttgcaaaactaattcctttttctacatctgattctttctacttttgtttagagttaatgctccttttatgtcacaagttgctttgctttttaaattatttcaaattggcactttgggggctgcctaagaattgataagcggggtatgatctgttgatgaatcttccagatttgtgactccctgcatcctctgatggccatttttcatatttggggttttggagggaagaaagctaactcgctttcaaaatgtgtcatttgcgatcttatctgggaacggtttgaggctcgggggaactctgctctcttgctcttggctgccatcactgctgccatgccctgttgcctgcctgcctcaggtgggaaggaggtttccccacctgggagcaggtggcagtcccaggnggttaggagccagtgagcagcagcaccttgcattgccaaaatcagagctgtggggcagcattttccatacttggttcattcaaacaatgtggggtcgtttgcctctccctcaggcagaagagtccagagcagagggggttgtctccagtgggtgtctataattgttcctctgtggtcttgcatgtcagaaattgctatttagtggtcagcttctgatgtcctgtctcctagcacagggaagcccccagctttgagatcaggatagtcaaagtgtcttgatacgggccacttgggcttctccccctgacccccccaaaagaaacctgcatcttctctggagaaggtgtttttcttattcttttttttttctttttttcttttttcttttttttaaggatttcttttatcaaagcagtattgctgaagagttggaaacagttctcattgtctcctccttaaaaanagggctggctttacatgagaagtaagggtggaatggaagaggagaggaacctgtggaaggtgggcgatgagctcaggtctgtagagcctctcagggcctatgaccttgagatgttcatccccttagaagatagaactgggtttcctgggcccccagatgcatttgcagtgagacttgtgaaatgctggacttacaggtggtgtttgatttgatttctgcacattctctctggagtagaaatggagactggaaaggtcgagtctggttttgctgggcagctgggtggccagcaaagccagctgcacgtccccaagcacagatagagtggcaagggcatgtccagcttactgaccatctgcattgagctcattctcattttctatatctgacttaaagtttctctcgtttcttttcttctcttcacctttaagcacaaacataaaccatccttgctacagcctagaacagttaagtaaacctttctcactgcccctaactgtgtgtgccatgaagtcgcagtgttgtagtggctctgggcttcagcggtgtttgccacggccatccctgtgatagtgccacctcngtccccacagaccagtcatctccattgcttttctttgcccgtgatgcttgttggagtagatgaatatagtgtgtcttagcgctgtcctttccggctgtagctcccaccagttaattccgaactgggggtgggctgaccttgatgtgaaagaatgttggagcagcatcctgccaaaaagcaactcacgttggctctcctgccagtgtgccctgagtggccccaaggcacctggctggagggaaaatggcaaacttttggctgaactggagaatgtcctaacaaacccccttccagaatggctttagtctctagtgcttgctagcatgggagctttgtcttgaattccttttgatctgccccgtttctctccagccttaggaataaatctagaggctattgtgcaatgatctgtgggctttttagaagtctctaaatttccttgaaattcagtacagcccagcataaactactcaagttcttgatcagcctgctgctttgttcttattaataaaagcagtgtgtagctggctaaggacttgttttattaatgctccacaggagcagagacagacagagagacatagtgagccttgaaccaaacacctgtattccaacattttacacagcggtctgggcaccctgtgcctaggagagccagctacgtgtctacctgagtctgacctgggccaggggctgttatcttgggaaagccagaatgtcattaagaaagggacaaataggcagttgcttgtgtagcaaggcagccaccaggttgctcaaagggggttctgcataaaccaacatattttgttgttgcttccagggcagcagaagaagcctttgtaaatgacattgacgagtcgtccccaggcactgagtgggaacgggtggcccggctgtgtgactttaaccccaagtctagcaagcaggccaaagatgtctcccgcatgcgctcagtcctcatctccctcaagcaggccccgctggtgcactgaagagccaccctgtggaaacactacatctgcaatatcttaatcctactcagtgaagctcttcacagtcattggattaattatgttgagttcttttggaccaaacctttttgtctttagagttgttcattgtttgtgattgcatgtttccttccttcaactgtgttctccctggcattcagagaggagggagaggaggaagaggaaggggagggaagcttcccaagagtagcctcaacctgtgcttctgtgcattattctgagaataaatttctgtttcaaactgta

SEQ ID NO: 440277 - DNA, 987 bp, Homo sapiens
agcgggttgttcccttttcggctctgcaacaccgcctagaccgaccggatacacgggtagggcttccgctttacccgtctccctcctggcgcttgtcctcctctcccagtcggcaccacagcggtggctgccgggcgtggtgtcggtgggtcggttggtttttgtctcaccgttggtgtccgtgccgttcagttgcccgccatggctgagctggatccgttcggcgcccctgccggcgcccctggcggtcccgcgctggggaacggagtggccggcgccggcgaagaagacccggctgcggccttcttggcgcagcaagagagcgagattgcgggcatcgagaacgacgaggccttcgccatcctggacggcggcgcccccgggccccagccgcacggcgagccgccggggggtccggatgccaattctcggaagcaagaagcagagtggaaagaaaaggcaataaaggagctagaagaatggtatgcaagacaggacgagcagctacagaaaacaaaagcaaacaacagggcagcagaagaagcctttgtaaatgacattgacgagtcgtccccaggcactgagtgggaacgggtggcccggctgtgtgactttaaccccaagtctagcaagcaggccaaagatgtctcccgcatgcgctcagtcctcatctccctcaagcaggccccgctggtgcactgaagagccaccctgtggaaacactacatctgcaatatcttaatcctactcagtgaagctcttcacagtcattggattaattatgttgagttcttttggaccaaacctttttgtctttagagttgttcattgtttgtgattgcatgtttccttccttcaactgtgttctccctggcattcagagaggagggagaggaggaagaggaaggggagggaagcttcccaagagtagcctcaacctgtgcttctgtgcattattctgagaataaatttctgtttcaaactgta

SEQ ID NO: 440278 - DNA, 1177 bp, Homo sapiens
  misc_feature (1126)..(1126): n is a, c, g, or t
  misc_feature (1135)..(1135): n is a, c, g, or t
  misc_feature (1139)..(1139): n is a, c, g, or t
  misc_feature (1152)..(1152): n is a, c, g, or t
  misc_feature (1164)..(1164): n is a, c, g, or t
  misc_feature (1171)..(1171): n is a, c, g, or t
  misc_feature (1174)..(1174): n is a, c, g, or t
agcgggttgttcccttttcggctctgcaacaccgcctagaccgaccggatacacgggtagggcttccgctttacccgtctccctcctggcgcttgtcctcctctcccagtcggcaccacagcggtggctgccgggcgtggtgtcggtgggtcggttggtttttgtctcaccgttggtgtccgtgccgttcagttgcccgccatggctgagctggatccgttcggcgcccctgccggcgcccctggcggtcccgcgctggggaacggagtggccggcgccggcgaagaagacccggctgcggccttcttggcgcagcaagagagcgagattgcgggcatcgagaacgacgaggccttcgccatcctggacggcggcgcccccgggccccagccgcacggcgagccgccggggggtccggatgctgttgatggagtaatgaatggtgaatactaccaggaaagtaatggtccaacagacagttatgcagctatttcacaagtggatcgattgcagtcagagcctgaaagtatccgtaaatggagagaagaacaaatggaacgcttggaagcccttgatgccaattctcggaagcaagaagcagagtggaaagaaaaggcaataaaggagctagaagaatggtatgcaagacaggacgagcagctacagaaaacaaaagcaaacaacagggcagcagaagaagcctttgtaaatgacattgacgagtcgtccccaggcactgagtgggaacgggtggcccggctgtgtgactttaaccccaagtctagcaagcaggccaaagatgtctcccgcaacagtcattggattaattatgttgagttcttttggaccaaacctttttgtctttagagttgttcattgtttgtgattgcatgtttccttccttcaactgtgttctccctggcattcagagaggagggagaggaggaagaggaaggggagggaagcttcccaagagtagcctcaacctgtgcttctgtgcattattctgagaataaatttctgtttcaaactgtaaaaaaaaaaaaaaaaaaaaaacaaaaaaaaaaaaaaaaaaaaaaaaaaaaaaacaaacacacaaaaacacaaaaacacaaaaaaaaaaacnaaaacacanaaancaaacacacacanacaccacaccancaaaaancanaca

SEQ ID NO: 440279 - DNA, 1345 bp, Homo sapiens
  misc_feature (1294)..(1294): n is a, c, g, or t
  misc_feature (1303)..(1303): n is a, c, g, or t
  misc_feature (1307)..(1307): n is a, c, g, or t
  misc_feature (1320)..(1320): n is a, c, g, or t
  misc_feature (1332)..(1332): n is a, c, g, or t
  misc_feature (1339)..(1339): n is a, c, g, or t
  misc_feature (1342)..(1342): n is a, c, g, or t
agcgggttgttcccttttcggctctgcaacaccgcctagaccgaccggatacacgggtagggcttccgctttacccgtctccctcctggcgcttgtcctcctctcccagtcggcaccacagcggtggctgccgggcgtggtgtcggtgggtcggttggtttttgtctcaccgttggtgtccgtgccgttcagttgcccgccatggctgagctggatccgttcggcgcccctgccggcgcccctggcggtcccgcgctggggaacggagtggccggcgccggcgaagaagacccggctgcggccttcttggcgcagcaagagagcgagattgcgggcatcgagaacgacgaggccttcgccatcctggacggcggcgcccccgggccccagccgcacggcgagccgccggggggtccggatgctgttgatggagtaatgaatggtgaatactaccaggaaagtaatggtccaacagacagttatgcagctatttcacaagtggatcgattgcagtcagagcctgaaagtatccgtaaatggagagaagaacaaatggaacgcttggaagcccttgatgccaattctcggaagcaagaagcagagtggaaagaaaaggcaataaaggagctagaagaatggtatgcaagacaggacgagcagctacagaaaacaaaagcaaacaacagggtggcagatgaagctttctacaaacaacccttcgctgacgtgattggttatgtcacaaacataaaccatccttgctacagcctagaacaggcagcagaagaagcctttgtaaatgacattgacgagtcgtccccaggcactgagtgggaacgggtggcccggctgtgtgactttaaccccaagtctagcaagcaggccaaagatgtctcccgcatgcgctcagtcctcatctccctcaagcaggccccgctggtgcactgaagagccaccctgtggaaacactacatctgcaatatcttaatcctactcagtgaagctcttcacagtcattggattaattatgttgagttcttttggaccaaacctttttgtctttagagttgttcattgtttgtgattgcatgtttccttccttcaactgtgttctccctggcattcagagaggagggagaggaggaagaggaaggggagggaagcttcccaagagtagcctcaacctgtgcttctgtgcattattctgagaataaatttctgtttcaaactgtaaaaaaaaaaaaaaaaaaaaaaaacaaacacacaaaaacacaaaaacacaaaaaaaaaaacnaaaacacanaaancaaacacacacanacaccacaccancaaaaancanaca

SEQ ID NO: 440280 - DNA, 864 bp, Homo sapiens
  misc_feature (736)..(736): n is a, c, g, or t
  misc_feature (746)..(746): n is a, c, g, or t
  misc_feature (750)..(750): n is a, c, g, or t
  misc_feature (755)..(755): n is a, c, g, or t
  misc_feature (766)..(766): n is a, c, g, or t
  misc_feature (770)..(770): n is a, c, g, or t
  misc_feature (776)..(776): n is a, c, g, or t
  misc_feature (783)..(784): n is a, c, g, or t
  misc_feature (788)..(789): n is a, c, g, or t
  misc_feature (792)..(792): n is a, c, g, or t
agcgggttgttcccttttcggctctgcaacaccgcctagaccgaccggatacacgggtagggcttccgctttacccgtctccctcctggcgcttgtcctcctctcccagtcggcaccacagcggtggctgccgggcgtggtgtcggtgggtcggttggtttttgtctcaccgttggtgtccgtgccgttcagttgcccgccatggctgagctggatccgttcggcgcccctgccggcgcccctggcggtcccgcgctggggaacggagtggccggcgccggcgaagaagacccggctgcggccttcttggcgcagcaagagagcgagattgcgggcatcgagaacgacgaggccttcgccatcctggacggcggcgcccccgggccccagccgcacggcgagccgccggggggtccggatgctgttgatggagtaatgaatggtgaatactaccaggaaagtaatggtccaacagacagttatgcagctatttcacaagtggatcgattgcagtcagagcctgaaagtatccgtaaatggagagaagaacaaatggaacgcttggaagcccttgatgccaattctcggaagcaagaagcagagtggaaagaaaaggcaataaaggagctagaagaatggtatgcaagacaggacgagcagctacagaaaacaaaagcaaacaacagcagaagaagcctttgtaaatgacattgacggatagtttcaggctctgacngcaatcgatncacntgtgnaatagctgcanaacngtctgntgaccannactnnccnggtagtattcaccattcattactccatcaacagtatccgaccccccggcggctcgccgtgcgactgggtaca

SEQ ID NO: 440281 - DNA, 617 bp, Homo sapiens
agcgggttgttcccttttcggctctgcaacaccgcctagaccgaccggatacacgggtagggcttccgctttacccgtctccctcctggcgcttgtcctcctctcccagtcggcaccacagcggtggctgccgggcgtggtgtcggtgggtcggttggtttttgtctcaccgttggtgtccgtgccgttcagttgcccgccatggctgagctggatccgttcggcgcccctgccggcgcccctggcggtcccgcgctggggaacggagtggccggcgccggcgaagaagacccggctgcggccttcttggcgcagcaagagagcgagattgcgggcatcgagaacgacgaggccttcgccatcctggacggcggcgcccccgggccccagccgcacggcgagccgccggggggtccggatgctgttgatggagtaatgaatggtgaatactaccaggaaagtaatggtccaacagacagttatgcagctatttcacaagtggatcgattgcagtcagagcctgaaagtatccgtaaatggagggaagcttcccaagagtagcctcaacctgtgcttctgtgcattattctgagaataaatttctgtttcaaactgta

SEQ ID NO: 440282 - DNA, 818 bp, Homo sapiens
agcgggttgttcccttttcggctctgcaacaccgcctagaccgaccggatacacgggtagggcttccgctttacccgtctccctcctggcgcttgtcctcctctcccagtcggcaccacagcggtggctgccgggcgtggtgtcggtgggtcggttggtttttgtctcaccgttggtgtccgtgccgttcagttgcccgccatggctgagctggatccgttcggcgcccctgccggcgcccctgtgctgtgtccctgctgctgtgtgtgaactgtgagttgtgcctggctgcctgtgctgaatgaatgaccctgtgcttgcgtgccattcattgtgctgcaagcaatgatgatgctgatgcatttgctgtgtgcatcagaagaaactgactgatgtgaccattcagacccatacctagtgactgtgctgtgctgccaccctgtgtgcccacagacctgcaactggctgatgcctgcctgtgtgtgtgtgtcctaggatgactggttagattggatgtacattgacattgtgttgacaatactaccatgtgaaacatgttacattgtgtaccacacaagaaacacagttaattgccatgctcattttcagcaatgttgtgaatctcgattatgccatgtacaatggatgacgcttggacaaaggtaattccctgataaagatggggacagaggcaaaggacacacaaattgaggaacatgcttttgggacatgccccctatgaaatagaccaaattaatcttctgggaaatgccaacagagacgccaggaaccgttgtgaacacatggacacaaatggc

SEQ ID NO: 440283 - DNA, 2621 bp, Homo sapiens
  misc_feature (1)..(1): n is a, c, g, or t
  misc_feature (3)..(4): n is a, c, g, or t
nannggcacgagagtgacgtcgtgtggggcgggtccgaccgcgcacaatgggccatggagttcccgttcgatgtggacgcgctgttcccggagcggatcacggtgctggaccagcacctgaggcccccagcccgccgacccggaaccacaacgccggcccgtgttgatctacagcagcaaattatgaccattatagatgaactgggcaaggcttctgccaaggcccagaatctttccgctcctatcactagtgcatcaaggatgcagagtaaccgccatgttgtttatattctcaaagacagttcagcccgaccggctggaaaaggagccattattggtttcatcaaagttggatacaagaagctctttgtactggatgatcgtgaggctcataatgaggtagaaccactttgcatcctggacttttacatccatgagtctgtgcaacgccatggccatgggcgagaactcttccagtatatgttgcagaaggagcgagtggaaccgcaccaactggcaattgaccgaccctcacagaagctgctgaaattcctgaataagcactacaatctggagaccacagtcccacaggtgaacaactttgtgatctttgaaggcttctttgcccatcaacatcctccagcaaggaagctgccacccaagagagcagagggagacatcaagccatactcctctagtgaccgagaatttctgaaggtagctgtggagcctccttggcccctaaacagggcccctcgccgcgccacacctccagcccacccacccccccgctccagcagcctgggaaactcaccagaacgaggtcccctccgcccctttgtgccagagcaggagctgctgcgttccttgcgcctctgccccccacaccctaccgcccgccttctgttggctgctgaccctgggggcagcccagctcaacgtcgtcgcaccaggtaataggagttgaagggctaaggagcctcacagctataaaagaggatgttagaaatggcaaagggcaatttgaatccatcagagagatggatcaataagatgggtggcttggggggggtcctgaaacctttcaagaaaaatatttgtgcaagtgatctgggaaaaaaatgcagtgaaggagcagaataggaccttatatggagcctagggaccctggctttaatgtgagagttatgtggaatggtaggaagaacaccgagatccatcgagttgggggaacagagccttctaagattgggaaaatcttcgcttaatacttgctggggaaggggcagtgtctgacagagagtgggaagccactggcttgtgtgccaagagtccatcgcagcaggcagggagtgggcatttcctttatttctctccctttctcttcacctctgacttctctgtttttctctcccccgccccccgccatttcccatctcccttcctcccatccataacatccttccacagctcccttccccgctctgaggagagtcgatactaacagctaccctctccctgccctgggagacctggggtgggcagggaacccctccctgagaacctcagacccactcttccattgcatcctgtaggacccagtggaacctgacagagcccataggattccctcttctactttcttagacagcagggatgtcagggtctcaaactgcctaacactttgtagcttttcttaacacaaaagcaccccttctctcctaacttgggctctgaatactttcccaacaggaagtctgatctgttgccagacttcttggttagatggctcatacatttatctagagaagcacactcttgcttgctgtcaaactttagaacaccatggaaggtctaagggcatcctgtgccagggaaactttttaaggaattttatctatgggataaaccccatattccctctagtgtctactggtggctctaatactgctttgtgctgcctgccacacttgccctttgagcctgcgaatggccgctagtgagcaagctctgcttcagagcagtctagttaggtagaacagggacttaccagcttcccaaagggatctactcaccattgccaaactcttcatttccacattttgtgtaggtgtcagggaaccccaaactggtgttgctttggggtctctaaaggagattggctgacaccaccatttcccccagatccagattctctgagggaggttgtttcttgagagtagatccagagtgtcaaggatctgttagatcctggaatcccttcttgcatccatccctccctggtagctaggtcccgatatactcctgtcttgtgagattgtcgagatgagatgggggaccactcttcctctgtccttcctctctcctttcctccatagcaaggacgaccttccctgctccatgcccagagtatagctagatcccttcccctccctaccctctgaatgtgtgctagatcaggtgccccactgtgtttcctgaaatccttgggagccggatctccccatctcccctactcactcttcccttttcttctctcagtgttgtctgaataaagtgtgaaatcttttgtgttttctaaattgacattttcaatgaaaaaaagaatcccaaaaaaaaaa

SEQ ID NO: 440284 - DNA, 1480 bp, Homo sapiens
attcctgattaaccaagggctttgtccatctcatccagaggaacccagggtcctcgttggcccggctgggaccattccactgccccagaataccagggggccgtgacagcacccactgacagtaagagctcactccccttggctgcccttctcctgcatctcccaggcccccagagtctccccttcgatctttctccctagctctgtgtttggcctactccttctggctttcctcaacagtgttccacattcccctcaaattcccttttggtgtgctggcattgccatggtgctgctcctgcaagttctcaggaggaactgtggtgtcagggagcagaggtttggggttggggtatagtggctgggaggaggggtgcaaagtatgtctcctaacgcttaccctgcctatgtcccctccactgccagctccagcaaggaagctgccacccaagagagcagagggagacatcaagccatactcctctagtgaccgagaatttctgaaggtagctgtggagcctccttggcccctaaacagggcccctcgccgcgccacacctccagcccacccacccccccgctccagcagcctgggaaactcaccagaacgaggtcccctccgcccctttgtgccagagcaggagctgctgcgttccttgcgcctctgccccccacaccctaccgcccgccttctgttggctgctgaccctgggggcagcccagctcaacgtcgtcgcaccagggggactcccccaggtctggtagcccaaagctgctgctacagccgccatgggggggtgaattcctcatcccccaatacaggcaaccaagactccaagcagggagaacaggaaacaaagaataggtctgccagtgaggagcaggccttgtcacaggatgggtctggggagaagcccatgcacacagctcctccacaggccccggccccgccagcccagtcctggacagtgggtggggacatactcaacgccaggttcattcgaaacctgcaggaacgtcgcagcaccaggccttggtgaccgcagccccgtcaaacatcttcaaagtattatttctccctcactacaggaaagagccaaagcccaaccctcataatagatggatacattcattcattcattcattcagcaggcttatcagattcaagtcatttgtatcttttaaccagaccaataaaagtatttatttttatcacaagagctgttgaaaaatttgactcattatttcagccgcctcacccctcactgtcgttgcacccattcagccttcagccctgtttttgctcagctttttgctcaaaggcctcagctgtgaatacagcgcttgggggggcaggggaggctgtaacttgcgcaagcgcactcaggcagtctccgagcccgcgggcgcaggcgcgcttacagccgacagagcgcttcagccgcttccctcgagcctgcagtgcgcaagcgcgggacat

SEQ ID NO: 440285 - DNA, 2173 bp, Homo sapiens
  misc_feature (1)..(1): n is a, c, g, or t
  misc_feature (3)..(4): n is a, c, g, or t
nannggcacgagagtgacgtcgtgtggggcgggtccgaccgcgcacaatgggccatggagttcccgttcgatgtggacgcgctgttcccggagcggatcacggtgctggaccagcacctgaggcccccagcccgccgacccggaaccacaacgccggcccgtgttgatctacagcagcaaattatgaccattatagatgaactgggcaaggcttctgccaaggcccagaatctttccgctcctatcactagtgcatcaaggatgcagagtaaccgccatgttgtttatattctcaaagacagttcagcccgaccggctggaaaaggagccattattggtttcatcaaagttggatacaagaagctctttgtactggatgatcgtgaggctcataatgaggtagaaccactttgcatcctggacttttacatccatgagtctgtgcaacgccatggccatgggcgagaactcttccagtatatgttgcagaaggagcgagtggaaccgcaccaactggcaattgaccgaccctcacagaagctgctgaaattcctgaataagcactacaatctggagaccacagtcccacaggtgaacaactttgtgatctttgaaggcttctttgcccatcaacatcggccccctgctccctctctgagggcaactcgacactctcgtgctgctgcagtcgatcccacgcccgctgctccagcaaggaagctgccacccaagagagcagagggagacatcaagccatactcctctagtgaccgagaatttctgaaggtagctgtggagcctccttggcccctaaacagggcccctcgccgcgccacacctccagcccacccacccccccgctccagcagcctgggaaactcaccagaacgaggtcccctccgcccctttgtgccagagcaggagctgctgcgttccttgcgcctctgccccccacaccctaccgcccgccttctgttggctgctgaccctgggggcagcccagctcaacgtcgtcgcaccagctcccttccccgctctgaggagagtcgatactaacagctaccctctccctgccctgggagacctggggtgggcagggaacccctccctgagaacctcagacccactcttccattgcatcctgtaggacccagtggaacctgacagagcccataggattccctcttctactttcttagacagcagggatgtcagggtctcaaactgcctaacactttgtagcttttcttaacacaaaagcaccccttctctcctaacttgggctctgaatactttcccaacaggaagtctgatctgttgccagacttcttggttagatggctcatacatttatctagagaagcacactcttgcttgctgtcaaactttagaacaccatggaaggtctaagggcatcctgtgccagggaaactttttaaggaattttatctatgggataaaccccatattccctctagtgtctactggtggctctaatactgctttgtgctgcctgccacacttgccctttgagcctgcgaatggccgctagtgagcaagctctgcttcagagcagtctagttaggtagaacagggacttaccagcttcccaaagggatctactcaccattgccaaactcttcatttccacattttgtgtaggtgtcagggaaccccaaactggtgttgctttggggtctctaaaggagattggctgacaccaccatttcccccagatccagattctctgagggaggttgtttcttgagagtagatccagagtgtcaaggatctgttagatcctggaatcccttcttgcatccatccctccctggtagctaggtcccgatatactcctgtcttgtgagattgtcgagatgagatgggggaccactcttcctctgtccttcctctctcctttcctccatagcaaggacgaccttccctgctccatgcccagagtatagctagatcccttcccctccctaccctctgaatgtgtgctagatcaggtgccccactgtgtttcctgaaatccttgggagccggatctccccatctcccctactcactcttcccttttcttctctcagtgttgtctgaataaagtgtgaaatcttttgtgttttctaaattgacattttcaatgaaaaaaagaatcccaaaaaaaaaa

SEQ ID NO: 440286 - DNA, 2104 bp, Homo sapiens
  misc_feature (1)..(1): n is a, c, g, or t
  misc_feature (3)..(4): n is a, c, g, or t
nannggcacgagagtgacgtcgtgtggggcgggtccgaccgcgcacaatgggccatggagttcccgttcgatgtggacgcgctgttcccggagcggatcacggtgctggaccagcacctgaggcccccagcccgccgacccggaaccacaacgccggcccgtgttgatctacagcagcaaattatgaccattatagatgaactgggcaaggcttctgccaaggcccagaatctttccgctcctatcactagtgcatcaaggatgcagagtaaccgccatgttgtttatattctcaaagacagttcagcccgaccggctggaaaaggagccattattggtttcatcaaagttggatacaagaagctctttgtactggatgatcgtgaggctcataatgaggtagaaccactttgcatcctggacttttacatccatgagtctgtgcaacgccatggccatgggcgagaactcttccagtatatgttgcagaaggagcgagtggaaccgcaccaactggcaattgaccgaccctcacagaagctgctgaaattcctgaataagcactacaatctggagaccacagtcccacaggtgaacaactttgtgatctttgaaggcttctttgcccatcaacatcctccagcaaggaagctgccacccaagagagcagagggagacatcaagccatactcctctagtgaccgagaatttctgaaggtagctgtggagcctccttggcccctaaacagggcccctcgccgcgccacacctccagcccacccacccccccgctccagcagcctgggaaactcaccagaacgaggtcccctccgcccctttgtgccagagcaggagctgctgcgttccttgcgcctctgccccccacaccctaccgcccgccttctgttggctgctgaccctgggggcagcccagctcaacgtcgtcgcaccagctcccttccccgctctgaggagagtcgatactaacagctaccctctccctgccctgggagacctggggtgggcagggaacccctccctgagaacctcagacccactcttccattgcatcctgtaggacccagtggaacctgacagagcccataggattccctcttctactttcttagacagcagggatgtcagggtctcaaactgcctaacactttgtagcttttcttaacacaaaagcaccccttctctcctaacttgggctctgaatactttcccaacaggaagtctgatctgttgccagacttcttggttagatggctcatacatttatctagagaagcacactcttgcttgctgtcaaactttagaacaccatggaaggtctaagggcatcctgtgccagggaaactttttaaggaattttatctatgggataaaccccatattccctctagtgtctactggtggctctaatactgctttgtgctgcctgccacacttgccctttgagcctgcgaatggccgctagtgagcaagctctgcttcagagcagtctagttaggtagaacagggacttaccagcttcccaaagggatctactcaccattgccaaactcttcatttccacattttgtgtaggtgtcagggaaccccaaactggtgttgctttggggtctctaaaggagattggctgacaccaccatttcccccagatccagattctctgagggaggttgtttcttgagagtagatccagagtgtcaaggatctgttagatcctggaatcccttcttgcatccatccctccctggtagctaggtcccgatatactcctgtcttgtgagattgtcgagatgagatgggggaccactcttcctctgtccttcctctctcctttcctccatagcaaggacgaccttccctgctccatgcccagagtatagctagatcccttcccctccctaccctctgaatgtgtgctagatcaggtgccccactgtgtttcctgaaatccttgggagccggatctccccatctcccctactcactcttcccttttcttctctcagtgttgtctgaataaagtgtgaaatcttttgtgttttctaaattgacattttcaatgaaaaaaagaatcccaaaaaaaaaa

SEQ ID NO: 440287 - DNA, 1893 bp, Homo sapiens
attcctgattaaccaagggctttgtccatctcatccagaggaacccagggtcctcgttggcccggctgggaccattccactgccccagaataccagggggccgtgacagcacccactgacagtaagagctcactccccttggctgcccttctcctgcatctcccaggcccccagagtctccccttcgatctttctccctagctctgtgtttggcctactccttctggctttcctcaacagtgttccacattcccctcaaattcccttttggtgtgctggcattgccatggtgctgctcctgcaagttctcaggaggaactgtggtgtcagggagcagaggtttggggttggggtatagtggctgggaggaggggtgcaaagtatgtctcctaacgcttaccctgcctatgtcccctccactgccagctccagcaaggaagctgccacccaagagagcagagggagacatcaagccatactcctctagtgaccgagaatttctgaaggtagctgtggagcctccttggcccctaaacagggcccctcgccgcgccacacctccagcccacccacccccccgctccagcagcctgggaaactcaccagaacgaggtcccctccgcccctttgtgccagagcaggagctgctgcgttccttgcgcctctgccccccacaccctaccgcccgccttctgttggctgctgaccctgggggcagcccagctcaacgtcgtcgcaccagctcccttccccgctctgaggagagtcgatactaacagctaccctctccctgccctgggagacctggggtgggcagggaacccctccctgagaacctcagacccactcttccattgcatcctgtaggacccagtggaacctgacagagcccataggattccctcttctactttcttagacagcagggatgtcagggtctcaaactgcctaacactttgtagcttttcttaacacaaaagcaccccttctctcctaacttgggctctgaatactttcccaacaggaagtctgatctgttgccagacttcttggttagatggctcatacatttatctagagaagcacactcttgcttgctgtcaaactttagaacaccatggaaggtctaagggcatcctgtgccagggaaactttttaaggaattttatctatgggataaaccccatattccctctagtgtctactggtggctctaatactgctttgtgctgcctgccacacttgccctttgagcctgcgaatggccgctagtgagcaagctctgcttcagagcagtctagttaggtagaacagggacttaccagcttcccaaagggatctactcaccattgccaaactcttcatttccacattttgtgtaggtgtcagggaaccccaaactggtgttgctttggggtctctaaaggagattggctgacaccaccatttcccccagatccagattctctgagggaggttgtttcttgagagtagatccagagtgtcaaggatctgttagatcctggaatcccttcttgcatccatccctccctggtagctaggtcccgatatactcctgtcttgtgagattgtcgagatgagatgggggaccactcttcctctgtccttcctctctcctttcctccatagcaaggacgaccttccctgctccatgcccagagtatagctagatcccttcccctccctaccctctgaatgtgtgctagatcaggtgccccactgtgtttcctgaaatccttgggagccggatctccccatctcccctactcactcttcccttttcttctctcagtgttgtctgaataaagtgtgaaatcttttgtgttttctaaattgacattttcaatgaaaaaaagaatcccaaaaaaaaaa

SEQ ID NO: 440288 - DNA, 1760 bp, Homo sapiens
  misc_feature (1)..(1): n is a, c, g, or t
  misc_feature (3)..(4): n is a, c, g, or t
nannggcacgagagtgacgtcgtgtggggcgggtccgaccgcgcacaatgggccatggagttcccgttcgatgtggacgcgctgttcccggagcggatcacggtgctggaccagcacctgaggcccccagcccgccgacccggaaccacaacgccggcccgtgttgatctacagcagcaaattatgaccattatagatgaactgggcaaggcttctgccaaggcccagaatctttccgctcctatcactagtgcatcaaggatgcagagtaaccgccatgttgtttatattctcaaagacagttcagcccgaccggctggaaaaggagccattattggtttcatcaaagttggatacaagaagctctttgtactggatgatcgtgaggctcataatgaggtagaaccactttgcatcctggacttttacatccatgagtctgtgcaacgccatggccatgggcgagaactcttccagtatatgttgcagaaggagcgagtggaaccgcaccaactggcaattgaccgaccctcacagaagctgctgaaattcctgaataagcactacaatctggagaccacagtcccacaggtgaacaactttgtgatctttgaaggcttctttgcccatcaacatcggccccctgctccctctctgagggcaactcgacactctcgtgctgctgcagtcgatcccacgcccgctgctccagcaaggaagctgccacccaagagagcagagggagacatcaagccatactcctctagtgaccgagaatttctgaaggtagctgtggagcctccttggcccctaaacagggcccctcgccgcgccacacctccagcccacccacccccccgctccagcagcctgggaaactcaccagaacgaggtcccctccgcccctttgtgccagagcaggagctgctgcgttccttgcgcctctgccccccacaccctaccgcccgccttctgttggctgctgaccctgggggcagcccagctcaacgtcgtcgcaccagggggactcccccaggtctggtagcccaaagctgctgctacagccgccatgggggggtgaattcctcatcccccaatacaggcaaccaagactccaagcagggagaacaggaaacaaagaataggtctgccagtgaggagcaggccttgtcacaggatgggtctggggagaagcccatgcacacagctcctccacaggccccggccccgccagcccagtcctggacagtgggtggggacatactcaacgccaggttcattcgaaacctgcaggaacgtcgcagcaccaggccttggtgaccgcagccccgtcaaacatcttcaaagtattatttctccctcactacaggaaagagccaaagcccaaccctcataatagatggatacattcattcattcattcattcagcaggcttatcagattcaagtcatttgtatcttttaaccagaccaataaaagtatttatttttatcacaagagctgttgaaaaatttgactcattatttcagccgcctcacccctcactgtcgttgcacccattcagccttcagccctgtttttgctcagctttttgctcaaaggcctcagctgtgaatacagcgcttgggggggcaggggaggctgtaacttgcgcaagcgcactcaggcagtctccgagcccgcgggcgcaggcgcgcttacagccgacagagcgcttcagccgcttccctcgagcctgcagtgcgcaagcgcgggacat

SEQ ID NO: 440289 - DNA, 1180 bp, Homo sapiens
  misc_feature (1)..(1): n is a, c, g, or t
  misc_feature (3)..(4): n is a, c, g, or t
nannggcacgagagtgacgtcgtgtggggcgggtccgaccgcgcacaatgggccatggagttcccgttcgatgtggacgcgctgttcccggagcggatcacggtgctggaccagcacctgaggcccccagcccgccgacccggaaccacaacgccggcccgtgttgatctacagcagcaaattatgaccattatagatgaactgggcaaggcttctgccaaggcccagaatctttccgctcctatcactagtgcatcaaggatgcagagtaaccgccatgttgtttatattctcaaagacagttcagcccgaccggctggaaaaggagccattattggtttcatcaaagttggatacaagaagctctttgtactggatgatcgtgaggctcataatgaggtagaaccactttgcatcctggacttttacatccatgagtctgtgcaacgccatggccatgggcgagaactcttccagtatatgttgcagaaggagcgagtggaaccgcaccaactggcaattgaccgaccctcacagaagctgctgaaattcctgaataagcactacaatctggagaccacagtcccacaggtgaacaactttgtgatctttgaaggcttctttgcccatcaacatcggccccctgctccctctctgagggcaactcgacactctcgtgctgctgcagtcgatcccacgcccgctgctccagcaaggaagctgccacccaagagagcagagggagacatcaagccatactcctctagtgaccgagaatgtaagaggggcaagggtcgggtgtctgggcctggggtaccttaacacaagggaagagaatgctcaggggacccagggaaaggattcgttctctctaaagactcagatttcttgggctgggcatggtggctcatgcctgtaatcccagcactttgagaggctaaggcaggcagatcgcctgagtccaggggttcaagaccagcctggccaacatggtgaaaccccgtctctactaaaaatacaaaaattagctgggcacggtggcacgtgcctgtaatcccagctacttgggaggctgaggcaggagaatggcttgaacccaggaggcggaagttgcagtgagccaagatcgtgccactgcactccagcttgggtgacagagtgagactccgtctcaaaaaag

SEQ ID NO: 440290 - DNA, 2690 bp, Homo sapiens
  misc_feature (1)..(1): n is a, c, g, or t
  misc_feature (3)..(4): n is a, c, g, or t
nannggcacgagagtgacgtcgtgtggggcgggtccgaccgcgcacaatgggccatggagttcccgttcgatgtggacgcgctgttcccggagcggatcacggtgctggaccagcacctgaggcccccagcccgccgacccggaaccacaacgccggcccgtgttgatctacagcagcaaattatgaccattatagatgaactgggcaaggcttctgccaaggcccagaatctttccgctcctatcactagtgcatcaaggatgcagagtaaccgccatgttgtttatattctcaaagacagttcagcccgaccggctggaaaaggagccattattggtttcatcaaagttggatacaagaagctctttgtactggatgatcgtgaggctcataatgaggtagaaccactttgcatcctggacttttacatccatgagtctgtgcaacgccatggccatgggcgagaactcttccagtatatgttgcagaaggagcgagtggaaccgcaccaactggcaattgaccgaccctcacagaagctgctgaaattcctgaataagcactacaatctggagaccacagtcccacaggtgaacaactttgtgatctttgaaggcttctttgcccatcaacatcggccccctgctccctctctgagggcaactcgacactctcgtgctgctgcagtcgatcccacgcccgctgctccagcaaggaagctgccacccaagagagcagagggagacatcaagccatactcctctagtgaccgagaatttctgaaggtagctgtggagcctccttggcccctaaacagggcccctcgccgcgccacacctccagcccacccacccccccgctccagcagcctgggaaactcaccagaacgaggtcccctccgcccctttgtgccagagcaggagctgctgcgttccttgcgcctctgccccccacaccctaccgcccgccttctgttggctgctgaccctgggggcagcccagctcaacgtcgtcgcaccaggtaataggagttgaagggctaaggagcctcacagctataaaagaggatgttagaaatggcaaagggcaatttgaatccatcagagagatggatcaataagatgggtggcttggggggggtcctgaaacctttcaagaaaaatatttgtgcaagtgatctgggaaaaaaatgcagtgaaggagcagaataggaccttatatggagcctagggaccctggctttaatgtgagagttatgtggaatggtaggaagaacaccgagatccatcgagttgggggaacagagccttctaagattgggaaaatcttcgcttaatacttgctggggaaggggcagtgtctgacagagagtgggaagccactggcttgtgtgccaagagtccatcgcagcaggcagggagtgggcatttcctttatttctctccctttctcttcacctctgacttctctgtttttctctcccccgccccccgccatttcccatctcccttcctcccatccataacatccttccacagctcccttccccgctctgaggagagtcgatactaacagctaccctctccctgccctgggagacctggggtgggcagggaacccctccctgagaacctcagacccactcttccattgcatcctgtaggacccagtggaacctgacagagcccataggattccctcttctactttcttagacagcagggatgtcagggtctcaaactgcctaacactttgtagcttttcttaacacaaaagcaccccttctctcctaacttgggctctgaatactttcccaacaggaagtctgatctgttgccagacttcttggttagatggctcatacatttatctagagaagcacactcttgcttgctgtcaaactttagaacaccatggaaggtctaagggcatcctgtgccagggaaactttttaaggaattttatctatgggataaaccccatattccctctagtgtctactggtggctctaatactgctttgtgctgcctgccacacttgccctttgagcctgcgaatggccgctagtgagcaagctctgcttcagagcagtctagttaggtagaacagggacttaccagcttcccaaagggatctactcaccattgccaaactcttcatttccacattttgtgtaggtgtcagggaaccccaaactggtgttgctttggggtctctaaaggagattggctgacaccaccatttcccccagatccagattctctgagggaggttgtttcttgagagtagatccagagtgtcaaggatctgttagatcctggaatcccttcttgcatccatccctccctggtagctaggtcccgatatactcctgtcttgtgagattgtcgagatgagatgggggaccactcttcctctgtccttcctctctcctttcctccatagcaaggacgaccttccctgctccatgcccagagtatagctagatcccttcccctccctaccctctgaatgtgtgctagatcaggtgccccactgtgtttcctgaaatccttgggagccggatctccccatctcccctactcactcttcccttttcttctctcagtgttgtctgaataaagtgtgaaatcttttgtgttttctaaattgacattttcaatgaaaaaaagaatcccaaaaaaaaaa

SEQ ID NO: 440291 - DNA, 1629 bp, Homo sapiens
  misc_feature (1)..(1): n is a, c, g, or t
  misc_feature (3)..(4): n is a, c, g, or t
nannggcacgagagtgacgtcgtgtggggcgggtccgaccgcgcacaatgggccatggagttcccgttcgatgtggacgcgctgttcccggagcggatcacggtgctggaccagcacctgaggcccccagcccgccgacccggaaccacaacgccggcccgtgttgatctacagcagcaaattatgaccattatagatgaactgggcaaggcttctgccaaggcccagaatctttccgctcctatcactagtgcatcaaggatgcagagtaaccgccatgttgtttatattctcaaagacagttcagcccgaccggctggaaaaggagccattattggtttcatcaaagttggatacaagaagctctttgtactggatgatcgtgaggctcataatgaggtagaaccactttgcatcctggacttttacatccatgagtctgtgcaacgccatggccatgggcgagaactcttccagtatatgttgcagaaggagcgagtggaaccgcaccaactggcaattgaccgaccctcacagaagctgctgaaattcctgaataagcactacaatctggagaccacagtcccacaggtgaacaactttgtgatctttgaaggcttctttgcccatcaacatcggccccctgctccctctctgagggcaactcgacactctcgtgctgctgcagtcgatcccacgcccgctggtcaagcctgtattgaaggggtggaactgtagtgcagtgatggctacttactctagatgccacggggtacagtgccatctgtgggcaattttggaaaattctaaagcaacccaagtctccagcagtcatgactgtttgcctttgccctcatgggagctcagtgcattttatatttggcaagacttttaactaagcaagctcattgggagcctgtttgacagctgatatcaatggaccctcttgccagttcaggtccgtcaacataggccagagtcaggctcctttgtaaaccccaggcttctgttagccagtgagggacaggctggtgcaaacagcccttccatttgcagtcacagaatagtgacacaaatggcccaaaatttaaatgttacttttagaagataacactcagagtttataacatttccaaccagataatgaaattgatatggagaaaccaaacctcagaggcactaaaatgctgtccagattccccatcccatatacacacacacacacacacacacacacacaaacacacttactgacagtctgagccccactccttcctcttcctcaccacctccaccttaccaacttctgacagctgtacagtgcttgcttgcacagaagagcccccttcctgagctggctctgtggccaggaaaggatgtaaccaccatccaaacagcagtctgtaaccagctatgagcatcacagtgtcaggcactgagaggcacctcaactcgctttggtttccaaggcttctcccatttagcttgttcagaaccacaggctgtgagagggactgagggccaacaaggatggtgaggtctcaggcctgcaggggagggtgctgtggataaagcttaagtgaatttgctgagaagtctttcatttgccacacatacatgatggagaat

SEQ ID NO: 440292 - DNA, 718 bp, Homo sapiens
aaatcaagtaggccacattcactgtctactcctgccttcccatgcctgatatttccacaggcaaccaagactccaagcagggagaacaggaaacaaagaataggtctgccagtgaggagcaggccttgtcacaggatgggtctggggagaagcccatgcacacagctcctccacaggccccggccccgccagcccagtcctggacagtgggtggggacatactcaacgccaggttcattcgaaacctgcaggaacgtcgcagcaccaggccttggtgaccgcagccccgtcaaacatcttcaaagtattatttctccctcactacaggaaagagccaaagcccaaccctcataatagatggatacattcattcattcattcattcagcaggcttatcagattcaagtcatttgtatcttttaaccagaccaataaaagtatttatttttatcacaagagctgttgaaaaatttgactcattatttcagccgcctcacccctcactgtcgttgcacccattcagccttcagccctgtttttgctcagctttttgctcaaaggcctcagctgtgaatacagcgcttgggggggcaggggaggctgtaacttgcgcaagcgcactcaggcagtctccgagcccgcgggcgcaggcgcgcttacagccgacagagcgcttcagccgcttccctcgagcctgcagtgcgcaagcgcgggacat

SEQ ID NO: 440293 - DNA, 2386 bp, Homo sapiens
  misc_feature (1)..(1): n is a, c, g, or t
  misc_feature (3)..(4): n is a, c, g, or t
nannggcacgagagtgacgtcgtgtggggcgggtccgaccgcgcacaatgggccatggagttcccgttcgatgtggacgcgctgttcccggagcggatcacggtgctggaccagcacctgaggcccccagcccgccgacccggaaccacaacgccggcccggtgacagctcaaacccaccctctggcccttttctcccggttcctctccaaacctggtccaggcaccacgcccccttctcactgactagtgatcgccccttttgatgtccaggcctgcctttttggtgacctctgaccctgggcctagtgggattgatcagcgcttggatctgtgacctttcaccccgggcccaaaatgtcccaatcaaaggatgtggttgacctggcctttctgcttcctcacaataaccttaagggaggagggagtgtgccaccttgaaagtgttgatctacagcagcaaattatgaccattatagatgaactgggcaaggcttctgccaaggcccagaatctttccgctcctatcactagtgcatcaaggatgcagagtaaccgccatgttgtttatattctcaaagacagttcagcccgaccggctggaaaaggagccattattggtttcatcaaagttggatacaagaagctctttgtactggatgatcgtgaggctcataatgaggtagaaccactttgcatcctggacttttacatccatgagtctgtgcaacgccatggccatgggcgagaactcttccagtatatgttgcagaaggagcgagtggaaccgcaccaactggcaattgaccgaccctcacagaagctgctgaaattcctgaataagcactacaatctggagaccacagtcccacaggtgaacaactttgtgatctttgaaggcttctttgcccatcaacatcctccagcaaggaagctgccacccaagagagcagagggagacatcaagccatactcctctagtgaccgagaatttctgaaggtagctgtggagcctccttggcccctaaacagggcccctcgccgcgccacacctccagcccacccacccccccgctccagcagcctgggaaactcaccagaacgaggtcccctccgcccctttgtgccagagcaggagctgctgcgttccttgcgcctctgccccccacaccctaccgcccgccttctgttggctgctgaccctgggggcagcccagctcaacgtcgtcgcaccagctcccttccccgctctgaggagagtcgatactaacagctaccctctccctgccctgggagacctggggtgggcagggaacccctccctgagaacctcagacccactcttccattgcatcctgtaggacccagtggaacctgacagagcccataggattccctcttctactttcttagacagcagggatgtcagggtctcaaactgcctaacactttgtagcttttcttaacacaaaagcaccccttctctcctaacttgggctctgaatactttcccaacaggaagtctgatctgttgccagacttcttggttagatggctcatacatttatctagagaagcacactcttgcttgctgtcaaactttagaacaccatggaaggtctaagggcatcctgtgccagggaaactttttaaggaattttatctatgggataaaccccatattccctctagtgtctactggtggctctaatactgctttgtgctgcctgccacacttgccctttgagcctgcgaatggccgctagtgagcaagctctgcttcagagcagtctagttaggtagaacagggacttaccagcttcccaaagggatctactcaccattgccaaactcttcatttccacattttgtgtaggtgtcagggaaccccaaactggtgttgctttggggtctctaaaggagattggctgacaccaccatttcccccagatccagattctctgagggaggttgtttcttgagagtagatccagagtgtcaaggatctgttagatcctggaatcccttcttgcatccatccctccctggtagctaggtcccgatatactcctgtcttgtgagattgtcgagatgagatgggggaccactcttcctctgtccttcctctctcctttcctccatagcaaggacgaccttccctgctccatgcccagagtatagctagatcccttcccctccctaccctctgaatgtgtgctagatcaggtgccccactgtgtttcctgaaatccttgggagccggatctccccatctcccctactcactcttcccttttcttctctcagtgttgtctgaataaagtgtgaaatcttttgtgttttctaaattgacattttcaatgaaaaaaagaatcccaaaaaaaaaa

SEQ ID NO: 440294 - DNA, 2119 bp, Homo sapiens
  misc_feature (1)..(1): n is a, c, g, or t
  misc_feature (3)..(4): n is a, c, g, or t
nannggcacgagagtgacgtcgtgtggggcgggtccgaccgcgcacaatgggccatggagttcccgttcgatgtggacgcgctgttcccggagcggatcacggtgctggaccagcacctgaggcccccagcccgccgacccggaaccacaacgccggcccgtgttgatctacagcagcaaattatgaccattatagatgaactgggcaaggcttctgccaaggcccagaatctttccgctcctatcactagtgcatcaaggatgcagagtaaccgccatgttgtttatattctcaaagacagttcagcccgaccggctggaaaaggagccattattggtttcatcaaagttggatacaagaagctctttgtactggatgatcgtgaggctcataatgaggtagaaccactttgcatcctggacttttacatccatgagtctgtgcaacgccatggccatgggcgagaactcttccagtatatgttgcagaaggagcgagtggaaccgcaccaactggcaattgaccgaccctcacagaagctgctgaaattcctgaataagcactacaatctggagaccacagtcccacaggtgaacaactttgtgatctttgaaggcttctttgcccatcaacatcggccccctgctccctctctgagggcaactcgacactctcgtgctgctgcagtcgatcccacgcccgctgctccagcaaggaagctgccacccaagagagcagagggagacatcaagccatactcctctagtgaccgagaatttctgaaggtagctgtggagcctccttggcccctaaacagggcccctcgccgcgccacacctccagcccacccacccccccgctccagcagcctgggaaactcaccagaacgaggtcccctccgcccctttgtgccagagcaggagctgctgcgttccttgcgcctctgccccccacaccctaccgcccgccttctgttggctgctgaccctgggggcagcccagctcaacgtcgtcgcaccagggggactcccccaggtctggtagcccaaagctgctgctacagccgccatgggggggtgaattcctcatcccccaatacaggcaaccaagactccaagcagggagaacaggaaacaaagaataggtgaggtctaaacccctcccctaacagcctcccaccaccatctgactcccttcctaacatcattctcagtcacttcctactcttaaatcttattgtatgaactggacaccagctcctcccacaattccttctaccttacatcctgcaagcccctttcccccacaggttcaactctggtacttccctttggaatacggattctctgagaggttttaaatttggacatagcactaatggttccagcttcatacccatcatgtgtcctacattaaaacctggcccgagaccttgaagagtctgtaatcttaatttcctctttagtattcctataacccactctccatctccccacctaccaggtctgccagtgaggagcaggccttgtcacaggatgggtctggggagaagcccatgcacacagctcctccacaggccccggccccgccagcccagtcctggacagtgggtggggacatactcaacgccaggttcattcgaaacctgcaggaacgtcgcagcaccaggccttggtgaccgcagccccgtcaaacatcttcaaagtattatttctccctcactacaggaaagagccaaagcccaaccctcataatagatggatacattcattcattcattcattcagcaggcttatcagattcaagtcatttgtatcttttaaccagaccaataaaagtatttatttttatcacaagagctgttgaaaaatttgactcattatttcagccgcctcacccctcactgtcgttgcacccattcagccttcagccctgtttttgctcagctttttgctcaaaggcctcagctgtgaatacagcgcttgggggggcaggggaggctgtaacttgcgcaagcgcactcaggcagtctccgagcccgcgggcgcaggcgcgcttacagccgacagagcgcttcagccgcttccctcgagcctgcagtgcgcaagcgcgggacat

SEQ ID NO: 440295 - DNA, 1641 bp, Homo sapiens
  misc_feature (1)..(1): n is a, c, g, or t
  misc_feature (3)..(4): n is a, c, g, or t
nannggcacgagagtgacgtcgtgtggggcgggtccgaccgcgcacaatgggccatggagttcccgttcgatgtggacgcgctgttcccggagcggatcacggtgctggaccagcacctgaggcccccagcccgccgacccggaaccacaacgccggcccgtgttgatctacagcagcaaattatgaccattatagatgaactgggcaaggcttctgccaaggcccagaatctttccgctcctatcactagtgcatcaaggatgcagagtaaccgccatgttgtttatattctcaaagacagttcagcccgaccggctggaaaaggagccattattggtttcatcaaagttggatacaagaagctctttgtactggatgatcgtgaggctcataatgaggtagaaccactttgcatcctggacttttacatccatgagtctgtgcaacgccatggccatgggcgagaactcttccagtatatgttgcagaaggagcgagtggaaccgcaccaactggcaattgaccgaccctcacagaagctgctgaaattcctgaataagcactacaatctggagaccacagtcccacaggtgaacaactttgtgatctttgaaggcttctttgcccatcaacatcctccagcaaggaagctgccacccaagagagcagagggagacatcaagccatactcctctagtgaccgagaatggggactcccccaggtctggtagcccaaagctgctgctacagccgccatgggggggtgaattcctcatcccccaatacaggcaaccaagactccaagcagggagaacaggaaacaaagaataggttcaactctggtacttccctttggaatacggattctctgagaggttttaaatttggacatagcactaatggttccagcttcatacccatcatgtgtcctacattaaaacctggcccgagaccttgaagagtctgtaatcttaatttcctctttagtattcctataacccactctccatctccccacctaccaggtctgccagtgaggagcaggccttgtcacaggatgggtctggggagaagcccatgcacacagctcctccacaggccccggccccgccagcccagtcctggacagtgggtggggacatactcaacgccaggttcattcgaaacctgcaggaacgtcgcagcaccaggccttggtgaccgcagccccgtcaaacatcttcaaagtattatttctccctcactacaggaaagagccaaagcccaaccctcataatagatggatacattcattcattcattcattcagcaggcttatcagattcaagtcatttgtatcttttaaccagaccaataaaagtatttatttttatcacaagagctgttgaaaaatttgactcattatttcagccgcctcacccctcactgtcgttgcacccattcagccttcagccctgtttttgctcagctttttgctcaaaggcctcagctgtgaatacagcgcttgggggggcaggggaggctgtaacttgcgcaagcgcactcaggcagtctccgagcccgcgggcgcaggcgcgcttacagccgacagagcgcttcagccgcttccctcgagcctgcagtgcgcaagcgcgggacat

SEQ ID NO: 440296 - DNA, 3001 bp, Homo sapiens
tgatgtgcagccaggattgacaagagcctttagtctagagctcgcagcagacctctagactatttggaatctgattttaaagaatggcccagcagatgaaggtgtttttttaaattgttagtcatgtgaaacgaactgagtattgatcagtaatacagacagggcagctgtgagagagtttgatgctaatctttgcagaactcaagaacatactccataaagtacagctgaaaagatcacgaaaaccttgagccttcgaggaaagagaagggtgacttggggtatgtatggggagaactaaaaacctgtcatcttggttcccacttgtggggaataaagggaaggtattgtcttaactgagctgctaactaatcaagcatgaaggtttctgggaagctgttttgttttttttttttaatttcacctggaattaaattaatagtcccctctggagtcagattttcttttccttcacctatcctcatgcctgagtccacactggattcctcagaataagggtgggcccatttactgctggagcaaagtagaaggttgtggtcctttgctatcacatggtgatggtggtggtttccgtagcaggtaattaaggagatgcacacttttgtatagccctgacagagagaagatgaaagctgctattccttttagtacactttttgagaactaccagaaacctgaactttctctcctagggaagaaaatttggaatttaaataaggccacatttcttcctaggacacaatcacaggaagggcatatggatccgagcatccagggtggttactggggtgatcagacaaataagcattgatgcctggaaggcagaaatcacactgcgacatcaaatgtttcatcaagcaaacagcaaggatctcttcaggctgtgttctctagacccgaaaatgtcctctgtggtttggctgacaaatggaatctctttagaaaacatgcaaaagggtatctcagctatccatgaacgatttggtctaggacaaagaactaacagttccttccaaaatagaggtctgttggtctgtttgacgtcatcccatcatcctatctctccctgtccttgtctgcagtagaagttaatgtaatcataccagatgtttaatgtgaacaagtaatttccaaatgtagaaacaccactgatgcacttagggggaaaaacagtggcagggtgttagagcatctcatcagaggtgaaaatcacccacttggaaacctactgtgcacccgttgtgagttctaagagtgtatcagaaagctgattttaccatctgttgtgaaagattatctgcaatgagggctgctagaaagtcagcctgctgatctcacaagtatatgacttcttattccacttcaaaagtggggaacttgacaagtttcttgtctgccttttgatgttgattctatagattaattagttcaggaacaagtctttcatatacattagactggtatcattgagttctgagctattctgttgttctttaactgacactctggattgccagtgtcggctgctacattctgatacagtaagtcaaaggaatctagtggccaagagttgtagtttagaaacaacccatctgaatactgcttttaccactttgatacctgaaaagatcatccccctttctaaaacctgaaaacaacatatagagaaatactgtagaaaccattgctagtgtcttaactaggaaaagcaagtagactcatcaacaatcctttcaaaacaagacctagagataaacagttttttccagtgtcaattttcatagacatttttaaaaaattaaacacatcttgtcacccagtgctagcaaaaattgtaaagagcaaaaccaaagtttttgatgttagtcttatttttgtaagcagggtatactatagtcgtggcccatatggaacacacaggcagccggttttctgctacctgagccttggagaagatgagaaggaagggctgcctgctgtgctgccctttgaaaaggtccaaagcagacaggagcgcacacagcagaagtcaccttctccttctgatgaccacctttcaaaaggcttaacagaatcaccaagtgtcacagtcagctcttggccagtggaaaattgtctgggcctgtatatgttggaggaactcagatagaaaaggacttgtaaacagcatggaaacctcaacatctgctgtctcaagcacttaaaaaaggctacaattcaggtgttactggatgacttaactgcatggacatttaggggctgacttgtgttgtgattattccaattgtgggctttggagaagcagagggatgattttcagttgtgtgggtgttaagtctatggattgggaatttaccactgaaattgatcgttcaaagtgtgacttcatagtagggccagctcctcctaagttgtccttttgtttttcacataaaatacatctggtactttttacttggaaagttgtactatgtccatgaaaatggttaaatgagaaggccataaagattcatttaatagctgaaaagcaacttttaaaatagaataggacgaatttaacatggaatgatgtgaccttctagggaactttttatagagagcttacatagtgtaattggggagaattttgtcttctatttccattcaacagtagcaaactggtggttttataaaattaacattatagtatgttatataaataaacgttatataaaatgacattaaagtataactgtgaaaaattaaagacttggagttatccacaacctttatgtgcaataaggaaaactgcagtaggcccccaaagtgccgtctttccctagcattttactcaatgtttgcctttgtgtatgtttagattgctattgtaaagctagccatgtgtgttcctgccctttactgatatttaacacattttctcaaagcttttctttttttaaaaaaacaaaactcaaaataaaacaactaactggctgagcta

SEQ ID NO: 440297 - DNA, 3226 bp, Homo sapiens
tgatgtgcagccaggattgacaagagcctttagtctagagctcgcagcagacctctagactatttggaatctgattttaaagaatggcccagcagatgaaggtgtttttttaaattgttagtcatgtgaaacgaactgagtattgatcagtaatacagacagggcagctgtgagagagtttgatgctaatctttgcagaactcaagaacatactccataaagtacagctgaaaagatcacgaaaaccttgagccttcgaggaaagagaagggtgacttggggtatgtatggggagaactaaaaacctgtcatcttggttcccacttgtggggaataaagggaaggtattgtcttaactgagctgctaactaatcaagcatgaaggtttctgggaagctgttttgttttttttttttaatttcacctggaattaaattaatagtcccctctggagtcagattttcttttccttcacctatcctcatgcctgagtccacactggattcctcagaataagggtgggcccatttactgctggagcaaagtagaaggttgtggtcctttgctatcacatggtgatggtggtggtttccgtagcaggtaattaaggagatgcacacttttgtatagccctgacagagagaagatgaaagctgctattccttttagtacactttttgagaactaccagaaacctgaactttctctcctagggaagaaaatttggaatttaaataaggccacatttcttcctaggacacaatcacaggaagggcatatggatccgagcatccagggtggttactggggtgatcagacaaataagcattgatgcctggaaggcagaaatcacactgcgacatcaaatgtttcatcaagcaaacagcaaggatctcttcaggctgtgttctctagacccgaaaatgtcctctgtggtttggctgacaaatggaatctctttagaaaacatgcaaaagggtatctcagctatccatgaacgatttggtctaggacaaagaactaacagttccttccaaaatagaggtctgttggtctgtttgacgtcatcccatcatcctatctctccctgtccttgtctgcagtagaagttaatgtaatcataccagatgtttaatgtgaacaagtaatttccaaatgtagaaacaccactgatgcacttagggggaaaaacagtggcagggtgttagagcatctcatcagaggtgaaaatcacccacttggaaacctactgtgcacccgttgtgagttctaagagtgtatcagaaagctgattttaccatctgttgtgaaagattatctgcaatgagggctgctagaaagtcagcctgctgatctcacaagtatatgacttcttattccacttcaaaagtggggaacttgacaagtttcttgtctgccttttgatgttgattctatagattaattagttcaggaacaagtctttcatatacattagactggtatcattgagttctgagctattctgttgttctttaactgacactctggattgccagtgtcggctgctacattctgatacagtaagtcaaaggaatctagtggccaagagttgtagtttagaaacaacccatctgaatactgcttttaccactttgatacctgaaaagatcatccccctttctaaaacctgaaaacaacatatagagaaatactgtagaaaccattgctagtgtcttaactaggaaaagcaagtagactcatcaacaatcctttcaaaacaagacctagagataaacagttttttccagtgtcaattttcatagacatttttaaaaaattaaacacatcttgtcacccagtgctagcaaaaattgtaaagagcaaaaccaaagtttttgatgttagtcttatttttgtaagcagggtatactatagtcgtggcccatatggaacacacaggcagccggttttctgctacctgagccttggagaagatgagaaggaagggctgcctgctgtgctgccctttgaaaaggtccaaagcagacaggagcgcacacagcagaagtcaccttctccttctgatgaccacctttcaaaaggcttaacagaatcaccaagtgtcacagtcagctcttggccagtggaaaattgtctgggcctgtatatgttggaggaactcagatagaaaaggacttgtaaacagcatggaaacctcaacatctgctgtctcaagcacttaaaaaaggctacaattcaggtgttactggatgacttaactgcatggacatttaggggctgacttgtgttgtgattattccaattgtgggctttggagaagcagagggatgattttcagttgtgtgggtgttaagtctatggattgggaatttaccactgaaattgatcgttcaaagtgtgacttcatagtagggccagctcctcctaagttgtccttttgtttttcacataaaatacatctggtactttttacttggaaagttgtactatgtccatgaaaatggttaaatgagaaggccataaagattcatttaatagctgaaaagcaacttttaaaatagaataggacgaatttaacatggaatgatgtgaccttctagggaactttttatagagagcttacatagtgtaattggggagaattttgtcttctatttccattcaacagtagcaaactggtggttttataaaattaacattatagtatgttatataaataaacgttatataaaatgacattaaagtataactgtgaaaaattaaagacttggagttatccacaacctttatgtgcaataaggaaaactgcagtaggcccccaaagtgccgtctttccctagcattttactcaatgtttgcctttgtgtatgtttagattgctattgtaaagctagccatgtgtgttcctgccctttactgatatttaacacattttctcaaagcttttctttttttaaaaaaacaaaactcaaaataaaacaactaactggctgagctaattttgttttgtattttaaagtaaagtatcatctgttggtagaaggctgtagtgtgatactattcttagtctgtttccctcactgagaggttcttttctgggtgtaagctattcctctccagctttctttaggcctggggttggcaaactacagctggctcctgaaccaagtccagcccactgcctttttttgtaaataaagttttattggcatgactaggaaaa

SEQ ID NO: 440298 - DNA, 2740 bp, Homo sapiens
tgatgtgcagccaggattgacaagagcctttagtctagagctcgcagcagacctctagactatttggaatctgattttaaagaatggcccagcagatgaaggtgtttttttaaattgttagtcatgtgaaacgaactgagtattgatcagtaatacagacagggcagctgtgagagagtttgatgctaatctttgcagaactcaagaacatactccataaagtacagctgaaaagatcacgaaaaccttgagccttcgaggaaagagaagggtgacttggggtatgtatggggagaactaaaaacctgtcatcttggttcccacttgtggggaataaagggaaggtattgtcttaactgagctgctaactaatcaagcatgaaggtttctgggaagctgttttgttttttttttttaatttcacctggaattaaattaatagtcccctctggagtcagattttcttttccttcacctatcctcatgcctgagtccacactggattcctcagaataagggtgggcccatttactgctggagcaaagtagaaggttgtggtcctttgctatcacatggtgatggtggtggtttccgtagcaggtaattaaggagatgcacacttttgtatagccctgacagagagaagatgaaagctgctattccttttagtacactttttgagaactaccagaaacctgaactttctctcctagggaagaaaatttggaatttaaataaggccacatttcttcctaggacacaatcacaggaagggcatatggatccgagcatccagggtggttactggggtgatcagacaaataagcattgatgcctggaaggcagaaatcacactgcgacatcaaatgtttcatcaagcaaacagcaaggatctcttcaggctgtgttctctagacccgaaaatgtcctctgtggtttggctgacaaatggaatctctttagaaaacatgcaaaagggtatctcagctatccatgaacgatttggtctaggacaaagaactaacagttccttccaaaatagaggtctgttggtctgtttgacgtcatcccatcatcctatctctccctgtccttgtctgcagtagaagttaatgtaatcataccagatgtttaatgtgaacaagtaatttccaaatgtagaaacaccactgatgcacttagggggaaaaacagtggcagggtgttagagcatctcatcagaggtgaaaatcacccacttggaaacctactgtgcacccgttgtgagttctaagagtgtatcagaaagctgattttaccatctgttgtgaaagattatctgcaatgagggctgctagaaagtcagcctgctgatctcacaagtatatgacttcttattccacttcaaaagtggggaacttgacaagtttcttgtctgccttttgatgttgattctatagattaattagttcaggaacaagtctttcatatacattagactggtatcattgagttctgagctattctgttgttctttaactgacactctggattgccagtgtcggctgctacattctgatacagtaagtcaaaggaatctagtggccaagagttgtagtttagaaacaacccatctgaatactgcttttaccactttgatacctgaaaagatcatccccctttctaaaacctgaaaacaacatatagagaaatactgtagaaaccattgctagtgtcttaactaggaaaagcaagtagactcatcaacaatcctttcaaaacaagacctagagataaacagttttttccagtgtcaattttcatagacatttttaaaaaattaaacacatcttgtcacccagtgctagcaaaaattgtaaagagcaaaaccaaagtttttgatgttagtcttatttttgtaagcagggtatactatagtcgtggcccatatggaacacacaggcagccggttttctgctacctgagccttggagaagatgagaaggaagggctgcctgctgtgctgccctttgaaaaggtccaaagcagacaggagcgcacacagcagaagtcaccttctccttctgatgaccacctttcaaaaggcttaacagaatcaccaagtgtcacagtcagctcttggccagtggaaaattgtctgggcctgtatatgttggaggaactcagatagaaaaggacttgtaaacagcatggaaacctcaacatctgctgtctcaagcacttaaaaaaggctacaattcaggtgttactggatgacttaactgcatggacatttaggggctgacttgtgttgtgattattccaattgtgggctttggagaagcagagggatgattttcagttgtgtgggtgttaagtctatggattgggaatttaccactgaaattgatcgttcaaagtgtgacttcatagtagggccagctcctcctaagttgtccttttgtttttcacataaaatacatctggtactttttacttggaaagttgtactatgtccatgaaaatggttaaatgagaaggccataaagattcatttaatagctgaaaagcaacttttaaaatagaataggacgaatttaacatggaatgatgtgaccttctagggaactttttatagagagcttacatagtgtaattggggagaattttgtcttctatttccattcaacagtagcaaactggtggttttataaaattaacattatagtatgttatataaataaacgttatataaaatgac

SEQ ID NO: 440299 - DNA, 2081 bp, Homo sapiens
tgatgtgcagccaggattgacaagagcctttagtctagagctcgcagcagacctctagactatttggaatctgattttaaagaatggcccagcagatgaaggtgtttttttaaattgttagtcatgtgaaacgaactgagtattgatcagtaatacagacagggcagctgtgagagagtttgatgctaatctttgcagaactcaagaacatactccataaagtacagctgaaaagatcacgaaaaccttgagccttcgaggaaagagaagggtgacttggggtatgtatggggagaactaaaaacctgtcatcttggttcccacttgtggggaataaagggaaggtattgtcttaactgagctgctaactaatcaagcatgaaggtttctgggaagctgttttgttttttttttttaatttcacctggaattaaattaatagtcccctctggagtcagattttcttttccttcacctatcctcatgcctgagtccacactggattcctcagaataagggtgggcccatttactgctggagcaaagtagaaggttgtggtcctttgctatcacatggtgatggtggtggtttccgtagcaggtaattaaggagatgcacacttttgtatagccctgacagagagaagatgaaagctgctattccttttagtacactttttgagaactaccagaaacctgaactttctctcctagggaagaaaatttggaatttaaataaggccacatttcttcctaggacacaatcacaggaagggcatatggatccgagcatccagggtggttactggggtgatcagacaaataagcattgatgcctggaaggcagaaatcacactgcgacatcaaatgtttcatcaagcaaacagcaaggatctcttcaggctgtgttctctagacccgaaaatgtcctctgtggtttggctgacaaatggaatctctttagaaaacatgcaaaagggtatctcagctatccatgaacgatttggtctaggacaaagaactaacagttccttccaaaatagaggtctgttggtctgtttgacgtcatcccatcatcctatctctccctgtccttgtctgcagtagaagttaatgtaatcataccagatgtttaatgtgaacaagtaatttccaaatgtagaaacaccactgatgcacttagggggaaaaacagtggcagggtgttagagcatctcatcagaggtgaaaatcacccacttggaaacctactgtgcacccgttgtgagttctaagagtgtatcagaaagctgattttaccatctgttgtgaaagattatctgcaatgagggctgctagaaagtcagcctgctgatctcacaagtatatgacttcttattccacttcaaaagtggggaacttgacaagtttcttgtctgccttttgatgttgattctatagattaattagttcaggaacaagtctttcatatacattagactggtatcattgagttctgagctattctgttgttctttaactgacactctggattgccagtgtcggctgctacattctgatacagtaagtcaaaggaatctagtggccaagagttgtagtttagaaacaacccatctgaatactgcttttaccactttgatacctgaaaagatcatccccctttctaaaacctgaaaacaacatatagagaaatactgtagaaaccattgctagtgtcttaactaggaaaagcaagtagactcatcaacaatcctttcaaaacaagacctagagataaacagttttttccagtgtcaattttcatagacatttttaaaaaaacaaaactcaaaataaaacaactaactggctgagctaattttgttttgtattttaaagtaaagtatcatctgttggtagaaggctgtagtgtgatactattcttagtctgtttccctcactgagaggttcttttctgggtgtaagctattcctctccagctttctttaggcctggggttggcaaactacagctggctcctgaaccaagtccagcccactgcctttttttgtaaataaagttttattggcatgactaggaaaa

SEQ ID NO: 440300 - DNA, 1411 bp, Homo sapiens
gctattttctttggccaggttcccactggggcaaagggtccatttctgagcctggctctatgtaaggcaaccggaaatcgactgcccttagtaaagatggcggaaagaacggcgtcattgcctgtcaggttgcggcatcggtgccctcgctcaacatggcggccttctgtgcccgccccctccgctaacgggcacgttactccgtccgaacgcagtagacgaaggcggcggcgatggcggcggggatagtggcttctcgcagactccgcgacctactgacccggcgactgacaggctccaactacccgggactcagtattagccttcgcctcactggctcctctgcacaagaggcggcttccggagtagccctcggtgaagccccagaccacagctatgagtcccttcgtgtgacgtctgcgcagaaacatgttctgcatgtccagctcaaccggcccaacaagaggaatgccatgaacaaggtcttctggagagagatggtagagtgcttcaacaagatttcgagagacgctgactgtcgggcggtggtgatctctggtgcaggaaaaatgttcactgcaggtattgacctgatggacatggcttcggacatcctgcagcccaaaggagatgatgtggcccggatcagctggtacctccgtgacatcatcactcgataccaggagaccttcaacgtcatcgagaggtgccccaagcccgtgattgctgccgtccatgggggctgcattggcggaggtgtggaccttgtcaccgcctgtgacatccggtactgtgcccaggatgctttcttccaggtgaaggaggtggacgtgggtttggctgccgatgtaggaacactgcagcgcctgcccaaggtcatcgggaaccagagcctggtcaacgagctggccttcaccgcccgcaagatgatggctgacgaggccctgggcagtgggctggtcagccgggtgttcccagacaaagaggtcatgctggatgctgccttagcgctggcggccgagatttccagcaagagccccgtggcggtgcagagcaccaaggtcaacctgctgtattcccgcgaccattcggtggccgagagcctcaactacgtggcgtcctggaacatgagcatgctgcagacccaagacctcgtgaagtcggtccaggccacgactgagaacaaggaactgaaaaccgtcaccttctccaagctctgagagccctcgcgtcccaggccccagccagggggccggccttgtcccgcctcatccacagaaagggaggatgggcgatgacagttgtttctatgccttctgacccagtttcccagtttataactttatgacaatgagtttctcaagcccaaggccttatcttcaccccacaaacaataaagcaaagtaaagaa

SEQ ID NO: 440301 - DNA, 652 bp, Homo sapiens
aattaaggctaggtacgaggcttggtggtttgaatcggccgagggctttcttccaggtgaaggaggtggacgtgggtttggctgccgatgtaggaacactgcagcgcctgcccaaggtcatcgggaaccagagcctggtcaacgagctggccttcaccgcccgcaagatgatggctgacgaggccctgggcagtgggctggtcagccgggtgttcccagacaaagaggtcatgctggatgctgccttagcgctggcggccgagatttccagcaagagccccgtggcggtgcagagcaccaaggtcaacctgctgtattcccgcgaccattcggtggccgagagcctcaactacgtggcgtcctggaacatgagcatgctgcagacccaagacctcgtgaagtcggtccaggccacgactgagaacaaggaactgaaaaccgtcaccttctccaagctctgagagccctcgcgtcccaggccccagccagggggccggccttgtcccgcctcatccacagaaagggaggatgggcgatgacagttgtttctatgccttctgacccagtttcccagtttataactttatgacaatgagtttctcaagcccaaggccttatcttcaccccacaaacaataaagcaaagtaaagaa

SEQ ID NO: 440302 - DNA, 493 bp, Homo sapiens
gacaatcgagctcggttccccttttggggactttgctcttttggggtctttgctcttttggggtctttgctttattgtttgtggggtgaagataaggccttgggcttgagaaactcattgtcataaagttataaactgggaaactgggtcagaaggcataggaacactgcagcgcctgcccaaggtcatcgggaaccagagcctggtcaacgagctggccttcaccgcccgcaagatgatggctgacgaggccctgggcagtgggctggtcagccgggtgttcccagacaaagaggtcatgctggatgctgccttagcgctggcggccgagatttccagcaagagccccgtggcggtgcagagcaccaaggtcaacctgctgtattcccgcgaccattcggtggccgagagcctcaactacgtgcgtcctggaacatgagcatgctgcagacccaaaagagcaaagaccccaaaagggggttcttctaaatct

SEQ ID NO: 440303 - DNA, 352 bp, Homo sapiens
cggccgcctactactactactactgctcgaattaagcttctaacgatgtacggggagcgtcctggaacatgagcatgctgcagacccaagacctcgtgaagtcggtccaggccacgactgagaacaaggaactgaaaaccgtcaccttctccaagctctgagagccctcgcgtcccaggccccagccagggggccggccttgtcccgcctcatccacagaaagggaggatgggcgatgacagttgtttctatgccttctgacccagtttcccagtttataactttatgacaatgagtttctcaagcccaaggccttatcttcaccccacaaacaataaagcaaagtaaagaa

SEQ ID NO: 440304 - DNA, 541 bp, Homo sapiens
ttatagcagatgtaggacggggagggctatccggggtcacgaagggcccgagtcccctaaattcaggggactgacaggctccaactacccgggactcagtattagccttcgcctcactggctcctctgcacaagaggcggcttccggagtagccctcggtgaagccccagaccacagctatgagtcccttcgtgtgacgtctgcgcagaaacatgttctgcatgtccagctcaaccggcccaacaagaggaatgccatgaacaaggtcttctggagagagatggtagagtgcttcaacaagatttcgagagacgctgactgtcgggcggtggtgatctctggtgcaggaaaaatgttcactgcagaggtaccagacgctcttcacacaccctgccagccttcctagctcctggcaatagacagtggagcagtgcttctgaattagggttttaagcagcttctgacttacacactttttttttttttttttgagacggggtcttgctctgttgccacgctggagtgcagtagcgcaatctca

SEQ ID NO: 440305 - DNA, 1720 bp, Homo sapiens
gctattttctttggccaggttcccactggggcaaagggtccatttctgagcctggctctatgtaaggcaaccggaaatcgactgcccttagtaaagatggcggaaagaacggcgtcattgcctgtcaggttgcggcatcggtgccctcgctcaacatggcggccttctgtgcccgccccctccgctaacgggcacgttactccgtccgaacgcagtagacgaaggcggcggcgatggcggcggggatagtggcttctcgcagactccgcgacctactgacccggcgactgacaggctccaactacccgggactcagtattagccttcgcctcactggctcctctgcacaagaggcggcttccggagtagccctcggtgaagccccagaccacagctatgagtcccttcgtgtgacgtctgcgcagaaacatgttctgcatgtccagctcaaccggcccaacaagaggaatgccatgaacaaggtcttctggagagagatggtagagtgcttcaacaagatttcgagagacgctgactgtcgggcggtggtgatctctggtgcaggaaaaatgttcactgcaggtattgacctgatggacatggcttcggacatcctgcagcccaaaggagatgatgtggcccggatcagctggtacctccgtgacatcatcactcgataccaggagaccttcaacgtcatcgagaggtgccccaagcccgtgattgctgccgtccatgggggctgcattggcggaggtgtggaccttgtcaccgcctgtgacatccggtactgtgcccaggatgctttcttccaggtgaaggaggtggacgtgggtttggctgccgatgtaggaacactgcagcgcctgcccaaggtcatcgggaaccagagcctggtcaacgagctggccttcaccgcccgcaagatgatggctgacgaggccctgggcagtgggctggtcagccgggtgttcccagacaaagaggtcatgctggatgctgccttagcgctggcggccgagatttccagcaagagccccgtggcggtgcagagcaccaaggtcaacctgctgtattcccgcgaccattcggtggccgagagcctcaactacgtggcgtcctggaacatgagcatgctgcagacccaagacctcgtgaagtcggtccaggccacgactgagaacaaggaactgaaaaccgtcaccttctccaagctctgagagccctcgcgtcccaggccccagccagggggccggccttgtcccgcctcatccacagaaagggaggatgggcgatgacagttgtttctatgccttctgacccagtttcccagtttataactttatgacaatgagtttctcaagcccaaggccttatcttcaccccacaaacaataaagcaaagtaaagaaaaaaaaaaaaacaaaaaaaaacaaaaaaaaaacatttggtgggcccgcctgcgggccctctagaaaaagttttctaaaacacctctcgttggggcgcgccggggcccaatatgggttataccggaaacacctgcggcccatagactgtggtccaaaagggacaccccgtggcactagcacaactggggggtggcgttccctcacaataaaaaagcgccgcgtcggaacaccgggcgtgtctgtgacaactccaaaggggcgttcggacgggccaggggagctaccagcgagcgcaagcggagccatata

SEQ ID NO: 440306 - DNA, 1436 bp, Homo sapiens
gctattttctttggccaggttcccactggggcaaagggtccatttctgagcctggctctatgtaaggcaaccggaaatcgactgcccttagtaaagatggcggaaagaacggcgtcattgcctgtcaggttgcggcatcggtgccctcgctcaacatggcggccttctgtgcccgccccctccgctaacgggcacgttactccgtccgaacgcagtagacgaaggcggcggcgatggcggcggggatagtggcttctcgcagactccgcgacctactgacccggcgtgagtcacctcttgccttatgggggactgacaggctccaactacccgggactcagtattagccttcgcctcactggctcctctgcacaagaggcggcttccggagtagccctcggtgaagccccagaccacagctatgagtcccttcgtgtgacgtctgcgcagaaacatgttctgcatgtccagctcaaccggcccaacaagaggaatgccatgaacaaggtcttctggagagagatggtagagtgcttcaacaagatttcgagagacgctgactgtcgggcggtggtgatctctggtgcaggaaaaatgttcactgcaggtattgacctgatggacatggcttcggacatcctgcagcccaaaggagatgatgtggcccggatcagctggtacctccgtgacatcatcactcgataccaggagaccttcaacgtcatcgagaggtgccccaagcccgtgattgctgccgtccatgggggctgcattggcggaggtgtggaccttgtcaccgcctgtgacatccggtactgtgcccaggatgctttcttccaggtgaaggaggtggacgtgggtttggctgccgatgtaggaacactgcagcgcctgcccaaggtcatcgggaaccagagcctggtcaacgagctggccttcaccgcccgcaagatgatggctgacgaggccctgggcagtgggctggtcagccgggtgttcccagacaaagaggtcatgctggatgctgccttagcgctggcggccgagatttccagcaagagccccgtggcggtgcagagcaccaaggtcaacctgctgtattcccgcgaccattcggtggccgagagcctcaactacgtggcgtcctggaacatgagcatgctgcagacccaagacctcgtgaagtcggtccaggccacgactgagaacaaggaactgaaaaccgtcaccttctccaagctctgagagccctcgcgtcccaggccccagccagggggccggccttgtcccgcctcatccacagaaagggaggatgggcgatgacagttgtttctatgccttctgacccagtttcccagtttataactttatgacaatgagtttctcaagcccaaggccttatcttcaccccacaaacaataaagcaaagtaaagaa

SEQ ID NO: 440307 - DNA, 1552 bp, Homo sapiens
gctattttctttggccaggttcccactggggcaaagggtccatttctgagcctggctctatgtaaggcaaccggaaatcgactgcccttagtaaagatggcggaaagaacggcgtcattgcctgtcaggttgcggcatcggtgccctcgctcaacatggcggccttctgtgcccgccccctccgctaacgggcacgttactccgtccgaacgcagtagacgaaggcggcggcgatggcggcggggatagtggcttctcgcagactccgcgacctactgacccggcgactgacaggctccaactacccgggactcagtattagccttcgcctcactggctcctctgcacaagaggcggcttccggagtagccctcggtgaagccccagaccacagctatgagtcccttcgtgtgacgtctgcgcagaaacatgttctgcatgtccagctcaaccggcccaacaagaggaatgccatgaacaaggtcttctggagagagatggtagagtgcttcaacaagatttcgagagacgctgactgtcgggcggtggtgatctctggtgcaggaaaaatgttcactgcaggtattgacctgatggacatggcttcggacatcctgcagcccaaaggagatgatgtggcccggatcagctggtacctccgtgacatcatcactcgataccaggagaccttcaacgtcatcgagaggtgccccaagcccgtgattgctgccgtccatgggggctgcattggcggaggtgtggaccttgtcaccgcctgtgacatccggtactgtgcccaggatgctttcttccaggtgaaggaggtggacgtgggtttggctgccgatgtaggaacactgcagcgcctgcccaaggtcatcgggaaccagagcctggtcaacgagctggccttcaccgcccgcaagatgatggctgacgaggccctgggcagtgggctggtcagccgggtgttcccagacaaagaggtcatgctggatgctgccttagcgctggcggccgagatttccagcaagagccccgtggcggtgcagagcaccaaggtcaacctgctgtattcccgcgaccattcggtggccgagagcctcaactacgtggtaaggtgcacgctccgaccaatcacagccctcctctaaccccaggcgaccaaccagggtgcagggtgctctcatgctttatcctgattggcccctgctaatctctctcctcgttctctctcaacaccctcggtaccaggcgcgtcctggaacatgagcatgctgcagacccaagacctcgtgaagtcggtccaggccacgactgagaacaaggaactgaaaaccgtcaccttctccaagctctgagagccctcgcgtcccaggccccagccagggggccggccttgtcccgcctcatccacagaaagggaggatgggcgatgacagttgtttctatgccttctgacccagtttcccagtttataactttatgacaatgagtttctcaagcccaaggccttatcttcaccccacaaacaataaagcaaagtaaagaa

SEQ ID NO: 440308 - DNA, 1103 bp, Homo sapiens
attggagtgtagcctgagaagtatctggggcagatgaggtcagagatggcaacaggaatgagatcaccagtggccctgtagccacctcaaagaattttagactttaacctacgtgttcatcagatctctttaagagtcttaaacagggaaaaaacatgattttctttcttggcagcgttccacagagagatggtagagtgcttcaacaagatttcgagagacgctgactgtcgggcggtggtgatctctggtgcaggaaaaatgttcactgcaggtattgacctgatggacatggcttcggacatcctgcagcccaaaggagatgatgtggcccggatcagctggtacctccgtgacatcatcactcgataccaggagaccttcaacgtcatcgagaggtgccccaagcccgtgattgctgccgtccatgggggctgcattggcggaggtgtggaccttgtcaccgcctgtgacatccggtactgtgcccaggatgctttcttccaggtgaaggaggtggacgtgggtttggctgccgatgtaggaacactgcagcgcctgcccaaggtcatcgggaaccagagcctggtcaacgagctggccttcaccgcccgcaagatgatggctgacgaggccctgggcagtgggctggtcagccgggtgttcccagacaaagaggtcatgctggatgctgccttagcgctggcggccgagatttccagcaagagccccgtggcggtgcagagcaccaaggtcaacctgctgtattcccgcgaccattcggtggccgagagcctcaactacgtggcgtcctggaacatgagcatgctgcagacccaagacctcgtgaagtcggtccaggccacgactgagaacaaggaactgaaaaccgtcaccttctccaagctctgagagccctcgcgtcccaggccccagccagggggccggccttgtcccgcctcatccacagaaagggaggatgggcgatgacagttgtttctatgccttctgacccagtttcccagtttataactttatgacaatgagtttctcaagcccaaggccttatcttcaccccacaaacaataaagcaaagtaaagaa

SEQ ID NO: 440309 - DNA, 1373 bp, Homo sapiens
gctattttctttggccaggttcccactggggcaaagggtccatttctgagcctggctctatgtaaggcaaccggaaatcgactgcccttagtaaagatggcggaaagaacggcgtcattgcctgtcaggttgcggcatcggtgccctcgctcaacatggcggccttctgtgcccgccccctccgctaacgggcacgttactccgtccgaacgcagtagacgaaggcggcggcgatggcggcggggatagtggcttctcgcagactccgcgacctactgacccggcgactgacaggctccaactacccgggactcagtattagccttcgcctcactggctcctctgcacaagaggcggcttccggagtagccctcggtgaagccccagaccacagctatgagtcccttcgtgtgacgtctgcgcagaaacatgttctgcatgtccagctcaaccggcccaacaagaggaatgccatgaacaaggtcttctggagagagatggtagagtgcttcaacaagatttcgagagacgctgactgtcgggcggtggtgatctctggtgcaggaaaaatgttcactgcagcccaaaggagatgatgtggcccggatcagctggtacctccgtgacatcatcactcgataccaggagaccttcaacgtcatcgagaggtgccccaagcccgtgattgctgccgtccatgggggctgcattggcggaggtgtggaccttgtcaccgcctgtgacatccggtactgtgcccaggatgctttcttccaggtgaaggaggtggacgtgggtttggctgccgatgtaggaacactgcagcgcctgcccaaggtcatcgggaaccagagcctggtcaacgagctggccttcaccgcccgcaagatgatggctgacgaggccctgggcagtgggctggtcagccgggtgttcccagacaaagaggtcatgctggatgctgccttagcgctggcggccgagatttccagcaagagccccgtggcggtgcagagcaccaaggtcaacctgctgtattcccgcgaccattcggtggccgagagcctcaactacgtggcgtcctggaacatgagcatgctgcagacccaagacctcgtgaagtcggtccaggccacgactgagaacaaggaactgaaaaccgtcaccttctccaagctctgagagccctcgcgtcccaggccccagccagggggccggccttgtcccgcctcatccacagaaagggaggatgggcgatgacagttgtttctatgccttctgacccagtttcccagtttataactttatgacaatgagtttctcaagcccaaggccttatcttcaccccacaaacaataaagcaaagtaaagaa

SEQ ID NO: 440310 - DNA, 1683 bp, Homo sapiens
gctattttctttggccaggttcccactggggcaaagggtccatttctgagcctggctctatgtaaggcaaccggaaatcgactgcccttagtaaagatggcggaaagaacggcgtcattgcctgtcaggttgcggcatcggtgccctcgctcaacatggcggccttctgtgcccgccccctccgctaacgggcacgttactccgtccgaacgcagtagacgaaggcggcggcgatggcggcggggatagtggcttctcgcagactccgcgacctactgacccggcgactgacaggctccaactacccgggactcagtattagccttcgcctcactggctcctctgcacaagaggcggcttccggagtagccctcggtgaagccccagaccacagctatgagtcccttcgtgtgacgtctgcgcagaaacatgttctgcatgtccagctcaaccggcccaacaagaggaatgccatgaacaaggtcttctggagagagatggtagagtgcttcaacaagatttcgagagacgctgactgtcgggcggtggtgatctctggtgcaggaaaaatgttcactgcaggtattgacctgatggacatggcttcggacatcctgcagcccaaaggagatgatgtggcccggatcagctggtacctccgtgacatcatcactcgataccaggagaccttcaacgtcatcgagagggtgactctaggggtctggaggggatctttctccatacgcgcctcccctgggccagccctgaccccactcttcctgttccctctcagtgccccaagcccgtgattgctgccgtccatgggggctgcattggcggaggtgagtctgcggctatcctcctgctcgggtgctccccaggtggggctgctgctccgatgccgcggccactggcatccagcctcagctctgtcatgggccagactgtgtcccaagaggcagccccacctcccgggagccagggttggttctggtggtcattcagcatccctggcctctacctcctaggtgtggaccttgtcaccgcctgtgacatccggtactgtgcccaggatgctttcttccaggtgaaggaggtggacgtgggtttggctgccgatgtaggaacactgcagcgcctgcccaaggtcatcgggaaccagagcctggtcaacgagctggccttcaccgcccgcaagatgatggctgacgaggccctgggcagtgggctggtcagccgggtgttcccagacaaagaggtcatgctggatgctgccttagcgctggcggccgagatttccagcaagagccccgtggcggtgcagagcaccaaggtcaacctgctgtattcccgcgaccattcggtggccgagagcctcaactacgtggcgtcctggaacatgagcatgctgcagacccaagacctcgtgaagtcggtccaggccacgactgagaacaaggaactgaaaaccgtcaccttctccaagctctgagagccctcgcgtcccaggccccagccagggggccggccttgtcccgcctcatccacagaaagggaggatgggcgatgacagttgtttctatgccttctgacccagtttcccagtttataactttatgacaatgagtttctcaagcccaaggccttatcttcaccccacaaacaataaagcaaagtaaagaa

SEQ ID NO: 440311 - DNA, 1330 bp, Homo sapiens
gctattttctttggccaggttcccactggggcaaagggtccatttctgagcctggctctatgtaaggcaaccggaaatcgactgcccttagtaaagatggcggaaagaacggcgtcattgcctgtcaggttgcggcatcggtgccctcgctcaacatggcggccttctgtgcccgccccctccgctaacgggcacgttactccgtccgaacgcagtagacgaaggcggcggcgatggcggcggggatagtggcttctcgcagactccgcgacctactgacccggcgactgacaggctccaactacccgggactcagtattagccttcgcctcactggctcctctgcacaagaggcggcttccggagtagccctcggtgaagccccagaccacagctatgagtcccttcgtgtgacgtctgcgcagaaacatgttctgcatgtccagctcaaccggcccaacaagaggaatgccatgaacaaggtcttctggagagagatggtagagtgcttcaacaagatttcgagagacgctgactgtcgggcggtggtgatctctggtgcaggaaaaatgttcactgcaggtattgacctgatggacatggcttcggacatcctgcagcccaaaggagatgatgtggcccggatcagctggtacctccgtgacatcatcactcgataccaggagaccttcaacgtcatcgagaggtgccccaagcccgtgattgctgccgtccatgggggctgcattggcggaggtgtggaccttgtcaccgcctgtgacatccggtactgtgcccaggatgctttcttccaggtgaaggaggtggacgtgggtttggctgccgatgtaggaacactgcagcgcctgcccaaggtcatcgggaaccagagcctggtcaacgagctggccttcaccgcccgcaagatgatggctgacgagatttccagcaagagccccgtggcggtgcagagcaccaaggtcaacctgctgtattcccgcgaccattcggtggccgagagcctcaactacgtggcgtcctggaacatgagcatgctgcagacccaagacctcgtgaagtcggtccaggccacgactgagaacaaggaactgaaaaccgtcaccttctccaagctctgagagccctcgcgtcccaggccccagccagggggccggccttgtcccgcctcatccacagaaagggaggatgggcgatgacagttgtttctatgccttctgacccagtttcccagtttataactttatgacaatgagtttctcaagcccaaggccttatcttcaccccacaaacaataaagcaaagtaaagaa

SEQ ID NO: 440312 - DNA, 720 bp, Homo sapiens
gacaatcgagctcggttccccttttggggactttgctcttttggggtctttgctcttttggggtctttgctttattgtttgtggggtgaagataaggccttgggcttgagaaactcattgtcataaagttataaactgggaaactgggtcagaaggcataggaacactgcagcgcctgcccaaggtcatcgggaaccagagcctggtcaacgagctggccttcaccgcccgcaagatgatggctgacgaggccctgggcagtgggctggtcagccgggtgttcccagacaaagaggtcatgctggatgctgccttagcgctggcggccgagatttccagcaagagccccgtggcggtgcagagcaccaaggtcaacctgctgtattcccgcgaccattcggtggccgagagcctcaactacgtggcgtcctggaacatgagcatgctgcagacccaagacctcgtgaagtcggtccaggccacgactgagaacaaggaactgaaaaccgtcaccttctccaagctctgagagccctcgcgtcccaggccccagccagggggccggccttgtcccgcctcatccacagaaagggaggatgggcgatgacagttgtttctatgccttctgacccagtttcccagtttataactttatgacaatgagtttctcaagcccaaggccttatcttcaccccacaaacaataaagcaaagtaaagaa

SEQ ID NO: 440313 - DNA, 961 bp, Homo sapiens
gctattttctttggccaggttcccactggggcaaagggtccatttctgagcctggctctatgtaaggcaaccggaaatcgactgcccttagtaaagatggcggaaagaacggcgtcattgcctgtcaggttgcggcatcggtgccctcgctcaacatggcggccttctgtgcccgccccctccgctaacgggcacgttactccgtccgaacgcagtagacgaaggcggcggcgatggcggcggggatagtggcttctcgcagactccgcgacctactgacccggcgactgacaggctccaactacccgggactcagtattagccttcgcctcactggctcctctgcacaagaggcggcttccggagtagccctcggtgaagccccagaccacagctatgagtcccttcgtgtgacgtctgcgcagaaacatgttctgcatgtccagctcaaccggcccaacaagaggaatgccatgaacaaggtcttctggagagagatggtagagtgcttcaacaagatttcgagagacgctgactgtcgggcggtggtgatctctggtgcaggaaaaatgttcactgcaggtattgacctgatggacatggcttcggacatcctgcagcccaaaggagatgatgtggcccggatcagctggtacctccgtgacatcatcactcgataccaggagaccttcaacgtcatcgagaggtgccccaagcccgtgattgctgccgtccatgggggctgcattggcggaggtgtggaccttgtcaccgcctgtgacatccggtactgtgcccaggatgctttcttccaggtgaaggaggtggacgtgggtttggctgccgatgtaggaacactgcagcgcctgcccaaggtcatcgggaaccagagcctgctcaactagctggcctttaccgcccgtatacctataggtcactagctttctgccacctttacccg

SEQ ID NO: 440314 - DNA, 913 bp, Homo sapiens
gctattttctttggccaggttcccactggggcaaagggtccatttctgagcctggctctatgtaaggcaaccggaaatcgactgcccttagtaaagatggcggaaagaacggcgtcattgcctgtcaggttgcggcatcggtgccctcgctcaacatggcggccttctgtgcccgccccctccgctaacgggcacgttactccgtccgaacgcagtagacgaaggcggcggcgatggcggcggggatagtggcttctcgcagactccgcgacctactgacccggcgactgacaggctccaactacccgggactcagtattagccttcgcctcactggctcctctgcacaagaggcggcttccggagtagccctcggtgaagccccagaccacagctatgagtcccttcgtgtgacgtctgcgcagaaacatgttctgcatgtccagctcaaccggcccaacaagaggaatgccatgaacaaggtcttctggagagagatggtagagtgcttcaacaagatttcgagagacgctgactgtcgggcggtggtgatctctggtgcaggaaaaatgttcactgcaggtattgacctgatggacatggcttcggacatcctgcagcccaaaggagatgatgtggcccggatcagctggtacctccgtgacatcatcactcgataccaggagaccttcaacgtcatcgagaggtgccccaagcccgtgattgctgccgtccatgggggctgcattggcggagggccttgtcccgcctcatccacagaaagggaggatgggcgatgacagttgtttctatgccttctgacccagtttcccagtttataactttatgacaatgagtttctcaagcccaaggccttatcttcaccccacaaacaataaagcaaagtaaagaa

SEQ ID NO: 440315 - DNA, 786 bp, Homo sapiens
ttatagcagatgtaggacggggagggctatccggggtcacgaagggcccgagtcccctaaattcaggggtgcgtgtgctcccttttgaaggactccctaattcgataggcctgtgtcttgcagtctggggtcatcaaaggctgttcctttctccccaggactgacaggctccaactacccgggactcagtattagccttcgcctcactggctcctctgcacaagaggcggcttccggagtagccctcggtgaagccccagaccacagctatgagtcccttcgtgtgacgtctgcgcagaaacatgttctgcatgtccagctcaaccggcccaacaagaggaatgccatgaacaaggtcttctggagagagatggtagagtgcttcaacaagatttcgagagacgctgactgtcgggcggtggtgatctctggtgcaggaaaaatgttcactgcaggtattgacctgatggacatggcttcggacatcctgcagcccaaaggagatgatgtggcccggatcagctggtacctccgtgacatcatcactcgataccaggagaccttcaacgtcatcgagaggtgccccaagcccgtgattgctgccgtccatgggggctgcattggcggagggccttgtcccgcctcatccacagaaagggaggatgggcgatgacagttgtttctatgccttctgacccagtttcccagtttataactttatgacaatgagtttctcaagcccaaggccttatcttcaccccacaaacaataaagcaaagtaaagaa

SEQ ID NO: 440316 - DNA, 749 bp, Homo sapiens
aaggctagtagaggctgggttaatcggacgagggtcatcgagaggtgccccaagcccgtgattgctgccgtccatgggggctgcattggcggaggtgtggaccttgtcaccgcctgtgacatccggtactgtgcccaggatgctttcttccaggtgaaggaggtggacgtgggtttggctgccgatgtaggaacactgcagcgcctgcccaaggtcatcgggaaccagagcctggtcaacgagctggccttcaccgcccgcaagatgatggctgacgaggccctgggcagtgggctggtcagccgggtgttcccagacaaagaggtcatgctggatgctgccttagcgctggcggccgagatttccagcaagagccccgtggcggtgcagagcaccaaggtcaacctgctgtattcccgcgaccattcggtggccgagagcctcaactacgtggcgtcctggaacatgagcatgctgcagacccaagacctcgtgaagtcggtccaggccacgactgagaacaaggaactgaaaaccgtcaccttctccaagctctgagagccctcgcgtcccaggccccagccagggggccggccttgtcccgcctcatccacagaaagggaggatgggcgatgacagttgtttctatgccttctgacccagtttcccagtttataactttatgacaatgagtttctcaagcccaaggccttatcttcaccccacaaacaataaagcaaagtaaagaa

SEQ ID NO: 440317 - DNA, 916 bp, Homo sapiens
gctattttctttggccaggttcccactggggcaaagggtccatttctgagcctggctctatgtaaggcaaccggaaatcgactgcccttagtaaagatggcggaaagaacggcgtcattgcctgtcaggttgcggcatcggtgccctcgctcaacatggcggccttctgtgcccgccccctccgctaacgggcacgttactccgtccgaacgcagtagacgaaggcggcggcgatggcggcggggatagtggcttctcgcagactccgcgacctactgacccggcgactgacaggctccaactacccgggactcagtattagccttcgcctcactggctcctctgcacaagaggcggcttccggagtagccctcggtgaagccccagaccacagctatgagtcccttcgtgtgacgtctgcgcagaaacatgttctgcatgtccagctcaaccggcccaacaagaggaatgccatgaacaaggtcttctggagagagatggtagagtgcttcaacaagatttcgagagacgctgactgtcgggcggtggtgatctctggtgcaggaaaaatgttcactgcaggtattgacctgatggacatggcttcggacatcctgcaggcgtcctggaacatgagcatgctgcagacccaagacctcgtgaagtcggtccaggccacgactgagaacaaggaactgaaaaccgtcaccttctccaagctctgagagccctcgcgtcccaggccccagccagggggccggccttgtcccgcctcatccacagaaagggaggatgggcgatgacagttgtttctatgccttctgacccagtttcccagtttataactttatgacaatgagtttctcaagcccaaggccttatcttcaccccacaaacaataaagcaaagtaaagaa

SEQ ID NO: 440318 - DNA, 1381 bp, Homo sapiens
gctattttctttggccaggttcccactggggcaaagggtccatttctgagcctggctctatgtaaggcaaccggaaatcgactgcccttagtaaagatggcggaaagaacggcgtcattgcctgtcaggttgcggcatcggtgccctcgctcaacatggcggccttctgtgcccgccccctccgctaacgggcacgttactccgtccgaacgcagtagacgaaggcggcggcgatggcggcggggatagtggcttctcgcagactccgcgacctactgacccggcgactgacaggctccaactacccgggactcagtattagccttcgcctcactggctcctctgcacaagaggcggcttccggagtagccctcggtgaagccccagaccacagctatgagtcccttcgtgtgacgtctgcgcagaaacatgttctgcatgtccagctcaaccggcccaacaagaggaatgccatgaacaaggtcttctggagagagatggtagagtgcttcaacaagatttcgagagacgctgactgtcgggcggtggtgatctctggtgcaggaaaaatgttcactgcaggtattgacctgatggacatggcttcggacatcctgcagcccaaaggagatgatgtggcccggatcagctggtacctccgtgacatcatcactcgataccaggagaccttcaacgtcatcgagaggtgccccaagcccgtgattgctgccgtccatgggggctgcattggcggaggtgtggaccttgtcaccgcctgtgacatccggtactgtgcccaggatgctttcttccaggtgaaggaggtggacgtgggtttggctgccgatgtaggaacactgcagcgcctgcccaaggtcatcgggaaccagagcctggtcaacgagctggccttcaccgcccgcaagatgatggctgacgaggccctgggcagtgggctggtcagccgggtgttcccagacaaagaggtcatgctggatgctgccttagcgctggcggccgagatttccagcaagagccccgtggcggtgcagagcaccaaggtcaacctgctgtattcccgcgaccattcggtggccgagagcctcaactacgtggcgtcctggaacatgagcatgctgcagacccaagacctcgtgaagtcggtccaggccacgactgagaacaaggaactgaaaaccgtcaccttctccaagctctgagagccctcgcgtcccaggccccagccagggggccggccttgtcccgcctcatccacagaaagggaggatgggcgatgacagttgtttctatgccttctgacccagtttcccagtttataactttatgacatcttaatctgggcccagcctgctggtccgct

SEQ ID NO: 440319 - DNA, 1284 bp, Homo sapiens
ttatagcagatgtaggacggggagggctatccggggtcacgaagggcccgagtcccctaaattcaggggtgcgtgtgctcccttttgaaggactccctaattcgataggcctgtgtcttgcagtctggggtcatcaaaggctgttcctttctccccaggactgacaggctccaactacccgggactcagtattagccttcgcctcactggctcctctgcacaagaggcggcttccggagtagccctcggtgaagccccagaccacagctatgagtcccttcgtgtgacgtctgcgcagaaacatgttctgcatgtccagctcaaccggcccaacaagaggaatgccatgaacaaggtcttctggagagagatggtagagtgcttcaacaagatttcgagagacgctgactgtcgggcggtggtgatctctggtgcaggaaaaatgttcactgcaggtattgacctgatggacatggcttcggacatcctgcagcccaaaggagatgatgtggcccggatcagctggtacctccgtgacatcatcactcgataccaggagaccttcaacgtcatcgagaggtgccccaagcccgtgattgctgccgtccatgggggctgcattggcggaggtgtggaccttgtcaccgcctgtgacatccggtactgtgcccaggatgctttcttccaggtgaaggaggtggacgtgggtttggctgccgatgtaggaacactgcagcgcctgcccaaggtcatcgggaaccagagcctggtcaacgagctggccttcaccgcccgcaagatgatggctgacgaggccctgggcagtgggctggtcagccgggtgttcccagacaaagaggtcatgctggatgctgccttagcgctggcggccgagatttccagcaagagccccgtggcggtgcagagcaccaaggtcaacctgctgtattcccgcgaccattcggtggccgagagcctcaactacgtggcgtcctggaacatgagcatgctgcagacccaagacctcgtgaagtcggtccaggccacgactgagaacaaggaactgaaaaccgtcaccttctccaagctctgagagccctcgcgtcccaggccccagccagggggccggccttgtcccgcctcatccacagaaagggaggatgggcgatgacagttgtttctatgccttctgacccagtttcccagtttataactttatgacaatgagtttctcaagcccaaggccttatcttcaccccacaaacaataaagcaaagtaaagaa

SEQ ID NO: 440320 - DNA, 1203 bp, Homo sapiens
gctattttctttggccaggttcccactggggcaaagggtccatttctgagcctggctctatgtaaggcaaccggaaatcgactgcccttagtaaagatggcggaaagaacggcgtcattgcctgtcaggttgcggcatcggtgccctcgctcaacatggcggccttctgtgcccgccccctccgctaacgggcacgttactccgtccgaacgcagtagacgaaggcggcggcgatggcggcggggatagtggcttctcgcagactccgcgacctactgacccggcagagatggtagagtgcttcaacaagatttcgagagacgctgactgtcgggcggtggtgatctctggtgcaggaaaaatgttcactgcaggtattgacctgatggacatggcttcggacatcctgcagcccaaaggagatgatgtggcccggatcagctggtacctccgtgacatcatcactcgataccaggagaccttcaacgtcatcgagaggtgccccaagcccgtgattgctgccgtccatgggggctgcattggcggaggtgtggaccttgtcaccgcctgtgacatccggtactgtgcccaggatgctttcttccaggtgaaggaggtggacgtgggtttggctgccgatgtaggaacactgcagcgcctgcccaaggtcatcgggaaccagagcctggtcaacgagctggccttcaccgcccgcaagatgatggctgacgaggccctgggcagtgggctggtcagccgggtgttcccagacaaagaggtcatgctggatgctgccttagcgctggcggccgagatttccagcaagagccccgtggcggtgcagagcaccaaggtcaacctgctgtattcccgcgaccattcggtggccgagagcctcaactacgtggcgtcctggaacatgagcatgctgcagacccaagacctcgtgaagtcggtccaggccacgactgagaacaaggaactgaaaaccgtcaccttctccaagctctgagagccctcgcgtcccaggccccagccagggggccggccttgtcccgcctcatccacagaaagggaggatgggcgatgacagttgtttctatgccttctgacccagtttcccagtttataactttatgacaatgagtttctcaagcccaaggccttatcttcaccccacaaacaataaagcaaagtaaagaa

SEQ ID NO: 440321 - DNA, 1687 bp, Homo sapiens
gctattttctttggccaggttcccactggggcaaagggtccatttctgagcctggctctatgtaaggcaaccggaaatcgactgcccttagtaaagatggcggaaagaacggcgtcattgcctgtcaggttgcggcatcggtgccctcgctcaacatggcggccttctgtgcccgccccctccgctaacgggcacgttactccgtccgaacgcagtagacgaaggcggcggcgatggcggcggggatagtggcttctcgcagactccgcgacctactgacccggcgactgacaggctccaactacccgggactcagtattagccttcgcctcactggctcctctgcacaagaggcggcttccggagtagccctcggtgaagccccagaccacagctatgagtcccttcgtgtgacgtctgcgcagaaacatgttctgcatgtccagctcaaccggcccaacaagaggaatgccatgaacaaggtcttctggagagagatggtagagtgcttcaacaagatttcgagagacgctgactgtcgggcggtggtgatctctggtgcaggaaaaatgttcactgcaggtattgacctgatggacatggcttcggacatcctgcagcccaaaggagatgatgtggcccggatcagctggtacctccgtgacatcatcactcgataccaggagaccttcaacgtcatcgagaggtgccccaagcccgtgattgctgccgtccatgggggctgcattggcggaggtgtggaccttgtcaccgcctgtgacatccggtactgtgcccaggatgctttcttccaggtgaaggaggtggacgtgggtttggctgccgatgtaggaacactgcagcgcctgcccaaggtcatcgggaaccagagcctggtcaacgagctggccttcaccgcccgcaagatgatggctgacgaggccctgggcagtgggctggtcaggtagggccatggccgtggtagctcagtgctgggggcagccaggcctggagggttggaggcctctccgggtccccttgtctcctcgctctagaattcctagtggcatcctttcttggtgagctcatttctttattgtggggtcagccccctgctctgattgggctgtttctctggggtcttgggccttcctctgtgagtggccacttcttcatctgcgggaggctggaggagagagcccttcccagcccacccggtccctgatctctttcactgcagccgggtgttcccagacaaagaggtcatgctggatgctgccttagcgctggcggccgagatttccagcaagagccccgtggcggtgcagagcaccaaggtcaacctgctgtattcccgcgaccattcggtggccgagagcctcaactacgtggcgtcctggaacatgagcatgctgcagacccaagacctcgtgaagtcggtccaggccacgactgagaacaaggaactgaaaaccgtcaccttctccaagctctgagagccctcgcgtcccaggccccagccagggggccggccttgtcccgcctcatccacagaaagggaggatgggcgatgacagttgtttctatgccttctgacccagtttcccagtttataactttatgacaatgagtttctcaagcccaaggccttatcttcaccccacaaacaataaagcaaagtaaagaa

SEQ ID NO: 440322 - DNA, 1171 bp, Homo sapiens
gctattttctttggccaggttcccactggggcaaagggtccatttctgagcctggctctatgtaaggcaaccggaaatcgactgcccttagtaaagatggcggaaagaacggcgtcattgcctgtcaggttgcggcatcggtgccctcgctcaacatggcggccttctgtgcccgccccctccgctaacgggcacgttactccgtccgaacgcagtagacgaaggcggcggcgatggcggcggggatagtggcttctcgcagactccgcgacctactgacccggcgactgacaggctccaactacccgggactcagtattagccttcgcctcactggctcctctgcacaagaggcggcttccggagtagccctcggtgaagccccagaccacagctatgagtcccttcgtgtgacgtctgcgcagaaacatgttctgcatgtccagctcaaccggcccaacaagaggtgccccaagcccgtgattgctgccgtccatgggggctgcattggcggaggtgtggaccttgtcaccgcctgtgacatccggtactgtgcccaggatgctttcttccaggtgaaggaggtggacgtgggtttggctgccgatgtaggaacactgcagcgcctgcccaaggtcatcgggaaccagagcctggtcaacgagctggccttcaccgcccgcaagatgatggctgacgaggccctgggcagtgggctggtcagccgggtgttcccagacaaagaggtcatgctggatgctgccttagcgctggcggccgagatttccagcaagagccccgtggcggtgcagagcaccaaggtcaacctgctgtattcccgcgaccattcggtggccgagagcctcaactacgtggcgtcctggaacatgagcatgctgcagacccaagacctcgtgaagtcggtccaggccacgactgagaacaaggaactgaaaaccgtcaccttctccaagctctgagagccctcgcgtcccaggccccagccagggggccggccttgtcccgcctcatccacagaaagggaggatgggcgatgacagttgtttctatgccttctgacccagtttcccagtttataactttatgacaatgagtttctcaagcccaaggccttatcttcaccccacaaacaataaagcaaagtaaagaa

SEQ ID NO: 440323 - DNA, 467 bp, Homo sapiens
taaactcagccggtaccagcaggcttgggcccagattaagatgtcatgctggatgctgccttagcgctggcggccgagatttccagcaagagccccgtggcggtgcagagcaccaaggtcaacctgctgtattcccgcgaccattcggtggccgagagcctcaactacgtggcgtcctggaacatgagcatgctgcagacccaagacctcgtgaagtcggtccaggccacgactgagaacaaggaactgaaaaccgtcaccttctccaagctctgagagccctcgcgtcccaggccccagccagggggccggccttgtcccgcctcatccacagaaagggaggatgggcgatgacagttgtttctatgccttctgacccagtttcccagtttataactttatgacaatgagtttctcaagcccaaggccttatcttcaccccacaaacaataaagcaaagtaaagaa

SEQ ID NO: 440324 - DNA, 758 bp, Homo sapiens
gctattttctttggccaggttcccactggggcaaagggtccatttctgagcctggctctatgtaaggcaaccggaaatcgactgcccttagtaaagatggcggaaagaacggcgtcattgcctgtcaggttgcggcatcggtgccctcgctcaacatggcggccttctgtgcccgccccctccgctaacgggcacgttactccgtccgaacgcagtagacgaaggcggcggcgatggcggcggggatagtggcttctcgcagactccgcgacctactgacccggcgactgacaggctccaactacccgggactcagtattagccttcgcctcactggctcctctgcacaagaggcggcttccggagtagccctcggtgaagccccagaccacagctatgagtcccttcgtgtgacgtctgcgcagaaacatgttctgcatgtccagctcaaccggcccaacaagaggaatgccatgaacaaggtcttctggagagagatggtagagtgcttcaacaagatttcgagagacgctgactgtcgggcggtggtgatctctggtgcaggaaaaatgttcactgcagaggtaccagacgctcttcacacaccctgccagccttcctagctcctggcaatagacagtggagcagtgcttctgaattagggttttaagcagcttctgacttacacactttttttttttttttttgagacggggtcttgctctgttgccacgctggagtgcagtagcgcaatctca

SEQ ID NO: 440325 - DNA, 2561 bp, Homo sapiens
ggcgcgcgcgtcgggaagatggcgctacgtctgctgcggagggcggcgcgcggagctgcggcggcggcgctgctgaggctgaaagcgtctctagcagctgatatccccagacttggatatagttcctcatcccatcacaagtacatcccccggagggcagtgctttatgtacctggaaatgatgaaaagaaaataaagaagattccatccctgaatgtagattgtgcagtgctcgactgtgaggatggagtggctgcaaacaaaaagaatgaagctcgactgagaattgtaaaaactcttgaagacattgatctgggccctactgaaaaatgtgtgagagtcaactcagtttccagtggtctggcggaagaagacctagagacccttttgcaatcccgggtccttccttccagcctgatgctaccaaaggtggaaagtcctgaagaaatccagtggtttgcagacaaattttcattccacttaaaaggccgaaaacttgaacaaccaatgaatttaatcccttttgtggaaactgcaatgggtttgctcaattttaaggcagtgtgtgaagaaaccctgaaggtcgggcctcaagtaggtctctttctagatgcagtcgtttttggaggagaagactttcgagccagcataggtgcaacaagtagtaaagaaaccctggatattctctacgcccggcaaaagattgttgtcatagcgaaagcctttggtctccaagccgtagatctggtgtacattgactttcgagatggagctgggctgcttagacagtcacgagaaggagccgccatgggcttcactggtaagcaggtgattcaccctaaccaaattgccgtggtccaggagcagttttctccttcccctgaaaaaattaagtgggctgaagaactgattgctgcctttaaagaacatcaacaattaggaaagggggcctttactttccaagggagtatgatcgacatgccattactgaagcaggcccagaacactgttacgcttgccacctccatcaaggaaaaatgatctgttaaatgaagctgtcatcaggtgggctgaacatatacagtggggttcttaaagacaaaccacaatactcaaagcaacttgttaggatgccagattgggacctgactccatttacagttcatgttaatcacaattttgttgttgttgtctcactggccagttattcccctaaaaaaatgaacgcttttccctttggatccaagcttatgattttatcatttttagtgtattacgaatatgggcttatgatttcacagggaggtaagatcctggggaaagatgggctgtgaggcgaaggtaggtctttaatgaaatggatctttcccaaatagacatattccctccacccttctcatgttagtaaatgtttcctgcttgttcatttatacagctgacaccacaaataattttaagaaaagccaggcctttaaaacatagtagcaacattaaggggtcatctctatttcactagtaatctgataaaacaacagagatggcatcaaaaaagaatactaagtattatattggcttaaaaagacactttctgaaaataaactttcgaaactggttactattaacctccacccctaaaacgaaacatccatctccttgaaccgctagacgatgaacacgaaagctgtcatcctgggtgaatgctgtgagtcaaccattaccggcaattaaaaaataaatgtgcagaaacacaagaccaaaaaaaaaaaaaaaaaaaaaaaaaaaaaaaaaaaaaaaaaaaaaaaaaaaaaaaaaaaaaaaaaaaaaaaaaaaaaaagcaaagaagagagcgagcgaggcgggaacgatatagcattctttgccagggtgagcgtaatcatagacagacccaaagcaatacgaaaagagagagacgagaacaaatgaaaaacaaagattacaagagagaagaagaacaggaacgaacataagaaaaggagacgagagaagagcaaaagaagagagaagagagaataagaaaaaaagaacacacacaggtcgaagaaagaggaaagagaaggacaaataaagaaaaagaggtaataagaacacagagaaaaaaaaaataaacaaaggaaaaatgaaaaaataaaaggaaaaaagaagagaacgaaaaataaggaggagcatgaagcaaaaaatacaacacggaaagaaagaaacatagaaaaaggccagacacgtgaaaagtaaacagacagaaaagagaaaaaggaagaataacaaaaaaaacaagacaaacagaaaaaaaaagaaagaagaaaacaaaacaaagagagagacaaaaaaacaagaagaaaaaaagaaaagaagagaacagagacagagagagaaaaaaagaaaagactagataaagagacacaagaaaaaatagagagaaaaaaaaaaagagaaagagaagagagcaaacagaaaaagaagacaagcagaaaaaagagaaaaactaagaaaaggaataaaaaaaaaaagacaaaatgaaaaaaaagataagagatataagacaa

SEQ ID NO: 440326 - DNA, 1193 bp, Homo sapiens
ggcgcgcgcgtcgggaagatggcgctacgtctgctgcggagggcggcgcgcggagctgcggcggcggcgctgctgaggctgaaagcgtctctagcagctgatatccccagacttggatatagttcctcatcccatcacaagtacatcccccggagggcagtgctttatgtacctggaaatgatgaaaagaaaataaagaagattccatccctgaatgtagattgtgcagtgctcgactgtgaggatggagtggctgcaaacaaaaagaatgaagctcgactgagaattgtaaaaactcttgaagacattgatctgggccctactgaaaaatgtgtgagagtcaactcagtttccagtggtctggcggaagaagacctagagacccttttgcaatcccgggtccttccttccagcctgatgctaccaaaggtggaaagtcctgaagaaatccagtggtttgcagacaaattttcattccacttaaaaggccgaaaacttgaacaaccaatgaatttaatcccttttgtggaaactgcaatgggtttgctcaattttaaggcagtgtgtgaagaaaccctgaaggtcgggcctcaagtaggtctctttctagatgcagtcgtttttggaggagaagactttcgagccagcataggtgcaacaagtagtaaagaaaccctggatattctctacgcccggcaaaagattgttgtcatagcgaaagcctttggtctccaagccgtagatctggtgtacattgactttcgagatggagctgggctgcttagacagtcacgagaaggagccgccatgggcttcactggtaagcaggtgattcaccctaaccaaattgccgtggtccaggagcagttttctccttcccctgaaaaaattaagtgggctgaagaactgattgctgcctttaaagaacatcaacaattaggaaagggggcctttactttccaagggagtatgatcgacatgccattactgaagcaggcccagaacactgttacgcttgccacctccatcaaggaaaaatgatctgttaaatgaagctgtcatcaggctaaagggtattgaagctgcagagggatcaacttgtgcttgccagaggacgccaatgaagtttgaaacaccaacaatcagagattttgtttctgttcctcattaaatcatgagcttttgtgccgaga

SEQ ID NO: 440327 - DNA, 2231 bp, Homo sapiens
ggcgcgcgcgtcgggaagatggcgctacgtctgctgcggagggcggcgcgcggagctgcggcggcggcgctgctgaggctgaaagcgtctctagcagctgatatccccagacttggatatagttcctcatcccatcacaagtacatcccccggagggcagtgctttatgtacctggaaatgatgaaaagaaaataaagaagattccatccctgaatgtagattgtgcagtgctcgactgtgaggatggagtggctgcaaacaaaaagaatgaagctcgactgagaattgtaaaaactcttgaagacattgatctgggccctactgaaaaatgtgtgagagtcaactcagtttccagtggtctggcggaagaagacctagagacccttttgcaatcccgggtccttccttccagcctgatgctaccaaaggtggaaagtcctgaagaaatccagtggtttgcagacaaattttcattccacttaaaaggccgaaaacttgaacaaccaatgaatttaatcccttttgtggaaactgcaatgggtttgctcaattttaaggcagtgtgtgaagaaaccctgaaggtcgggcctcaagtaggtctctttctagatgcagtcgtttttggaggagaagactttcgagccagcataggtgtcaaagacatctctctctctctttttctgtgtgcaacaagtagtaaagaaaccctggatattctctacgcccggcaaaagattgttgtcatagcgaaagcctttggtctccaagccgtagatctggtgtacattgactttcgagatggagctgggctgcttagacagtcacgagaaggagccgccatgggcttcactggtaagcaggtgattcaccctaaccaaattgccgtggtccaggagcagttttctccttcccctgaaaaaattaagtgggctgaagaactgattgctgcctttaaagaacatcaacaattaggaaagggggcctttactttccaagggagtatgatcgacatgccattactgaagcaggcccagaacactgttacgcttgccacctccatcaaggaaaaatgatctgttaaatgaagctgtcatcaggtgggctgaacatatacagtggggttcttaaagacaaaccacaatactcaaagcaacttgttaggatgccagattgggacctgactccatttacagttcatgttaatcacaattttgttgttgttgtctcactggccagttattcccctaaaaaaatgaacgcttttccctttggatccaagcttatgattttatcatttttagtgtattacgaatatgggcttatgatttcacagggaggtaagatcctggggaaagatgggctgtgaggcgaaggtaggtctttaatgaaatggatctttcccaaatagacatattccctccacccttctcatgttagtaaatgtttcctgcttgttcatttatacagctgacaccacaaataattttaagaaaagccaggcctttaaaacatagtagcaacattaaggggtcatctctatttcactagtaatctgataaaacaacagagatggcatcaaaaaagaatactaagtattatattggcttaaaaagacactttctgaaaataaactttcgaaactggttactattaacctccacccctaaaacgaaacatccatctccttgaaccgctagacgatgaacacgaaagctgtcatcctgggtgaatgctgtgagtcaaccattaccggcaattaaaaaataaatgtgcagaaacacaagaccatccattctccccctttattttcccgtttaactgtttgccattgaggctatttccccctggaaatgtatggctgggacaggactccctcagtcataaacttgtagcgtctcagaagacacaatgcacccgagctggtgcatgtggcccctgcgagatttgcatcacattagagatgcggctgcaggtcagatgggtggtgtggttaacgggcttagtaaagctgttttgaagaggttaacccagcttgtagtaagggtaaataaacataacaaccagccattgttccctattcagcatgtactcttatattgaaggctaaagggtattgaagctgcagagggatcaacttgtgcttgccagaggacgccaatgaagtttgaaacaccaacaatcagagattttgtttctgttcctcattaaatcatgagcttttgtgccgaga

SEQ ID NO: 440328 - DNA, 1115 bp, Homo sapiens
ggcgcgcgcgtcgggaagatggcgctacgtctgctgcggagggcggcgcgcggagctgcggcggcggcgctgctgaggctgaaagcgtctctagcagctgatatccccagacttggatatagttcctcatcccatcacaagtacatcccccggagggcagtgctttatgtacctggaaatgatgaaaagaaaataaagaagattccatccctgaatgtagattgtgcagtgctcgactgtgaggatggagtggctgcaaacaaaaagaatgaagctcgactgagaattgtaaaaactcttgaagacattgatctgggccctactgaaaaatgtgtgagagtcaactcagtttccagtggtctggcggaagaagacctagagacccttttgcaatcccgggtccttccttccagcctgatgctaccaaaggtggaaagtcctgaagaaatccagtggtttgcagacaaattttcattccacttaaaaggccgaaaacttgaacaaccaatgaatttaatcccttttgtggaaactgcaatgggtttgctcaattttaaggcagtgtgtgaagaaaccctgaaggtcgggcctcaagtaggtctctttctagatgcagtcgtttttggaggagaagactttcgagccagcataggtgcaacaagtagtaaagaaaccctggatattctctacgcccggcaaaagattgttgtcatagcgaaagcctttggtctccaagccgtagatctggtgtacattgactttcgagatggagctgggctgcttagacagtcacgagaaggagccgccatgggcttcactggtaagcaggtgattcaccctaaccaaattgccgtggtccaggagcagttttctccttcccctgaaaaaattaagtgggctgaagaactgattgctgcctttaaagaacatcaacaattaggaaagggggcctttactttccaagggagtatgatcgacatgccattactgaagcaggcccagaacactgttacgcttgccacctccatcaaggaaaaatgatctgttaaatgaagctgtcatcaggaagcccgagaggtgaggagctgaggttagacaccaggagaggcaccatc

SEQ ID NO: 440329 - DNA, 1492 bp, Homo sapiens
tgtgtccgatgtgtttctcctctccattaaaatgctgaagatttttatttttttcccctctttagggggaaaaaagaagtgtttcctctgtaatttactttggctttctcaaaagttgggcgggaaagtcagtataattcaggtggaatctaaaatgttcttgttgcacaagtgtgcacagaaaggaaacctataacttcgagtattctttcaggaagtttgtattctctgttttccagggggcctttactttccaagggagtatgatcgacatgccattactgaagcaggcccagaacactgttacgcttgccacctccatcaaggaaaaatgatctgttaaatgaagctgtcatcaggtgggctgaacatatacagtggggttcttaaagacaaaccacaatactcaaagcaacttgttaggatgccagattgggacctgactccatttacagttcatgttaatcacaattttgttgttgttgtctcactggccagttattcccctaaaaaaatgaacgcttttccctttggatccaagcttatgattttatcatttttagtgtattacgaatatgggcttatgatttcacagggaggtaagatcctggggaaagatgggctgtgaggcgaaggtaggtctttaatgaaatggatctttcccaaatagacatattccctccacccttctcatgttagtaaatgtttcctgcttgttcatttatacagctgacaccacaaataattttaagaaaagccaggcctttaaaacatagtagcaacattaaggggtcatctctatttcactagtaatctgataaaacaacagagatggcatcaaaaaagaatactaagtattatattggcttaaaaagacactttctgaaaataaactttcgaaactggttactattaacctccacccctaaaacgaaacatccatctccttgaaccgctagacgatgaacacgaaagctgtcatcctgggtgaatgctgtgagtcaaccattaccggcaattaaaaaataaatgtgcagaaacacaagaccatccattctccccctttattttcccgtttaactgtttgccattgaggctatttccccctggaaatgtatggctgggacaggactccctcagtcataaacttgtagcgtctcagaagacacaatgcacccgagctggtgcatgtggcccctgcgagatttgcatcacattagagatgcggctgcaggtcagatgggtggtgtggttaacgggcttagtaaagctgttttgaagaggttaacccagcttgtagtaagggtaaataaacataacaaccagccattgttccctattcagcatgtactcttatattgaaggctaaagggtattgaagctgcagagggatcaacttgtgcttgccagaggacgccaatgaagtttgaaacaccaacaatcagagattttgtttctgttcctcattaaatcatgagcttttgtgccgaga

SEQ ID NO: 440330 - DNA, 986 bp, Homo sapiens
ggcgcgcgcgtcgggaagatggcgctacgtctgctgcggagggcggcgcgcggagctgcggcggcggcgctgctgaggctgaaagcgtctctagcagctgatatccccagacttggatatagttcctcatcccatcacaagtacatcccccggagggcagtgctttatgtacctggaaatgatgaaaagaaaataaagaagattccatccctgaatgtagattgtgcagtgctcgactgtgaggatggagtggctgcaaacaaaaagaatgaagctcgactgagaattgtaaaaactcttgaagacattgatctgggccctactgaaaaatgtgtgagagtcaactcagtttccagtggtctggcggaagaagacctagagacccttttgcaatcccgggtccttccttccagcctgatgctaccaaaggtggaaagtcctgaagaaatccagtggtttgcagacaaattttcattccacttaaaaggccgaaaacttgaacaaccaatgaatttaatcccttttgtggaaactgcaatgggtttgctcaattttaaggcagtgtgtgaagaaaccctgaaggtcgggcctcaagtaggtctctttctagatgcagtcgtttttggaggagaagactttcgagccagcataggtgtcaaagacatctctctctctctttttctgtgtgtgtgtgtgtatatgtgtgtatatattttttctttgcccctcaaggatggacatttacataacaatgtatatttgccaaccatgacaatggtttttcatgacaatggaatggacactacttcctgataatttagggctcctcatagctgccctgcttctagagcactgcattattacttctgttcatttataaaagacacgagcaatagaaagcctgttgcagccccaggcatgctcaggaatatatggcatctcctttgctcctaataaatatattatgtgaacagcctcaccgttgc

SEQ ID NO: 440331 - DNA, 2198 bp, Homo sapiens
ggcgcgcgcgtcgggaagatggcgctacgtctgctgcggagggcggcgcgcggagctgcggcggcggcgctgctgaggctgaaagcgtctctagcagctgatatccccagacttggatatagttcctcatcccatcacaagtacatcccccggagggcagtgctttatgtacctggaaatgatgaaaagaaaataaagaagattccatccctgaatgtagattgtgcagtgctcgactgtgaggatggagtggctgcaaacaaaaagaatgaagctcgactgagaattgtaaaaactcttgaagacattgatctgggccctactgaaaaatgtgtgagagtcaactcagtttccagtggtctggcggaagaagacctagagacccttttgcaatcccgggtccttccttccagcctgatgctaccaaaggtggaaagtcctgaagaaatccagtggtttgcagacaaattttcattccacttaaaaggccgaaaacttgaacaaccaatgaatttaatcccttttgtggaaactgcaatgggtttgctcaattttaaggcagtgtgtgaagaaaccctgaaggtcgggcctcaagtaggtctctttctagatgcagtcgtttttggaggagaagactttcgagccagcataggtgcaacaagtagtaaagaaaccctggatattctctacgcccggcaaaagattgttgtcatagcgaaagcctttggtctccaagccgtagatctggtgtacattgactttcgagatggagctgggctgcttagacagtcacgagaaggagccgccatgggcttcactggtaagcaggtgattcaccctaaccaaattgccgtggtccaggagcagttttctccttcccctgaaaaaattaagtgggctgaagaactgattgctgcctttaaagaacatcaacaattaggaaagggggcctttactttccaagggagtatgatcgacatgccattactgaagcaggcccagaacactgttacgcttgccacctccatcaaggaaaaatgatctgttaaatgaagctgtcatcaggtgggctgaacatatacagtggggttcttaaagacaaaccacaatactcaaagcaacttgttaggatgccagattgggacctgactccatttacagttcatgttaatcacaattttgttgttgttgtctcactggccagttattcccctaaaaaaatgaacgcttttccctttggatccaagcttatgattttatcatttttagtgtattacgaatatgggcttatgatttcacagggaggtaagatcctggggaaagatgggctgtgaggcgaaggtaggtctttaatgaaatggatctttcccaaatagacatattccctccacccttctcatgttagtaaatgtttcctgcttgttcatttatacagctgacaccacaaataattttaagaaaagccaggcctttaaaacatagtagcaacattaaggggtcatctctatttcactagtaatctgataaaacaacagagatggcatcaaaaaagaatactaagtattatattggcttaaaaagacactttctgaaaataaactttcgaaactggttactattaacctccacccctaaaacgaaacatccatctccttgaaccgctagacgatgaacacgaaagctgtcatcctgggtgaatgctgtgagtcaaccattaccggcaattaaaaaataaatgtgcagaaacacaagaccatccattctccccctttattttcccgtttaactgtttgccattgaggctatttccccctggaaatgtatggctgggacaggactccctcagtcataaacttgtagcgtctcagaagacacaatgcacccgagctggtgcatgtggcccctgcgagatttgcatcacattagagatgcggctgcaggtcagatgggtggtgtggttaacgggcttagtaaagctgttttgaagaggttaacccagcttgtagtaagggtaaataaacataacaaccagccattgttccctattcagcatgtactcttatattgaaggctaaagggtattgaagctgcagagggatcaacttgtgcttgccagaggacgccaatgaagtttgaaacaccaacaatcagagattttgtttctgttcctcattaaatcatgagcttttgtgccgaga

SEQ ID NO: 440332 - DNA, 2327 bp, Homo sapiens
ggcgcgcgcgtcgggaagatggcgctacgtctgctgcggagggcggcgcgcggagctgcggcggcggcgctgctgaggctgaaagcgtctctagcagctgatatccccagacttggatatagttcctcatcccatcacaagtacatcccccggagggcagtgctttatgtacctggaaatgatgaaaagaaaataaagaagattccatccctgaatgtagattgtgcagtgctcgactgtgaggatggagtggctgcaaacaaaaagaatgaagctcgactgagaattgtaaaaactcttgaagacattgatctgggccctactgaaaaatgtgtgagagtcaactcagtttccagtggtctggcggaagaagacctagagacccttttgcaatcccgggtccttccttccagcctgatgctaccaaaggtggaaagtcctgaagaaatccagtggtttgcagacaaattttcattccacttaaaaggccgaaaacttgaacaaccaatgaatttaatcccttttgtggaaactgcaatgggtttgctcaattttaaggcagtgtgtgaagaaaccctgaaggtcgggcctcaagtaggtctctttctagatgcagtcgtttttggaggagaagactttcgagccagcataggtgcaacaagtagtaaagaaaccctggatattctctacgcccggcaaaagattgttgtcatagcgaaagcctttggtctccaagccgtagatctggtgtacattgactttcgagatggagctgggctgcttagacagtcacgagaaggagccgccatgggcttcactggtaagcaggtgattcaccctaaccaaattgccgtggtccaggagcagttttctccttcccctgaaaaaattaagtgggctgaagaactgattgctgcctttaaagaacatcaacaattaggaaaggtaggtcggtattgctgctcttggctttgcattcagccttttccatcatcaccaggtcagcggtcacagagcatctcccgtgtacctggcaggtactgggtgctgggtgccaggtcctgggagtcaaagggggcctttactttccaagggagtatgatcgacatgccattactgaagcaggcccagaacactgttacgcttgccacctccatcaaggaaaaatgatctgttaaatgaagctgtcatcaggtgggctgaacatatacagtggggttcttaaagacaaaccacaatactcaaagcaacttgttaggatgccagattgggacctgactccatttacagttcatgttaatcacaattttgttgttgttgtctcactggccagttattcccctaaaaaaatgaacgcttttccctttggatccaagcttatgattttatcatttttagtgtattacgaatatgggcttatgatttcacagggaggtaagatcctggggaaagatgggctgtgaggcgaaggtaggtctttaatgaaatggatctttcccaaatagacatattccctccacccttctcatgttagtaaatgtttcctgcttgttcatttatacagctgacaccacaaataattttaagaaaagccaggcctttaaaacatagtagcaacattaaggggtcatctctatttcactagtaatctgataaaacaacagagatggcatcaaaaaagaatactaagtattatattggcttaaaaagacactttctgaaaataaactttcgaaactggttactattaacctccacccctaaaacgaaacatccatctccttgaaccgctagacgatgaacacgaaagctgtcatcctgggtgaatgctgtgagtcaaccattaccggcaattaaaaaataaatgtgcagaaacacaagaccatccattctccccctttattttcccgtttaactgtttgccattgaggctatttccccctggaaatgtatggctgggacaggactccctcagtcataaacttgtagcgtctcagaagacacaatgcacccgagctggtgcatgtggcccctgcgagatttgcatcacattagagatgcggctgcaggtcagatgggtggtgtggttaacgggcttagtaaagctgttttgaagaggttaacccagcttgtagtaagggtaaataaacataacaaccagccattgttccctattcagcatgtactcttatattgaaggctaaagggtattgaagctgcagagggatcaacttgtgcttgccagaggacgccaatgaagtttgaaacaccaacaatcagagattttgtttctgttcctcattaaatcatgagcttttgtgccgaga

SEQ ID NO: 440333 - DNA, 2096 bp, Homo sapiens
ggcgcgcgcgtcgggaagatggcgctacgtctgctgcggagggcggcgcgcggagctgcggcggcggcgctgctgaggctgaaagcgtctctagcagctgatatccccagacttggatatagttcctcatcccatcacaagtacatcccccggagggcagtgctttatgtacctggaaatgatgaaaagaaaataaagaagattccatccctgaatgtagattgtgcagtgctcgactgtgaggatggagtggctgcaaacaaaaagaatgaagctcgactgagaattgtaaaaactcttgaagacattgatctgggccctactgaaaaatgtgtgagagtcaactcagtttccagtggtctggcggaagaagacctagagacccttttgcaatcccgggtccttccttccagcctgatgctaccaaaggtggaaagtcctgaagaaatccagtgggcagtgtgtgaagaaaccctgaaggtcgggcctcaagtaggtctctttctagatgcagtcgtttttggaggagaagactttcgagccagcataggtgcaacaagtagtaaagaaaccctggatattctctacgcccggcaaaagattgttgtcatagcgaaagcctttggtctccaagccgtagatctggtgtacattgactttcgagatggagctgggctgcttagacagtcacgagaaggagccgccatgggcttcactggtaagcaggtgattcaccctaaccaaattgccgtggtccaggagcagttttctccttcccctgaaaaaattaagtgggctgaagaactgattgctgcctttaaagaacatcaacaattaggaaagggggcctttactttccaagggagtatgatcgacatgccattactgaagcaggcccagaacactgttacgcttgccacctccatcaaggaaaaatgatctgttaaatgaagctgtcatcaggtgggctgaacatatacagtggggttcttaaagacaaaccacaatactcaaagcaacttgttaggatgccagattgggacctgactccatttacagttcatgttaatcacaattttgttgttgttgtctcactggccagttattcccctaaaaaaatgaacgcttttccctttggatccaagcttatgattttatcatttttagtgtattacgaatatgggcttatgatttcacagggaggtaagatcctggggaaagatgggctgtgaggcgaaggtaggtctttaatgaaatggatctttcccaaatagacatattccctccacccttctcatgttagtaaatgtttcctgcttgttcatttatacagctgacaccacaaataattttaagaaaagccaggcctttaaaacatagtagcaacattaaggggtcatctctatttcactagtaatctgataaaacaacagagatggcatcaaaaaagaatactaagtattatattggcttaaaaagacactttctgaaaataaactttcgaaactggttactattaacctccacccctaaaacgaaacatccatctccttgaaccgctagacgatgaacacgaaagctgtcatcctgggtgaatgctgtgagtcaaccattaccggcaattaaaaaataaatgtgcagaaacacaagaccatccattctccccctttattttcccgtttaactgtttgccattgaggctatttccccctggaaatgtatggctgggacaggactccctcagtcataaacttgtagcgtctcagaagacacaatgcacccgagctggtgcatgtggcccctgcgagatttgcatcacattagagatgcggctgcaggtcagatgggtggtgtggttaacgggcttagtaaagctgttttgaagaggttaacccagcttgtagtaagggtaaataaacataacaaccagccattgttccctattcagcatgtactcttatattgaaggctaaagggtattgaagctgcagagggatcaacttgtgcttgccagaggacgccaatgaagtttgaaacaccaacaatcagagattttgtttctgttcctcattaaatcatgagcttttgtgccgaga

SEQ ID NO: 440334 - DNA, 1218 bp, Homo sapiens
ggcgcgcgcgtcgggaagatggcgctacgtctgctgcggagggcggcgcgcggagctgcggcggcggcgctgctgaggctgaaagcgtctctagcagctgatatccccagacttggatatagttcctcatcccatcacaagtacatcccccggagggcagtgctttatgtacctggaaatgatgaaaagaaaataaagaagattccatccctgaatgtagattgtgcagtgctcgactgtgaggatggagtggctgcaaacaaaaagaatgaagctcgactgagaattgtaaaaactcttgaagacattgatctgggccctactgaaaaatgtgtgagagtcaactcagtttccagtggtctggcggaagaagacctagagacccttttgcaatcccgggtccttccttccagcctgatgctaccaaaggtggaaagtcctgaagaaatccagtggtttgcagacaaattttcattccacttaaaaggccgaaaacttgaacaaccaatgaatttaatcccttttgtggaaactgcaatgggtttgctcaattttaaggcagtgtgtgaagaaaccctgaaggtcgggcctcaagtaggtctctttctagatgcagtcgtttttggaggagaagactttcgagccagcataggtgcaacaagtagtaaagaaaccctggatattctctacgcccggcaaaagattgttgtcatagcgaaagcctttggtctccaagccgtagatctggtgtacattgactttcgagatggagctgggctgcttagacagtcacgagaaggagccgccatgggcttcactggtaagcaggtgattcaccctaaccaaattgccgtggtccaggagcagttttctccttcccctgaaaaaattaagtgggctgaagaactgattgctgcctttaaagaacatcaacaattaggaaaggaagtttgtattctctgttttccagggggcctttactttccaagggagtatgatcgacatgccattactgaagcaggcccagaacactgttacgcttgccacctccatcaaggaaaaatgatctgttaaatgaagctgtcatcaggctaaagggtattgaagctgcagagggatcaacttgtgcttgccagaggacgccaatgaagtttgaaacaccaacaatcagagattttgtttctgttcctcattaaatcatgagcttttgtgccgaga

SEQ ID NO: 440335 - DNA, 1926 bp, Homo sapiens
ttttgggcgggggggaggtttatgaagttttgctctttgaaccacagctttattatggtcctttacactggagacagacacagagacactgttcagaagatgaactaaactcagcagtggtctggtatcaagagctttctgatgttttacagcctgaatttggagggataacgatctgctgtgcctttgcagtcactgcttagcccaaagtaatagtacttttgataataactcactctgtgcgatattcctgaataagtccatctcaaaagtttgggattttcctcctcttaactttcttaatatttggacatgcagttgtcgccaaacttgggtattcatggaatttctagtaaatgaaatacctatactttgatactgaagactgccaaatacataggaattttctttcttaaaaaacagtaatgaagactatatctcctttcccagcactgaatgttttactagcactgggtgctcaccatgcaactgaagaaaatgtggaaactcaaaaggtcaggacagacttccaagcacttgcaactgatgttactgtcttcaattttaataattacacatatttgtatatttcagagaagtttttaatatttctctgtccactttttataagctttaaaatgattttctctgccttgagatttgcatcaagaaaaagcacctctcttcacctgaaagctttgaagactagagacacgctttacacgttttaacaagtatattgagtccacgtttggtagcatcagttgttgagttaaaaagaaaattattgcatttgatctggatggattttaaaagaatataatgttcaatattaaaaggataattcacatttgccaccataatgttcttttttatgtaaaaagaagaacttggagacattaacatgaaaaagtcttttatcattagctcatgtatttgaggaagagcagctgtctttttatatgttttttgacaaatcatattgtattcttttgtacaaaaaagaactacttgtattctagaagaaatatgaaatgcttaatttataagcgggctggagattttttccaatattgttttctttgaaaatgaaaggggatcatctattttagttttggggtctgggaactttttgaaaatttaatttgtggaccaatgttttgtgaaagctaaagagggcaggggttaaaatagggcttgaatttctcattctgtatagaccagcaaacttccctgtgcaaggcaagtttacatcacaaatccaagaatgtttgcatcctaaatgctagtttgcttcagcccctagttaacctcaggacttggtttgcatataaaaggtagacagctgatatgttttcatgaataaatattgtcagccagaaaaggttggtgtcaggtaatgcatatttttttaagctttgttttatatttatttttcatttagtttttattgggaatggttttcaaagaactctcagttctgcctaggtgtttttgggggagccctgttttccatagtgtaattccatttaagaggttgtctaaaagtctttttaattaatagaaagattttaatatccaagagtagtcaaattaaggatataaactttccacaccttcctgtcgtgacagataaaagcacagaaaggacaacccttgaaatcatgtaacgttggtcatttcaatattttgtacctgttttaaattctgttagtgtatttacttcattgtaaatatttttgagggtacctttgtattttgcttttgaccttggttctgtgatttggatgtcaacaacttccctaaaaagcaccagtgtgttaggttctaatgtcatgacccaatttgtgttattcatctttaatcctgttttcagtctctatgtgtacagcagtatttttaataaagaattacagagataaattt

SEQ ID NO: 440336 - DNA, 1481 bp, Homo sapiens
ctgcctgcggtcgctctagaggatccccccaatcaacatccaaccccaatcaacatccatccagatcaaatgcaataattttctttttaactcaacaactgatgttactgtcttcaattttaataattacacatatttgtatatttcagagaagtttttaatatttctctgtccactttttataagctttaaaatgattttctctgccttgagatttgcatcaagaaaaagcacctctcttcacctgaaagctttgaagactagagacacgctttacacgttttaacaagtatattgagtccacgtttggtagcatcagttgttgagttaaaaagaaaattattgcatttgatctggatggattttaaaagaatataatgttcaatattaaaaggataattcacatttgccaccataatgttcttttttatgtaaaaagaagaacttggagacattaacatgaaaaagtcttttatcattagctcatgtatttgaggaagagcagctgtctttttatatgttttttgacaaatcatattgtattcttttgtacaaaaaagaactacttgtattctagaagaaatatgaaatgcttaatttataagcgggctggagattttttccaatattgttttctttgaaaatgaaaggggatcatctattttagttttggggtctgggaactttttgaaaatttaatttgtggaccaatgttttgtgaaagctaaagagggcaggggttaaaatagggcttgaatttctcattctgtatagaccagcaaacttccctgtgcaaggcaagtttacatcacaaatccaagaatgtttgcatcctaaatgctagtttgcttcagcccctagttaacctcaggacttggtttgcatataaaaggtagacagctgatatgttttcatgaataaatattgtcagccagaaaaggttggtgtcaggtaatgcatatttttttaagctttgttttatatttatttttcatttagtttttattgggaatggttttcaaagaactctcagttctgcctaggtgtttttgggggagccctgttttccatagtgtaattccatttaagaggttgtctaaaagtctttttaattaatagaaagattttaatatccaagagtagtcaaattaaggatataaactttccacaccttcctgtcgtgacagataaaagcacagaaaggacaacccttgaaatcatgtaacgttggtcatttcaatattttgtacctgttttaaattctgttagtgtatttacttcattgtaaatatttttgagggtacctttgtattttgcttttgaccttggttctgtgatttggatgtcaacaacttccctaaaaagcaccagtgtgttaggttctaatgtcatgacccaatttgtgttattcatctttaatcctgttttcagtctctatgtgtacagcagtatttttaataaagaattacagagataaattt

SEQ ID NO: 440337 - DNA, 1149 bp, Homo sapiens
ctgcctgcggtcgctctagaggatccccccaatcaacatccaaccatgttcaatattaaaaggataattcacatttgccaccataatgttcttttttatgtaaaaagaagaacttggagacattaacatgaaaaagtcttttatcattagctcatgtatttgaggaagagcagctgtctttttatatgttttttgacaaatcatattgtattcttttgtacaaaaaagaactacttgtattctagaagaaatatgaaatgcttaatttataagcgggctggagattttttccaatattgttttctttgaaaatgaaaggggatcatctattttagttttggggtctgggaactttttgaaaatttaatttgtggaccaatgttttgtgaaagctaaagagggcaggggttaaaatagggcttgaatttctcattctgtatagaccagcaaacttccctgtgcaaggcaagtttacatcacaaatccaagaatgtttgcatcctaaatgctagtttgcttcagcccctagttaacctcaggacttggtttgcatataaaaggtagacagctgatatgttttcatgaataaatattgtcagccagaaaaggttggtgtcaggtaatgcatatttttttaagctttgttttatatttatttttcatttagtttttattgggaatggttttcaaagaactctcagttctgcctaggtgtttttgggggagccctgttttccatagtgtaattccatttaagaggttgtctaaaagtctttttaattaatagaaagattttaatatccaagagtagtcaaattaaggatataaactttccacaccttcctgtcgtgacagataaaagcacagaaaggacaacccttgaaatcatgtaacgttggtcatttcaatattttgtacctgttttaaattctgttagtgtatttacttcattgtaaatatttttgagggtacctttgtattttgcttttgaccttggttctgtgatttggatgtcaacaacttccctaaaaagcaccagtgtgttaggttctaatgtcatgacccaatttgtgttattcatctttaatcctgttttcagtctctatgtgtacagcagtatttttaataaagaattacagagataaattt

SEQ ID NO: 440338 - DNA, 5374 bp, Homo sapiens
ccagccccttccgtccgccgcgctccgccgctgtcctccgccggcccgcgtgggaggacgatgggtcagcgcggaaaaagtgaatgagggcggcagcggtggcggcggtagccagcgcctgactcggcgggcccggagcaccgcccgcgtcccggcccccggcaccatggacgcgccgcgcgcctcggcggccaagcccccgaccgggaggaagatgaaggctcgtgctcccccacctcctggaaaggctgccactctgcatgtgcacagtgaccagaagcccccccacgatggggccctcgggtcgcagcagaacttggttcgcatgaaggaggcgctgagggccagcaccatggacgtcaccgtggtcctgcctagcgggctggagaagaggagcgtgctcaatgggagccatgcgatgatggacctactggttgaactttgccttcagaaccacctgaatccatcccaccatgcccttgaaattcggtcttcagaaacccaacaacctttgagttttaagccaaatactttgattgggaccctgaatgtgcatactgtgtttctgaaagaaaaagttcctgaagagaaggttaagcctggtccccctaaggtgcctgagaaatctgtgcgtttggtcgtgaattacctgcggacacaaaaagctgttgtgcgtgtgagccctgaggttcctctccagaatattctcccagtcatttgtgcaaagtgtgaggtcagcccagagcacgtggttctcctcagggacaacattgccggagaggagctggagctgtccaagtccctgaacgagctcgggataaaggagctctacgcgtgggacaacagaagagaaacctttaggaaatcatcacttggcaatgatgagacagataaagagaagaaaaaatttctgggatttttcaaagttaataaaagaagcaatagtaaggctgagcagctcgtgctgtcgggtgcagacagcgatgaggacacctccagggctgccccaggaaggggtttgaacgggctgtttaacgacccccaactccccatccatgcactcacgttctcttacgctgggtccatccctctcgctgggcagcatctcaggggtgtccgtgaagtcggagatgaagaagcgccgagcccctcctcctccaggttcagggccacctgtgcaagacaaggcatcggaaaaggtatctcttgggtcacagattgatttacagaagaagaagcggcgagcgccagctccccctccaccacagccaccaccaccgagtcccctgatccccaaccgcactgaggataaggaggagaacaggaagagcacgatggtaagcctgcccctggggtctggcagccactgcagcccggatggagccccgcaggtgctgtcagaggcggaggagaccgtgtcagttggcagctgttttgcgtcggaggacacgaccgaggactcaggagtgatgagttccccctcagacatcgtctctctggactcgcagcaggacagcatgaaatacaaagacaagtgggccacagaccaggaagactgcagtgaccaggacctcgctggaaccccagacctgggtccccagaagagccccttgtgggagaagaatggctctgagaactcacatctgagaactgaaaaagctgtcacagcctcaaatgatgaagaagacctattaattgctggagagttccgtaaaacccttgcagaacttgatgaagacctggaagaaatggaagacagctatgaaacagacaccagctccctcaccagctccatccatggtgcatccaaccactgcccacaggatgccatgatccctcacggcgacacagatgcaatcccagtaacattcataggggaagtttcagatgatcctgtggattcggggttgttttccaatagaaacaacaatgctgggtctttcgactcggagggtgttgccagcaggagagactccctggcgccacttcaagctgagcacagccagccccatgaaaaggcaagggaggaagtacctgccctgcaccccgcttcccatgacgtcggaaaaggaatccgtgtggccttatctaacatctctaaagatgggaatctaatggaaacggcgcccagggtgacttcttttgcttcgaatcttcacacagacaacctaaatgcaaaagtgaaagacaaagtgtatggctgtgctgacggggagaggactcaagccacagagagagtgaattcccaaccggtgaatgaaaaggacagcaacgataaaaacgctgccttggcaccaacatcatggcaccaacgaggccaaaacccagggaaaagctacagacttaagcacggcctcacaacgtataaaatcattcctccaaagtcagagatgcgatgttacgacagagatgtgtccctctccaccggagccattaagattgacgagctggggaacttggtgagtcctcacgccaccggcatcaggatcatttccctgtcttcgtctgtgcctgaagcagaatctcagcccattgggaaagtcagagagttctggaggtgcaactctgtggaaaaacacctgggccgaccctcagagagctctgccaggggacccccctccacccctgtgcccacgcagacgcagaatccagagagcagactccaagcagaccccaagccaatatcgccccagcagaagtctgcccaccatgagggccggaaccccctaggggaggggagaaaccagccccccaccatgggcatgggtcacgtgagggtgccagcagctcacaccacagaagtcacatttctcaagcctcagagaagaacgtccagccagtatgtggcctctgccattgccaagcgcataggagccccaaaagtccatgctgatgtggtgaggccacacggttatgccgagaagggttatgcaggcaaggcgccagtgctggctgcaccacctgtcactgtgaaagatgacaggacatccagcccacactcagagacacaaggatggaaggatggtgcccagtggccctgtgtcactcctcccaacaaccacggggaagatttggcagtgggagcccctcctaggggggaggtcattggcccacacaggaagttgtctactcaggacagacctgctgctatccacagaagctcctgtttctcactggttcagtcttcccagagggatcgtgtttctgtgggacagagctgtggtttcagtggaaagcaaagcacaagtagccaggaggccagctcagcatctgagcccagacgcgcacctgatggtacagacccaccccctccacacacatctgacactcaggcctgcagcagggagctggtcaatggctctgtgcgcgccccaggccacggcgagccttcccaccctccaggagggtctggcacagaaagccacattctcctagaaagagaggaaaagcccagtgtgttctctacagatggaaatgaaacagacagtatttggccacccagcatttttgggccgaagaaaaaattcaaacctgttgtccagagaccagtcccaaaagacacatccctgcactctgccctgatggaagccatccactctgcgggagggaaggacagactacgcaagacggcagaacacaccggggagggcaggccagcgaaactgtcctacacggaggcagagggcgaacgatctgcactgctggcagctatccgcgggcacagcggcacctgcagcctgaggaaggtggcatcctctgcttctgaggagctccagagcttccgagatgccgcactctctgcacagggctcggaaagtcctctgctagaagaccttggtcttctgtccccaccagccattcccccaccaccccctccaccctcccaggctctctctgcaccaaggacggcctccaggttcagcacgggcaccctcagcaacaccgcagacgcaaggcaagccttgatggacgccatccgctccggcacaggggctgcgagactgagaaaggtgcccttgctcgtgtgaatgaacagaggccagagaattgcagaaacccacctgtaatatgcccacaggcgtcactcaaggagtctgcatagccaggaacatcaagttttggtgttactttcttgtctacaggccaaaatgcgcacagttgattttcggtgtgttcctgtataacggcttgaaaggaaaggagaagatgctgtgtcgctgcgcagctcgtgtgccaaggaaatgtgttttgcctctgaatatcttaagttgctaataaacgattcttgttggcaggttaatgggactataaatgctggagcccagcactcacacttaattatatttatgggcaaagtaaaaagaatcatgccttagactgattttggacctttgagacttttaccacatacagatggatgaaactacttactgatttaagatcttttgaattttagaaaaaacatatgaatcagatggaacaatctgaatgtgatatgctccatgatgctgtgtgttttggtagtaagaaaaaaaaattgggaggcttttcaaaggtggctttgttaggtagtaaaactgctggattcttcttcctcaaatatttggggctaacacttcacagagggtcacagtccatgatctgaccaactaagcttttaaaaatcaactattaccacccagaaaacagtcctacgtgatcatgtggccagggcatgcccgagtcctgcaagggtggcgggtggctgaggtcacaccaccactggagtggatgggcagtgccccacatggacagccattccccaggctatgaagtgacataggcctcccccacggtgcctgtgtacggagcctgatgacttcactgggagccttctggaatcctgcagagggtcaaggagcagggatgttggatgcccacctgtcaagagttcagatcaaagttgcgctgagagcgtcacaattttggttcagccttgacgcgtttgtccaacagctcattggctccctttgtatgatatcgtggtcttctcacatggtgcccagtcaccaatatttataatgaggtctaactacagcagtagtttttcatatatatctctaaaacattttgttatattgaaaaaagtaatagaaatcaagatgtgttgatgaaataaaatgtgtatctgagtgagaaaacaagtatggtgaggtcactttaatgtttcacagcgatctcagatctaggcctcaggtagaatggaagctgttctgcattcactgattaacgttgctaaactcttggtgaggcacgagctaccagccaattgctcttcatcacagctatctgtcttttagtgccacaaataaaagaaaatcaaatcttaaaaaat

SEQ ID NO: 440339 - DNA, 5320 bp, Homo sapiens
ccagccccttccgtccgccgcgctccgccgctgtcctccgccggcccgcgtgggaggacgatgggtcagcgcggaaaaagtgaatgagggcggcagcggtggcggcggtagccagcgcctgactcggcgggcccggagcaccgcccgcgtcccggcccccggcaccatggacgcgccgcgcgcctcggcggccaagcccccgaccgggaggaagatgaaggctcgtgctcccccacctcctggaaaggctgccactctgcatgtgcacagtgaccagaagcccccccacgatggggccctcgggtcgcagcagaacttggttcgcatgaaggaggcgctgagggccagcaccatggacgtcaccgtggtcctgcctagcgggctggagaagaggagcgtgctcaatgggagccatgcgatgatggacctactggttgaactttgccttcagaaccacctgaatccatcccaccatgcccttgaaattcggtcttcagaaacccaacaacctttgagttttaagccaaatactttgattgggaccctgaatgtgcatactgtgtttctgaaagaaaaagttcctgaagagaaggttaagcctggtccccctaaggtgcctgagaaatctgtgcgtttggtcgtgaattacctgcggacacaaaaagctgttgtgcgtgtgagccctgaggttcctctccagaatattctcccagtcatttgtgcaaagtgtgaggtcagcccagagcacgtggttctcctcagggacaacattgccggagaggagctggagctgtccaagtccctgaacgagctcgggataaaggagctctacgcgtgggacaacagaagagaaacctttaggaaatcatcacttggcaatgatgagacagataaagagaagaaaaaatttctgggatttttcaaagttaataaaagaagcaatagtaaggctgagcagctcgtgctgtcgggtgcagacagcgatgaggacacctccagggctgccccaggaaggggtttgaacgggctgtttaacgacccccaactccccatccatgcactcacgttctcttacgctgggtccatccctctcgctgggcagcatctcaggggtgtccgtgaagtcggagatgaagaagcgccgagcccctcctcctccaggttcagggccacctgtgcaagacaaggcatcggaaaaggtatctcttgggtcacagattgatttacagaagaagaagcggcgagcgccagctccccctccaccacagccaccaccaccgagtcccctgatccccaaccgcactgaggataaggaggagaacaggaagagcacgatggtaagcctgcccctggggtctggcagccactgcagcccggatggagccccgcaggtgctgtcagaggcggaggagaccgtgtcagttggcagctgttttgcgtcggaggacacgaccgaggactcaggagtgatgagttccccctcagacatcgtctctctggactcgcagcaggacagcatgaaatacaaagacaagtgggccacagaccaggaagactgcagtgaccaggacctcgctggaaccccagacctgggtccccagaagagccccttgtgggagaagaatggctctgagaactcacatctgagaactgaaaaagctgtcacagcctcaaatgatgaagaagacctattaattgctggagagttccgtaaaacccttgcagaacttgatgaagacctggaagaaatggaagacagctatgaaacagacaccagctccctcaccagctccatccatggtgcatccaaccactgcccacaggatgccatgatccctcacggcgacacagatgcaatcccagtaacattcataggggaagtttcagatgatcctgtggattcggggttgttttccaatagaaacaacaatgctgggtctttcgactcggagggtgttgccagcaggagagactccctggcgccacttcaagctgagcacagccagccccatgaaaaggcaagggaggaagtacctgccctgcaccccgcttcccatgacgtcggaaaaggaatccgtgtggccttatctaacatctctaaagatgggaatctaatggaaacggcgcccagggtgacttcttttgcttcgaatcttcacacagacaacctaaatgcaaaagtgaaagacaaagtgtatggctgtgctgacggggagaggactcaagccacagagagagtgaattcccaaccggtgaatgaaaaggacagcaacgataaaaacgctgccttggcaccaacatcatggcaccaacgaggccaaaacccagggaaaagctacagacttaagcacggcctcacaacgtataaaatcattcctccaaagtcagagatgcgatgttacgacagagatgtgtccctctccaccggagccattaagattgacgagctggggaacttggtgagtcctcacgccaccggcatcaggatcatttccctgtcttcgtctgtgcctgaagcagaatctcagcccattgggaaagtcagagagttctggaggtgcaactctgtggaaaaacacctgggccgaccctcagagagctctgccaggggacccccctccacccctgtgcccacgcagacgcagaatccagagagcagactccaagcagaccccaagccaatatcgccccagcagaagtctgcccaccatgagggccggaaccccctaggggaggggagaaaccagccccccaccatgggcatgggtcacgtgagggtgccagcagctcacaccacagaagtcacatttctcaagcctcagagaagaacgtccagccagtatgtggcctctgccattgccaagcgcataggagccccaggcaaggcgccagtgctggctgcaccacctgtcactgtgaaagatgacaggacatccagcccacactcagagacacaaggatggaaggatggtgcccagtggccctgtgtcactcctcccaacaaccacggggaagatttggcagtgggagcccctcctaggggggaggtcattggcccacacaggaagttgtctactcaggacagacctgctgctatccacagaagctcctgtttctcactggttcagtcttcccagagggatcgtgtttctgtgggacagagctgtggtttcagtggaaagcaaagcacaagtagccaggaggccagctcagcatctgagcccagacgcgcacctgatggtacagacccaccccctccacacacatctgacactcaggcctgcagcagggagctggtcaatggctctgtgcgcgccccaggccacggcgagccttcccaccctccaggagggtctggcacagaaagccacattctcctagaaagagaggaaaagcccagtgtgttctctacagatggaaatgaaacagacagtatttggccacccagcatttttgggccgaagaaaaaattcaaacctgttgtccagagaccagtcccaaaagacacatccctgcactctgccctgatggaagccatccactctgcgggagggaaggacagactacgcaagacggcagaacacaccggggagggcaggccagcgaaactgtcctacacggaggcagagggcgaacgatctgcactgctggcagctatccgcgggcacagcggcacctgcagcctgaggaaggtggcatcctctgcttctgaggagctccagagcttccgagatgccgcactctctgcacagggctcggaaagtcctctgctagaagaccttggtcttctgtccccaccagccattcccccaccaccccctccaccctcccaggctctctctgcaccaaggacggcctccaggttcagcacgggcaccctcagcaacaccgcagacgcaaggcaagccttgatggacgccatccgctccggcacaggggctgcgagactgagaaaggtgcccttgctcgtgtgaatgaacagaggccagagaattgcagaaacccacctgtaatatgcccacaggcgtcactcaaggagtctgcatagccaggaacatcaagttttggtgttactttcttgtctacaggccaaaatgcgcacagttgattttcggtgtgttcctgtataacggcttgaaaggaaaggagaagatgctgtgtcgctgcgcagctcgtgtgccaaggaaatgtgttttgcctctgaatatcttaagttgctaataaacgattcttgttggcaggttaatgggactataaatgctggagcccagcactcacacttaattatatttatgggcaaagtaaaaagaatcatgccttagactgattttggacctttgagacttttaccacatacagatggatgaaactacttactgatttaagatcttttgaattttagaaaaaacatatgaatcagatggaacaatctgaatgtgatatgctccatgatgctgtgtgttttggtagtaagaaaaaaaaattgggaggcttttcaaaggtggctttgttaggtagtaaaactgctggattcttcttcctcaaatatttggggctaacacttcacagagggtcacagtccatgatctgaccaactaagcttttaaaaatcaactattaccacccagaaaacagtcctacgtgatcatgtggccagggcatgcccgagtcctgcaagggtggcgggtggctgaggtcacaccaccactggagtggatgggcagtgccccacatggacagccattccccaggctatgaagtgacataggcctcccccacggtgcctgtgtacggagcctgatgacttcactgggagccttctggaatcctgcagagggtcaaggagcagggatgttggatgcccacctgtcaagagttcagatcaaagttgcgctgagagcgtcacaattttggttcagccttgacgcgtttgtccaacagctcattggctccctttgtatgatatcgtggtcttctcacatggtgcccagtcaccaatatttataatgaggtctaactacagcagtagtttttcatatatatctctaaaacattttgttatattgaaaaaagtaatagaaatcaagatgtgttgatgaaataaaatgtgtatctgagtgagaaaacaagtatggtgaggtcactttaatgtttcacagcgatctcagatctaggcctcaggtagaatggaagctgttctgcattcactgattaacgttgctaaactcttggtgaggcacgagctaccagccaattgctcttcatcacagctatctgtcttttagtgccacaaataaaagaaaatcaaatcttaaaaaat

SEQ ID NO: 440340 - DNA, 4394 bp, Homo sapiens
tttccccgtacggccaaccgtacgcccaaaaagaagcaatagtagggctgtttaacgacccccaactccccatccatgcactcacgttctcttacgctgggtccatccctctcgctgggcagcatctcaggggtgtccgtgaagtcggagatgaagaagcgccgagcccctcctcctccaggttcagggccacctgtgcaagacaaggcatcggaaaaggtatctcttgggtcacagattgatttacagaagaagaagcggcgagcgccagctccccctccaccacagccaccaccaccgagtcccctgatccccaaccgcactgaggataaggaggagaacaggaagagcacgatggtaagcctgcccctggggtctggcagccactgcagcccggatggagccccgcaggtgctgtcagaggcggaggagaccgtgtcagttggcagctgttttgcgtcggaggacacgaccgaggactcaggagtgatgagttccccctcagacatcgtctctctggactcgcagcaggacagcatgaaatacaaagacaagtgggccacagaccaggaagactgcagtgaccaggacctcgctggaaccccagacctgggtccccagaagagccccttgtgggagaagaatggctctgagaactcacatctgagaactgaaaaagctgtcacagcctcaaatgatgaagaagacctattaattgctggagagttccgtaaaacccttgcagaacttgatgaagacctggaagaaatggaagacagctatgaaacagacaccagctccctcaccagctccatccatggtgcatccaaccactgcccacaggatgccatgatccctcacggcgacacagatgcaatcccagtaacattcataggggaagtttcagatgatcctgtggattcggggttgttttccaatagaaacaacaatgctgggtctttcgactcggagggtgttgccagcaggagagactccctggcgccacttcaagctgagcacagccagccccatgaaaaggcaagggaggaagtacctgccctgcaccccgcttcccatgacgtcggaaaaggaatccgtgtggccttatctaacatctctaaagatgggaatctaatggaaacggcgcccagggtgacttcttttgcttcgaatcttcacacagacaacctaaatgcaaaagtgaaagacaaagtgtatggctgtgctgacggggagaggactcaagccacagagagagtgaattcccaaccggtgaatgaaaaggacagcaacgataaaaacgctgccttggcaccaacatcatggcaccaacgaggccaaaacccagggaaaagctacagacttaagcacggcctcacaacgtataaaatcattcctccaaagtcagagatgcgatgttacgacagagatgtgtccctctccaccggagccattaagattgacgagctggggaacttggtgagtcctcacgccaccggcatcaggatcatttccctgtcttcgtctgtgcctgaagcagaatctcagcccattgggaaagtcagagagttctggaggtgcaactctgtggaaaaacacctgggccgaccctcagagagctctgccaggggacccccctccacccctgtgcccacgcagacgcagaatccagagagcagactccaagcagaccccaagccaatatcgccccagcagaagtctgcccaccatgagggccggaaccccctaggggaggggagaaaccagccccccaccatgggcatgggtcacgtgagggtgccagcagctcacaccacagaagtcacatttctcaagcctcagagaagaacgtccagccagtatgtggcctctgccattgccaagcgcataggagccccaaaagtccatgctgatgtggtgaggccacacggttatgccgagaagggttatgcaggcaaggcgccagtgctggctgcaccacctgtcactgtgaaagatgacaggacatccagcccacactcagagacacaaggatggaaggatggtgcccagtggccctgtgtcactcctcccaacaaccacggggaagatttggcagtgggagcccctcctaggggggaggtcattggcccacacaggaagttgtctactcaggacagacctgctgctatccacagaagctcctgtttctcactggttcagtcttcccagagggatcgtgtttctgtgggacagagctgtggtttcagtggaaagcaaagcacaagtagccaggaggccagctcagcatctgagcccagacgcgcacctgatggtacagacccaccccctccacacacatctgacactcaggcctgcagcagggagctggtcaatggctctgtgcgcgccccaggccacggcgagccttcccaccctccaggagggtctggcacagaaagccacattctcctagaaagagaggaaaagcccagtgtgttctctacagatggaaatgaaacagacagtatttggccacccagcatttttgggccgaagaaaaaattcaaacctgttgtccagagaccagtcccaaaagacacatccctgcactctgccctgatggaagccatccactctgcgggagggaaggacagactacgcaagacggcagaacacaccggggagggcaggccagcgaaactgtcctacacggaggcagagggcgaacgatctgcactgctggcagctatccgcgggcacagcggcacctgcagcctgaggaaggtggcatcctctgcttctgaggagctccagagcttccgagatgccgcactctctgcacagggctcggaaagtcctctgctagaagaccttggtcttctgtccccaccagccattcccccaccaccccctccaccctcccaggctctctctgcaccaaggacggcctccaggttcagcacgggcaccctcagcaacaccgcagacgcaaggcaagccttgatggacgccatccgctccggcacaggggctgcgagactgagaaaggtgcccttgctcgtgtgaatgaacagaggccagagaattgcagaaacccacctgtaatatgcccacaggcgtcactcaaggagtctgcatagccaggaacatcaagttttggtgttactttcttgtctacaggccaaaatgcgcacagttgattttcggtgtgttcctgtataacggcttgaaaggaaaggagaagatgctgtgtcgctgcgcagctcgtgtgccaaggaaatgtgttttgcctctgaatatcttaagttgctaataaacgattcttgttggcaggttaatgggactataaatgctggagcccagcactcacacttaattatatttatgggcaaagtaaaaagaatcatgccttagactgattttggacctttgagacttttaccacatacagatggatgaaactacttactgatttaagatcttttgaattttagaaaaaacatatgaatcagatggaacaatctgaatgtgatatgctccatgatgctgtgtgttttggtagtaagaaaaaaaaattgggaggcttttcaaaggtggctttgttaggtagtaaaactgctggattcttcttcctcaaatatttggggctaacacttcacagagggtcacagtccatgatctgaccaactaagcttttaaaaatcaactattaccacccagaaaacagtcctacgtgatcatgtggccagggcatgcccgagtcctgcaagggtggcgggtggctgaggtcacaccaccactggagtggatgggcagtgccccacatggacagccattccccaggctatgaagtgacataggcctcccccacggtgcctgtgtacggagcctgatgacttcactgggagccttctggaatcctgcagagggtcaaggagcagggatgttggatgcccacctgtcaagagttcagatcaaagttgcgctgagagcgtcacaattttggttcagccttgacgcgtttgtccaacagctcattggctccctttgtatgatatcgtggtcttctcacatggtgcccagtcaccaatatttataatgaggtctaactacagcagtagtttttcatatatatctctaaaacattttgttatattgaaaaaagtaatagaaatcaagatgtgttgatgaaataaaatgtgtatctgagtgagaaaacaagtatggtgaggtcactttaatgtttcacagcgatctcagatctaggcctcaggtagaatggaagctgttctgcattcactgattaacgttgctaaactcttggtgaggcacgagctaccagccaattgctcttcatcacagctatctgtcttttagtgccacaaataaaagaaaatcaaatcttaaaaaat

SEQ ID NO: 440341 - DNA, 3920 bp, Homo sapiens
tgcacacacatgggggacacacacacccatgaacaatctgcgtctccgtagttctgaggacaacagcagtacagtgagtatgtgactgcttgaatttgagtatgagctgttctatcctcagatattcctggaaaggagtacattaaatcaatagtaagagaaatgagtgctcctttctctttggtcttccctagaactgaaaaagctgtcacagcctcaaatgatgaagaagacctattaattgctggagagttccgtaaaacccttgcagaacttgatgaagacctggaagaaatggaagacagctatgaaacagacaccagctccctcaccagctccatccatggtgcatccaaccactgcccacaggatgccatgatccctcacggcgacacagatgcaatcccagtaacattcataggggaagtttcagatgatcctgtggattcggggttgttttccaatagaaacaacaatgctgggtctttcgactcggagggtgttgccagcaggagagactccctggcgccacttcaagctgagcacagccagccccatgaaaaggcaagggaggaagtacctgccctgcaccccgcttcccatgacgtcggaaaaggaatccgtgtggccttatctaacatctctaaagatgggaatctaatggaaacggcgcccagggtgacttcttttgcttcgaatcttcacacagacaacctaaatgcaaaagtgaaagacaaagtgtatggctgtgctgacggggagaggactcaagccacagagagagtgaattcccaaccggtgaatgaaaaggacagcaacgataaaaacgctgccttggcaccaacatcatggcaccaacgaggccaaaacccagggaaaagctacagacttaagcacggcctcacaacgtataaaatcattcctccaaagtcagagatgcgatgttacgacagagatgtgtccctctccaccggagccattaagattgacgagctggggaacttggtgagtcctcacgccaccggcatcaggatcatttccctgtcttcgtctgtgcctgaagcagaatctcagcccattgggaaagtcagagagttctggaggtgcaactctgtggaaaaacacctgggccgaccctcagagagctctgccaggggacccccctccacccctgtgcccacgcagacgcagaatccagagagcagactccaagcagaccccaagccaatatcgccccagcagaagtctgcccaccatgagggccggaaccccctaggggaggggagaaaccagccccccaccatgggcatgggtcacgtgagggtgccagcagctcacaccacagaagtcacatttctcaagcctcagagaagaacgtccagccagtatgtggcctctgccattgccaagcgcataggagccccaaaagtccatgctgatgtggtgaggccacacggttatgccgagaagggttatgcaggcaaggcgccagtgctggctgcaccacctgtcactgtgaaagatgacaggacatccagcccacactcagagacacaaggatggaaggatggtgcccagtggccctgtgtcactcctcccaacaaccacggggaagatttggcagtgggagcccctcctaggggggaggtcattggcccacacaggaagttgtctactcaggacagacctgctgctatccacagaagctcctgtttctcactggttcagtcttcccagagggatcgtgtttctgtgggacagagctgtggtttcagtggaaagcaaagcacaagtagccaggaggccagctcagcatctgagcccagacgcgcacctgatggtacagacccaccccctccacacacatctgacactcaggcctgcagcagggagctggtcaatggctctgtgcgcgccccaggccacggcgagccttcccaccctccaggagggtctggcacagaaagccacattctcctagaaagagaggaaaagcccagtgtgttctctacagatggaaatgaaacagacagtatttggccacccagcatttttgggccgaagaaaaaattcaaacctgttgtccagagaccagtcccaaaagacacatccctgcactctgccctgatggaagccatccactctgcgggagggaaggacagactacgcaagacggcagaacacaccggggagggcaggccagcgaaactgtcctacacggaggcagagggcgaacgatctgcactgctggcagctatccgcgggcacagcggcacctgcagcctgaggaaggtggcatcctctgcttctgaggagctccagagcttccgagatgccgcactctctgcacagggctcggaaagtcctctgctagaagaccttggtcttctgtccccaccagccattcccccaccaccccctccaccctcccaggctctctctgcaccaaggacggcctccaggttcagcacgggcaccctcagcaacaccgcagacgcaaggcaagccttgatggacgccatccgctccggcacaggggctgcgagactgagaaaggtgcccttgctcgtgtgaatgaacagaggccagagaattgcagaaacccacctgtaatatgcccacaggcgtcactcaaggagtctgcatagccaggaacatcaagttttggtgttactttcttgtctacaggccaaaatgcgcacagttgattttcggtgtgttcctgtataacggcttgaaaggaaaggagaagatgctgtgtcgctgcgcagctcgtgtgccaaggaaatgtgttttgcctctgaatatcttaagttgctaataaacgattcttgttggcaggttaatgggactataaatgctggagcccagcactcacacttaattatatttatgggcaaagtaaaaagaatcatgccttagactgattttggacctttgagacttttaccacatacagatggatgaaactacttactgatttaagatcttttgaattttagaaaaaacatatgaatcagatggaacaatctgaatgtgatatgctccatgatgctgtgtgttttggtagtaagaaaaaaaaattgggaggcttttcaaaggtggctttgttaggtagtaaaactgctggattcttcttcctcaaatatttggggctaacacttcacagagggtcacagtccatgatctgaccaactaagcttttaaaaatcaactattaccacccagaaaacagtcctacgtgatcatgtggccagggcatgcccgagtcctgcaagggtggcgggtggctgaggtcacaccaccactggagtggatgggcagtgccccacatggacagccattccccaggctatgaagtgacataggcctcccccacggtgcctgtgtacggagcctgatgacttcactgggagccttctggaatcctgcagagggtcaaggagcagggatgttggatgcccacctgtcaagagttcagatcaaagttgcgctgagagcgtcacaattttggttcagccttgacgcgtttgtccaacagctcattggctccctttgtatgatatcgtggtcttctcacatggtgcccagtcaccaatatttataatgaggtctaactacagcagtagtttttcatatatatctctaaaacattttgttatattgaaaaaagtaatagaaatcaagatgtgttgatgaaataaaatgtgtatctgagtgagaaaacaagtatggtgaggtcactttaatgtttcacagcgatctcagatctaggcctcaggtagaatggaagctgttctgcattcactgattaacgttgctaaactcttggtgaggcacgagctaccagccaattgctcttcatcacagctatctgtcttttagtgccacaaataaaagaaaatcaaatcttaaaaaat

SEQ ID NO: 440342 - DNA, 2019 bp, Homo sapiens
ccagccccttccgtccgccgcgctccgccgctgtcctccgccggcccgcgtgggaggacgatgggtcagcgcggaaaaagtgaatgagggcggcagcggtggcggcggtagccagcgcctgactcggcgggcccggagcaccgcccgcgtcccggcccccggcaccatggacgcgccgcgcgcctcggcggccaagcccccgaccgggaggaagatgaaggctcgtgctcccccacctcctggaaaggctgccactctgcatgtgcacagtgaccagaagcccccccacgatggggccctcgggtcgcagcagaacttggttcgcatgaaggaggcgctgagggccagcaccatggacgtcaccgtggtcctgcctagcgggctggagaagaggagcgtgctcaatgggagccatgcgatgatggacctactggttgaactttgccttcagaaccacctgaatccatcccaccatgcccttgaaattcggtcttcagaaacccaacaacctttgagttttaagccaaatactttgattgggaccctgaatgtgcatactgtgtttctgaaagaaaaagttcctgaagagaaggttaagcctggtccccctaaggtgcctgagaaatctgtgcgtttggtcgtgaattacctgcggacacaaaaagctgttgtgcgtgtgagccctgaggttcctctccagaatattctcccagtcatttgtgcaaagtgtgaggtcagcccagagcacgtggttctcctcagggacaacattgccggagaggagctggagctgtccaagtccctgaacgagctcgggataaaggagctctacgcgtgggacaacagaagagaaacctttaggaaatcatcacttggcaatgatgagacagataaagagaagaaaaaatttctgggatttttcaaagttaataaaagaagcaatagtaaggctgagcagctcgtgctgtcgggtgcagacagcgatgaggacacctccagggctgccccaggaaggggtttgaacgggctgtttaacgacccccaactccccatccatgcactcacgttctcttacgctgggtccatccctctcgctgggcagcatctcaggggtgtccgtgaagtcggagatgaagaagcgccgagcccctcctcctccaggttcagggccacctgtgcaagacaaggcatcggaaaaggtatctcttgggtcacagattgatttacagaagaagaagcggcgagcgccagctccccctccaccacagccaccaccaccgagtcccctgatccccaaccgcactgaggataaggaggagaacaggaagagcacgatggtttattgctgtgcgtcattccctactcaggccaagcgcttctgatggacgggcctcttcctgacctcggacctttcccagtgtctcttctgccctggctctgattttcctgttgttcttcctcctttcaggataaaagggctcattgtatacccagaatttacttcctttggggtttacatataaatgcattaataacagagatttgtttgattgaggtttatatttttttgaaggaggtaaattatatgcaaattttaggttgataatattcacctgtctgaaattcactgatacttggaaatgttcctgtgaagaactctgctttattttaattcattattaattcatgtttttcttattggatattcagttccagaatttattgccaatttttcttaaaactagattgtatccataaattgaccagtatagtcaatttggatagaactgaaactttctgtctacctggtaaaactaagtgcctaaaaacatgaactataaatgtagttactaggaactcacaacttatatatactatccattcaatgatacataggacccaatgtctttgtgtttttgaggttttcctgttactgtgtactttgccattttacatagttcactaaaaagaaagaagtgggagaagaagggtgttctattcattattctatattatgat

SEQ ID NO: 440343 - DNA, 234 bp, Homo sapiens
tgacctagtcacccccaatcctcatctcctcatgccactaccttgggcgttgggatttcacagctgaattttgggagacattcactctatagcagtcatttaatcatctcattgccaggtggcatcctctgcttctgaggagctccagagcttccgagatgccgcactctctgcacagggctcggaaagtcctctgctagaagaccttggtcttctgtccccaccagccattcc

SEQ ID NO: 440344 - DNA, 5299 bp, Homo sapiens
ccagccccttccgtccgccgcgctccgccgctgtcctccgccggcccgcgtgggaggacgatgggtcagcgcggaaaaagtgaatgagggcggcagcggtggcggcggtagccagcgcctgactcggcgggcccggagcaccgcccgcgtcccggcccccggcaccatggacgcgccgcgcgcctcggcggccaagcccccgaccgggaggaagatgaaggctcgtgctcccccacctcctggaaaggctgccactctgcatgtgcacagtgaccagaagcccccccacgatggggccctcgggtcgcagcagaacttggttcgcatgaaggaggcgctgagggccagcaccatggacgtcaccgtggtcctgcctagcgggctggagaagaggagcgtgctcaatgggagccatgcgatgatggacctactggttgaactttgccttcagaaccacctgaatccatcccaccatgcccttgaaattcggtcttcagaaacccaacaacctttgagttttaagccaaatactttgattgggaccctgaatgtgcatactgtgtttctgaaagaaaaagttcctgaagagaaggttaagcctggtccccctaaggtgcctgagaaatctgtgcgtttggtcgtgaattacctgcggacacaaaaagctgttgtgcgtgtgagccctgaggttcctctccagaatattctcccagtcatttgtgcaaagtgtgaggtcagcccagagcacgtggttctcctcagggacaacattgccggagaggagctggagctgtccaagtccctgaacgagctcgggataaaggagctctacgcgtgggacaacagaagagaaacctttaggaaatcatcacttggcaatgatgagacagataaagagaagaaaaaatttctgggatttttcaaagttaataaaagaagcaatagtaaggggctgtttaacgacccccaactccccatccatgcactcacgttctcttacgctgggtccatccctctcgctgggcagcatctcaggggtgtccgtgaagtcggagatgaagaagcgccgagcccctcctcctccaggttcagggccacctgtgcaagacaaggcatcggaaaaggtatctcttgggtcacagattgatttacagaagaagaagcggcgagcgccagctccccctccaccacagccaccaccaccgagtcccctgatccccaaccgcactgaggataaggaggagaacaggaagagcacgatggtaagcctgcccctggggtctggcagccactgcagcccggatggagccccgcaggtgctgtcagaggcggaggagaccgtgtcagttggcagctgttttgcgtcggaggacacgaccgaggactcaggagtgatgagttccccctcagacatcgtctctctggactcgcagcaggacagcatgaaatacaaagacaagtgggccacagaccaggaagactgcagtgaccaggacctcgctggaaccccagacctgggtccccagaagagccccttgtgggagaagaatggctctgagaactcacatctgagaactgaaaaagctgtcacagcctcaaatgatgaagaagacctattaattgctggagagttccgtaaaacccttgcagaacttgatgaagacctggaagaaatggaagacagctatgaaacagacaccagctccctcaccagctccatccatggtgcatccaaccactgcccacaggatgccatgatccctcacggcgacacagatgcaatcccagtaacattcataggggaagtttcagatgatcctgtggattcggggttgttttccaatagaaacaacaatgctgggtctttcgactcggagggtgttgccagcaggagagactccctggcgccacttcaagctgagcacagccagccccatgaaaaggcaagggaggaagtacctgccctgcaccccgcttcccatgacgtcggaaaaggaatccgtgtggccttatctaacatctctaaagatgggaatctaatggaaacggcgcccagggtgacttcttttgcttcgaatcttcacacagacaacctaaatgcaaaagtgaaagacaaagtgtatggctgtgctgacggggagaggactcaagccacagagagagtgaattcccaaccggtgaatgaaaaggacagcaacgataaaaacgctgccttggcaccaacatcatggcaccaacgaggccaaaacccagggaaaagctacagacttaagcacggcctcacaacgtataaaatcattcctccaaagtcagagatgcgatgttacgacagagatgtgtccctctccaccggagccattaagattgacgagctggggaacttggtgagtcctcacgccaccggcatcaggatcatttccctgtcttcgtctgtgcctgaagcagaatctcagcccattgggaaagtcagagagttctggaggtgcaactctgtggaaaaacacctgggccgaccctcagagagctctgccaggggacccccctccacccctgtgcccacgcagacgcagaatccagagagcagactccaagcagaccccaagccaatatcgccccagcagaagtctgcccaccatgagggccggaaccccctaggggaggggagaaaccagccccccaccatgggcatgggtcacgtgagggtgccagcagctcacaccacagaagtcacatttctcaagcctcagagaagaacgtccagccagtatgtggcctctgccattgccaagcgcataggagccccaaaagtccatgctgatgtggtgaggccacacggttatgccgagaagggttatgcaggcaaggcgccagtgctggctgcaccacctgtcactgtgaaagatgacaggacatccagcccacactcagagacacaaggatggaaggatggtgcccagtggccctgtgtcactcctcccaacaaccacggggaagatttggcagtgggagcccctcctaggggggaggtcattggcccacacaggaagttgtctactcaggacagacctgctgctatccacagaagctcctgtttctcactggttcagtcttcccagagggatcgtgtttctgtgggacagagctgtggtttcagtggaaagcaaagcacaagtagccaggaggccagctcagcatctgagcccagacgcgcacctgatggtacagacccaccccctccacacacatctgacactcaggcctgcagcagggagctggtcaatggctctgtgcgcgccccaggccacggcgagccttcccaccctccaggagggtctggcacagaaagccacattctcctagaaagagaggaaaagcccagtgtgttctctacagatggaaatgaaacagacagtatttggccacccagcatttttgggccgaagaaaaaattcaaacctgttgtccagagaccagtcccaaaagacacatccctgcactctgccctgatggaagccatccactctgcgggagggaaggacagactacgcaagacggcagaacacaccggggagggcaggccagcgaaactgtcctacacggaggcagagggcgaacgatctgcactgctggcagctatccgcgggcacagcggcacctgcagcctgaggaaggtggcatcctctgcttctgaggagctccagagcttccgagatgccgcactctctgcacagggctcggaaagtcctctgctagaagaccttggtcttctgtccccaccagccattcccccaccaccccctccaccctcccaggctctctctgcaccaaggacggcctccaggttcagcacgggcaccctcagcaacaccgcagacgcaaggcaagccttgatggacgccatccgctccggcacaggggctgcgagactgagaaaggtgcccttgctcgtgtgaatgaacagaggccagagaattgcagaaacccacctgtaatatgcccacaggcgtcactcaaggagtctgcatagccaggaacatcaagttttggtgttactttcttgtctacaggccaaaatgcgcacagttgattttcggtgtgttcctgtataacggcttgaaaggaaaggagaagatgctgtgtcgctgcgcagctcgtgtgccaaggaaatgtgttttgcctctgaatatcttaagttgctaataaacgattcttgttggcaggttaatgggactataaatgctggagcccagcactcacacttaattatatttatgggcaaagtaaaaagaatcatgccttagactgattttggacctttgagacttttaccacatacagatggatgaaactacttactgatttaagatcttttgaattttagaaaaaacatatgaatcagatggaacaatctgaatgtgatatgctccatgatgctgtgtgttttggtagtaagaaaaaaaaattgggaggcttttcaaaggtggctttgttaggtagtaaaactgctggattcttcttcctcaaatatttggggctaacacttcacagagggtcacagtccatgatctgaccaactaagcttttaaaaatcaactattaccacccagaaaacagtcctacgtgatcatgtggccagggcatgcccgagtcctgcaagggtggcgggtggctgaggtcacaccaccactggagtggatgggcagtgccccacatggacagccattccccaggctatgaagtgacataggcctcccccacggtgcctgtgtacggagcctgatgacttcactgggagccttctggaatcctgcagagggtcaaggagcagggatgttggatgcccacctgtcaagagttcagatcaaagttgcgctgagagcgtcacaattttggttcagccttgacgcgtttgtccaacagctcattggctccctttgtatgatatcgtggtcttctcacatggtgcccagtcaccaatatttataatgaggtctaactacagcagtagtttttcatatatatctctaaaacattttgttatattgaaaaaagtaatagaaatcaagatgtgttgatgaaataaaatgtgtatctgagtgagaaaacaagtatggtgaggtcactttaatgtttcacagcgatctcagatctaggcctcaggtagaatggaagctgttctgcattcactgattaacgttgctaaactcttggtgaggcacgagctaccagccaattgctcttcatcacagctatctgtcttttagtgccacaaataaaagaaaatcaaatcttaaaaaat

SEQ ID NO: 440345 - DNA, 5233 bp, Homo sapiens
ccagccccttccgtccgccgcgctccgccgctgtcctccgccggcccgcgtgggaggacgatgggtcagcgcggaaaaagtgaatgagggcggcagcggtggcggcggtagccagcgcctgactcggcgggcccggagcaccgcccgcgtcccggcccccggcaccatggacgcgccgcgcgcctcggcggccaagcccccgaccgggaggaagatgaaggctcgtgctcccccacctcctggaaaggctgccactctgcatgtgcacagtgaccagaagcccccccacgatggggccctcgggtcgcagcagaacttggttcgcatgaaggaggcgctgagggccagcaccatggacgtcaccgtggtcctgcctagcgggctggagaagaggagcgtgctcaatgggagccatgcgatgatggacctactggttgaactttgccttcagaaccacctgaatccatcccaccatgcccttgaaattcggtcttcagaaacccaacaacctttgagttttaagccaaatactttgattgggaccctgaatgtgcatactgtgtttctgaaagaaaaagttcctgaagagaaggttaagcctggtccccctaaggtgcctgagaaatctgtgcgtttggtcgtgaattacctgcggacacaaaaagctgttgtgcgtgtgagccctgaggttcctctccagaatattctcccagtcatttgtgcaaagtgtgaggtcagcccagagcacgtggttctcctcagggacaacattgccggagaggagctggagctgtccaagtccctgaacgagctcgggataaaggagctctacgcgtgggacaacagaagagaaacctttaggaaatcatcacttggcaatgatgagacagataaagagaagaaaaaatttctgggatttttcaaagttaataaaagaagcaatagtaaggctgagcagctcgtgctgtcgggtgcagacagcgatgaggacacctccagggctgccccaggaaggggtttgaacgggctgtttaacgacccccaactccccatccatgcactcacgttctcttacgctgggtccatccctctcgctgggcagcatctcaggggtgtccgtgaagtcggagatgaagaagcgccgagcccctcctcctccaggttcagggccacctgtgcaagacaaggcatcggaaaaggtatctcttgggtcacagattgatttacagaagaagaagcggcgagcgccagctccccctccaccacagccaccaccaccgagtcccctgatccccaaccgcactgaggataaggaggagaacaggaagagcacgatggtaagcctgcccctggggtctggcagccactgcagcccggatggagccccgcaggtgctgtcagaggcggaggagaccgtgtcagttggcagctgttttgcgtcggaggacacgaccgaggactcaggagtgatgagttccccctcagacatcgtctctctggactcgcagcaggacagcatgaaatacaaagacaagtgggccacagaccaggaagactgcagtgaccaggacctcgctggaaccccagacctgggtccccagaagagccccttgtgggagaagaatggctctgagaactcacatctgagaactgaaaaagctgtcacagcctcaaatgatgaagaagacctattaattgctggagagttccgtaaaacccttgcagaacttgatgaagacctggaagaaatggaagacagctatgaaacagacaccagctccctcaccagctccatccatggtgcatccaaccactgcccacaggatgccatgatccctcacggcgacacagatgcaatcccagtaacattcataggggaagtttcagatgatcctgtggattcggggttgttttccaatagaaacaacaatgctgggtctttcgactcggagggtgttgccagcaggagagactccctggcgccacttcaagctgagcacagccagccccatgaaaaggcaagggaggaagtacctgccctgcaccccgcttcccatgacgtcggaaaaggaatccgtgtggccttatctaacatctctaaagatgggaatctaatggaaacggcgcccagggtgacttcttttgcttcgaatcttcacacagacaacctaaatgcaaaagtgaaagacaaagtgtatggctgtgctgacggggagaggactcaagccacagagagagtgaattcccaaccggtgaatgaaaaggacagcaacgataaaaacgctgccttggcaccaacatcatggcaccaacgaggccaaaacccagggaaaagctacagacttaagcacggcctcacaacgtataaaatcattcctccaaagtcagagatgcgatgttacgacagagatgtgtccctctccaccggagccattaagattgacgagctggggaacttggtgagtcctcacgccaccggcatcaggatcatttccctgtcttcgtctgtgcctgaagcagaatctcagcccattgggaaagtcagagagttctggaggtgcaactctgtggaaaaacacctgggccgaccctcagagagctctgccaggggacccccctccacccctgtgcccacgcagacgcagaatccagagagcagactccaagcagaccccaagccaatatcgccccagcagaagtctgcccaccatgagggccggaaccccctaggggaggggagaaaccagccccccaccatgggcatgggtcacgtgagggtgccagcagctcacaccacagaagtcacatttctcaagcctcagagaagaacgtccagccagtatgtggcctctgccattgccaagcgcataggagccccaaaagtccatgctgatgtggtgaggccacacggttatgccgagaagggttatgcaggcaaggcgccagtgctggctgcaccacctgtcactgtgaaagatgacaggacatccagcccacactcagagacacaaggatggaaggatggtgcccagtggccctgtgtcactcctcccaacaaccacggggaagatttggcagtgggagcccctcctaggggggaggtcattggcccacacaggaagttgtctactcaggacagacctgctgctatccacagaagctcctgtttctcactggttcagtcttcccagagggatcgtgtttctgtgggacagagctgtggtttcagtggaaagcaaagcacaagtagccaggaggccagctcagcatctgagcccagacgcgcacctgatggtacagacccaccccctccacacacatctgacactcaggcctgcagcagggagctggtcaatggctctgtgcgcgccccaggccacggcgagccttcccaccctccaggagggtctggcacagaaagccacattctcctagaaagagaggaaaagcccagtgtgttctctacagatggaaatgaaacagacagtatttggccacccagcatttttgggccgaagaaaaaattcaaacctgttgtccagagaccagtcccaaaagacacatccctgcactctgccctgatggaagccatccactctgcgggagggaaggacagactacgcaagacggcagaacacaccggggagggcaggccagcgaaactgtcctacacggaggcagagggcgaacgatctgcactgctggcagctatccgcgggcacagcggcacctgcagcctgaggaaggctctctctgcaccaaggacggcctccaggttcagcacgggcaccctcagcaacaccgcagacgcaaggcaagccttgatggacgccatccgctccggcacaggggctgcgagactgagaaaggtgcccttgctcgtgtgaatgaacagaggccagagaattgcagaaacccacctgtaatatgcccacaggcgtcactcaaggagtctgcatagccaggaacatcaagttttggtgttactttcttgtctacaggccaaaatgcgcacagttgattttcggtgtgttcctgtataacggcttgaaaggaaaggagaagatgctgtgtcgctgcgcagctcgtgtgccaaggaaatgtgttttgcctctgaatatcttaagttgctaataaacgattcttgttggcaggttaatgggactataaatgctggagcccagcactcacacttaattatatttatgggcaaagtaaaaagaatcatgccttagactgattttggacctttgagacttttaccacatacagatggatgaaactacttactgatttaagatcttttgaattttagaaaaaacatatgaatcagatggaacaatctgaatgtgatatgctccatgatgctgtgtgttttggtagtaagaaaaaaaaattgggaggcttttcaaaggtggctttgttaggtagtaaaactgctggattcttcttcctcaaatatttggggctaacacttcacagagggtcacagtccatgatctgaccaactaagcttttaaaaatcaactattaccacccagaaaacagtcctacgtgatcatgtggccagggcatgcccgagtcctgcaagggtggcgggtggctgaggtcacaccaccactggagtggatgggcagtgccccacatggacagccattccccaggctatgaagtgacataggcctcccccacggtgcctgtgtacggagcctgatgacttcactgggagccttctggaatcctgcagagggtcaaggagcagggatgttggatgcccacctgtcaagagttcagatcaaagttgcgctgagagcgtcacaattttggttcagccttgacgcgtttgtccaacagctcattggctccctttgtatgatatcgtggtcttctcacatggtgcccagtcaccaatatttataatgaggtctaactacagcagtagtttttcatatatatctctaaaacattttgttatattgaaaaaagtaatagaaatcaagatgtgttgatgaaataaaatgtgtatctgagtgagaaaacaagtatggtgaggtcactttaatgtttcacagcgatctcagatctaggcctcaggtagaatggaagctgttctgcattcactgattaacgttgctaaactcttggtgaggcacgagctaccagccaattgctcttcatcacagctatctgtcttttagtgccacaaataaaagaaaatcaaatcttaaaaaat

SEQ ID NO: 440346 - DNA, 5110 bp, Homo sapiens
ccagccccttccgtccgccgcgctccgccgctgtcctccgccggcccgcgtgggaggacgatgggtcagcgcggaaaaagtgaatgagggcggcagcggtggcggcggtagccagcgcctgactcggcgggcccggagcaccgcccgcgtcccggcccccggcaccatggacgcgccgcgcgcctcggcggccaagcccccgaccgggaggaagatgaaggctcgtgctcccccacctcctggaaaggctgccactctgcatgtgcacagtgaccagaagcccccccacgatggggccctcgggtcgcagcagaacttggttcgcatgaaggaggcgctgagggccagcaccatggacgtcaccgtggtcctgcctagcgggctggagaagaggagcgtgctcaatgggagccatgcgatgatggacctactggttgaactttgccttcagaaccacctgaatccatcccaccatgcccttgaaattcggtcttcagaaacccaacaacctttgagttttaagccaaatactttgattgggaccctgaatgtgcatactgtgtttctgaaagaaaaagttcctgaagagaaggttaagcctggtccccctaaggtgcctgagaaatctgtgcgtttggtcgtgaattacctgcggacacaaaaagctgttgtgcgtgtgagccctgaggttcctctccagaatattctcccagtcatttgtgcaaagtgtgaggtcagcccagagcacgtggttctcctcagggacaacattgccggagaggagctggagctgtccaagtccctgaacgagctcgggataaaggagctctacgcgtgggacaacagaagagaaacctttaggaaatcatcacttggcaatgatgagacagataaagagaagaaaaaatttctgggatttttcaaagttaataaaagaagcaatagtaaggctgagcagctcgtgctgtcgggtgcagacagcgatgaggacacctccagggctgccccaggaaggggtttgaacgggctgtttaacgacccccaactccccatccatgcactcacgttctcttacgctgggtccatccctctcgctgggcagcatctcaggggtgtccgtgaagtcggagatgaagaagcgccgagcccctcctcctccaggttcagggccacctgtgcaagacaaggcatcggaaaaggtatctcttgggtcacagattgatttacagaagaagaagcggcgagcgccagctccccctccaccacagccaccaccaccgagtcccctgatccccaaccgcactgaggataaggaggagaacaggaagagcacgatggtaagcctgcccctggggtctggcagccactgcagcccggatggagccccgcaggtgctgtcagaggcggaggagaccgtgtcagttggcagctgttttgcgtcggaggacacgaccgaggactcaggagtgatgagttccccctcagacatcgtctctctggactcgcagcaggacagcatgaaatacaaagacaagtgggccacagaccaggaagactgcagtgaccaggacctcgctggaaccccagacctgggtccccagaagagccccttgtgggagaagaatggctctgagaactcacatctgagaactgaaaaagctgtcacagcctcaaatgatgaagaagacctattaattgctggagagttccgtaaaacccttgcagaacttgatgaagacctggaagaaatggaagacagctatgaaacagacaccagctccctcaccagctccatccatggtgcatccaaccactgcccacaggatgccatgatccctcacggcgacacagatgcaatcccagtaacattcataggggaagtttcagatgatcctgtggattcggggttgttttccaatagaaacaacaatgctgggtctttcgactcggagggtgttgccagcaggagagactccctggcgccacttcaagctgagcacagccagccccatgaaaaggcaagggaggaagtacctgccctgcaccccgcttcccatgacgtcggaaaaggaatccgtgtggccttatctaacatctctaaagatgggaatctaatggaaacggcgcccagggtgacttcttttgcttcgaatcttcacacagacaacctaaatgcaaaagtgaaagacaaagtgtatggctgtgctgacggggagaggactcaagccacagagagagtgaattcccaaccggtgaatgaaaaggacagcaacgataaaaacgctgccttggcaccaacatcatggcaccaacgaggccaaaacccagggaaaagctacagacttaagcacggcctcacaacgtataaaatcattcctccaaagtcagagatgcgatgttacgacagagatgtgtccctctccaccggagccattaagattgacgagctggggaacttggtgagtcctcacgccaccggcatcaggatcatttccctgtcttcgtctgtgcctgaagcagaatctcagcccattgggaaagtcagagagttctggaggtgcaactctgtggaaaaacacctgggccgaccctcagagagctctgccaggggacccccctccacccctgtgcccacgcagacgcagaatccagagagcagactccaagcagaccccaagccaatatcgccccagcagaagtctgcccaccatgagggccggaaccccctaggggaggggagaaaccagccccccaccatgggcatgggtcacgtgagggtgccagcagctcacaccacagaagtcacatttctcaagcctcagagaagaacgtccagccagtatgtggcctctgccattgccaagcgcataggagccccaaaagtccatgctgatgtggtgaggccacacggttatgccgagaagggttatgcaggcaaggcgccagtgctggctgcaccacctgtcactgtgaaagatgacaggacatccagcccacactcagagacacaaggatggaaggatggtgcccagtggccctgtgtcactcctcccaacaaccacggggaagatttggcagtgggagcccctcctaggggggaggtcattggcccacacaggaagttgtctactcaggacagacctgctgctatccacagaagctcctgtttctcactggttcagtcttcccagagggatcgtgtttctgtgggacagagctgtggtttcagtggaaagcaaagcacaagtagccaggaggccagctcagcatctgagcccagacgcgcacctgatggtacagacccaccccctccacacacatctgacactcaggcctgcagcagggagctggtcaatggctctgtgcgcgccccaggccacggcgagccttcccaccctccaggagggtctggcacagaaagccacattctcctagaaagagaggaaaagcccagtgtgttctctacagatggaaatgaaacagacagtatttggccacccagcatttttgggccgaagaaaaaattcaaacctgttgtccagagaccagtcccaaaagacacatccctgcactctgccctgatggaagccatccactctgcgggagggaaggacagactacgcaagacggcagaacacaccggggagggcaggccagcgaaactgtcctacacggaggcagagggcgaacgatctgcactgctggcagctatccgcgggcacagcggcacctgcagcctgaggaaggtgcccttgctcgtgtgaatgaacagaggccagagaattgcagaaacccacctgtaatatgcccacaggcgtcactcaaggagtctgcatagccaggaacatcaagttttggtgttactttcttgtctacaggccaaaatgcgcacagttgattttcggtgtgttcctgtataacggcttgaaaggaaaggagaagatgctgtgtcgctgcgcagctcgtgtgccaaggaaatgtgttttgcctctgaatatcttaagttgctaataaacgattcttgttggcaggttaatgggactataaatgctggagcccagcactcacacttaattatatttatgggcaaagtaaaaagaatcatgccttagactgattttggacctttgagacttttaccacatacagatggatgaaactacttactgatttaagatcttttgaattttagaaaaaacatatgaatcagatggaacaatctgaatgtgatatgctccatgatgctgtgtgttttggtagtaagaaaaaaaaattgggaggcttttcaaaggtggctttgttaggtagtaaaactgctggattcttcttcctcaaatatttggggctaacacttcacagagggtcacagtccatgatctgaccaactaagcttttaaaaatcaactattaccacccagaaaacagtcctacgtgatcatgtggccagggcatgcccgagtcctgcaagggtggcgggtggctgaggtcacaccaccactggagtggatgggcagtgccccacatggacagccattccccaggctatgaagtgacataggcctcccccacggtgcctgtgtacggagcctgatgacttcactgggagccttctggaatcctgcagagggtcaaggagcagggatgttggatgcccacctgtcaagagttcagatcaaagttgcgctgagagcgtcacaattttggttcagccttgacgcgtttgtccaacagctcattggctccctttgtatgatatcgtggtcttctcacatggtgcccagtcaccaatatttataatgaggtctaactacagcagtagtttttcatatatatctctaaaacattttgttatattgaaaaaagtaatagaaatcaagatgtgttgatgaaataaaatgtgtatctgagtgagaaaacaagtatggtgaggtcactttaatgtttcacagcgatctcagatctaggcctcaggtagaatggaagctgttctgcattcactgattaacgttgctaaactcttggtgaggcacgagctaccagccaattgctcttcatcacagctatctgtcttttagtgccacaaataaaagaaaatcaaatcttaaaaaat

SEQ ID NO: 440347 - DNA, 1619 bp, Homo sapiens
agttcccttgacctcgggcctctgcatcctgctagtcgtccttccctggcagcttttacgaggaagctggagcgtgagaaggtctgtgaggacagccctgatcacagcctcctttctgcaggtcaaaggaactgggaagggggttccaggagtactattgcaagagtggctgtgcacagagctctctagcaccagaagatctgcatcctgggcttattgacataccaaataactgtgaatctctcttccctgcaggtgcccttgctcgtgtgaatgaacagaggccagagaattgcagaaacccacctgtaatatgcccacaggcgtcactcaaggagtctgcatagccaggaacatcaagttttggtgttactttcttgtctacaggccaaaatgcgcacagttgattttcggtgtgttcctgtataacggcttgaaaggaaaggagaagatgctgtgtcgctgcgcagctcgtgtgccaaggaaatgtgttttgcctctgaatatcttaagttgctaataaacgattcttgttggcaggttaatgggactataaatgctggagcccagcactcacacttaattatatttatgggcaaagtaaaaagaatcatgccttagactgattttggacctttgagacttttaccacatacagatggatgaaactacttactgatttaagatcttttgaattttagaaaaaacatatgaatcagatggaacaatctgaatgtgatatgctccatgatgctgtgtgttttggtagtaagaaaaaaaaattgggaggcttttcaaaggtggctttgttaggtagtaaaactgctggattcttcttcctcaaatatttggggctaacacttcacagagggtcacagtccatgatctgaccaactaagcttttaaaaatcaactattaccacccagaaaacagtcctacgtgatcatgtggccagggcatgcccgagtcctgcaagggtggcgggtggctgaggtcacaccaccactggagtggatgggcagtgccccacatggacagccattccccaggctatgaagtgacataggcctcccccacggtgcctgtgtacggagcctgatgacttcactgggagccttctggaatcctgcagagggtcaaggagcagggatgttggatgcccacctgtcaagagttcagatcaaagttgcgctgagagcgtcacaattttggttcagccttgacgcgtttgtccaacagctcattggctccctttgtatgatatcgtggtcttctcacatggtgcccagtcaccaatatttataatgaggtctaactacagcagtagtttttcatatatatctctaaaacattttgttatattgaaaaaagtaatagaaatcaagatgtgttgatgaaataaaatgtgtatctgagtgagaaaacaagtatggtgaggtcactttaatgtttcacagcgatctcagatctaggcctcaggtagaatggaagctgttctgcattcactgattaacgttgctaaactcttggtgaggcacgagctaccagccaattgctcttcatcacagctatctgtcttttagtgccacaaataaaagaaaatcaaatcttaaaaaat

SEQ ID NO: 440348 - DNA, 1571 bp, Homo sapiens
ccagccccttccgtccgccgcgctccgccgctgtcctccgccggcccgcgtgggaggacgatgggtcagcgcggaaaaagtgaatgagggcggcagcggtggcggcggtagccagcgcctgactcggcgggcccggagcaccgcccgcgtcccggcccccggcaccatggacgcgccgcgcgcctcggcggccaagcccccgaccgggaggaagatgaaggctcgtgctcccccacctcctggaaaggctgccactctgcatgtgcacagtgaccagaagcccccccacgatggggccctcgggtcgcagcagaacttggttcgcatgaaggaggcgctgagggccagcaccatggacgtcaccgtggtcctgcctagcgggctggagaagaggagcgtgctcaatgggagccatgcgatgatggacctactggttgaactttgccttcagaaccacctgaatccatcccaccatgcccttgaaattcggtcttcagaaacccaacaacctttgagttttaagccaaatactttgattgggaccctgaatgtgcatactgtgtttctgaaagaaaaagttcctgaagagaaggttaagcctggtccccctaaggtgcctgagaaatctgtgcgtttggtcgtgaattacctgcggacacaaaaagctgttgtgcgtgtgagccctgaggttcctctccagaatattctcccagtcatttgtgcaaagtgtgaggtcagcccagagcacgtggttctcctcagggacaacattgccggagaggagctggagctgtccaagtccctgaacgagctcgggataaaggagctctacgcgtgggacaacagaagagaaacctttaggaaatcatcacttggcaatgatgagacagataaagagaagaaaaaatttctgggatttttcaaagttaataaaagaagcaatagtaaggctgagcagctcgtgctgtcgggtgcagacagcgatgaggacacctccagggctgccccaggaaggggtttgaacgggctgtttaacgacccccaactccccatccatgcactcacgttctcttacgctgggtccatccctctcgctgggcagcatctcaggggtgtccgtgaagtcggagatgaagaagcgccgagcccctcctcctccaggttcagggccacctgtgcaagacaaggcatcggaaaaggtatctcttgggtcacagattgatttacagaagaagaagcggcgagcgccagctccccctccaccacagccaccaccaccgagtcccctgatccccaaccgcactgaggataaggaggagaacaggaagagcacgatgggtgagtgaggctcggcctgccgtctgcatgcggggatgcttgctctgtcctggaatgtcagctctgatgtgaactcctgcagtggcctcatccataatgacattaacccaaaaaatattaatgctaaagaaagaagggctggaaagaaataattgcaagttcacttcatatcttactagcagtatttggtgggcattatgtgagcatttaggaggcgggggacggtggaaggg

SEQ ID NO: 440349 - DNA, 700 bp, Homo sapiens
tgcggtggctcaagcctgtaatcccagcactttgggaggcggaggcaggtggatcacgaggtcaagagatcgaggtcatcctggccagcatggtgacaccccgtctctactaaaaatacaaaaattacccaggtgtaatggcacacgcctgtagtcccagctactcgggaggctgaggcaggagaatcacttgaacccgggaggcagagcttgcagagagctgagatcgcgccactgcactccaggatattctaaaataaagtaacatcaagttgccgtaatatttatgacactatttaaattgtatcaatataattttaaacaaagtgtatttttgtgtatatttagcatattggtatacacgctgttctctatatatgttgttctttaataagagtctatcggccgggcgtaatggctcatgcctgtaatcccagcactttgggaggctgaggtgggcggatcaactgaggtcgggagttcgagaccagcctgacaacatggagaaaccctgtctctattaaaaatacaaaaaagttagccgggtgtggtggcgcatgcctgtaatcccagctgctcgggaggctgacgcaggagaatcgcttcaacctgggaggcagaggttgcagtgagccaagattgcaccattgcactccagcctgggcaacaagagcaaaattgtatctcaaaacaaaaaaaa

SEQ ID NO: 440350 - DNA, 756 bp, Homo sapiens
caacaactttaccttccacctgcaaaaatgttatgaacactttcattcccttcataactagaaaatgataatcccaaagcttcagataagccaaatatcagcacttcaaagatgcatctaaatctgagccagaagttcaagaacaaactttctaatgtttctgggttaaaatacagcaagttgtccttgtctacaaatgtagcaccacccagattgcagccctgggtctccctgtcagtccctatgttttaaaacagaagggtgtgaaatcaaaacagcttcaacctcgaaggcctccagggatattctaaaataaagtaacatcaagttgccgtaatatttatgacactatttaaattgtatcaatataattttaaacaaagtgtatttttgtgtatatttagcatattggtatacacgctgttctctatatatgttgttctttaataagagtctatcggccgggcgtaatggctcatgcctgtaatcccagcactttgggaggctgaggtgggcggatcaactgaggtcgggagttcgagaccagcctgacaacatggagaaaccctgtctctattaaaaatacaaaaaagttagccgggtgtggtggcgcatgcctgtaatcccagctgctcgggaggctgacgcaggagaatcgcttcaacctgggaggcagaggttgcagtgagccaagattgcaccattgcactccagcctgggcaacaagagcaaaattgtatctcaaaacaaaaaaaa

SEQ ID NO: 440351 - DNA, 1742 bp, Homo sapiens
cacagctctctttcccaaggagtaatcagagggtgagaacgtggagcctggtggacaggtgaaagcactgggatctttctgcccagaaaggggaaagttgcacatttatatcctagagggaagcgacacgagtgcttctccctgtgctgaggtacaggagccatgtggctagaaatcctcctcacttcagtgctgggctttgccatctactggttcatctcccgggacaaagaggaaactttgccacttgaagatgggtggtgggggccaggcacgaggtccgcagccagggaggacgacagcatccgccctttcaaggtggaaacgtcagatgaggagatccacgacttacaccagaggatcgataagttccgtttcaccccacctttggaggacagctgcttccactatggcttcaactccaactacctgaagaaagtcatctcctactggcggaatgaatttgactggaagaagcaggtggagattctcaacagacaccctcacttcaagactaagattgaagggctggacatccacttcatccacgtgaagcccccccagctgcccgcaggccataccccgaagcccttgctgatggtgcacggctggcccggctctttctacgagttttataagatcatcccactcctgactgaccccaagaaccatggcctgagcgatgagcacgtttttgaagtcatctgcccttccatccctggctatggcttctcagaggcatcctccaagaaggggttcaactcggtggccaccgccaggatcttttacaagctgatgctgcggctgggcttccaggaattctacattcaaggaggggactgggggtccctgatctgcactaatatggcccagctggtgcccagccacgtgaaaggcctgcacttgaacatggctttggttttaagcaacttctctaccctgaccctcctcctgggacagcgtttcgggaggtttcttggcctcactgagagggatgtggagctgctgtaccccgtcaaggagaaggtattctacagcctgatgagggagagcggctacatgcacatccagtgcaccaagcctgacaccgtaggctctgctctgaatgactctcctgtgggtctggctgcctatattctagagaagttttccacctggaccaatacggaattccgatacctggaggatggaggcctggaaaggaagttctccctggacgacctgctgaccaacgtcatgctctactggacaacaggcaccatcatctcctcccagcgcttctacaaggagaacctgggacagggctggatgacccagaagcatgagcggatgaaggtctatgtgcccactggcttctctgccttcccttttgagctattgcacacgcctgaaaagtgggtgaggttcaagtacccaaagctcatctcctattcctacatggttcgtgggggccactttgcggcctttgaggagccggagctgctcgcccaggacatccgcaagttcctgtcggtgctggagcggcaatgacccacccctctccccccgcctgccacctccccccacaagtgccctccaggcttttcttggggaagataccccttttctgaggaatgagtttgcctccgtcccctgcccatgctgggagcccacgctcaccccctcacccctccaagctcactccccaacccccaactccgtgtggtaagcaacatggctttgatgataaacgactttactct

SEQ ID NO: 440352 - DNA, 488 bp, Homo sapiens
tgcatgtatgtgttcctgcctagctctaaagatggacagatttgttgtgactgcaatatttttgcatttagtaaggttacaacgtataagtacatctcagtcacctataattgggttctgaatctctccaactttatctgactgtaagtcacattgtggaagaaggctgttctcatgacatacatccctctctggctggcgttttgcaaacatacctcttcaatcttagtcttgaagtgagggtatctgttgagaatctccacctgcttcttccagtcaaattcattccgccagtaggagatgactttcttcaggtagttggagttgaagccatagtggaagcagctgtcctccaaaggtggggtgaaacggaacttatcgatcctctggtgtaagtcgtggatctcctcatctgacgtttccaccttgaaagggcggatgctgtcgtcctccctggctgcggacctcaacggggagaacggggataa

SEQ ID NO: 440353 - DNA, 5734 bp, Homo sapiens
cctagtgctggtaccctcggggttaccgggcatcggaacacgccccgcgctgctgggtcccgccagacacgccgccgccgcaggaaagtctacagtttggtaccccaggactcgctggtcaggaaagccctgcaggacatgagtgttaggcccgacgcctggcccttggcagcttgggaggtggctggggctgcttttgcctttgccagagacagctccaactgaggacctctccaacgggcccatccacagtccttccttcccctagtgtctgggaagacaggcgcgatgatggactccccgttcctggagctgtggcagtccaaggcagtgtccatcagggagcagctgggactcggggaccggcccaacgactcctattgctacaactcggccaaaaacagcaccgtgctccagggggtcacctttggtggcatccccactgtcctgctcatagacgtcagctgcttcctgttcttaatcttggtgttttctattataagaagaagattctgggactatggccgcattgccctggtgtcagaagcagacagcgagtccagatttcagagattgtcatcgacttcctcctcaggtcaacaagactttgaaaatgagctgggatgctgtccctggctgactgccatcttccgtctgcatgatgaccagatcctggaatggtgtggggaggacgccatccactacctgtccttccagaggcacatcatcttcctgttggtggtggtcagctttttgtccctgtgtgtcatcctgcctgtcaacctctcaggggatttgctggacaaagacccgtatagttttgggaggacaacaatagcaaacctacagactgacaatgacctcctttggctgcacaccatctttgctgtcatttacctcttcttcactgtgggtttcatgcggcaccacactcagtccattaagtacaaagaggagaacctggtgaggcggaccctgttcatcacaggactccccagagatgccaggaaggagactgtggagagccacttccgggacgcgtatcccacgtgtgaggtggttgatgtgcagctgtgctacaacgtggccaaactgatctacctgtgcaaggagaaaaagaagactgagaagagcctgacctattacacaaacctgcaggtgaagacaggccagcggaccctcatcaaccccaagccctgtggccagttttgctgctgtgaagtgctgggctgtgagtgggaagacgccatctcttactacacacggatgaaggacaggctgctggagaggatcacagaggaagaacgccacgtccaggaccagcccctgggaatggccttcgtcaccttccaggagaagtccatggccacctacatcctgaaagatttcaatgcctgcaagtgtcagagccttcagtgcaaaggtgagccccagccgtcctcccatagcagggagctctatacctccaagtggacagtcacctttgctgctgaccctgaggacatctgctggaagaacctctctatccagggcctccgctggtggctacagtggctgggcatcaacttcaccctcttcctggggctatttttcctgaccacaccctccatcatcctgtccaccatggacaagtttaatgtcaccaaacccatccatgcgctgaataacccgatcatcagccagttcttccccaccctcctgctctggtccttctcggccctgctcccctccattgtctactactctacactgctggagtctcactggaccaagtcgggggaaaaccagatcatgatgaccaaagtctacatattcttgatcttcatggtgctgatcctgccctccctgggtctcaccagtctagattttttcttccggtggctctttgacaaaacttcctcggaggcctccatcaggttggagtgcgtcttcctgcctgaccagggtgccttctttgtgaactatgtcatcgcctcggccttcatcggcaatggcatggagctgctgcggctgccaggtctcatcctctataccttccgcatgatcatggccaagacggctgctgaccgcaggaatgtcaagcagaaccaggccttccagtacgagtttggagccatgtatgcatggatgctgtgtgtcttcactgtcatcgtggcctacagcatcacttgtcccatcatcgcgccatttggcctcatctacatcctgctcaagcacatggtggaccggcacaacctctacttcgtctacctcccagccaagctggagaaggggatccactttgccgctgtgaaccaggccttggcagcccccatcctgtgcctcttctggctctacttcttttccttcctgcgcctgggtatgaaggcccccgccactctgttcaccttcctggtgctgctgctcaccatcctggtctgcctggctcacacctgctttggatgcttcaagcacctcagccctctgaactacaaaacagaagagcctgcaagtgacaaaggaagtgaggcagaggcccacatgcccccaccgttcacaccctacgtgcctcggattctgaacggcttggcctcggagaggacagcactgtctccgcagcagcagcagcagcagacctatggtgccatccacaacatcagcgggactatccctggacagtgcttggcgcagagcgccacgggcagtgtggctgctgccccccaggaggcctgaggctgggtctcactgctctgaaaagacacaaccagaatggcctggggctcaggcccttggctgagtgggaatgcgttgggactgcccagctgagctatcaggtgcccatcttttctggtcccagcagtggtgaggagagcacaggcaggcctcgcccctcccttgctcacccagtttcccctccggcacaagcttccagctctgcagctggggtgacatccccagtggtttgtcgccaagaccatgtggtggacttttcgccccccaaactgatgagtccgggagaatatatggagagagagatgtaacaaggggaaggcctcctcccttctgagcacacacacaaccgataaccaaagagatgctgcagtccaggtctgaggtcccgctggcatccagctccctgctccatggccagtccctccccagcccagcagtccctccaggctacatccaggagtaagctatggggaacaggttgggaggtggccagtgctcctgccagctgtgcacacatctctgtatcccgctagagttctgtgtttttgtatcatgttgtcagggacgctagctgggtcagggttaccccatagcaggcagggacaaggaccactcataatatgcccattggaccacagttaagatccagcctctctcacctcttcagggctgagtgcatgagtctgcacctccaggcaggctctgtgcagtactcaccccctccgtctgctccctccaaggtgtgggggtgggcagtgctcagggcctcctcggagccaaaggacagcatggtcggcacagaggaaggggtacctgggctgggtgcagggccatcccactgcccttgagctgtggctctggcaggaaggaggggcagcccatccctcttctccctcctggggattctggggaatgggatgcaacttaagacttctgcctgagaagcctcctccctgctgcctccagggggcaccaaggcacaagcctgtgcagtaggggcgggatgggggtgtggaagagcaggtccaggctcctagcacaactggcctggggccttggcacctctgtaggccctgcctgtgcctgtccgctggcctggggggcctgggcttatctgggccttctcactcagggactctcttgacgctgacttgcccccgcagtggtggccagtgctgcctctgctccaagctgcccctgcgctgggaggggtgggggcggtgccattggtctggtgcagcatagccctggccagtggcctcatccccagcaggcctcccgtgcctctgccagcaaggaggggccggccagctctgcttgcacagggggccccatgtggggtcagcgcacgctcatgtcactgagttccagccgcttttagagtaaagtcgtttatcatcaaagccatgttgcttaccacacggagttgggggttggggagtgagcttggaggggtgagggggtgagcgtgggctcccagcatgggcaggggacggaggcaaactcattcctcagaaaaggggtatcttccccaagaaaagcctggagggcacttgtggggggaggtggcaggcggggggagaggggtgggtcattgccgctccagcaccgacaggaacttgcggatgtcctgggcgagcagctccggctcctcaaaggccgcaaagtggcccccacgaaccatgtaggaataggagatgagctttgggtacttgaacctcacccacttttcaggcgtgtgcaatagctcaaaagggaaggcagagaagccagtgggcacatagaccttcatccgctcatgcttctgggtcatccagccctgtcccaggttctccttgtagaagcgctgggaggagatgatggtgcctgttgtccagtagagcatgacgttggtcagcaggtcgtccagggagaacttcctttccaggcctccatcctccaggtatcggaattccgtattggtccaggtggaaaacttctctagaatataggcagccagacccacaggagagtcattcagagcagagcctacggtgtcaggcttggtgcactggatgtgcatgtagccgctctccctcatcaggctgtagaataccttctccttgacggggtacagcagctccacatccctctcagtgaggccaagaaacctcccgaaacgctgtcccaggaggagggtcagggtagagaagttgcttaaaaccaaagccatgttcaagtgcaggcctttcacgtggctgggcaccagctgggccatattagtgcagatcagggacccccagtcccctccttgaatgtagaattcctggaagcccagccgcagcatcagcttgtaaaagatcctggcggtggccaccgagttgaaccccttcttggaggatgcctctgagaagccatagccagggatggaagggcagatgacttcaaaaacgtgctcatcgctcaggccatggttcttggggtcagtcaggagtgggatgatcttataaaactcgtagaaagagccgggccagccgtgcaccatcagcaagggcttcggggtatggcctgcgggcagctgggggggcttcacgtggatgaagtggatgtccagcccttcaatcttagtcttgaagtgagggtatctgttgagaatctccacctgcttcttccagtcaaattcattccgccagtaggagatgactttcttcaggtagttggagttgaagccatagtggaagcagctgtcctccaaaggtggggtgaaacggaacttatcgatcctctggtgtaagtcgtggatctcctcatctgacgtttccaccttgaaagggcggatgctgtcgtcctccctggctgcggacctcgtgcctggcccccaccacccatcttcaagtggcaaagtttcctctttgtcccgggagatgaaccagtagatggcaaagcccagcactgaagtgaggaggatttctagccacatggctcggtctcggctcgcaggctccggcggcggcaggcgcgcgatctctccggctcctggctc

SEQ ID NO: 440354 - DNA, 6180 bp, Homo sapiens
cctagtgctggtaccctcggggttaccgggcatcggaacacgccccgcgctgctgggtcccgccagacacgccgccgccgcaggaaagtctacagtttggtaccccaggactcgctggtcaggaaagccctgcaggacatgagtgttaggcccgacgcctggcccttggcagcttgggaggtggctggggctgcttttgcctttgccagagacagctccaactgaggacctctccaacgggcccatccacagtccttccttcccctagtgtctgggaagacaggcgcgatgatggactccccgttcctggagctgtggcagtccaaggcagtgtccatcagggagcagctgggactcggggaccggcccaacgactcctattgctacaactcggccaaaaacagcaccgtgctccagggggtcacctttggtggcatccccactgtcctgctcatagacgtcagctgcttcctgttcttaatcttggtgttttctattataagaagaagattctgggactatggccgcattgccctggtgtcagaagcagacagcgagtccagatttcagagattgtcatcgacttcctcctcaggtcaacaagactttgaaaatgagctgggatgctgtccctggctgactgccatcttccgtctgcatgatgaccagatcctggaatggtgtggggaggacgccatccactacctgtccttccagaggcacatcatcttcctgttggtggtggtcagctttttgtccctgtgtgtcatcctgcctgtcaacctctcaggggatttgctggacaaagacccgtatagttttgggaggacaacaatagcaaacctacagactgacaatgacctcctttggctgcacaccatctttgctgtcatttacctcttcttcactgtgggtttcatgcggcaccacactcagtccattaagtacaaagaggagaacctggtgaggcggaccctgttcatcacaggactccccagagatgccaggaaggagactgtggagagccacttccgggacgcgtatcccacgtgtgaggtggttgatgtgcagctgtgctacaacgtggccaaactgatctacctgtgcaaggagaaaaagaagactgagaagagcctgacctattacacaaacctgcaggtgaagacaggccagcggaccctcatcaaccccaagccctgtggccagttttgctgctgtgaagtgctgggctgtgagtgggaagacgccatctcttactacacacggatgaaggacaggctgctggagaggatcacagaggaagaacgccacgtccaggaccagcccctgggaatggccttcgtcaccttccaggagaagtccatggccacctacatcctgaaagatttcaatgcctgcaagtgtcagagccttcagtgcaaaggtgagccccagccgtcctcccatagcagggagctctatacctccaagtggacagtcacctttgctgctgaccctgaggacatctgctggaagaacctctctatccagggcctccgctggtggctacagtggctgggcatcaacttcaccctcttcctggggctatttttcctgaccacaccctccatcatcctgtccaccatggacaagtttaatgtcaccaaacccatccatgcgctgaataacccgatcatcagccagttcttccccaccctcctgctctggtccttctcggccctgctcccctccattgtctactactctacactgctggagtctcactggaccaagtcgggggaaaaccagatcatgatgaccaaagtctacatattcttgatcttcatggtgctgatcctgccctccctgggtctcaccagtctagattttttcttccggtggctctttgacaaaacttcctcggaggcctccatcaggttggagtgcgtcttcctgcctgaccagggtgccttctttgtgaactatgtcatcgcctcggccttcatcggcaatggcatggagctgctgcggctgccaggtctcatcctctataccttccgcatgatcatggccaagacggctgctgaccgcaggaatgtcaagcagaaccaggccttccagtacgagtttggagccatgtatgcatggatgctgtgtgtcttcactgtcatcgtggcctacagcatcacttgtcccatcatcgcgccatttggcctcatctacatcctgctcaagcacatggtggaccggcacaacctctacttcgtctacctcccagccaagctggagaaggggatccactttgccgctgtgaaccaggccttggcagcccccatcctgtgcctcttctggctctacttcttttccttcctgcgcctgggtatgaaggcccccgccactctgttcaccttcctggtgctgctgctcaccatcctggtctgcctggctcacacctgctttggatgcttcaagcacctcagccctctgaactacaaaacagaagagcctgcaagtgacaaaggaagtgaggcagaggcccacatgcccccaccgttcacaccctacgtgcctcggattctgaacggcttggcctcggagaggacagcactgtctccgcagcagcagcagcagcagacctatggtgccatccacaacatcagcgggactatccctggacagtgcttggcgcagagcgccacgggcagtgtggctgctgccccccaggaggcctgaggctgggtctcactgctctgaaaagacacaaccagaatggcctggggctcaggcccttggctgagtgggaatgcgttgggactgcccagctgagctatcaggtgcccatcttttctggtcccagcagtggtgaggagagcacaggcaggcctcgcccctcccttgctcacccagtttcccctccggcacaagcttccagctctgcagctggggtgacatccccagtggtttgtcgccaagaccatgtggtggacttttcgccccccaaactgatgagtccgggagaatatatggagagagagatgtaacaaggggaaggcctcctcccttctgagcacacacacaaccgataaccaaagagatgctgcagtccaggtctgaggtcccgctggcatccagctccctgctccatggccagtccctccccagcccagcagtccctccaggctacatccaggagtaagctatggggaacaggttgggaggtggccagtgctcctgccagctgtgcacacatctctgtatcccgctagagttctgtgtttttgtatcatgttgtcagggacgctagctgggtcagggttaccccatagcaggcagggacaaggaccactcataatatgcccattggaccacagttaagatccagcctctctcacctcttcagggctgagtgcatgagtctgcacctccaggcaggctctgtgcagtactcaccccctccgtctgctccctccaaggtgtgggggtgggcagtgctcagggcctcctcggagccaaaggacagcatggtcggcacagaggaaggggtacctgggctgggtgcagggccatcccactgcccttgagctgtggctctggcaggaaggaggggcagcccatccctcttctccctcctggggattctggggaatgggatgcaacttaagacttctgcctgagaagcctcctccctgctgcctccagggggcaccaaggcacaagcctgtgcagtaggggcgggatgggggtgtggaagagcaggtccaggctcctagcacaactggcctggggccttggcacctctgtaggccctgcctgtgcctgtccgctggcctggggggcctgggcttatctgggccttctcactcagggactctcttgacgctgacttgcccccgcagtggtggccagtgctgcctctgctccaagctgcccctgcgctgggaggggtgggggcggtgccattggtctggtgcagcatagccctggccagtggcctcatccccagcaggcctcccgtgcctctgccagcaaggaggggccggccagctctgcttgcacagggggccccatgtggggtcagcgcacgctcatgtcactgagttccagccgcttttagagtaaagtcgtttatcatcaaagccatgttgcttaccacacggagttgggggttggggagtgagcttggaggggtgagggggtgagcgtgggctcccagcatgggcaggggacggaggcaaactcattcctcagaaaaggggtatcttccccaagaaaagcctggagggcacttgtggggggaggtggcaggcggggggagaggggtgggtcattgccgctccagcaccgacaggaacttgcggatgtcctgggcgagcagctccggctcctcaaaggccgcaaagtggcccccacgaaccatgtaggaataggagatgagctttgggtacttgaacctcacccacttttcaggcgtgtgcaatagctcaaaagggaaggcagagaagccagtgggcacatagaccttcatccgctcatgcttctgggtcatccagccctgtcccaggttctccttgtagaagcgctgggaggagatgatggtgcctgttgtccagtagagcatgacgttggtcagcaggtcgtccagggagaacttcctttccaggcctccatcctccaggtatcggaattccgtattggtccaggtggaaaacttctctagaatataggcagccagacccacaggagagtcattcagagcagagcctacggtgtcaggcttggtgcactggatgtgcatgtagccgctctccctcatcaggctgtagaataccttctccttgacggggtacagcagctccacatccctctcagtgaggccaagaaacctcccgaaacgctgtcccaggaggagggtcagggtagagaagttgcttaaaaccaaagccatgttcaagtgcaggcctttcacgtggctgggcaccagctgggccatattagtgcagatcagggacccccagtcccctccttgaatgtagaattcctggaagcccagccgcagcatcagcttgtaaaagatcctggcggtggccaccgagttgaaccccttcttggaggatgcctctgagaagccatagccagggatggaagggcagatgacttcaaaaacgtgctcatcgctcaggccatggttcttggggtcagtcaggagtgggatgatcttataaaactcgtagaaagagccgggccagccgtgcaccatcagcaagggcttcggggtatggcctgcgggcagctgggggggcttcacgtggatgaagtggatgtccagcccttcaatcttagtcttgaagtgagggtatctgttgagaatctccacctgcttcttccagtcaaattcattccgccagtaggagatgactttcttcaggtagttggagttgaagccatagtggaagcagctgtcctccaaaggtggggtgaaacggaacttatcgatcctctggtgtaagtcgtggatctcctcatctgacgtttccaccttgaaagggcggatgctgtcgtcctccctggctgcggacctcgtgcctggcccccaccacccatcttcaagtggcaaagtttcctctttgtcccgggagatgaaccagtagatggcaaagcccagcactgaagtgaggaggatttctagccacatggctcacaaagcctgtttggtggtctcttcacacggacgcgcatgaaaatcagtgttccgacttgggtgacaaattaagtgcatttcaccgccgagcgagccacggccctggaagcagagctcgcccaggccaggggacgcggtgcgctctcggggtcgcgagcctccctccctgcggcgtccgcccacagtctgggacgcggaattccctgcgagaagtccgcggtcgcctgcaggctccttcccccagtaggcggcacgcgcagtctcctggccggggcaggagctgggggcggaccaactacaagtccctctgcacccctgcgggccgaccgcagccccgacccctcggcgccccggcccgccgcccaccccggcggccgagcccgcgcggagcccgaaccgcgtctgcgtccggggagtgcgggcccggccggccccgggcgcttacggtctcggctcgcaggctccggcggcggcaggcgcgcgatctctccggctcctggctc

SEQ ID NO: 440355 - DNA, 3449 bp, Homo sapiens
tgagaactgctctcttgtgcttccttctgtgatcatgagaactgtataactgtgctttctcttttgccctggctgctaggaaattctgcaggtgtcatattttcggtcttaatgtcctaaatggatgtcggtgtttcttcatatgtcctttatggccactgtctgtgtcctgttgggagaagggcaggaggggagggatgcagtgtggaagctcatgcctgtccaggccaagcacaaatccatttgctgacagccctacgtgcctcggattctgaacggcttggcctcggagaggacagcactgtctccgcagcagcagcagcagcagacctatggtgccatccacaacatcagcgggactatccctggacagtgcttggcgcagagcgccacgggcagtgtggctgctgccccccaggaggcctgaggctgggtctcactgctctgaaaagacacaaccagaatggcctggggctcaggcccttggctgagtgggaatgcgttgggactgcccagctgagctatcaggtgcccatcttttctggtcccagcagtggtgaggagagcacaggcaggcctcgcccctcccttgctcacccagtttcccctccggcacaagcttccagctctgcagctggggtgacatccccagtggtttgtcgccaagaccatgtggtggacttttcgccccccaaactgatgagtccgggagaatatatggagagagagatgtaacaaggggaaggcctcctcccttctgagcacacacacaaccgataaccaaagagatgctgcagtccaggtctgaggtcccgctggcatccagctccctgctccatggccagtccctccccagcccagcagtccctccaggctacatccaggagtaagctatggggaacaggttgggaggtggccagtgctcctgccagctgtgcacacatctctgtatcccgctagagttctgtgtttttgtatcatgttgtcagggacgctagctgggtcagggttaccccatagcaggcagggacaaggaccactcataatatgcccattggaccacagttaagatccagcctctctcacctcttcagggctgagtgcatgagtctgcacctccaggcaggctctgtgcagtactcaccccctccgtctgctccctccaaggtgtgggggtgggcagtgctcagggcctcctcggagccaaaggacagcatggtcggcacagaggaaggggtacctgggctgggtgcagggccatcccactgcccttgagctgtggctctggcaggaaggaggggcagcccatccctcttctccctcctggggattctggggaatgggatgcaacttaagacttctgcctgagaagcctcctccctgctgcctccagggggcaccaaggcacaagcctgtgcagtaggggcgggatgggggtgtggaagagcaggtccaggctcctagcacaactggcctggggccttggcacctctgtaggccctgcctgtgcctgtccgctggcctggggggcctgggcttatctgggccttctcactcagggactctcttgacgctgacttgcccccgcagtggtggccagtgctgcctctgctccaagctgcccctgcgctgggaggggtgggggcggtgccattggtctggtgcagcatagccctggccagtggcctcatccccagcaggcctcccgtgcctctgccagcaaggaggggccggccagctctgcttgcacagggggccccatgtggggtcagcgcacgctcatgtcactgagttccagccgcttttagagtaaagtcgtttatcatcaaagccatgttgcttaccacacggagttgggggttggggagtgagcttggaggggtgagggggtgagcgtgggctcccagcatgggcaggggacggaggcaaactcattcctcagaaaaggggtatcttccccaagaaaagcctggagggcacttgtggggggaggtggcaggcggggggagaggggtgggtcattgccgctccagcaccgacaggaacttgcggatgtcctgggcgagcagctccggctcctcaaaggccgcaaagtggcccccacgaaccatgtaggaataggagatgagctttgggtacttgaacctcacccacttttcaggcgtgtgcaatagctcaaaagggaaggcagagaagccagtgggcacatagaccttcatccgctcatgcttctgggtcatccagccctgtcccaggttctccttgtagaagcgctgggaggagatgatggtgcctgttgtccagtagagcatgacgttggtcagcaggtcgtccagggagaacttcctttccaggcctccatcctccaggtatcggaattccgtattggtccaggtggaaaacttctctagaatataggcagccagacccacaggagagtcattcagagcagagcctacggtgtcaggcttggtgcactggatgtgcatgtagccgctctccctcatcaggctgtagaataccttctccttgacggggtacagcagctccacatccctctcagtgaggccaagaaacctcccgaaacgctgtcccaggaggagggtcagggtagagaagttgcttaaaaccaaagccatgttcaagtgcaggcctttcacgtggctgggcaccagctgggccatattagtgcagatcagggacccccagtcccctccttgaatgtagaattcctggaagcccagccgcagcatcagcttgtaaaagatcctggcggtggccaccgagttgaaccccttcttggaggatgcctctgagaagccatagccagggatggaagggcagatgacttcaaaaacgtgctcatcgctcaggccatggttcttggggtcagtcaggagtgggatgatcttataaaactcgtagaaagagccgggccagccgtgcaccatcagcaagggcttcggggtatggcctgcgggcagctgggggggcttcacgtggatgaagtggatgtccagcccttcaatcttagtcttgaagtgagggtatctgttgagaatctccacctgcttcttccagtcaaattcattccgccagtaggagatgactttcttcaggtagttggagttgaagccatagtggaagcagctgtcctccaaaggtggggtgaaacggaacttatcgatcctctggtgtaagtcgtggatctcctcatctgacgtttccaccttgaaagggcggatgctgtcgtcctccctggctgcggacctcgtgcctggcccccaccacccatcttcaagtggcaaagtttcctctttgtcccgggagatgaaccagtagatggcaaagcccagcactgaagtgaggaggatttctagccacatggctcggtctcggctcgcaggctccggcggcggcaggcgcgcgatctctccggctcctggctc

SEQ ID NO: 440356 - DNA, 5692 bp, Homo sapiens
cctagtgctggtaccctcggggttaccgggcatcggaacacgccccgcgctgctgggtcccgccagacacgccgccgccgcaggaaagtctacagtttggtaccccaggactcgctggtcaggaaagccctgcaggacatgagtgttaggcccgacgcctggcccttggcagcttgggaggtggctggggctgcttttgcctttgccagagacagctccaactgaggacctctccaacgggcccatccacagtccttccttcccctagtgtctgggaagacaggcgcgatgatggactccccgttcctggagctgtggcagtccaaggcagtgtccatcagggagcagctgggactcggggaccggcccaacgactcctattgctacaactcggccaaaaacagcaccgtgctccagggggtcacctttggtggcatccccactgtcctgctcatagacgtcagctgcttcctgttcttaatcttggtgttttctattataagaagaagattctgggactatggccgcattgccctggtgtcagaagcagacagcgagtccagatttcagagattgtcatcgacttcctcctcaggtcaacaagactttgaaaatgagctgggatgctgtccctggctgactgccatcttccgtctgcatgatgaccagatcctggaatggtgtggggaggacgccatccactacctgtccttccagaggcacatcatcttcctgttggtggtggtcagctttttgtccctgtgtgtcatcctgcctgtcaacctctcaggggatttgctggacaaagacccgtatagttttgggaggacaacaatagcaaacctacagactgacaatgacctcctttggctgcacaccatctttgctgtcatttacctcttcttcactgtgggtttcatgcggcaccacactcagtccattaagtacaaagaggagaacctggtgaggcggaccctgttcatcacaggactccccagagatgccaggaaggagactgtggagagccacttccgggacgcgtatcccacgtgtgaggtggttgatgtgcagctgtgctacaacgtggccaaactgatctacctgtgcaaggagaaaaagaagactgagaagagcctgacctattacacaaacctgcaggtgaagacaggccagcggaccctcatcaaccccaagccctgtggccagttttgctgctgtgaagtgctgggctgtgagtgggaagacgccatctcttactacacacggatgaaggacaggctgctggagaggatcacagaggaagaacgccacgtccaggaccagcccctgggaatggccttcgtcaccttccaggagaagtccatggccacctacatcctgaaagatttcaatgcctgcaagtgtcagagccttcagtgcaaaggtgagccccagccgtcctcccatagcagggagctctatacctccaagtggacagtcacctttgctgctgaccctgaggacatctgctggaagaacctctctatccagggcctccgctggtggctacagtggctgggcatcaacttcaccctcttcctggggctatttttcctgaccacaccctccatcatcctgtccaccatggacaagtttaatgtcaccaaacccatccatgcgctgaataacccgatcatcagccagttcttccccaccctcctgctctggtccttctcggccctgctcccctccattgtctactactctacactgctggagtctcactggaccaagtcgggggaaaaccagatcatgatgaccaaagtctacatattcttgatcttcatggtgctgatcctgccctccctgggtctcaccagtctagattttttcttccggtggctctttgacaaaacttcctcggaggcctccatcaggttggagtgcgtcttcctgcctgaccagggtgccttctttgtgaactatgtcatcgcctcggccttcatcggcaatggcatggagctgctgcggctgccaggtctcatcctctataccttccgcatgatcatggccaagacggctgctgaccgcaggaatgtcaagcagaaccaggccttccagtacgagtttggagccatgtatgcatggatgctgtgtgtcttcactgtcatcgtggcctacagcatcacttgtcccatcatcgcgccatttggcctcatctacatcctgctcaagcacatggtggaccggcacaacctctacttcgtctacctcccagccaagctggagaaggggatccactttgccgctgtgaaccaggccttggcagcccccatcctgtgcctcttctggctctacttcttttccttcctgcgcctgggtatgaaggcccccgccactctgttcaccttcctggtgctgctgctcaccatcctggtctgcctggctcacacctgctttggatgcttcaagcacctcagccctctgaactacaaaacagaagagcctgcaagtgacaaaggaagtgaggcagaggcccacatgcccccaccgttcacaccctacgtgcctcggattctgaacggcttggcctcggagaggacagcactgtctccgcagcagcagcagcagcagacctatggtgccatccacaacatcagcgggactatccctggacagtgcttggcgcagagcgccacgggcagtgtggctgctgccccccaggaggcctgaggctgggtctcactgctctgaaaagacacaaccagaatggcctggggctcaggcccttggctgagtgggaatgcgttgggactgcccagctgagctatcaggtgcccatcttttctggtcccagcagtggtgaggagagcacaggcaggcctcgcccctcccttgctcacccagtttcccctccggcacaagcttccagctctgcagctggggtgacatccccagtggtttgtcgccaagaccatgtggtggacttttcgccccccaaactgatgagtccgggagaatatatggagagagagatgtaacaaggggaaggcctcctcccttctgagcacacacacaaccgataaccaaagagatgctgcagtccaggtctgaggtcccgctggcatccagctccctgctccatggccagtccctccccagcccagcagtccctccaggctacatccaggagtaagctatggggaacaggttgggaggtggccagtgctcctgccagctgtgcacacatctctgtatcccgctagagttctgtgtttttgtatcatgttgtcagggacgctagctgggtcagggttaccccatagcaggcagggacaaggaccactcataatatgcccattggaccacagttaagatccagcctctctcacctcttcagggctgagtgcatgagtctgcacctccaggcaggctctgtgcagtactcaccccctccgtctgctccctccaaggtgtgggggtgggcagtgctcagggcctcctcggagccaaaggacagcatggtcggcacagaggaaggggtacctgggctgggtgcagggccatcccactgcccttgagctgtggctctggcaggaaggaggggcagcccatccctcttctccctcctggggattctggggaatgggatgcaacttaagacttctgcctgagaagcctcctccctgctgcctccagggggcaccaaggcacaagcctgtgcagtaggggcgggatgggggtgtggaagagcaggtccaggctcctagcacaactggcctggggccttggcacctctgtaggccctgcctgtgcctgtccgctggcctggggggcctgggcttatctgggccttctcactcagggactctcttgacgctgacttgcccccgcagtggtggccagtgctgcctctgctccaagctgcccctgcgctgggaggggtgggggcggtgccattggtctggtgcagcatagccctggccagtggcctcatccccagcaggcctcccgtgcctctgccagcaaggaggggccggccagctctgcttgcacagggggccccatgtggggtcagcgcacgctcatgtcactgagttccagccgcttttagagtaaagtcgtttatcatcaaagccatgttgcttaccacacggagttgggggttggggagtgagcttggaggggtgagggggtgagcgtgggctcccagcatgggcaggggacggaggcaaactcattcctcagaaaaggggtatcttccccaagaaaagcctggagggcacttgtggggggaggtggcaggcggggggagaggggtgggtcattgccgctccagcaccgacaggaacttgcggatgtcctgggcgagcagctccggctcctcaaaggccgcaaagtggcccccacgaaccatgtaggaataggagatgagctttgggtacttgaacctcacccacttttcaggcgtgtgcaatagctcaaaagggaaggcagagaagccagtgggcacatagaccttcatccgctcatgcttctgggtcatccagccctgtcccaggttctccttgtagaagcgctgggaggagatgatggtgcctgttgtccagtagagcatgacgttggtcagcaggtcgtccagggagaacttcctttccaggcctccatcctccaggtatcggaattccgtattggtccaggtggaaaacttctctagaatataggcagccagacccacaggagagtcattcagagcagagcctacggtgtcaggcttggtgcactggatgtgcatgtagccgctctccctcatcaggctgtagaataccttctccttgacggggtacagcagctccacatccctctcagtgaggccaagaaacctcccgaaacgctgtcccaggaggagggtcagggtagagaagttgcttaaaaccaaagccatgttcaagtgcaggcctttcacgtggctgggcaccagctgggccatattagtgcagatcagggacccccagtcccctccttgaatgtagaattcctggaagcccagccgcagcatcagcttgtaaaagatcctggcggtggccaccgagttgaaccccttcttggaggatgcctctgagaagccatagccagggatggaagggcagatgacttcaaaaacgtgctcatcgctcaggccatggttcttggggtcagtcaggagtgggatgatcttataaaactcgtagaaagagccgggccagccgtgcaccatcagcaagggcttcggggtatggcctgcggcttcaatcttagtcttgaagtgagggtatctgttgagaatctccacctgcttcttccagtcaaattcattccgccagtaggagatgactttcttcaggtagttggagttgaagccatagtggaagcagctgtcctccaaaggtggggtgaaacggaacttatcgatcctctggtgtaagtcgtggatctcctcatctgacgtttccaccttgaaagggcggatgctgtcgtcctccctggctgcggacctcgtgcctggcccccaccacccatcttcaagtggcaaagtttcctctttgtcccgggagatgaaccagtagatggcaaagcccagcactgaagtgaggaggatttctagccacatggctcggtctcggctcgcaggctccggcggcggcaggcgcgcgatctctccggctcctggctc

SEQ ID NO: 440357 - DNA, 2075 bp, Homo sapiens
ggacgcgtgggtcgacccacgcgtcgcaaggcacaagcctgtgcagtaggggcgggatgggggtgtggaagagcaggtccaggctcctagcacaactggcctggggccttggcacctctgtaggccctgcctgtgcctgtccgctggcctggggggcctgggcttatctgggccttctcactcagggactctcttgacgctgacttgcccccgcagtggtggccagtgctgcctctgctccaagctgcccctgcgctgggaggggtgggggcggtgccattggtctggtgcagcatagccctggccagtggcctcatccccagcaggcctcccgtgcctctgccagcaaggaggggccggccagctctgcttgcacagggggccccatgtggggtcagcgcacgctcatgtcactgagttccagccgcttttagagtaaagtcgtttatcatcaaagccatgttgcttaccacacggagttgggggttggggagtgagcttggaggggtgagggggtgagcgtgggctcccagcatgggcaggggacggaggcaaactcattcctcagaaaaggggtatcttccccaagaaaagcctggagggcacttgtggggggaggtggcaggcggggggagaggggtgggtcattgccgctccagcaccgacaggaacttgcggatgtcctgggcgagcagctccggctcctcaaaggccgcaaagtggcccccacgaaccatgtaggaataggagatgagctttgggtacttgaacctcacccacttttcaggcgtgtgcaatagctcaaaagggaaggcagagaagccagtgggcacatagaccttcatccgctcatgcttctgggtcatccagccctgtcccaggttctccttgtagaagcgctgggaggagatgatggtgcctgttgtccagtagagcatgacgttggtcagcaggtcgtccagggagaacttcctttccaggcctccatcctccaggtatcggaattccgtattggtccaggtggaaaacttctctagaatataggcagccagacccacaggagagtcattcagagcagagcctacggtgtcaggcttggtgcactggatgtgcatgtagccgctctccctcatcaggctgtagaataccttctccttgacggggtacagcagctccacatccctctcagtgaggccaagaaacctcccgaaacgctgtcccaggaggagggtcagggtagagaagttgcttaaaaccaaagccatgttcaagtgcaggcctttcacgtggctgggcaccagctgggccatattagtgcagatcagggacccccagtcccctccttgaatgtagaattcctggaagcccagccgcagcatcagcttgtaaaagatcctggcggtggccaccgagttgaaccccttcttggaggatgcctctgagaagccatagccagggatggaagggcagatgacttcaaaaacgtgctcatcgctcaggccatggttcttggggtcagtcaggagtgggatgatcttataaaactcgtagaaagagccgggccagccgtgcaccatcagcaagggcttcggggtatggcctgcgggcagctgggggggcttcacgtggatgaagtggatgtccagcccttcaatcttagtcttgaagtgagggtatctgttgagaatctccacctgcttcttccagtcaaattcattccgccagtaggagatgactttcttcaggtagttggagttgaagccatagtggaagcagctgtcctccaaaggtggggtgaaacggaacttatcgatcctctggtgtaagtcgtggatctcctcatctgacgtttccaccttgaaagggcggatgctgtcgtcctccctggctgcggacctcgtgcctggcccccaccacccatcttcaagtggcaaagtttcctctttgtcccgggagatgaaccagtagatggcaaagcccagcactgaagtgaggaggatttctagccacatggctcggtctcggctcgcaggctccggcggcggcaggcgcgcgatctctccggctcctggctc

SEQ ID NO: 440358 - DNA, 2519 bp, Homo sapiens
  misc_feature (29)..(29): n is a, c, g, or t
agcgaactagccgaggagagccaggagcnggagagatcgcgcgcctgccgccgccggagcctgcgagccgagaccgagccatgtggctagaaatcctcctcacttcagtgctgggctttgccatctactggttcatctcccgggacaaagaggaaactttgccacttgaagatgggtggtgggggccaggcacgaggtccgcagccagggaggacgacagcatccgccctttcaaggtggaaacgtcagatgaggagatccacgacttacaccagaggatcgataagttccgtttcaccccacctttggaggacagctgcttccactatggcttcaactccaactacctgaagaaagtcatctcctactggcggaatgaatttgactggaagaagcaggtggagattctcaacagacaccctcacttcaagactaagattgaagggctggacatccacttcatccacgtgaagcccccccagctgcccgcaggccataccccgaagcccttgctgatggtgcacggctggcccggctctttctacgagttttataagatcatcccactcctgactgaccccaagaaccatggcctgagcgatgagcacgtttttgaagtcatctgcccttccatccctggctatggcttctcagaggcatcctccaagaaggggttcaactcggtggccaccgccaggatcttttacaagctgatgctgcggctgggcttccaggaattctacattcaaggaggggactgggggtccctgatctgcactaatatggcccagctggtgcccagccacgtgaaaggcctgcacttgaacatggctttggttttaagcaacttctctaccctgaccctcctcctgggacagcgtttcgggaggtttcttggcctcactgagagggatgtggagctgctgtaccccgtcaaggagaaggtattctacagcctgatgagggagagcggctacatgcacatccagtgcaccaagcctgacaccgtaggctctgctctgaatgactctcctgtgggtctggctgcctatattctagagaagttttccacctggaccaatacggaattccgatacctggaggatggaggcctggaaagggatgtcctgggcgagcagctccggctcctcaaaggccgcaaagtggcccccacgaaccatgtaggaataggagatgagctttgggtacttgaacctcacccacttttcaggcgtgtgcaatagctcaaaagggaaggcagagaagccagtgggcacatagaccttcatccgctcatgcttctgggtcatccagccctgtcccaggttctccttgtagaagcgctgggaggagatgatggtgcctgttgtccagtagagcatgacgttggtcagcaggtcgtccagggagaacttcctttccaggcctccatcctccaggtatcggaattccgtattggtccaggtggaaaacttctctagaatataggcagccagacccacaggagagtcattcagagcagagcctacggtgtcaggcttggtgcactggatgtgcatgtagccgctctccctcatcaggctgtagaataccttctccttgacggggtacagcagctccacatccctctcagtgaggccaagaaacctcccgaaacgctgtcccaggaggagggtcagggtagagaagttgcttaaaaccaaagccatgttcaagtgcaggcctttcacgtggctgggcaccagctgggccatattagtgcagatcagggacccccagtcccctccttgaatgtagaattcctggaagcccagccgcagcatcagcttgtaaaagatcctggcggtggccaccgagttgaaccccttcttggaggatgcctctgagaagccatagccagggatggaagggcagatgacttcaaaaacgtgctcatcgctcaggccatggttcttggggtcagtcaggagtgggatgatcttataaaactcgtagaaagagccgggccagccgtgcaccatcagcaagggcttcggggtatggcctgcgggcagctgggggggcttcacgtggatgaagtggatgtccagcccttcaatcttagtcttgaagtgagggtatctgttgagaatctccacctgcttcttccagtcaaattcattccgccagtaggagatgactttcttcaggtagttggagttgaagccatagtggaagcagctgtcctccaaaggtggggtgaaacggaacttatcgatcctctggtgtaagtcgtggatctcctcatctgacgtttccaccttgaaagggcggatgctgtcgtcctccctggctgcggacctcgtgcctggcccccaccacccatcttcaagtggcaaagtttcctctttgtcccgggagatgaaccagtagatggcaaagcccagcactgaagtgaggaggatttctagccacatggctcggtctcggctcgcaggctccggcggcggcaggcgcgcgatctctccggctcctggctc

SEQ ID NO: 440359 - DNA, 2601 bp, Homo sapiens
cacagctctctttcccaaggagtaatcagagggtgagaacgtggagcctggtggacaggtgaaagcactgggatctttctgcccagaaaggggaaagttgcacatttatatcctagagggaagcgacacgagtgcttctccctgtgctgaggtacaggagccatgtggctagaaatcctcctcacttcagtgctgggctttgccatctactggttcatctcccgggacaaagaggaaactttgccacttgaagatgggtggtgggggccaggcacgaggtccgcagccagggaggacgacagcatccgccctttcaaggtggaaacgtcagatgaggagatccacgacttacaccagaggatcgataagttccgtttcaccccacctttggaggacagctgcttccactatggcttcaactccaactacctgaagaaagtcatctcctactggcggaatgaatttgactggaagaagcaggtggagattctcaacagacaccctcacttcaagactaagattgaagggctggacatccacttcatccacgtgaagcccccccagctgcccgcaggccataccccgaagcccttgctgatggtgcacggctggcccggctctttctacgagttttataagatcatcccactcctgactgaccccaagaaccatggcctgagcgatgagcacgtttttgaagtcatctgcccttccatccctggctatggcttctcagaggcatcctccaagaaggggttcaactcggtggccaccgccaggatcttttacaagctgatgctgcggctgggcttccaggaattctacattcaaggaggggactgggggtccctgatctgcactaatatggcccagctggtgcccagccacgtgaaaggcctgcacttgaacatggctttggttttaagcaacttctctaccctgaccctcctcctgggacagcgtttcgggaggtttcttggcctcactgagagggatgtggagctgctgtaccccgtcaaggagaaggtattctacagcctgatgagggagagcggctacatgcacatccagtgcaccaagcctgacaccgtaggctctgctctgaatgactctcctgtgggtctggctgcctatattctagagaagttttccacctggaccaatacggaattccgatacctggaggatggaggcctggaaagggatgtcctgggcgagcagctccggctcctcaaaggccgcaaagtggcccccacgaaccatgtaggaataggagatgagctttgggtacttgaacctcacccacttttcaggcgtgtgcaatagctcaaaagggaaggcagagaagccagtgggcacatagaccttcatccgctcatgcttctgggtcatccagccctgtcccaggttctccttgtagaagcgctgggaggagatgatggtgcctgttgtccagtagagcatgacgttggtcagcaggtcgtccagggagaacttcctttccaggcctccatcctccaggtatcggaattccgtattggtccaggtggaaaacttctctagaatataggcagccagacccacaggagagtcattcagagcagagcctacggtgtcaggcttggtgcactggatgtgcatgtagccgctctccctcatcaggctgtagaataccttctccttgacggggtacagcagctccacatccctctcagtgaggccaagaaacctcccgaaacgctgtcccaggaggagggtcagggtagagaagttgcttaaaaccaaagccatgttcaagtgcaggcctttcacgtggctgggcaccagctgggccatattagtgcagatcagggacccccagtcccctccttgaatgtagaattcctggaagcccagccgcagcatcagcttgtaaaagatcctggcggtggccaccgagttgaaccccttcttggaggatgcctctgagaagccatagccagggatggaagggcagatgacttcaaaaacgtgctcatcgctcaggccatggttcttggggtcagtcaggagtgggatgatcttataaaactcgtagaaagagccgggccagccgtgcaccatcagcaagggcttcggggtatggcctgcgggcagctgggggggcttcacgtggatgaagtggatgtccagcccttcaatcttagtcttgaagtgagggtatctgttgagaatctccacctgcttcttccagtcaaattcattccgccagtaggagatgactttcttcaggtagttggagttgaagccatagtggaagcagctgtcctccaaaggtggggtgaaacggaacttatcgatcctctggtgtaagtcgtggatctcctcatctgacgtttccaccttgaaagggcggatgctgtcgtcctccctggctgcggacctcgtgcctggcccccaccacccatcttcaagtggcaaagtttcctctttgtcccgggagatgaaccagtagatggcaaagcccagcactgaagtgaggaggatttctagccacatggctcggtctcggctcgcaggctccggcggcggcaggcgcgcgatctctccggctcctggctc

SEQ ID NO: 440360 - DNA, 1917 bp, Homo sapiens
  misc_feature (36)..(36): n is a, c, g, or t
  misc_feature (50)..(50): n is a, c, g, or t
atgacccagaagcatgagcggatgaaggtctatgtncccactggcttctnagaggcatcctccaagaaggggttcaactcggtggccaccgccaggatcttttacaagctgatgctgcggctgggcttccaggaattctacattcaaggaggggactgggggtccctgatctgcactaatatggcccagctggtgcccagccacgtgaaaggcctgcacttgaacatggctttggttttaagcaacttctctaccctgaccctcctcctgggacagcgtttcgggaggtttcttggcctcactgagagggatgtggagctgctgtaccccgtcaaggagaaggtattctacagcctgatgagggagagcggctacatgcacatccagtgcaccaagcctgacaccgtaggctctgctctgaatgactctcctgtgggtctggctgcctatattctagagaagttttccacctggaccaatacggaattccgatacctggaggatggaggcctggaaagggatgtcctgggcgagcagctccggctcctcaaaggccgcaaagtggcccccacgaaccatgtaggaataggagatgagctttgggtacttgaacctcacccacttttcaggcgtgtgcaatagctcaaaagggaaggcagagaagccagtgggcacatagaccttcatccgctcatgcttctgggtcatccagccctgtcccaggttctccttgtagaagcgctgggaggagatgatggtgcctgttgtccagtagagcatgacgttggtcagcaggtcgtccagggagaacttcctttccaggcctccatcctccaggtatcggaattccgtattggtccaggtggaaaacttctctagaatataggcagccagacccacaggagagtcattcagagcagagcctacggtgtcaggcttggtgcactggatgtgcatgtagccgctctccctcatcaggctgtagaataccttctccttgacggggtacagcagctccacatccctctcagtgaggccaagaaacctcccgaaacgctgtcccaggaggagggtcagggtagagaagttgcttaaaaccaaagccatgttcaagtgcaggcctttcacgtggctgggcaccagctgggccatattagtgcagatcagggacccccagtcccctccttgaatgtagaattcctggaagcccagccgcagcatcagcttgtaaaagatcctggcggtggccaccgagttgaaccccttcttggaggatgcctctgagaagccatagccagggatggaagggcagatgacttcaaaaacgtgctcatcgctcaggccatggttcttggggtcagtcaggagtgggatgatcttataaaactcgtagaaagagccgggccagccgtgcaccatcagcaagggcttcggggtatggcctgcgggcagctgggggggcttcacgtggatgaagtggatgtccagcccttcaatcttagtcttgaagtgagggtatctgttgagaatctccacctgcttcttccagtcaaattcattccgccagtaggagatgactttcttcaggtagttggagttgaagccatagtggaagcagctgtcctccaaaggtggggtgaaacggaacttatcgatcctctggtgtaagtcgtggatctcctcatctgacgtttccaccttgaaagggcggatgctgtcgtcctccctggctgcggacctcgtgcctggcccccaccacccatcttcaagtggcaaagtttcctctttgtcccgggagatgaaccagtagatggcaaagcccagcactgaagtgaggaggatttctagccacatggctcggtctcggctcgcaggctccggcggcggcaggcgcgcgatctctccggctcctggctc

SEQ ID NO: 440361 - DNA, 1616 bp, Homo sapiens
aggcgcctgcgtagtacttaatgttgaaccagggactctagaaaagaattgtaaatcagaatgtcttgtgcaaaccacgtacagtatccctagggtagtaagccgccagattaggggtcatgttggcctcaaagttcggcagccattgagcaaaacccttgccaattgaaaatatatcttcccaaggatggtcaggacttcccatgtatgcgagtggcaggcggggggagaggggtgggtcattgccgctccagcaccgacaggaacttgcggatgtcctgggcgagcagctccggctcctcaaaggccgcaaagtggcccccaccaggcgtgtgcaatagctcaaaagggaaggcagagaagccagtgggcacatagaccttcatccgctcatgcttctgggtcatccagccctgtcccaggttctccttgtagaagcgctgggaggagatgatggtgcctgttgtccagtagagcatgacgttggtcagcaggtcgtccagggagaacttcctttccaggcctccatcctccaggtatcggaattccgtattggtccaggtggaaaacttctctagaatataggcagccagacccacaggagagtcattcagagcagagcctacggtgtcaggcttggtgcactggatgtgcatgtagccgctctccctcatcaggctgtagaataccttctccttgacggggtacagcagctccacatccctctcagtgaggccaagaaacctcccgaaacgctgtcccaggaggagggtcagggtagagaagttgcttaaaaccaaagccatgttcaagtgcaggcctttcacgtggctgggcaccagctgggccatattagtgcagatcagggacccccagtcccctccttgaatgtagaattcctggaagcccagccgcagcatcagcttgtaaaagatcctggcggtggccaccgagttgaaccccttcttggaggatgcctctgagaagccatagccagggatggaagggcagatgacttcaaaaacgtgctcatcgctcaggccatggttcttggggtcagtcaggagtgggatgatcttataaaactcgtagaaagagccgggccagccgtgcaccatcagcaagggcttcggggtatggcctgcgggcagctgggggggcttcacgtggatgaagtggatgtccagcccttcaatcttagtcttgaagtgagggtatctgttgagaatctccacctgcttcttccagtcaaattcattccgccagtaggagatgactttcttcaggtagttggagttgaagccatagtggaagcagctgtcctccaaaggtggggtgaaacggaacttatcgatcctctggtgtaagtcgtggatctcctcatctgacgtttccaccttgaaagggcggatgctgtcgtcctccctggctgcggacctcgtgcctggcccccaccacccatcttcaagtggcaaagtttcctctttgtcccgggagatgaaccagtagatggcaaagcccagcactgaagtgaggaggatttctagccacatggctcggtctcggctcgcaggctccggcggcggcaggcgcgcgatctctccggctcctggctc

SEQ ID NO: 440362 - DNA, 1837 bp, Homo sapiens
cccctctctgaataaggcagcatgacatttgcattcattcaacatctatgtactgggctctcccactgttcacccggcattgttctaggtgatggggctacagcatggccaagacagagtccctacccccaaggcaggattcagtctcattttactgtctttcccatccccagcactgtctggtcctgtgtgtcactgaaggaataaagggatgggccctggaaagggtgggtcagagctgaccttggtgaagcctgagtcaggccacagagctgggagtcaggcatgtagaggatacagcctctaaggctctgagagattaacagcctcctgtctttctgcgaccaccctcctggaacacgcagtcacgtgaccctgatgccaggctctccagggaatcaggaggaaaagcccaggtgctcttgacaataatgtggtgcctgctgccctgtgggctccctaatccccagaggggcctgttcagcaaaaggagcacaagcaggtgagcctgcatcctagtcttgaccatgcactgtgaggctgggaacaacccaccaggccacctcacccaaaaaatgcagctacgttggtcacagggtgaggatttgtaagaaagccaacaatagaatttgctgagtgccccatgcagagcaaccagacaaggggatgaagagggtgaggaggttggctgctgggaccagggtcatgactgcaggggcaaaccagggcctcacctttccaggcctccatcctccaggtatcggaattccgtattggtccaggtggaaaacttctctagaatataggcagccagacccacaggagagtcattcagagcagagcctacggtgtcaggcttggtgcactggatgtgcatgtagccgctctccctcatcaggctgtagaataccttctccttgacggggtacagcagctccacatccctctcagtgaggccaagaaacctcccgaaacgctgtcccaggaggagggtcagggtagagaagttgcttaaaaccaaagccatgttcaagtgcaggcctttcacgtggctgggcaccagctgggccatattagtgcagatcagggacccccagtcccctccttgaatgtagaattcctggaagcccagccgcagcatcagcttgtaaaagatcctggcggtggccaccgagttgaaccccttcttggaggatgcctctgagaagccatagccagggatggaagggcagatgacttcaaaaacgtgctcatcgctcaggccatggttcttggggtcagtcaggagtgggatgatcttataaaactcgtagaaagagccgggccagccgtgcaccatcagcaagggcttcggggtatggcctgcgggcagctgggggggcttcacgtggatgaagtggatgtccagcccttcaatcttagtcttgaagtgagggtatctgttgagaatctccacctgcttcttccagtcaaattcattccgccagtaggagatgactttcttcaggtagttggagttgaagccatagtggaagcagctgtcctccaaaggtggggtgaaacggaacttatcgatcctctggtgtaagtcgtggatctcctcatctgacgtttccaccttgaaagggcggatgctgtcgtcctccctggctgcggacctcgtgcctggcccccaccacccatcttcaagtggcaaagtttcctctttgtcccgggagatgaaccagtagatggcaaagcccagcactgaagtgaggaggatttctagccacatggctcggtctcggctcgcaggctccggcggcggcaggcgcgcgatctctccggctcctggctc

SEQ ID NO: 440363 - DNA, 2081 bp, Homo sapiens
  misc_feature (29)..(29): n is a, c, g, or t
  misc_feature (1945)..(1945): n is a, c, g, or t
agcgaactagccgaggagagccaggagcnggagagatcgcgcgcctgccgccgccggagcctgcgagccgagaccgagccatgtggctagaaatcctcctcacttcagtgctgggctttgccatctactggttcatctcccgggacaaagaggaaactttgccacttgaagatgggtggtgggggccaggcacgaggtccgcagccagggaggacgacagcatccgccctttcaaggtggaaacgtcagatgaggagatccacgacttacaccagaggatcgataagttccgtttcaccccacctttggaggacagctgcttccactatggcttcaactccaactacctgaagaaagtcatctcctactggcggaatgaatttgactggaagaagcaggtggagattctcaacagacaccctcacttcaagactaagattgaagggctggacatccacttcatccacgtgaagcccccccagctgcccgcaggccataccccgaagcccttgctgatggtgcacggctggcccggctctttctacgagttttataagatcatcccactcctgactgaccccaagaaccatggcctgagcgatgagcacgtttttgaagtcatctgcccttccatccctggctatggcttctcagaggcatcctccaagaaggggttcaactcggtggccaccgccaggatcttttacaagctgatgctgcggctgggcttccaggaattctacattcaaggaggggactgggggtccctgatctgcactaatatggcccagctggtgcccagccacgtgaaaggcctgcacttgaacatggctttggttttaagcaacttctctaccctgaccctcctcctgggacagcgtttcgggaggtttcttggcctcactgagagggatgtggagctgctgtaccccgtcaaggagaaggtattctacagcctgatgagggagagcggctacatgcacatccagtgcaccaagcctgacaccgtaggctctgctctgaatgactctcctgtgggtctggctgcctatattctagagaagttttccacctggaccaatacggaattccgatacctggaggatggaggcctggaaaggaagttctccctggacgacctgctgaccaacgtcatgctctactggacaacaggcaccatcatctcctcccagcgcttctacaaggagaacctgggacagggctggatgacccagaagcatgagcggatgaaggtctatgtgcccactggcttctctgccttcccttttgagctattgcacacgcctgaaaagtgggtgaggttcaagtacccaaagctcatctcctattcctacatggttcgtgggggccactttgcggcctttgaggagccggagctgctcgcccaggacatccgcaagttcctgtcggtgctggagcggcaatgacccacccctctccccccgcctgccacctccccccacaagtgccctccaggcttttcttggggaagataccccttttctgaggaatgagtttgcctccgtcccctgcccatgctgggagcccacgctcaccccctcacccctccaagctcactccccaacccccaactccgtgtggtaagcaacatggctttgatgataaacgactttactctaaaagcggctggaactcagtgacatgagcgtgcgctgaccccacatgggccccctgtgcaagcagagctggccggcccctccttgctggcagaggcacgggaggcctgctggggatgaggccactggccagggctatgctgcaccagaccaatggcaccgccccacccctcccagcgcaggggcagcttggagcagaggcagcactggccaccgctgcgggggcaagtcagcgtcaagagagtccctgagtgagaaggcccagataagcccaggccccccaggcnagcggacaggcacaggcaggggctacagaggtgccaaggccccaggccagttgtgctaggagcctggacctgctcttccacatcctcccattacccacccctactgcatcaggcttataccttggtgccccctgga

SEQ ID NO: 440364 - DNA, 5625 bp, Homo sapiens
cctagtgctggtaccctcggggttaccgggcatcggaacacgccccgcgctgctgggtcccgccagacacgccgccgccgcaggaaagtctacagtttggtaccccaggactcgctggtcaggaaagccctgcaggacatgagtgttaggcccgacgcctggcccttggcagcttgggaggtggctggggctgcttttgcctttgccagagacagctccaactgaggacctctccaacgggcccatccacagtccttccttcccctagtgtctgggaagacaggcgcgatgatggactccccgttcctggagctgtggcagtccaaggcagtgtccatcagggagcagctgggactcggggaccggcccaacgactcctattgctacaactcggccaaaaacagcaccgtgctccagggggtcacctttggtggcatccccactgtcctgctcatagacgtcagctgcttcctgttcttaatcttggtgttttctattataagaagaagattctgggactatggccgcattgccctggtgtcagaagcagacagcgagtccagatttcagagattgtcatcgacttcctcctcaggtcaacaagactttgaaaatgagctgggatgctgtccctggctgactgccatcttccgtctgcatgatgaccagatcctggaatggtgtggggaggacgccatccactacctgtccttccagaggcacatcatcttcctgttggtggtggtcagctttttgtccctgtgtgtcatcctgcctgtcaacctctcaggggatttgctggacaaagacccgtatagttttgggaggacaacaatagcaaacctacagactgacaatgacctcctttggctgcacaccatctttgctgtcatttacctcttcttcactgtgggtttcatgcggcaccacactcagtccattaagtacaaagaggagaacctggtgaggcggaccctgttcatcacaggactccccagagatgccaggaaggagactgtggagagccacttccgggacgcgtatcccacgtgtgaggtggttgatgtgcagctgtgctacaacgtggccaaactgatctacctgtgcaaggagaaaaagaagactgagaagagcctgacctattacacaaacctgcaggtgaagacaggccagcggaccctcatcaaccccaagccctgtggccagttttgctgctgtgaagtgctgggctgtgagtgggaagacgccatctcttactacacacggatgaaggacaggctgctggagaggatcacagaggaagaacgccacgtccaggaccagcccctgggaatggccttcgtcaccttccaggagaagtccatggccacctacatcctgaaagatttcaatgcctgcaagtgtcagagccttcagtgcaaaggtgagccccagccgtcctcccatagcagggagctctatacctccaagtggacagtcacctttgctgctgaccctgaggacatctgctggaagaacctctctatccagggcctccgctggtggctacagtggctgggcatcaacttcaccctcttcctggggctatttttcctgaccacaccctccatcatcctgtccaccatggacaagtttaatgtcaccaaacccatccatgcgctgaataacccgatcatcagccagttcttccccaccctcctgctctggtccttctcggccctgctcccctccattgtctactactctacactgctggagtctcactggaccaagtcgggggaaaaccagatcatgatgaccaaagtctacatattcttgatcttcatggtgctgatcctgccctccctgggtctcaccagtctagattttttcttccggtggctctttgacaaaacttcctcggaggcctccatcaggttggagtgcgtcttcctgcctgaccagggtgccttctttgtgaactatgtcatcgcctcggccttcatcggcaatggcatggagctgctgcggctgccaggtctcatcctctataccttccgcatgatcatggccaagacggctgctgaccgcaggaatgtcaagcagaaccaggccttccagtacgagtttggagccatgtatgcatggatgctgtgtgtcttcactgtcatcgtggcctacagcatcacttgtcccatcatcgcgccatttggcctcatctacatcctgctcaagcacatggtggaccggcacaacctctacttcgtctacctcccagccaagctggagaaggggatccactttgccgctgtgaaccaggccttggcagcccccatcctgtgcctcttctggctctacttcttttccttcctgcgcctgggtatgaaggcccccgccactctgttcaccttcctggtgctgctgctcaccatcctggtctgcctggctcacacctgctttggatgcttcaagcacctcagccctctgaactacaaaacagaagagcctgcaagtgacaaaggaagtgaggcagaggcccacatgcccccaccgttcacaccctacgtgcctcggattctgaacggcttggcctcggagaggacagcactgtctccgcagcagcagcagcagcagacctatggtgccatccacaacatcagcgggactatccctggacagtgcttggcgcagagcgccacgggcagtgtggctgctgccccccaggaggcctgaggctgggtctcactgctctgaaaagacacaaccagaatggcctggggctcaggcccttggctgagtgggaatgcgttgggactgcccagctgagctatcaggtgcccatcttttctggtcccagcagtggtgaggagagcacaggcaggcctcgcccctcccttgctcacccagtttcccctccggcacaagcttccagctctgcagctggggtgacatccccagtggtttgtcgccaagaccatgtggtggacttttcgccccccaaactgatgagtccgggagaatatatggagagagagatgtaacaaggggaaggcctcctcccttctgagcacacacacaaccgataaccaaagagatgctgcagtccaggtctgaggtcccgctggcatccagctccctgctccatggccagtccctccccagcccagcagtccctccaggctacatccaggagtaagctatggggaacaggttgggaggtggccagtgctcctgccagctgtgcacacatctctgtatcccgctagagttctgtgtttttgtatcatgttgtcagggacgctagctgggtcagggttaccccatagcaggcagggacaaggaccactcataatatgcccattggaccacagttaagatccagcctctctcacctcttcagggctgagtgcatgagtctgcacctccaggcaggctctgtgcagtactcaccccctccgtctgctccctccaaggtgtgggggtgggcagtgctcagggcctcctcggagccaaaggacagcatggtcggcacagaggaaggggtacctgggctgggtgcagggccatcccactgcccttgagctgtggctctggcaggaaggaggggcagcccatccctcttctccctcctggggattctggggaatgggatgcaacttaagacttctgcctgagaagcctcctccctgctgcctccagggggcaccaaggctctccagggaatcaggaggaaaagcccaggtgctcttgacaataatgtggtgcctgctgccctgtgggctccctaatccccagaggggcctgttcagcaaaaggagcacaagcaggtgagcctgcatcctagtcttgaccatgcactgtgaggctgggaacaacccaccaggccacctcacccaaaaaatgcagctacgttggtcacagggtgaggatttgtaagaaagccaacaatagaatttgctgagtgccccatgcagagcaaccagacaaggggatgaagagggtgaggaggttggctgctgggaccagggtcatgactgcaggggcaaaccagggcctcacctttccaggcctccatcctccaggtatcggaattccgtattggtccaggtggaaaacttctctagaatataggcagccagacccacaggagagtcattcagagcagagcctggcggggagcggggagcaagggagagactcaggcctggggaccagagagctggagcttcaggtgtgatgtgtggcactggccgcagagggcggggctgtgtgcaggaagccacgttcgagcacaggcctgccttaactcctgggtgctcacatgcctcgcttccttaactctgcctcggcatcctcatctgataaacagggacgataccttcccactgtctcccagggcctggcacactgcctgctcagcttccttcaaactgaagggcctacgcctctgcatttggtggggtcccaatgagaagtgctgtttttaaaaaggcggggtttttcagtctatgtgctctgattcatgaaaaatgagaagccacctaaaaaagtctaaaataggggatcagttacaaatattgatatactcataagccaaaatactgtacagtcattaaaaatggctggaacaggctgggggcattggctcatgcctgtaatcccagcactttgggagggcgagaaaggtggatcacctgcggtaaggagttcgagactatcctggctgacatggtgaaaccccatctctattaaaaatacaaaaaaattagcagggcatggtggtgcatgcctgtaatcccagctacttgggaggctgaggcaggcaaattgcttgaacccgggaggtggaggttgcagtgagccgagatcgtaccactgcactctagcctgggcaacagagcaagactctgtctcaaaaaaaaataaataaataaagctgggacaatggcataaatgaatctcacaaacataatattgagcaaaagaagccagactcaagggtatatactctgtgattctattcataggacttaaacaggcacaatcaaaaccatctcagtcagaagtcagagcgtggtacctgggagagaaccccgaggggcatctggagtgttggggccatgttggtgatatggacgtacttcacttgtgaaaattctcaccaaaatgttcacaagttcttttgaaggagaggggatgtggggagggagaagaggttatatgagattgtctttaatgttttgtactttttgcatttttaagctttttgacaacatgtattttataatcagagaaaaatgctgacttttataaagtgccattattatgattaaaaaaaaaaagctgcctcgtgtgtgtgggcatgggtttgccatgaaaactatgaagaactttgagatgggcaagacaattcctgggtgtcttctggacaagatctagggagttacctagcagaccttccggactgacgtgatgctacaggggtcccatctttccttgtcattgagctattttacagttctgtgaattgtaaagaactgagggtaatgcgaatgactcttgttcatagaggcaaatgaattttgtcccatggagatttaattgatattactctgtggatgttgacaagttttgtgtctgttagca

SEQ ID NO: 440365 - DNA, 6137 bp, Homo sapiens
  misc_feature (1133)..(1133): n is a, c, g, or t
  misc_feature (1144)..(1144): n is a, c, g, or t
cagtctcctgccatgcaaagaaggctcatagagttgctttggaagtggattctttgtacagcctggaagaagacgctgtgtaaatgacatgctttgggggctcccccggccacagaaggagaaaactggagccttctgatttcctgttgtttactttccagaggctggagttgggtaggaaacctgagcataccggcacactggcttgtgggtgacttctctccctgctgtatttcccggacaggtgaggcggaccctgttcatcacaggactccccagagatgccaggaaggagactgtggagagccacttccggtaagcaggtggggtgggaggggagctgagccccctccacgtaggaccaacacagccccacccgcagggcgagcaccttaggtgagcgccttctgtctctcgcttgggtatccaggtgagatctgagaaggacctggccctgccacacgtgtatggagtggctcctgtgtgccagccctgctggtgctgtgcagtgaatagcgccctggtggcctatcctcttcaagcagcctgtgcacagtgtccagagcacagaccagggtgtaggtgcgaataaacgtcttgagagcatacgggggaaaaaattgttgaccccggggttcttagcatcacctttgcagaataagagagacgtgagctgagcatttgtatggacccacagggctagggtctcacaggtggaaggacctcggggccatctctgcgtttgttcgtttgtccacccactgagcgggtgtctgttgagtgagcactgtgtctgagtccaggctctccctggtagaacctcctttccagcggctccctttgagtatctgcaccaccaattcctgcagatggaggctggaggaaagtctttcctgtgaggagattacgtgtgcagccagggatgcggggaaaggcccagagcatcaggaaaggtggcggtggggtgcaggggggcagggcaagcagtccgggaaggctcccaggaccccatgctggaggacctgaaggctgggctgaggagctgacattttattctttcttcattcctttttttgtaatcctatttttttagagacagggtcttgctctgttgcccaggctagagttcagtngtgcaataatngcttactgcggcctcaactcctggacttaaggcatcttcctgcctcagcctcccaagtagctgggactgcagacacatggcaccacacccagctaatttttaaattttttatggagatagagtcttgctatgttgcccaggctggtctcgaattgctgggctcaagtgatcctcctgccttgccctcccaaagtgctgggattacaggcgtgagccaccatgcccggcctctcttcattccttatcaatacagcagccactaatttgttgcatggactaggagttggctgcactttaactttgcactatttgtgaagaaagcacttgctaagcaaattgctagacaggatcgtaaactgaatgtttaaaatttgaaaaacttcttcagaaactctaagtattttagaaatatttactaatatgtaaatactcaataccagaatcatttttctgtatttccttgaagcaactcctcaaagttgcctgctaggcaacacctggaaacagtaattccacttaatgtataactttaaagagaaaaaaaaagtctcctcattctcatacaaacattgcatgactcatgctttcccctattttaagaggcctttttagtgaatgctgttgcagtccgtggggattgatgtatgaatttgcctttcaagcagggatgcttaaattgcagttttcttcctcacagctcttattgagaccagaaattgtcctactgtttaatttcatgattgatatacctatgggctgtctctctcactaaaatgtaagcacatccaggccctgttaccagcacctagaacagtgcctggcaggtggtaggtggggatttacatggttctggaatcccctggaattgtatgtataattttgcgtgtatggtgagggggtattgcatggtggccatgagcattgaccttggagccaggttgcctgtattcacctcctggctcagacactcactagctgtgtgatcttgggcacaagccacttacctctgtcggcctcagtttactcatctgtaaaatggggacaaaacctcacaggttatgatgaggattaaataaataaatatatgtaacaatacctggtcaatagtgagtatgtattttgctgggtgacagagtgagaccctgtctctaaacaaaacaaaacaaaacaaaagccctctttgtattaaatttcaaaatttcccccttttggaggataaaagacaaagagaagagaggtctccgctggcacagaaaccagcagcgagatcactctgccatcctttcccttggatccgtgggcacgtctcctgcttggggtgttttcttttccaacggtgtcttttgcctccttctctccctggccacagggacgcgtatcccacgtgtgaggtggttgatgtgcagctgtgctacaacgtggccaaactgatctacctgtgcaaggagaaaaagaagactgagaagagcctgacctattacacaaacctgcaggtgaagacaggccagcggaccctcatcaaccccaagccctgtggccagttttgctgctgtgaagtgctgggctgtgagtgggaagacgccatctcttactacacacggatgaaggacaggctgctggagaggatcacagaggaagaacgccacgtccaggaccagcccctgggaatggccttcgtcaccttccaggagaagtccatggccacctagtgagtgtaggcacatccagaccccttcttggctgactccctgttcccctccagataactcactgtccctctcgagtggagatggtactgctgacccaccatccctgggatttatctgtggtgtttccttctcctccctcagctacccacactcactttcagccagcccagcccatgtttgtgtaacaggcggtgggggtgtgggcagcagccacggagtgggtgattctggctgaccccctcgagctgatgtggcctggccccactgccgggctcttccctgctgccctggacccatcctgttggcttcatgtgccagccttgccccaggggagatggaggcaccctcctttcagacatctgctctgggccacagatccttctgtctgtggctccccaccttcccacaaatgcaaagctgtggggaagacccctggggcacgctggggcgctcactgcagtggggagcttgaccctggggagtggcttttcacagtggcccttggcatgggactctaggctctcatgcctgtggtctcagtgtcatctcgccttaggagcagcacagggtgggtcgggagaggggtgtggaaaggtgtccagccactgccccaggcattgtgacactaggaatggactcacacaggacttcctgcctccttgcagacactggggcaggaggaaaggggaaggcatctgaggcaggagtagaggggctgctgggctccttacgggaggttaaaggaggaaaagctgtgacctgttgagatggtgagggtcgaggtgggagccctgaggagggaagcttgggaacaggcaatgtgtaacgtggtctattgctacacttgggcctggggaaaaagtgacagaatgaaaagttgagccactggcctggcagtagcactgatcagagctccagcttaacaggcagggtggagggggatggccctatggaagagcagtgtgttgccctcagtttccttatctgtaaaatgggaatcgtactccctttgttgctggtggttgcgaggattaaacaaaattctccacacactgtgctagcgtggcacctcttacatagcgttactcataatacactaatcacaacaaagcaaaggtcctatgccactgcctcccactcctactcagtccccacttgccacatgtgtgctggtaacctgagtagcctgggcctggctgttgctacatttccttgcagcatcctgaaagatttcaatgcctgcaagtgtcagagccttcagtgcaaaggtgagccccagccgtcctcccatagcagggagctctatacctccaagtggacagtcacctttgctgctgaccctgaggacatctgctggtaagctcctagaccaaggagaggtgggagagaggcctgggttcctggtgggagctgcccatcacctggagcacaggtgtgacctggcagtcaatggagatctccacacatctgcaattctgtgggctgtgatgctgtgatgtgctcggtgtggcccaactggggtatctgcccagcccttccctccagtgttcctccctagcattcaagtgctacccagcagaaatataatgccagttctgcatctaattttaaatttcctaatagccatgctaaaaaagtaaaaagaaacagttgaaattaattttaataatgtatctcgcccaatatatccaaactgttatttcaacatgcaatttttgaaaaatgtgagatgttttacattctctttttcacacttagtcttcaatatctggtgtgtattttacacttctagcacctctcaattcacaccagccacatttaaaatgctcagtagccgcatgcagcttgtgcagccttacttaggtccagtgtcagcctggggccgtgctggggagctgagctgtgtccatgggggccctggtgagcctccagtgctgtgctgagggtaagggcacccagcgcaagccccagcgcagctgcctgtccagccctgcctcagctccttgcacagaatgagcttgaagtgctcccctctgctcggttctagttctgcctctgacagttttgctctttggttcacaaggcttcctaaactcaggattgctttgtgggtctgttctttgggatgagaggccagggcaggtgcaagctatgccttcactcctttgtccctgccttcctccttcctgtaccccagctacagccccgttgggaagaatgtgtcgttagtcacaaagcattgcagatgtgtctaagaaatgccacgctggggccgggcgtggtgctcacacctgtaatcccagcacttcgagaggctgaggcaggcggattgcctgagctcaggatttcaagaccaccctgggtaacatggtgaaaccctgtctctactaaaaatacaaaaaaattagctgggtgtggtggtacacgcctatagtcccagctacatgggaggctgagcaggagaattgcttgaacctgggaggcagaggttgcagtgagctgagatcacaccactgcactctaccctgggcaacagagccagactgggtcttgagaaaaaataaataaataaagctgggacaatggcataaatgaatctcacaaacataatattgagcaaaagaagccagactcaagggtatatactctgtgattctattcataggacttaaacaggcacaatcaaaaccatctcagtcagaagtcagagcgtggtacctgggagagaaccccgaggggcatctggagtgttggggccatgttggtgatatggacgtacttcacttgtgaaaattctcaccaaaatgttcacaagttcttttgaaggagaggggatgtggggagggagaagaggttatatgagattgtctttaatgttttgtactttttgcatttttaagctttttgacaacatgtattttataatcagagaaaaatgctgacttttataaagtgccattattatgattaaaaaaaaaaagctgcctcgtgtgtgtgggcatgggtttgccatgaaaactatgaagaactttgagatgggcaagacaattcctgggtgtcttctggacaagatctagggagttacctagcagaccttccggactgacgtgatgctacaggggtcccatctttccttgtcattgagctattttacagttctgtgaattgtaaagaactgagggtaatgcgaatgactcttgttcatagaggcaaatgaattttgtcccatggagatttaattgatattactctgtggatgttgacaagttttgtgtctgttagca

SEQ ID NO: 440366 - DNA, 3872 bp, Homo sapiens
cctagtgctggtaccctcggggttaccgggcatcggaacacgccccgcgctgctgggtcccgccagacacgccgccgccgcaggaaagtctacagtttggtaccccaggactcgctggtcaggaaagccctgcaggacatgagtgttaggcccgacgcctggcccttggcagcttgggaggtggctggggctgcttttgcctttgccagagacagctccaactgaggacctctccaacgggcccatccacagtccttccttcccctagtgtctgggaagacaggcgcgatgatggactccccgttcctggagctgtggcagtccaaggcagtgtccatcagggagcagctgggactcggggaccggcccaacgactcctattgctacaactcggccaaaaacagcaccgtgctccagggggtcacctttggtggcatccccactgtcctgctcatagacgtcagctgcttcctgttcttaatcttggtgttttctattataagaagaagattctgggactatggccgcattgccctggtgtcagaagcagacagcgagtccagatttcagagattgtcatcgacttcctcctcaggtcaacaagactttgaaaatgagctgggatgctgtccctggctgactgccatcttccgtctgcatgatgaccagatcctggaatggtgtggggaggacgccatccactacctgtccttccagaggcacatcatcttcctgttggtggtggtcagctttttgtccctgtgtgtcatcctgcctgtcaacctctcaggggatttgctggacaaagacccgtatagttttgggaggacaacaatagcaaacctacagactgacaatgacctcctttggctgcacaccatctttgctgtcatttacctcttcttcactgtgggtttcatgcggcaccacactcagtccattaagtacaaagaggagaacctggtgaggcggaccctgttcatcacaggactccccagagatgccaggaaggagactgtggagagccacttccgggacgcgtatcccacgtgtgaggtggttgatgtgcagctgtgctacaacgtggccaaactgatctacctgtgcaaggagaaaaagaagactgagaagagcctgacctattacacaaacctgcaggtgaagacaggccagcggaccctcatcaaccccaagccctgtggccagttttgctgctgtgaagtgctgggctgtgagtgggaagacgccatctcttactacacacggatgaaggacaggctgctggagaggatcacagaggaagaacgccacgtccaggaccagcccctgggaatggccttcgtcaccttccaggagaagtccatggccacctacatcctgaaagatttcaatgcctgcaagtgtcagagccttcagtgcaaaggtgagccccagccgtcctcccatagcagggagctctatacctccaagtggacagtcacctttgctgctgaccctgaggacatctgctggaagaacctctctatccagggcctccgctggtggctacagtggctgggcatcaacttcaccctcttcctggggctatttttcctgaccacaccctccatcatcctgtccaccatggacaagtttaatgtcaccaaacccatccatgcgctgaataacccgatcatcagccagttcttccccaccctcctgctctggtccttctcggccctgctcccctccattgtctactactctacactgctggagtctcactggaccaagtcgggggaaaaccagatcatgatgaccaaagtctacatattcttgatcttcatggtgctgatcctgccctccctgggtctcaccagtctagattttttcttccggtggctctttgacaaaacttcctcggaggcctccatcaggttggagtgcgtcttcctgcctgaccagggtgccttctttgtgaactatgtcatcgcctcggccttcatcggcaatggcatggagctgctgcggctgccaggtctcatcctctataccttccgcatgatcatggccaagacggctgctgaccgcaggaatgtcaagcagaaccaggccttccagtacgagtttggagccatgtatgcatggatgctgtgtgtcttcactgtcatcgtggcctacagcatcacttgtcccatcatcgcgccatttggcctcatctacatcctgctcaagcacatggtggaccggcacaacctctacttcgtctacctcccagccaagctggagaaggggatccactttgccgctgtgaaccaggccttggcagcccccatcctgtgcctcttctggctctacttcttttccttcctgcgcctgggtatgaaggcccccgccactctgttcaccttcctggtgctgctgctcaccatcctggtctgcctggctcacacctgctttggatgcttcaagcacctcagccctctgaactacaaaacagaagagcctgcaagtgacaaaggaagtgaggcagaggcccacatgcccccaccgttcacaccctacgtgcctcggattctgaacggcttggcctcggagaggacagcactgtctccgcagcagcagcagcagcagacctatggtgccatccacaacatcagcgggactatccctggacagtgcttggcgcagagcgccacgggcagtgtggctgctgccccccaggaggcctgaggctgggtctcactgctctgaaaagacacaaccagaatggcctggggctcaggcccttggctgagtgggaatgcgttgggactgcccagctgagctatcaggtgcccatcttttctggtcccagcagtggtgaggagagcacaggcaggcctcgcccctcccttgctcacccagtttcccctccggcacaagcttccagctctgcagctggggtgacatccccagtggtttgtcgccaagaccatgtggtggacttttcgccccccaaactgatgagtccgggagaatatatggagagagagatgtaacaaggggaaggcctcctcccttctgagcacacacacaaccgataaccaaagagatgctgcagtccaggtctgaggtcccgctggcatccagctccctgctccatggccagtccctccccagcccagcagtccctccaggctacatccaggagtaagctatggggaacaggttgggaggtggccagtgctcctgccagctgtgcacacatctctgtatcccgctagagttctgtgtttttgtatcatgttgtcagggacgctagctgggtcagggttaccccatagcaggcagggacaaggaccactcataatatgcccattggaccacagttaagatccagcctctctcacctcttcagggctgagtgcatgagtctgcacctccaggcaggctctgtgcagtactcaccccctccgtctgctccctccaaggtgtgggggtgggcagtgctcagggcctcctcggagccaaaggacagcatggtcggcacagaggaaggggtacctgggctgggtgcagggccatcccactgcccttgagctgtggctctggcaggaaggaggggcagcccatccctcttctccctcctggggattctggggaatgggatgcaacttaagacttctgcctgagaagcctcctccctgctgcctccagggggcaccaaggcacaagcctgtgcagtaggggcgggatgggggtgtggaagaccaattctaggttctctacatcacatgcgtatgtgacttgtctcctaatatatgtcatgtctgtgaccttcttctgattctttctggaccttccatatttgtgactcttttattactgatctttctttatgcatttcttgt

SEQ ID NO: 440367 - DNA, 3790 bp, Homo sapiens
cctagtgctggtaccctcggggttaccgggcatcggaacacgccccgcgctgctgggtcccgccagacacgccgccgccgcaggaaagtctacagtttggtaccccaggactcgctggtcaggaaagccctgcaggacatgagtgttaggcccgacgcctggcccttggcagcttgggaggtggctggggctgcttttgcctttgccagagacagctccaactgaggacctctccaacgggcccatccacagtccttccttcccctagtgtctgggaagacaggcgcgatgatggactccccgttcctggagctgtggcagtccaaggcagtgtccatcagggagcagctgggactcggggaccggcccaacgactcctattgctacaactcggccaaaaacagcaccgtgctccagggggtcacctttggtggcatccccactgtcctgctcatagacgtcagctgcttcctgttcttaatcttggtgttttctattataagaagaagattctgggactatggccgcattgccctggtgtcagaagcagacagcgagtccagatttcagagattgtcatcgacttcctcctcaggtcaacaagactttgaaaatgagctgggatgctgtccctggctgactgccatcttccgtctgcatgatgaccagatcctggaatggtgtggggaggacgccatccactacctgtccttccagaggcacatcatcttcctgttggtggtggtcagctttttgtccctgtgtgtcatcctgcctgtcaacctctcaggggatttgctggacaaagacccgtatagttttgggaggacaacaatagcaaacctacagactgacaatgacctcctttggctgcacaccatctttgctgtcatttacctcttcttcactgtgggtttcatgcggcaccacactcagtccattaagtacaaagaggagaacctggtgaggcggaccctgttcatcacaggactccccagagatgccaggaaggagactgtggagagccacttccgggacgcgtatcccacgtgtgaggtggttgatgtgcagctgtgctacaacgtggccaaactgatctacctgtgcaaggagaaaaagaagactgagaagagcctgacctattacacaaacctgcaggtgaagacaggccagcggaccctcatcaaccccaagccctgtggccagttttgctgctgtgaagtgctgggctgtgagtgggaagacgccatctcttactacacacggatgaaggacaggctgctggagaggatcacagaggaagaacgccacgtccaggaccagcccctgggaatggccttcgtcaccttccaggagaagtccatggccacctacatcctgaaagatttcaatgcctgcaagtgtcagagccttcagtgcaaaggtgagccccagccgtcctcccatagcagggagctctatacctccaagtggacagtcacctttgctgctgaccctgaggacatctgctggaagaacctctctatccagggcctccgctggtggctacagtggctgggcatcaacttcaccctcttcctggggctatttttcctgaccacaccctccatcatcctgtccaccatggacaagtttaatgtcaccaaacccatccatgcgctgaataacccgatcatcagccagttcttccccaccctcctgctctggtccttctcggccctgctcccctccattgtctactactctacactgctggagtctcactggaccaagtcgggggaaaaccagatcatgatgaccaaagtctacatattcttgatcttcatggtgctgatcctgccctccctgggtctcaccagtctagattttttcttccggtggctctttgacaaaacttcctcggaggcctccatcaggttggagtgcgtcttcctgcctgaccagggtgccttctttgtgaactatgtcatcgcctcggccttcatcggcaatggcatggagctgctgcggctgccaggtctcatcctctataccttccgcatgatcatggccaagacggctgctgaccgcaggaatgtcaagcagaaccaggccttccagtacgagtttggagccatgtatgcatggatgctgtgtgtcttcactgtcatcgtggcctacagcatcacttgtcccatcatcgcgccatttggcctcatctacatcctgctcaagcacatggtggaccggcacaacctctacttcgtctacctcccagccaagctggagaaggggatccactttgccgctgtgaaccaggccttggcagcccccatcctgtgcctcttctggctctacttcttttccttcctgcgcctgggtatgaaggcccccgccactctgttcaccttcctggtgctgctgctcaccatcctggtctgcctggctcacacctgctttggatgcttcaagcacctcagccctctgaactacaaaacagaagagcctgcaagtgacaaaggaagtgaggcagaggcccacatgcccccaccgttcacaccctacgtgcctcggattctgaacggcttggcctcggagaggacagcactgtctccgcagcagcagcagcagcagacctatggtgccatccacaacatcagcgggactatccctggacagtgcttggcgcagagcgccacgggcagtgtggctgctgccccccaggaggcctgaggctgggtctcactgctctgaaaagacacaaccagaatggcctggggctcaggcccttggctgagtgggaatgcgttgggactgcccagctgagctatcaggtgcccatcttttctggtcccagcagtggtgaggagagcacaggcaggcctcgcccctcccttgctcacccagtttcccctccggcacaagcttccagctctgcagctggggtgacatccccagtggtttgtcgccaagaccatgtggtggacttttcgccccccaaactgatgagtccgggagaatatatggagagagagatgtaacaaggggaaggcctcctcccttctgagcacacacacaaccgataaccaaagagatgctgcagtccaggtctgaggtcccgctggcatccagctccctgctccatggccagtccctccccagcccagcagtccctccaggctacatccaggagacttaaacaggcacaatcaaaaccatctcagtcagaagtcagagcgtggtacctgggagagaaccccgaggggcatctggagtgttggggccatgttggtgatatggacgtacttcacttgtgaaaattctcaccaaaatgttcacaagttcttttgaaggagaggggatgtggggagggagaagaggttatatgagattgtctttaatgttttgtactttttgcatttttaagctttttgacaacatgtattttataatcagagaaaaatgctgacttttataaagtgccattattatgattaaaaaaaaaaagctgcctcgtgtgtgtgggcatgggtttgccatgaaaactatgaagaactttgagatgggcaagacaattcctgggtgtcttctggacaagatctagggagttacctagcagaccttccggactgacgtgatgctacaggggtcccatctttccttgtcattgagctattttacagttctgtgaattgtaaagaactgagggtaatgcgaatgactcttgttcatagaggcaaatgaattttgtcccatggagatttaattgatattactctgtggatgttgacaagttttgtgtctgttagca

SEQ ID NO: 440368 - DNA, 3440 bp, Homo sapiens
cctagtgctggtaccctcggggttaccgggcatcggaacacgccccgcgctgctgggtcccgccagacacgccgccgccgcaggaaagtctacagtttggtaccccaggactcgctggtcaggaaagccctgcaggacatgagtgttaggcccgacgcctggcccttggcagcttgggaggtggctggggctgcttttgcctttgccagagacagctccaactgaggacctctccaacgggcccatccacagtccttccttcccctagtgtctgggaagacaggcgcgatgatggactccccgttcctggagctgtggcagtccaaggcagtgtccatcagggagcagctgggactcggggaccggcccaacgactcctattgctacaactcggccaaaaacagcaccgtgctccagggggtcacctttggtggcatccccactgtcctgctcatagacgtcagctgcttcctgttcttaatcttggtgttttctattataagaagaagattctgggactatggccgcattgccctggtgtcagaagcagacagcgagtccagatttcagagattgtcatcgacttcctcctcaggtcaacaagactttgaaaatgagctgggatgctgtccctggctgactgccatcttccgtctgcatgatgaccagatcctggaatggtgtggggaggacgccatccactacctgtccttccagaggcacatcatcttcctgttggtggtggtcagctttttgtccctgtgtgtcatcctgcctgtcaacctctcaggggatttgctggacaaagacccgtatagttttgggaggacaacaatagcaaacctacagactgacaatgacctcctttggctgcacaccatctttgctgtcatttacctcttcttcactgtgggtttcatgcggcaccacactcagtccattaagtacaaagaggagaacctggtgaggcggaccctgttcatcacaggactccccagagatgccaggaaggagactgtggagagccacttccgggacgcgtatcccacgtgtgaggtggttgatgtgcagctgtgctacaacgtggccaaactgatctacctgtgcaaggagaaaaagaagactgagaagagcctgacctattacacaaacctgcaggtgaagacaggccagcggaccctcatcaaccccaagccctgtggccagttttgctgctgtgaagtgctgggctgtgagtgggaagacgccatctcttactacacacggatgaaggacaggctgctggagaggatcacagaggaagaacgccacgtccaggaccagcccctgggaatggccttcgtcaccttccaggagaagtccatggccacctacatcctgaaagatttcaatgcctgcaagtgtcagagccttcagtgcaaaggtgagccccagccgtcctcccatagcagggagctctatacctccaagtggacagtcacctttgctgctgaccctgaggacatctgctggaagaacctctctatccagggcctccgctggtggctacagtggctgggcatcaacttcaccctcttcctggggctatttttcctgaccacaccctccatcatcctgtccaccatggacaagtttaatgtcaccaaacccatccatgcgctgaataacccgatcatcagccagttcttccccaccctcctgctctggtccttctcggccctgctcccctccattgtctactactctacactgctggagtctcactggaccaagtcgggggaaaaccagatcatgatgaccaaagtctacatattcttgatcttcatggtgctgatcctgccctccctgggtctcaccagtctagattttttcttccggtggctctttgacaaaacttcctcggaggcctccatcaggttggagtgcgtcttcctgcctgaccagggtgccttctttgtgaactatgtcatcgcctcggccttcatcggcaatggcatggagctgctgcggctgccaggtctcatcctctataccttccgcatgatcatggccaagacggctgctgaccgcaggaatgtcaagcagaaccaggccttccagtacgagtttggagccatgtatgcatggatgctgtgtgtcttcactgtcatcgtggcctacagcatcacttgtcccatcatcgcgccatttggcctcatctacatcctgctcaagcacatggtggaccggcacaacctctacttcgtctacctcccagccaagctggagaaggggatccactttgccgctgtgaaccaggccttggcagcccccatcctgtgcctcttctggctctacttcttttccttcctgcgcctgggtatgaaggcccccgccactctgttcaccttcctggtgctgctgctcaccatcctggtctgcctggctcacacctgctttggatgcttcaagcacctcagccctctgaactacaaaacagaagagcctgcaagtgacaaaggaagtgaggcagaggcccacatgcccccaccgttcacaccctacgtgcctcggattctgaacggcttggcctcggagaggacagcactgtctccgcagcagcagcagcagcagacctatggtgccatccacaacatcagcgggactatccctggacagtgcttggcgcagagcgccacgggcagtgtggctgctgccccccaggaggcctgaggctgggtctcactgctctgaaaagacacaaccagaatggcctggggctcaggcccttggctgagtgggaatgcgttgggactgcccagctgagctatcaggtgcccatcttttctggtcccagcagtggtgaggagagcacaggcaggcctcgcccctcccttgctcacccagtttcccctccggcacaagcttccagctctgcagctggggtgacatccccagtggtttgtcgccaagaccatgtggtggacttttcgccccccaaactgatgagtccgggagaatatatggagagagagatgtaacaaggggaaggcctcctcccttctgagcacacacacaaccgataaccaaagagatgctgcagtccaggtctgaggtcccgctggcatccagctccctgctccatggccagtccctccccagcccagcagtccctccaggctacatccaggaaaactatgaagaactttgagatgggcaagacaattcctgggtgtcttctggacaagatctagggagttacctagcagaccttccggactgacgtgatgctacaggggtcccatctttccttgtcattgagctattttacagttctgtgaattgtaaagaactgagggtaatgcgaatgactcttgttcatagaggcaaatgaattttgtcccatggagatttaattgatattactctgtggatgttgacaagttttgtgtctgttagca

SEQ ID NO: 440369 - DNA, 6849 bp, Homo sapiens
  misc_feature (1852)..(1852): n is a, c, g, or t
  misc_feature (1863)..(1863): n is a, c, g, or t
cctagtgctggtaccctcggggttaccgggcatcggaacacgccccgcgctgctgggtcccgccagacacgccgccgccgcaggaaagtctacagtttggtaccccaggactcgctggtcaggaaagccctgcaggacatgagtgttaggcccgacgcctggcccttggcagcttgggaggtggctggggctgcttttgcctttgccagagacagctccaactgaggacctctccaacgggcccatccacagtccttccttcccctagtgtctgggaagacaggcgcgatgatggactccccgttcctggagctgtggcagtccaaggcagtgtccatcagggagcagctgggactcggggaccggcccaacgactcctattgctacaactcggccaaaaacagcaccgtgctccagggggtcacctttggtggcatccccactgtcctgctcatagacgtcagctgcttcctgttcttaatcttggtgttttctattataagaagaagattctgggactatggccgcattgccctggtgtcagaagcagacagcgagtccagatttcagagattgtcatcgacttcctcctcaggtcaacaagactttgaaaatgagctgggatgctgtccctggctgactgccatcttccgtctgcatgatgaccagatcctggaatggtgtggggaggacgccatccactacctgtccttccagaggcacatcatcttcctgttggtggtggtcagctttttgtccctgtgtgtcatcctgcctgtcaacctctcaggggatttgctggacaaagacccgtatagttttgggaggacaacaatagcaaacctacagactgacaatgacctcctttggctgcacaccatctttgctgtcatttacctcttcttcactgtgggtttcatgcggcaccacactcagtccattaagtacaaagaggagaacctggtgaggcggaccctgttcatcacaggactccccagagatgccaggaaggagactgtggagagccacttccggtaagcaggtggggtgggaggggagctgagccccctccacgtaggaccaacacagccccacccgcagggcgagcaccttaggtgagcgccttctgtctctcgcttgggtatccaggtgagatctgagaaggacctggccctgccacacgtgtatggagtggctcctgtgtgccagccctgctggtgctgtgcagtgaatagcgccctggtggcctatcctcttcaagcagcctgtgcacagtgtccagagcacagaccagggtgtaggtgcgaataaacgtcttgagagcatacgggggaaaaaattgttgaccccggggttcttagcatcacctttgcagaataagagagacgtgagctgagcatttgtatggacccacagggctagggtctcacaggtggaaggacctcggggccatctctgcgtttgttcgtttgtccacccactgagcgggtgtctgttgagtgagcactgtgtctgagtccaggctctccctggtagaacctcctttccagcggctccctttgagtatctgcaccaccaattcctgcagatggaggctggaggaaagtctttcctgtgaggagattacgtgtgcagccagggatgcggggaaaggcccagagcatcaggaaaggtggcggtggggtgcaggggggcagggcaagcagtccgggaaggctcccaggaccccatgctggaggacctgaaggctgggctgaggagctgacattttattctttcttcattcctttttttgtaatcctatttttttagagacagggtcttgctctgttgcccaggctagagttcagtngtgcaataatngcttactgcggcctcaactcctggacttaaggcatcttcctgcctcagcctcccaagtagctgggactgcagacacatggcaccacacccagctaatttttaaattttttatggagatagagtcttgctatgttgcccaggctggtctcgaattgctgggctcaagtgatcctcctgccttgccctcccaaagtgctgggattacaggcgtgagccaccatgcccggcctctcttcattccttatcaatacagcagccactaatttgttgcatggactaggagttggctgcactttaactttgcactatttgtgaagaaagcacttgctaagcaaattgctagacaggatcgtaaactgaatgtttaaaatttgaaaaacttcttcagaaactctaagtattttagaaatatttactaatatgtaaatactcaataccagaatcatttttctgtatttccttgaagcaactcctcaaagttgcctgctaggcaacacctggaaacagtaattccacttaatgtataactttaaagagaaaaaaaaagtctcctcattctcatacaaacattgcatgactcatgctttcccctattttaagaggcctttttagtgaatgctgttgcagtccgtggggattgatgtatgaatttgcctttcaagcagggatgcttaaattgcagttttcttcctcacagctcttattgagaccagaaattgtcctactgtttaatttcatgattgatatacctatgggctgtctctctcactaaaatgtaagcacatccaggccctgttaccagcacctagaacagtgcctggcaggtggtaggtggggatttacatggttctggaatcccctggaattgtatgtataattttgcgtgtatggtgagggggtattgcatggtggccatgagcattgaccttggagccaggttgcctgtattcacctcctggctcagacactcactagctgtgtgatcttgggcacaagccacttacctctgtcggcctcagtttactcatctgtaaaatggggacaaaacctcacaggttatgatgaggattaaataaataaatatatgtaacaatacctggtcaatagtgagtatgtattttgctgggtgacagagtgagaccctgtctctaaacaaaacaaaacaaaacaaaagccctctttgtattaaatttcaaaatttcccccttttggaggataaaagacaaagagaagagaggtctccgctggcacagaaaccagcagcgagatcactctgccatcctttcccttggatccgtgggcacgtctcctgcttggggtgttttcttttccaacggtgtcttttgcctccttctctccctggccacagggacgcgtatcccacgtgtgaggtggttgatgtgcagctgtgctacaacgtggccaaactgatctacctgtgcaaggagaaaaagaagactgagaagagcctgacctattacacaaacctgcaggtgaagacaggccagcggaccctcatcaaccccaagccctgtggccagttttgctgctgtgaagtgctgggctgtgagtgggaagacgccatctcttactacacacggatgaaggacaggctgctggagaggatcacagaggaagaacgccacgtccaggaccagcccctgggaatggccttcgtcaccttccaggagaagtccatggccacctagtgagtgtaggcacatccagaccccttcttggctgactccctgttcccctccagataactcactgtccctctcgagtggagatggtactgctgacccaccatccctgggatttatctgtggtgtttccttctcctccctcagctacccacactcactttcagccagcccagcccatgtttgtgtaacaggcggtgggggtgtgggcagcagccacggagtgggtgattctggctgaccccctcgagctgatgtggcctggccccactgccgggctcttccctgctgccctggacccatcctgttggcttcatgtgccagccttgccccaggggagatggaggcaccctcctttcagacatctgctctgggccacagatccttctgtctgtggctccccaccttcccacaaatgcaaagctgtggggaagacccctggggcacgctggggcgctcactgcagtggggagcttgaccctggggagtggcttttcacagtggcccttggcatgggactctaggctctcatgcctgtggtctcagtgtcatctcgccttaggagcagcacagggtgggtcgggagaggggtgtggaaaggtgtccagccactgccccaggcattgtgacactaggaatggactcacacaggacttcctgcctccttgcagacactggggcaggaggaaaggggaaggcatctgaggcaggagtagaggggctgctgggctccttacgggaggttaaaggaggaaaagctgtgacctgttgagatggtgagggtcgaggtgggagccctgaggagggaagcttgggaacaggcaatgtgtaacgtggtctattgctacacttgggcctggggaaaaagtgacagaatgaaaagttgagccactggcctggcagtagcactgatcagagctccagcttaacaggcagggtggagggggatggccctatggaagagcagtgtgttgccctcagtttccttatctgtaaaatgggaatcgtactccctttgttgctggtggttgcgaggattaaacaaaattctccacacactgtgctagcgtggcacctcttacatagcgttactcataatacactaatcacaacaaagcaaaggtcctatgccactgcctcccactcctactcagtccccacttgccacatgtgtgctggtaacctgagtagcctgggcctggctgttgctacatttccttgcagcatcctgaaagatttcaatgcctgcaagtgtcagagccttcagtgcaaaggtgagccccagccgtcctcccatagcagggagctctatacctccaagtggacagtcacctttgctgctgaccctgaggacatctgctggaagaacctctctatccagggcctccgctggtggctacagtggctgggcatcaacttcaccctcttcctggggctatttttcctgaccacaccctccatcatcctgtccaccatggacaagtttaatgtcaccaaacccatccatgcgctgaataacccgatcatcagccagttcttccccaccctcctgctctggtccttctcggccctgctcccctccattgtctactactctacactgctggagtctcactggaccaagtcgggggaaaaccagatcatgatgaccaaagtctacatattcttgatcttcatggtgctgatcctgccctccctgggtctcaccagtctagattttttcttccggtggctctttgacaaaacttcctcggaggcctccatcaggttggagtgcgtcttcctgcctgaccagggtgccttctttgtgaactatgtcatcgcctcggccttcatcggcaatggcatggagctgctgcggctgccaggtctcatcctctataccttccgcatgatcatggccaagacggctgctgaccgcaggaatgtcaagcagaaccaggccttccagtacgagtttggagccatgtatgcatggatgctgtgtgtcttcactgtcatcgtggcctacagcatcacttgtcccatcatcgcgccatttggcctcatctacatcctgctcaagcacatggtggaccggcacaacctctacttcgtctacctcccagccaagctggagaaggggatccactttgccgctgtgaaccaggccttggcagcccccatcctgtgcctcttctggctctacttcttttccttcctgcgcctgggtatgaaggcccccgccactctgttcaccttcctggtgctgctgctcaccatcctggtctgcctggctcacacctgctttggatgcttcaagcacctcagccctctgaactacaaaacagaagagcctgcaagtgacaaaggaagtgaggcagaggcccacatgcccccaccgttcacaccctacgtgcctcggattctgaacggcttggcctcggagaggacagcactgtctccgcagcagcagcagcagcagacctatggtgccatccacaacatcagcgggactatccctggacagtgcttggcgcagagcgccacgggcagtgtggctgctgccccccaggaggcctgaggctgggtctcactgctctgaaaagacacaaccagaatggcctggggctcaggcccttggctgagtgggaatgcgttgggactgcccagctgagctatcaggacttaaacaggcacaatcaaaaccatctcagtcagaagtcagagcgtggtacctgggagagaaccccgaggggcatctggagtgttggggccatgttggtgatatggacgtacttcacttgtgaaaattctcaccaaaatgttcacaagttcttttgaaggagaggggatgtggggagggagaagaggttatatgagattgtctttaatgttttgtactttttgcatttttaagctttttgacaacatgtattttataatcagagaaaaatgctgacttttataaagtgccattattatgattaaaaaaaaaaagctgcctcgtgtgtgtgggcatgggtttgccatgaaaactatgaagaactttgagatgggcaagacaattcctgggtgtcttctggacaagatctagggagttacctagcagaccttccggactgacgtgatgctacaggggtcccatctttccttgtcattgagctattttacagttctgtgaattgtaaagaactgagggtaatgcgaatgactcttgttcatagaggcaaatgaattttgtcccatggagatttaattgatattactctgtggatgttgacaagttttgtgtctgttagca

SEQ ID NO: 440370 - DNA, 426 bp, Homo sapiens
tcctgattctagctcttggggaaccctggggagcctccccagtagcattggcccttggggcccaggtgaagtcctttgcttggggccctaccgtgagcccacaacctccagggtttctgtgggagagggctgctcccctagacccagcaggtccttgagccattggcaaagaggagagaggctggggccacaggtggtgctggccgaggaaggaggagtagggtcgcacagaggagcactgatggatggagaaccagttctgggagtttggggagagatcaaggcaggagggagcccactgggcagaacctaaaggtccatatgggcagcatgcatacacaggtgtgtgctggagggtttccatccagacccctacactggaaaagggtggctcccatgtgatgcttggtgtctgtgatccttcag

SEQ ID NO: 440371 - DNA, 279 bp, Homo sapiens
gctgatggtgcacggctggcccggctctttctacgagttttataagatcatcccactcctgactgaccccaagaaccatggcctgagcgatgagcacgtttttgaagtcatctgcccttccatccctggctatggcttctcagaggcatcctccaagaagggtacggggctgctagaggttccataactgccccgtcctcgccaagggtgggcccggtgttcccaccaggctctccttccggcggggtgagcagggagttggcccgaggaagctgggaa

SEQ ID NO: 440372 - DNA, 277 bp, Homo sapiens
ggctgcagggtttgctgtgttttctggaaacagactttgctcttgtgctctgtccttcccatccctctcaacttggggtcctgaattttgctccaggacttacaccagaggatcgataagttccgtttcaccccacctttggaggacagctgcttccactatggcttcaactccaactacctgaagaaagtcatctcctactggcggaatgaatttgactggaagaagcaggtggagattctcaacagacaccctcacttcaagactaagattgaag

SEQ ID NO: 440373 - DNA, 502 bp, Homo sapiens
tccacaccctaaccccccagctgctcaggcagtgggcacatggcaggggcctcactgggggcacatagagcatttgggggactgcgagtgctcacctttgacttcctgcaggtcgggggaaaaccagatcatgatgaccaaagtctacatattcttgatcttcatggtgctgatcctgccctccctgggtctcaccaggtatatgccaccaccttctgctctaaattcagaataagagtcacatcaggagagcactgtccccaggagaatgcaaacggtttggcagcagaagcaaacctctaacaatatctaagcctgtcgcaaccactcggcgtgcagtagggctgggtcattgattcttctggcaatatgattgattgttcttctttaaaaaagaaaaaaacaccatattggtcaggctgttcttgagctcctgacctcaggtgatccacccgcctcggcctcccaaagtgctgggattacaggcgtgagactctgtctc

SEQ ID NO: 440374 - DNA, 629 bp, Homo sapiens
  misc_feature (24)..(24): n is a, c, g, or t
  misc_feature (493)..(493): n is a, c, g, or t
tactttaagttttagggtacatgntgacattgtgcaggttagttacatatgtatacgtgtgccacgctggtgtgctgcacccactaactcgtcatctagcattaggtgtatctcccaatgctaaccccctcacccctccaagctcactccccaacccccaactccgtgtggtaagcaacatggctttgatgataaacgactttactctaaaagcggctggaactcagtgacatgagcgtgcgctgaccccacatgggccccctgtgcaagcagagctggccggcccctccttgctggcagaggcacgggaggcctgctggggatgaggccactggccagggctatgctgcaccagaccaatggcaccgccccacccctcccagcgcaggggcagcttggagcagaggcagcactggccaccgctgcgggggcaagtcagcgtcaagagagtccctgagtgagaaggcccagataagcccaggccccccaggcnagcggacaggcacaggcaggggctacagaggtgccaaggccccaggccagttgtgctaggagcctggacctgctcttccacatcctcccattacccacccctactgcatcaggcttataccttggtgccccctgga

SEQ ID NO: 440375 - DNA, 5946 bp, Homo sapiens
cctagtgctggtaccctcggggttaccgggcatcggaacacgccccgcgctgctgggtcccgccagacacgccgccgccgcaggaaagtctacagtttggtaccccaggactcgctggtcaggaaagccctgcaggacatgagtgttaggcccgacgcctggcccttggcagcttgggaggtggctggggctgcttttgcctttgccagagacagctccaactgaggacctctccaacgggcccatccacagtccttccttcccctagtgtctgggaagacaggcgcgatgatggactccccgttcctggagctgtggcagtccaaggcagtgtccatcagggagcagctgggactcggggaccggcccaacgactcctattgctacaactcggccaaaaacagcaccgtgctccagggggtcacctttggtggcatccccactgtcctgctcatagacgtcagctgcttcctgttcttaatcttggtgttttctattataagaagaagattctgggactatggccgcattgccctggtgtcagaagcagacagcgagtccagatttcagagattgtcatcgacttcctcctcaggtcaacaagactttgaaaatgagctgggatgctgtccctggctgactgccatcttccgtctgcatgatgaccagatcctggaatggtgtggggaggacgccatccactacctgtccttccagaggcacatcatcttcctgttggtggtggtcagctttttgtccctgtgtgtcatcctgcctgtcaacctctcaggggatttgctggacaaagacccgtatagttttgggaggacaacaatagcaaacctacagactgacaatgacctcctttggctgcacaccatctttgctgtcatttacctcttcttcactgtgggtttcatgcggcaccacactcagtccattaagtacaaagaggagaacctggtgaggcggaccctgttcatcacaggactccccagagatgccaggaaggagactgtggagagccacttccgggacgcgtatcccacgtgtgaggtggttgatgtgcagctgtgctacaacgtggccaaactgatctacctgtgcaaggagaaaaagaagactgagaagagcctgacctattacacaaacctgcaggtgaagacaggccagcggaccctcatcaaccccaagccctgtggccagttttgctgctgtgaagtgctgggctgtgagtgggaagacgccatctcttactacacacggatgaaggacaggctgctggagaggatcacagaggaagaacgccacgtccaggaccagcccctgggaatggccttcgtcaccttccaggagaagtccatggccacctacatcctgaaagatttcaatgcctgcaagtgtcagagccttcagtgcaaaggtgagccccagccgtcctcccatagcagggagctctatacctccaagtggacagtcacctttgctgctgaccctgaggacatctgctggaagaacctctctatccagggcctccgctggtggctacagtggctgggcatcaacttcaccctcttcctggggctatttttcctgaccacaccctccatcatcctgtccaccatggacaagtttaatgtcaccaaacccatccatgcgctgaataacccgatcatcagccagttcttccccaccctcctgctctggtccttctcggccctgctcccctccattgtctactactctacactgctggagtctcactggaccaagtcgggggaaaaccagatcatgatgaccaaagtctacatattcttgatcttcatggtgctgatcctgccctccctgggtctcaccagtctagattttttcttccggtggctctttgacaaaacttcctcggaggcctccatcaggttggagtgcgtcttcctgcctgaccagggtgccttctttgtgaactatgtcatcgcctcggccttcatcggcaatggcatggagctgctgcggctgccaggtctcatcctctataccttccgcatgatcatggccaagacggctgctgaccgcaggaatgtcaagcagaaccaggccttccagtacgagtttggagccatgtatgcatggatgctgtgtgtcttcactgtcatcgtggcctacagcatcacttgtcccatcatcgcgccatttggcctcatctacatcctgctcaagcacatggtggaccggcacaacctctacttcgtctacctcccagccaagctggagaaggggatccactttgccgctgtgaaccaggccttggcagcccccatcctgtgcctcttctggctctacttcttttccttcctgcgcctgggtatgaaggcccccgccactctgttcaccttcctggtgctgctgctcaccatcctggtctgcctggctcacacctgctttggatgcttcaagcacctcagccctctgaactacaaaacagaagagcctgcaagtgacaaaggaagtgaggcagaggcccacatgcccccaccgttcacaccctacgtgcctcggattctgaacggcttggcctcggagaggacagcactgtctccgcagcagcagcagcagcagacctatggtgccatccacaacatcagcgggactatccctggacagtgcttggcgcagagcgccacgggcagtgtggctgctgccccccaggaggcctgaggctgggtctcactgctctgaaaagacacaaccagaatggcctggggctcaggcccttggctgagtgggaatgcgttgggactgcccagctgagctatcaggtgcccatcttttctggtcccagcagtggtgaggagagcacaggcaggcctcgcccctcccttgctcacccagtttcccctccggcacaagcttccagctctgcagctggggtgacatccccagtggtttgtcgccaagaccatgtggtggacttttcgccccccaaactgatgagtccgggagaatatatggagagagagatgtaacaaggggaaggcctcctcccttctgagcacacacacaaccgataaccaaagagatgctgcagtccaggtctgaggtcccgctggcatccagctccctgctccatggccagtccctccccagcccagcagtccctccaggctacatccaggagtaagctatggggaacaggttgggaggtggccagtgctcctgccagctgtgcacacatctctgtatcccgctagagttctgtgtttttgtatcatgttgtcagggacgctagctgggtcagggttaccccatagcaggcagggacaaggaccactcataatatgcccattggaccacagttaagatccagcctctctcacctcttcagggctgagtgcatgagtctgcacctccaggcaggctctgtgcagtactcaccccctccgtctgctccctccaaggtgtgggggtgggcagtgctcagggcctcctcggagccaaaggacagcatggtcggcacagaggaaggggtacctgggctgggtgcagggccatcccactgcccttgagctgtggctctggcaggaaggaggggcagcccatccctcttctccctcctggggattctggggaatgggatgcaacttaagacttctgcctgagaagcctcctccctgctgcctccagggggcaccaaggcacaagcctgtgcagtaggggcgggatgggggtgtggaagagcaggtccaggctcctagcacaactggcctggggccttggcacctctgtaggccctgcctgtgcctgtccgctggcctggggggcctgggcttatctgggccttctcactcagggactctcttgacgctgacttgcccccgcagtggtggccagtgctgcctctgctccaagctgcccctgcgctgggaggggtgggggcggtgccattggtctggtgcagcatagccctggccagtggcctcatccccagcaggcctcccgtgcctctgccagcaaggaggggccggccagctctgcttgcacagggggccccatgtggggtcagcgcacgctcatgtcactgagttccagccgcttttagagtaaagtcgtttatcatcaaagccatgttgcttaccacacggagttgggggttggggagtgagcttggaggggtgagggggtgagcgtgggctcccagcatgggcaggggacggaggcaaactcattcctcagaaaaggggtatcttccccaagaaaagcctggagggcacttgtggggggaggtggcaggcggggggagaggggtgggtcattgccgctccagcaccgacaggaacttgcggatgtcctgggcgagcagctccggctcctcaaaggccgcaaagtggcccccacgaaccatgtaggaataggagatgagctttgggtacttgaacctcacccacttttcaggcgtgtgcaatagctcaaaagggaaggcagagaagccagtgggcacatagaccttcatccgctcatgcttctgggtcatccagccctgtcccaggttctccttgtagaagcgctgggaggagatgatggtgcctgttgtccagtagagcatgacgttggtcagcaggtcgtccagggagaacttcctttccaggcctccatcctccaggtatcggaattccgtattggtccaggtggaaaacttctctagaatataggcagccagacccacaggagagtcattcagagcagagcctacggtgtcaggcttggtgcactggatgtgcatgtagccgctctccctcatcaggctgtagaataccttctccttgacggggtacagcagctccacatccctctcagtgaggccaagaaacctcccgaaacgctgtcccaggaggagggtcagggtagagaagttgcttaaaaccaaagccatgttcaagtgcaggcctttcacgtggctgggcaccagctgggccatattagtgcagatcagggacccccagtcccctccttgaatgtagaattcctggaagcccagccgcagcatcagcttgtaaaagatcctggcggtggccaccgagttgaaccccttcttggaggatgcctctgagaagccatagccagggatggaagggcagatgacttcaaaaacgtgctcatcgctcaggccatggttcttggggtcagtcaggagtgggatgatcttataaaactcgtagaaagagccgggccagccgtgcaccatcagcaagggcttcggggtatggcctgcgggcagctgggggggcttcacgtggatgaagtggatgtccagcccttcaatcttagtcttgaagtgagggtatctgttgagaatctccacctgcttcttccagtcaaattcattccgccagtaggagatgactttcttcaggtagttggagttgaagccatagtggaagcagctgtcctccaaaggtggggtgaaacggaacttatcgatcctctggtgtaagtcgtggatctcctcatctgacgtttccaccttgaaagggcggatgctgtcgtcctccctggctgcggacctcgtgcctggcccccaccacccatcttcaagtggcaaagtttcctctttgtcccgggagatgaaccagtagatggcaaagcccagcactgaagtgaggaggatttctagccacatggctcctgtacctcagcacagggagaagcactgctgtcgcttccctctaggatataaatgtgcaactttcccctttctgggcagaaagatcccagtgctttcacctgtccaccaggctccacgttctcaccctctgattactccttgggaaagagagctgtggagctctgcacctggcgatgctctaagggcctgtgagagaggcagggcaggctgcaggcactggcccccactccccacggccttctgacaattgcacagtcctgccaagtcag

SEQ ID NO: 440376 - DNA, 8185 bp, Homo sapiens
  misc_feature (1852)..(1852): n is a, c, g, or t
  misc_feature (1863)..(1863): n is a, c, g, or t
cctagtgctggtaccctcggggttaccgggcatcggaacacgccccgcgctgctgggtcccgccagacacgccgccgccgcaggaaagtctacagtttggtaccccaggactcgctggtcaggaaagccctgcaggacatgagtgttaggcccgacgcctggcccttggcagcttgggaggtggctggggctgcttttgcctttgccagagacagctccaactgaggacctctccaacgggcccatccacagtccttccttcccctagtgtctgggaagacaggcgcgatgatggactccccgttcctggagctgtggcagtccaaggcagtgtccatcagggagcagctgggactcggggaccggcccaacgactcctattgctacaactcggccaaaaacagcaccgtgctccagggggtcacctttggtggcatccccactgtcctgctcatagacgtcagctgcttcctgttcttaatcttggtgttttctattataagaagaagattctgggactatggccgcattgccctggtgtcagaagcagacagcgagtccagatttcagagattgtcatcgacttcctcctcaggtcaacaagactttgaaaatgagctgggatgctgtccctggctgactgccatcttccgtctgcatgatgaccagatcctggaatggtgtggggaggacgccatccactacctgtccttccagaggcacatcatcttcctgttggtggtggtcagctttttgtccctgtgtgtcatcctgcctgtcaacctctcaggggatttgctggacaaagacccgtatagttttgggaggacaacaatagcaaacctacagactgacaatgacctcctttggctgcacaccatctttgctgtcatttacctcttcttcactgtgggtttcatgcggcaccacactcagtccattaagtacaaagaggagaacctggtgaggcggaccctgttcatcacaggactccccagagatgccaggaaggagactgtggagagccacttccggtaagcaggtggggtgggaggggagctgagccccctccacgtaggaccaacacagccccacccgcagggcgagcaccttaggtgagcgccttctgtctctcgcttgggtatccaggtgagatctgagaaggacctggccctgccacacgtgtatggagtggctcctgtgtgccagccctgctggtgctgtgcagtgaatagcgccctggtggcctatcctcttcaagcagcctgtgcacagtgtccagagcacagaccagggtgtaggtgcgaataaacgtcttgagagcatacgggggaaaaaattgttgaccccggggttcttagcatcacctttgcagaataagagagacgtgagctgagcatttgtatggacccacagggctagggtctcacaggtggaaggacctcggggccatctctgcgtttgttcgtttgtccacccactgagcgggtgtctgttgagtgagcactgtgtctgagtccaggctctccctggtagaacctcctttccagcggctccctttgagtatctgcaccaccaattcctgcagatggaggctggaggaaagtctttcctgtgaggagattacgtgtgcagccagggatgcggggaaaggcccagagcatcaggaaaggtggcggtggggtgcaggggggcagggcaagcagtccgggaaggctcccaggaccccatgctggaggacctgaaggctgggctgaggagctgacattttattctttcttcattcctttttttgtaatcctatttttttagagacagggtcttgctctgttgcccaggctagagttcagtngtgcaataatngcttactgcggcctcaactcctggacttaaggcatcttcctgcctcagcctcccaagtagctgggactgcagacacatggcaccacacccagctaatttttaaattttttatggagatagagtcttgctatgttgcccaggctggtctcgaattgctgggctcaagtgatcctcctgccttgccctcccaaagtgctgggattacaggcgtgagccaccatgcccggcctctcttcattccttatcaatacagcagccactaatttgttgcatggactaggagttggctgcactttaactttgcactatttgtgaagaaagcacttgctaagcaaattgctagacaggatcgtaaactgaatgtttaaaatttgaaaaacttcttcagaaactctaagtattttagaaatatttactaatatgtaaatactcaataccagaatcatttttctgtatttccttgaagcaactcctcaaagttgcctgctaggcaacacctggaaacagtaattccacttaatgtataactttaaagagaaaaaaaaagtctcctcattctcatacaaacattgcatgactcatgctttcccctattttaagaggcctttttagtgaatgctgttgcagtccgtggggattgatgtatgaatttgcctttcaagcagggatgcttaaattgcagttttcttcctcacagctcttattgagaccagaaattgtcctactgtttaatttcatgattgatatacctatgggctgtctctctcactaaaatgtaagcacatccaggccctgttaccagcacctagaacagtgcctggcaggtggtaggtggggatttacatggttctggaatcccctggaattgtatgtataattttgcgtgtatggtgagggggtattgcatggtggccatgagcattgaccttggagccaggttgcctgtattcacctcctggctcagacactcactagctgtgtgatcttgggcacaagccacttacctctgtcggcctcagtttactcatctgtaaaatggggacaaaacctcacaggttatgatgaggattaaataaataaatatatgtaacaatacctggtcaatagtgagtatgtattttgctgggtgacagagtgagaccctgtctctaaacaaaacaaaacaaaacaaaagccctctttgtattaaatttcaaaatttcccccttttggaggataaaagacaaagagaagagaggtctccgctggcacagaaaccagcagcgagatcactctgccatcctttcccttggatccgtgggcacgtctcctgcttggggtgttttcttttccaacggtgtcttttgcctccttctctccctggccacagggacgcgtatcccacgtgtgaggtggttgatgtgcagctgtgctacaacgtggccaaactgatctacctgtgcaaggagaaaaagaagactgagaagagcctgacctattacacaaacctgcaggtgaagacaggccagcggaccctcatcaaccccaagccctgtggccagttttgctgctgtgaagtgctgggctgtgagtgggaagacgccatctcttactacacacggatgaaggacaggctgctggagaggatcacagaggaagaacgccacgtccaggaccagcccctgggaatggccttcgtcaccttccaggagaagtccatggccacctagtgagtgtaggcacatccagaccccttcttggctgactccctgttcccctccagataactcactgtccctctcgagtggagatggtactgctgacccaccatccctgggatttatctgtggtgtttccttctcctccctcagctacccacactcactttcagccagcccagcccatgtttgtgtaacaggcggtgggggtgtgggcagcagccacggagtgggtgattctggctgaccccctcgagctgatgtggcctggccccactgccgggctcttccctgctgccctggacccatcctgttggcttcatgtgccagccttgccccaggggagatggaggcaccctcctttcagacatctgctctgggccacagatccttctgtctgtggctccccaccttcccacaaatgcaaagctgtggggaagacccctggggcacgctggggcgctcactgcagtggggagcttgaccctggggagtggcttttcacagtggcccttggcatgggactctaggctctcatgcctgtggtctcagtgtcatctcgccttaggagcagcacagggtgggtcgggagaggggtgtggaaaggtgtccagccactgccccaggcattgtgacactaggaatggactcacacaggacttcctgcctccttgcagacactggggcaggaggaaaggggaaggcatctgaggcaggagtagaggggctgctgggctccttacgggaggttaaaggaggaaaagctgtgacctgttgagatggtgagggtcgaggtgggagccctgaggagggaagcttgggaacaggcaatgtgtaacgtggtctattgctacacttgggcctggggaaaaagtgacagaatgaaaagttgagccactggcctggcagtagcactgatcagagctccagcttaacaggcagggtggagggggatggccctatggaagagcagtgtgttgccctcagtttccttatctgtaaaatgggaatcgtactccctttgttgctggtggttgcgaggattaaacaaaattctccacacactgtgctagcgtggcacctcttacatagcgttactcataatacactaatcacaacaaagcaaaggtcctatgccactgcctcccactcctactcagtccccacttgccacatgtgtgctggtaacctgagtagcctgggcctggctgttgctacatttccttgcagcatcctgaaagatttcaatgcctgcaagtgtcagagccttcagtgcaaaggtgagccccagccgtcctcccatagcagggagctctatacctccaagtggacagtcacctttgctgctgaccctgaggacatctgctggaagaacctctctatccagggcctccgctggtggctacagtggctgggcatcaacttcaccctcttcctggggctatttttcctgaccacaccctccatcatcctgtccaccatggacaagtttaatgtcaccaaacccatccatgcgctgaataacatcagcgggactatccctggacagtgcttggcgcagagcgccacgggcagtgtggctgctgccccccaggaggcctgaggctgggtctcactgctctgaaaagacacaaccagaatggcctggggctcaggcccttggctgagtgggaatgcgttgggactgcccagctgagctatcaggtgcccatcttttctggtcccagcagtggtgaggagagcacaggcaggcctcgcccctcccttgctcacccagtttcccctccggcacaagcttccagctctgcagctggggtgacatccccagtggtttgtcgccaagaccatgtggtggacttttcgccccccaaactgatgagtccgggagaatatatggagagagagatgtaacaaggggaaggcctcctcccttctgagcacacacacaaccgataaccaaagagatgctgcagtccaggtctgaggtcccgctggcatccagctccctgctccatggccagtccctccccagcccagcagtccctccaggctacatccaggagtaagctatggggaacaggttgggaggtggccagtgctcctgccagctgtgcacacatctctgtatcccgctagagttctgtgtttttgtatcatgttgtcagggacgctagctgggtcagggttaccccatagcaggcagggacaaggaccactcataatatgcccattggaccacagttaagatccagcctctctcacctcttcagggctgagtgcatgagtctgcacctccaggcaggctctgtgcagtactcaccccctccgtctgctccctccaaggtgtgggggtgggcagtgctcagggcctcctcggagccaaaggacagcatggtcggcacagaggaaggggtacctgggctgggtgcagggccatcccactgcccttgagctgtggctctggcaggaaggaggggcagcccatccctcttctccctcctggggattctggggaatgggatgcaacttaagacttctgcctgagaagcctcctccctgctgcctccagggggcaccaaggcacaagcctgtgcagtaggggcgggatgggggtgtggaagagcaggtccaggctcctagcacaactggcctggggccttggcacctctgtaggccctgcctgtgcctgtccgctggcctggggggcctgggcttatctgggccttctcactcagggactctcttgacgctgacttgcccccgcagtggtggccagtgctgcctctgctccaagctgcccctgcgctgggaggggtgggggcggtgccattggtctggtgcagcatagccctggccagtggcctcatccccagcaggcctcccgtgcctctgccagcaaggaggggccggccagctctgcttgcacagggggccccatgtggggtcagcgcacgctcatgtcactgagttccagccgcttttagagtaaagtcgtttatcatcaaagccatgttgcttaccacacggagttgggggttggggagtgagcttggaggggtgagggggtgagcgtgggctcccagcatgggcaggggacggaggcaaactcattcctcagaaaaggggtatcttccccaagaaaagcctggagggcacttgtggggggaggtggcaggcggggggagaggggtgggtcattgccgctccagcaccgacaggaacttgcggatgtcctgggcgagcagctccggctcctcaaaggccgcaaagtggcccccacgaaccatgtaggaataggagatgagctttgggtacttgaacctcacccacttttcaggcgtgtgcaatagctcaaaagggaaggcagagaagccagtgggcacatagaccttcatccgctcatgcttctgggtcatccagccctgtcccaggttctccttgtagaagcgctgggaggagatgatggtgcctgttgtccagtagagcatgacgttggtcagcaggtcgtccagggagaacttcctttccaggcctccatcctccaggtatcggaattccgtattggtccaggtggaaaacttctctagaatataggcagccagacccacaggagagtcattcagagcagagcctacggtgtcaggcttggtgcactggatgtgcatgtagccgctctccctcatcaggctgtagaataccttctccttgacggggtacagcagctccacatccctctcagtgaggccaagaaacctcccgaaacgctgtcccaggaggagggtcagggtagagaagttgcttaaaaccaaagccatgttcaagtgcaggcctttcacgtggctgggcaccagctgggccatattagtgcagatcagggacccccagtcccctccttgaatgtagaattcctggaagcccagccgcagcatcagcttgtaaaagatcctggcggtggccaccgagttgaaccccttcttggaggatgcctctgagaagccatagccagggatggaagggcagatgacttcaaaaacgtgctcatcgctcaggccatggttcttggggtcagtcaggagtgggatgatcttataaaactcgtagaaagagccgggccagccgtgcaccatcagcaagggcttcggggtatggcctgcgggcagctgggggggcttcacgtggatgaagtggatgtccagcccttcaatcttagtcttgaagtgagggtatctgttgagaatctccacctgcttcttccagtcaaattcattccgccagtaggagatgactttcttcaggtagttggagttgaagccatagtggaagcagctgtcctccaaaggtggggtgaaacggaacttatcgatcctctggtgtaagtcgtggatctcctcatctgacgtttccaccttgaaagggcggatgctgtcgtcctccctggctgcggacctcgtgcctggcccccaccacccatcttcaagtggcaaagtttcctctttgtcccgggagatgaaccagtagatggcaaagcccagcactgaagtgaggaggatttctagccacatggctcggtctcggctcgcaggctccggcggcggcaggcgcgcgatctctccggctcctggctc

SEQ ID NO: 440377 - DNA, 5952 bp, Homo sapiens
cctagtgctggtaccctcggggttaccgggcatcggaacacgccccgcgctgctgggtcccgccagacacgccgccgccgcaggaaagtctacagtttggtaccccaggactcgctggtcaggaaagccctgcaggacatgagtgttaggcccgacgcctggcccttggcagcttgggaggtggctggggctgcttttgcctttgccagagacagctccaactgaggacctctccaacgggcccatccacagtccttccttcccctagtgtctgggaagacaggcgcgatgatggactccccgttcctggagctgtggcagtccaaggcagtgtccatcagggagcagctgggactcggggaccggcccaacgactcctattgctacaactcggccaaaaacagcaccgtgctccagggggtcacctttggtggcatccccactgtcctgctcatagacgtcagctgcttcctgttcttaatcttggtgttttctattataagaagaagattctgggactatggccgcattgccctggtgtcagaagcagacagcgagtccagatttcagagattgtcatcgacttcctcctcaggtcaacaagactttgaaaatgagctgggatgctgtccctggctgactgccatcttccgtctgcatgatgaccagatcctggaatggtgtggggaggacgccatccactacctgtccttccagaggcacatcatcttcctgttggtggtggtcagctttttgtccctgtgtgtcatcctgcctgtcaacctctcaggggatttgctggacaaagacccgtatagttttgggaggacaacaatagcaaacctacagactgacaatgacctcctttggctgcacaccatctttgctgtcatttacctcttcttcactgtgggtttcatgcggcaccacactcagtccattaagtacaaagaggagaacctggtgaggcggaccctgttcatcacaggactccccagagatgccaggaaggagactgtggagagccacttccgggacgcgtatcccacgtgtgaggtggttgatgtgcagctgtgctacaacgtggccaaactgatctacctgtgcaaggagaaaaagaagactgagaagagcctgacctattacacaaacctgcaggtgaagacaggccagcggaccctcatcaaccccaagccctgtggccagttttgctgctgtgaagtgctgggctgtgagtgggaagacgccatctcttactacacacggatgaaggacaggctgctggagaggatcacagaggaagaacgccacgtccaggaccagcccctgggaatggccttcgtcaccttccaggagaagtccatggccacctacatcctgaaagatttcaatgcctgcaagtgtcagagccttcagtgcaaaggtgagccccagccgtcctcccatagcagggagctctatacctccaagtggacagtcacctttgctgctgaccctgaggacatctgctggaagaacctctctatccagggcctccgctggtggctacagtggctgggcatcaacttcaccctcttcctggggctatttttcctgaccacaccctccatcatcctgtccaccatggacaagtttaatgtcaccaaacccatccatgcgctgaataacccgatcatcagccagttcttccccaccctcctgctctggtccttctcggccctgctcccctccattgtctactactctacactgctggagtctcactggaccaagtcgggggaaaaccagatcatgatgaccaaagtctacatattcttgatcttcatggtgctgatcctgccctccctgggtctcaccagtctagattttttcttccggtggctctttgacaaaacttcctcggaggcctccatcaggttggagtgcgtcttcctgcctgaccagggtgccttctttgtgaactatgtcatcgcctcggccttcatcggcaatggcatggagctgctgcggctgccaggtctcatcctctataccttccgcatgatcatggccaagacggctgctgaccgcaggaatgtcaagcagaaccaggccttccagtacgagtttggagccatgtatgcatggatgctgtgtgtcttcactgtcatcgtggcctacagcatcacttgtcccatcatcgcgccatttggcctcatctacatcctgctcaagcacatggtggaccggcacaacctctacttcgtctacctcccagccaagctggagaaggggatccactttgccgctgtgaaccaggccttggcagcccccatcctgtgcctcttctggctctacttcttttccttcctgcgcctgggtatgaaggcccccgccactctgttcaccttcctggtgctgctgctcaccatcctggtctgcctggctcacacctgctttggatgcttcaagcacctcagccctctgaactacaaaacagaagagcctgcaagtgacaaaggaagtgaggcagaggcccacatgcccccaccgttcacaccctacgtgcctcggattctgaacggcttggcctcggagaggacagcactgtctccgcagcagcagcagcagcagacctatggtgccatccacaacatcagcgggactatccctggacagtgcttggcgcagagcgccacgggcagtgtggctgctgccccccaggaggcctgaggctgggtctcactgctctgaaaagacacaaccagaatggcctggggctcaggcccttggctgagtgggaatgcgttgggactgcccagctgagctatcaggtgcccatcttttctggtcccagcagtggtgaggagagcacaggcaggcctcgcccctcccttgctcacccagtttcccctccggcacaagcttccagctctgcagctggggtgacatccccagtggtttgtcgccaagaccatgtggtggacttttcgccccccaaactgatgagtccgggagaatatatggagagagagatgtaacaaggggaaggcctcctcccttctgagcacacacacaaccgataaccaaagagatgctgcagtccaggtctgaggtcccgctggcatccagctccctgctccatggccagtccctccccagcccagcagtccctccaggctacatccaggagtaagctatggggaacaggttgggaggtggccagtgctcctgccagctgtgcacacatctctgtatcccgctagagttctgtgtttttgtatcatgttgtcagggacgctagctgggtcagggttaccccatagcaggcagggacaaggaccactcataatatgcccattggaccacagttaagatccagcctctctcacctcttcagggctgagtgcatgagtctgcacctccaggcaggctctgtgcagtactcaccccctccgtctgctccctccaaggtgtgggggtgggcagtgctcagggcctcctcggagccaaaggacagcatggtcggcacagaggaaggggtacctgggctgggtgcagggccatcccactgcccttgagctgtggctctggcaggaaggaggggcagcccatccctcttctccctcctggggattctggggaatgggatgcaacttaagacttctgcctgagaagcctcctccctgctgcctccagggggcaccaaggcacaagcctgtgcagtaggggcgggatgggggtgtggaagagcaggtccaggctcctagcacaactggcctggggccttggcacctctgtaggccctgcctgtgcctgtccgctggcctggggggcctgggcttatctgggccttctcactcagggactctcttgacgctgacttgcccccgcagtggtggccagtgctgcctctgctccaagctgcccctgcgctgggaggggtgggggcggtgccattggtctggtgcagcatagccctggccagtggcctcatccccagcaggcctcccgtgcctctgccagcaaggaggggccggccagctctgcttgcacagggggccccatgtggggtcagcgcacgctcatgtcactgagttccagccgcttttagagtaaagtcgtttatcatcaaagccatgttgcttaccacacggagttgggggttggggagtgagcttggaggggtgagggggtgagcgtgggctcccagcatgggcaggggacggaggcaaactcattcctcagaaaaggggtatcttccccaagaaaagcctggagggcacttgtggggggaggtggcaggcggggggagaggggtgggtcattgccgctccagcaccgacaggaacttgcggatgtcctgggcgagcagctccggctcctcaaaggccgcaaagtggcccccacgaaccatgtaggaataggagatgagctttgggtacttgaacctcacccacttttcaggcgtgtgcaatagctcaaaagggaaggcagagaagccagtgggcacatagaccttcatccgctcatgcttctgggtcatccagccctgtcccaggttctccttgtagaagcgctgggaggagatgatggtgcctgttgtccagtagagcatgacgttggtcagcaggtcgtccagggagaacttcctttccaggcctccatcctccaggtatcggaattccgtattggtccaggtggaaaacttctctagaatataggcagccagacccacaggagagtcattcagagcagagcctacggtgtcaggcttggtgcactggatgtgcatgtagccgctctccctcatcaggctgtagaataccttctccttgacggggtacagcagctccacatccctctcagtgaggccaagaaacctcccgaaacgctgtcccaggaggagggtcagggtagagaagttgcttaaaaccaaagccatgttcaagtgcaggcctttcacgtggctgggcaccagctgggccatattagtgcagatcagggacccccagtcccctccttgaatgtagaattcctggaagcccagccgcagcatcagcttgtaaaagatcctggcggtggccaccgagttgaacccttcaatcttagtcttgaagtgagggtatctgttgagaatctccacctgcttcttccagtcaaattcattccgccagtaggagatgactttcttcaggtagttggagttgaagccatagtggaagcagctgtcctccaaaggtggggtgaaacggaacttatcgatcctctggtgtaagtcgtggatctcctcatctgacgtttccaccttgaaagggcggatgctgtcgtcctccctggctgcggacctcgtgcctggcccccaccacccatcttcaagtggcaaagtttcctctttgtcccgggagatgaaccagtagatggcaaagcccagcactgaagtgaggaggatttctagccacatggctcacaaagcctgtttggtggtctcttcacacggacgcgcatgaaaatcagtgttccgacttgggtgacaaattaagtgcatttcaccgccgagcgagccacggccctggaagcagagctcgcccaggccaggggacgcggtgcgctctcggggtcgcgagcctccctccctgcggcgtccgcccacagtctgggacgcggaattccctgcgagaagtccgcggtcgcctgcaggctccttcccccagtaggcggcacgcgcagtctcctggccggggcaggagctgggggcggaccaactacaagtccctctgcacccctgcgggccgaccgcagccccgacccctcggcgccccggcccgccgcccaccccggcggccgagcccgcgcggagcccgaaccgcgtctgcgtccggggagtgcgggcccggccggccccgggcgcttacggtctcggctcgcaggctccggcggcggcaggcgcgcgatctctccggctcctggctc

SEQ ID NO: 440378 - DNA, 6218 bp, Homo sapiens
cctagtgctggtaccctcggggttaccgggcatcggaacacgccccgcgctgctgggtcccgccagacacgccgccgccgcaggaaagtctacagtttggtaccccaggactcgctggtcaggaaagccctgcaggacatgagtgttaggcccgacgcctggcccttggcagcttgggaggtggctggggctgcttttgcctttgccagagacagctccaactgaggacctctccaacgggcccatccacagtccttccttcccctagtgtctgggaagacaggcgcgatgatggactccccgttcctggagctgtggcagtccaaggcagtgtccatcagggagcagctgggactcggggaccggcccaacgactcctattgctacaactcggccaaaaacagcaccgtgctccagggggtcacctttggtggcatccccactgtcctgctcatagacgtcagctgcttcctgttcttaatcttggtgttttctattataagaagaagattctgggactatggccgcattgccctggtgtcagaagcagacagcgagtccagatttcagagattgtcatcgacttcctcctcaggtcaacaagactttgaaaatgagctgggatgctgtccctggctgactgccatcttccgtctgcatgatgaccagatcctggaatggtgtggggaggacgccatccactacctgtccttccagaggcacatcatcttcctgttggtggtggtcagctttttgtccctgtgtgtcatcctgcctgtcaacctctcaggggatttgctggacaaagacccgtatagttttgggaggacaacaatagcaaacctacagactgacaatgacctcctttggctgcacaccatctttgctgtcatttacctcttcttcactgtgggtttcatgcggcaccacactcagtccattaagtacaaagaggagaacctggtgaggcggaccctgttcatcacaggactccccagagatgccaggaaggagactgtggagagccacttccgggacgcgtatcccacgtgtgaggtggttgatgtgcagctgtgctacaacgtggccaaactgatctacctgtgcaaggagaaaaagaagactgagaagagcctgacctattacacaaacctgcaggtgaagacaggccagcggaccctcatcaaccccaagccctgtggccagttttgctgctgtgaagtgctgggctgtgagtgggaagacgccatctcttactacacacggatgaaggacaggctgctggagaggatcacagaggaagaacgccacgtccaggaccagcccctgggaatggccttcgtcaccttccaggagaagtccatggccacctacatcctgaaagatttcaatgcctgcaagtgtcagagccttcagtgcaaaggtgagccccagccgtcctcccatagcagggagctctatacctccaagtggacagtcacctttgctgctgaccctgaggacatctgctggaagaacctctctatccagggcctccgctggtggctacagtggctgggcatcaacttcaccctcttcctggggctatttttcctgaccacaccctccatcatcctgtccaccatggacaagtttaatgtcaccaaacccatccatgcgctgaataacccgatcatcagccagttcttccccaccctcctgctctggtccttctcggccctgctcccctccattgtctactactctacactgctggagtctcactggaccaagtcgggggaaaaccagatcatgatgaccaaagtctacatattcttgatcttcatggtgctgatcctgccctccctgggtctcaccagtctagattttttcttccggtggctctttgacaaaacttcctcggaggcctccatcaggttggagtgcgtcttcctgcctgaccagggtgccttctttgtgaactatgtcatcgcctcggccttcatcggcaatggcatggagctgctgcggctgccaggtctcatcctctataccttccgcatgatcatggccaagacggctgctgaccgcaggaatgtcaagcagaaccaggccttccagtacgagtttggagccatgtatgcatggatgctgtgtgtcttcactgtcatcgtggcctacagcatcacttgtcccatcatcgcgccatttggcctcatctacatcctgctcaagcacatggtggaccggcacaacctctacttcgtctacctcccagccaagctggagaaggggatccactttgccgctgtgaaccaggccttggcagcccccatcctgtgcctcttctggctctacttcttttccttcctgcgcctgggtatgaaggcccccgccactctgttcaccttcctggtgctgctgctcaccatcctggtctgcctggctcacacctgctttggatgcttcaagcacctcagccctctgaactacaaaacagaagagcctgcaagtgacaaaggaagtgaggcagaggcccacatgcccccaccgttcacaccctacgtgcctcggattctgaacggcttggcctcggagaggacagcactgtctccgcagcagcagcagcagcagacctatggtgccatccacaacatcagcgggactatccctggacagtgcttggcgcagagcgccacgggcagtgtggctgctgccccccaggaggcctgaggctgggtctcactgctctgaaaagacacaaccagaatggcctggggctcaggcccttggctgagtgggaatgcgttgggactgcccagctgagctatcaggtgcccatcttttctggtcccagcagtggtgaggagagcacaggcaggcctcgcccctcccttgctcacccagtttcccctccggcacaagcttccagctctgcagctggggtgacatccccagtggtttgtcgccaagaccatgtggtggacttttcgccccccaaactgatgagtccgggagaatatatggagagagagatgtaacaaggggaaggcctcctcccttctgagcacacacacaaccgataaccaaagagatgctgcagtccaggtctgaggtcccgctggcatccagctccctgctccatggccagtccctccccagcccagcagtccctccaggctacatccaggagtaagctatggggaacaggttgggaggtggccagtgctcctgccagctgtgcacacatctctgtatcccgctagagttctgtgtttttgtatcatgttgtcagggacgctagctgggtcagggttaccccatagcaggcagggacaaggaccactcataatatgcccattggaccacagttaagatccagcctctctcacctcttcagggctgagtgcatgagtctgcacctccaggcaggctctgtgcagtactcaccccctccgtctgctccctccaaggtgtgggggtgggcagtgctcagggcctcctcggagccaaaggacagcatggtcggcacagaggaaggggtacctgggctgggtgcagggccatcccactgcccttgagctgtggctctggcaggaaggaggggcagcccatccctcttctccctcctggggattctggggaatgggatgcaacttaagacttctgcctgagaagcctcctccctgctgcctccagggggcaccaaggcacaagcctgtgcagtaggggcgggatgggggtgtggaagagcaggtccaggctcctagcacaactggcctggggccttggcacctctgtaggccctgcctgtgcctgtccgctggcctggggggcctgggcttatctgggccttctcactcagggactctcttgacgctgacttgcccccgcagtggtggccagtgctgcctctgctccaagctgcccctgcgctgggaggggtgggggcggtgccattggtctggtgcagcatagccctggccagtggcctcatccccagcaggcctcccgtgcctctgccagcaaggaggggccggccagctctgcttgcacagggggccccatgtggggtcagcgcacgctcatgtcactgagttccagccgcttttagagtaaagtcgtttatcatcaaagccatgttgcttaccacacggagttgggggttggggagtgagcttggaggggtgagggggtgagcgtgggctcccagcatgggcaggggacggaggcaaactcattcctcagaaaaggggtatcttccccaagaaaagcctggagggcacttgtggggggaggtggcaggcggggggagaggggtgggtcattgccgctccagcaccgacaggaacttgcggatgtcctgggcgagcagctccggctcctcaaaggccgcaaagtggcccccacgaaccatgtaggaataggagatgagctttgggtacttgaacctcacccacttttcaggcgtgtgcaatagctcaaaagggaaggcagagaagccagtgggcacatagaccttcatccgctcatgcttctgggtcatccagccctgtcccaggttctccttgtagaagcgctgggaggagatgatggtgcctgttgtccagtagagcatgacgttggtcagcaggtcgtccagggagaacttcctttccaggcctccatcctccaggtatcggaattccgtattggtccaggtggaaaacttctctagaatataggcagccagacccacaggagagtcattcagagcagagcctggcggggagcggggagcaagggagagactcaggcctggggaccagagagctggagcttcaggtgtgatgtgtggcactggccgcagagggcggggctgtgtgcaggaagccacgttcgagcacaggcctgccttaactcctgggtgctcacatgcctcgcttccttaactctgcctcggcatcctcatctgataaacagggacgataccttcccactgtctcccagggcctggcacactgcctgctcagcttccttcaaactgaagggcctacgcctctgcatttggtggggtcccaatgagaagtgctgtttttaaaaaggcggggtttttcagtctatgtgctctgattcatgaaaaatgagaagccacctaaaaaagtctaaaataggggatcagttacaaatattgatatactcataagccaaaatactgtacagtcattaaaaatggctggaacaggctgggggcattggctcatgcctgtaatcccagcactttgggagggcgagaaaggtggatcacctgcggtaaggagttcgagactatcctggctgacatggtgaaaccccatctctattaaaaatacaaaaaaattagcagggcatggtggtgcatgcctgtaatcccagctacttgggaggctgaggcaggcaaattgcttgaacccgggaggtggaggttgcagtgagccgagatcgtaccactgcactctagcctgggcaacagagcaagactctgtctcaaaaaaaaataaataaataaagctgggacaatggcataaatgaatctcacaaacataatattgagcaaaagaagccagactcaagggtatatactctgtgattctattcataggacttaaacaggcacaatcaaaaccatctcagtcagaagtcagagcgtggtacctgggagagaaccccgaggggcatctggagtgttggggccatgttggtgatatggacgtacttcacttgtgaaaattctcaccaaaatgttcacaagttcttttgaaggagaggggatgtggggagggagaagaggttatatgagattgtctttaatgttttgtactttttgcatttttaagctttttgacaacatgtattttataatcagagaaaaatgctgacttttataaagtgccattattatgattaaaaaaaaaaagctgcctcgtgtgtgtgggcatgggtttgccatgaaaactatgaagaactttgagatgggcaagacaattcctgggtgtcttctggacaagatctagggagttacctagcagaccttccggactgacgtgatgctacaggggtcccatctttccttgtcattgagctattttacagttctgtgaattgtaaagaactgagggtaatgcgaatgactcttgttcatagaggcaaatgaattttgtcccatggagatttaattgatattactctgtggatgttgacaagttttgtgtctgttagca

SEQ ID NO: 440379 - DNA, 5141 bp, Homo sapiens
cctagtgctggtaccctcggggttaccgggcatcggaacacgccccgcgctgctgggtcccgccagacacgccgccgccgcaggaaagtctacagtttggtaccccaggactcgctggtcaggaaagccctgcaggacatgagtgttaggcccgacgcctggcccttggcagcttgggaggtggctggggctgcttttgcctttgccagagacagctccaactgaggacctctccaacgggcccatccacagtccttccttcccctagtgtctgggaagacaggcgcgatgatggactccccgttcctggagctgtggcagtccaaggcagtgtccatcagggagcagctgggactcggggaccggcccaacgactcctattgctacaactcggccaaaaacagcaccgtgctccagggggtcacctttggtggcatccccactgtcctgctcatagacgtcagctgcttcctgttcttaatcttggtgttttctattataagaagaagattctgggactatggccgcattgccctggtgtcagaagcagacagcgagtccagatttcagagattgtcatcgacttcctcctcaggtcaacaagactttgaaaatgagctgggatgctgtccctggctgactgccatcttccgtctgcatgatgaccagatcctggaatggtgtggggaggacgccatccactacctgtccttccagaggcacatcatcttcctgttggtggtggtcagctttttgtccctgtgtgtcatcctgcctgtcaacctctcaggggatttgctggacaaagacccgtatagttttgggaggacaacaatagcaaacctacagactgacaatgacctcctttggctgcacaccatctttgctgtcatttacctcttcttcactgtgggtttcatgcggcaccacactcagtccattaagtacaaagaggagaacctggtgaggcggaccctgttcatcacaggactccccagagatgccaggaaggagactgtggagagccacttccgggacgcgtatcccacgtgtgaggtggttgatgtgcagctgtgctacaacgtggccaaactgatctacctgtgcaaggagaaaaagaagactgagaagagcctgacctattacacaaacctgcaggtgaagacaggccagcggaccctcatcaaccccaagccctgtggccagttttgctgctgtgaagtgctgggctgtgagtgggaagacgccatctcttactacacacggatgaaggacaggctgctggagaggatcacagaggaagaacgccacgtccaggaccagcccctgggaatggccttcgtcaccttccaggagaagtccatggccacctacatcctgaaagatttcaatgcctgcaagtgtcagagccttcagtgcaaaggtgagccccagccgtcctcccatagcagggagctctatacctccaagtggacagtcacctttgctgctgaccctgaggacatctgctggaagaacctctctatccagggcctccgctggtggctacagtggctgggcatcaacttcaccctcttcctggggctatttttcctgaccacaccctccatcatcctgtccaccatggacaagtttaatgtcaccaaacccatccatgcgctgaataacccgatcatcagccagttcttccccaccctcctgctctggtccttctcggccctgctcccctccattgtctactactctacactgctggagtctcactggaccaagtcgggggaaaaccagatcatgatgaccaaagtctacatattcttgatcttcatggtgctgatcctgccctccctgggtctcaccagtctagattttttcttccggtggctctttgacaaaacttcctcggaggcctccatcaggttggagtgcgtcttcctgcctgaccagggtgccttctttgtgaactatgtcatcgcctcggccttcatcggcaatggcatggagctgctgcggctgccaggtctcatcctctataccttccgcatgatcatggccaagacggctgctgaccgcaggaatgtcaagcagaaccaggccttccagtacgagtttggagccatgtatgcatggatgctgtgtgtcttcactgtcatcgtggcctacagcatcacttgtcccatcatcgcgccatttggcctcatctacatcctgctcaagcacatggtggaccggcacaacctctacttcgtctacctcccagccaagctggagaaggggatccactttgccgctgtgaaccaggccttggcagcccccatcctgtgcctcttctggctctacttcttttccttcctgcgcctgggtatgaaggcccccgccactctgttcaccttcctggtgctgctgctcaccatcctggtctgcctggctcacacctgctttggatgcttcaagcacctcagccctctgaactacaaaacagaagagcctgcaagtgacaaaggaagtgaggcagaggcccacatgcccccaccgttcacaccctacgtgcctcggattctgaacggcttggcctcggagaggacagcactgtctccgcagcagcagcagcagcagacctatggtgccatccacaacatcagcgggactatccctggacagtgcttggcgcagagcgccacgggcagtgtggctgctgccccccaggaggcctgaggctgggtctcactgctctgaaaagacacaaccagaatggcctggggctcaggcccttggctgagtgggaatgcgttgggactgcccagctgagctatcaggtgcccatcttttctggtcccagcagtggtgaggagagcacaggcaggcctcgcccctcccttgctcacccagtttcccctccggcacaagcttccagctctgcagctggggtgacatccccagtggtttgtcgccaagaccatgtggtggacttttcgccccccaaactgatgagtccgggagaatatatggagagagagatgtaacaaggggaaggcctcctcccttctgagcacacacacaaccgataaccaaagagatgctgcagtccaggtctgaggtcccgctggcatccagctccctgctccatggccagtccctccccagcccagcagtccctccaggctacatccaggagtaagctatggggaacaggttgggaggtggccagtgctcctgccagctgtgcacacatctctgtatcccgctagagttctgtgtttttgtatcatgttgtcagggacgctagctgggtcagggttaccccatagcaggcagggacaaggaccactcataatatgcccattggaccacagttaagatccagcctctctcacctcttcagggctgagtgcatgagtctgcacctccaggcaggctctgtgcagtactcaccccctccgtctgctccctccaaggtgtgggggtgggcagtgctcagggcctcctcggagccaaaggacagcatggtcggcacagaggaaggggtacctgggctgggtgcagggccatcccactgcccttgagctgtggctctggcaggaaggaggggcagcccatccctcttctccctcctggggattctggggaatgggatgcaacttaagacttctgcctgagaagcctcctccctgctgcctccagggggcaccaaggctctccagggaatcaggaggaaaagcccaggtgctcttgacaataatgtggtgcctgctgccctgtgggctccctaatccccagaggggcctgttcagcaaaaggagcacaagcaggtgagcctgcatcctagtcttgaccatgcactgtgaggctgggaacaacccaccaggccacctcacccaaaaaatgcagctacgttggtcacagggtgaggatttgtaagaaagccaacaatagaatttgctgagtgccccatgcagagcaaccagacaaggggatgaagagggtgaggaggttggctgctgggaccagggtcatgactgcaggggcaaaccagggcctcacctttccaggcctccatcctccaggtatcggaattccgtattggtccaggtggaaaacttctctagaatataggcagccagacccacaggagagtcattcagagcagagcctacggtgtcaggcttggtgcactggatgtgcatgtagccgctctccctcatcaggctgtagaataccttctccttgacggggtacagcagctccacatccctctcagtgaggccaagaaacctcccgaaacgctgtcccaggaggagggtcagggtagagaagttgcttaaaaccaaagccatgttcaagtgcaggcctttcacgtggctgggcaccagctgggccatattagtgcagatcagggacccccagtcccctccttgaatgtagaattcctggaagcccagccgcagcatcagcttgtaaaagatcctggcggtggccaccgagttgaaccccttcttggaggatgcctctgagaagccatagccagggatggaagggcagatgacttcaaaaacgtgctcatcgctcaggccatggttcttggggtcagtcaggagtgggatgatcttataaaactcgtagaaagagccgggccagccgtgcaccatcagcaagggcttcggggtatggcctgcgggcagctgggggggcttcacgtggatgaagtggatgtccagcccttcaatcttagtcttgaagtgagggtatctgttgagaatctccacctgcttcttccagtcaaattcattccgccagtaggagatgactttcttcaggtagttggagttgaagccatagtggaagcagctgtcctccaaaggtggggtgaaacggaacttatcgatcctctggtgtaagtcgtggatctcctcatctgacgtttccaccttgaaagggcggatgctgtcgtcctccctggctgcggacctcgtgcctggcccccaccacccatcttcaagtggcaaagtttcctctttgtcccgggagatgaaccagtagatggcaaagcccagcactgaagtgaggaggatttctagccacatggctcggtctcggctcgcaggctccggcggcggcaggcgcgcgatctctccggctcctggctc

SEQ ID NO: 440380 - DNA, 1679 bp, Homo sapiens
caaggcggccattgaagtgtaatcgactccaataggagagtaaagtcgtttatcatcaaagccatgttgcttaccacacggagttgggggttggggagtgagcttggaggggtgagggggtgagcgtgggctcccagcatgggcaggggacggaggcaaactcattcctcagaaaaggggtatcttccccaagaaaagcctggagggcacttgtggggggaggtggcaggcggggggagaggggtgggtcattgccgctccagcaccgacaggaacttgcggatgtcctgggcgagcagctccggctcctcaaaggccgcaaagtggcccccacgaaccatgtaggaataggagatgagctttgggtacttgaacctcacccacttttcaggcgtgtgcaatagctcaaaagggaaggcagagaagccagtgggcacatagaccttcatccgctcatgcttctgggtcatccagccctgtcccaggttctccttgtagaagcgctgggaggagatgatggtgcctgttgtccagtagagcatgacgttggtcagcaggtcgtccagggagaacttcctttccaggcctccatcctccaggtatcggaattccgtattggtccaggtggaaaacttctctagaatataggcagccagacccacaggagagtcattcagagcagagcctacggtgtcaggcttggtgcactggatgtgcatgtagccgctctccctcatcaggctgtagaataccttctccttgacggggtacagcagctccacatccctctcagtgaggccaagaaacctcccgaaacgctgtcccaggaggagggtcagggtagagaagttgcttaaaaccaaagccatgttcaagtgcaggcctttcacgtggctgggcaccagctgggccatattagtgcagatcagggacccccagtcccctccttgaatgtagaattcctggaagcccagccgcagcatcagcttgtaaaagatcctggcggtggccaccgagttgaaccccttcttggaggatgcctctgagaagccatagccagggatggaagggcagatgacttcaaaaacgtgctcatcgctcaggccatggttcttggggtcagtcaggagtgggatgatcttataaaactcgtagaaagagccgggccagccgtgcaccatcagcaagggcttcggggtatggcctgcgggcagctgggggggcttcacgtggatgaagtggatgtccagcccttcaatcttagtcttgaagtgagggtatctgttgagaatctccacctgcttcttccagtcaaattcattccgccagtaggagatgactttcttcaggtagttggagttgaagccatagtggaagcagctgtcctccaaaggtggggtgaaacggaacttatcgatcctctggtgtaagtcgtggatctcctcatctgacgtttccaccttgaaagggcggatgctgtcgtcctccctggctgcggacctcgtgcctggcccccaccacccatcttcaagtggcaaagtttcctctttgtcccgggagatgaaccagtagatggcaaagcccagcactgaagtgaggaggatttctagccacatggctcggtctcggctcgcaggctccggcggcggcaggcgcgcgatctctccggctcctggctc

SEQ ID NO: 440381 - DNA, 2247 bp, Homo sapiens
ggcctagtgggatagtctggtggggcctcacatcttgctccaggtatccgtgtgcaaggagcaggccagaccccctgccaaggtggtcttgcagaagctccatcaacccctgtgtcctgctgaatgtagggcaggggaaacagatcccagacgaaggccctgctgaggctcttggaggaggtgaggacctgcctgcaggaatgagtttgcttttgatctggccccagtgtacctgcttcagcctctggacaagccaccctttccaagcaccctttccttgcatttttattgcttttctctttgcctaagtttctctcctccatccagcaaactcctacttatcctccaaggcccaaatcagatacattctcctggtcatttcccctctctgccgcttagacaaagaatcctccttccactggactctcacagtcctttgcgcattcattcaacatctatgtactgggctctcccactgttcacccggcattgttctaggtgatggggctacagcatggccaagacagagtccctacccccaaggcaggattcagtctcattttactgtctttcccatccccagcactgtctggtcctgtgtgtcactgaaggaataaagggatgggccctggaaagggtgggtcagagctgaccttggtgaagcctgagtcaggccacagagctgggagtcaggcatgtagaggatacagcctctaaggctctgagagattaacagcctcctgtctttctgcgaccaccctcctggaacacgcagtcacgtgaccctgatgccaggctctccagggaatcaggaggaaaagcccaggtgctcttgacaataatgtggtgcctgctgccctgtgggctccctaatccccagaggggcctgttcagcaaaaggagcacaagcaggtgagcctgcatcctagtcttgaccatgcactgtgaggctgggaacaacccaccaggccacctcacccaaaaaatgcagctacgttggtcacagggtgaggatttgtaagaaagccaacaatagaatttgctgagtgccccatgcagagcaaccagacaaggggatgaagagggtgaggaggttggctgctgggaccagggtcatgactgcaggggcaaaccagggcctcacctttccaggcctccatcctccaggtatcggaattccgtattggtccaggtggaaaacttctctagaatataggcagccagacccacaggagagtcattcagagcagagcctacggtgtcaggcttggtgcactggatgtgcatgtagccgctctccctcatcaggctgtagaataccttctccttgacggggtacagcagctccacatccctctcagtgaggccaagaaacctcccgaaacgctgtcccaggaggagggtcagggtagagaagttgcttaaaaccaaagccatgttcaagtgcaggcctttcacgtggctgggcaccagctgggccatattagtgcagatcagggacccccagtcccctccttgaatgtagaattcctggaagcccagccgcagcatcagcttgtaaaagatcctggcggtggccaccgagttgaaccccttcttggaggatgcctctgagaagccatagccagggatggaagggcagatgacttcaaaaacgtgctcatcgctcaggccatggttcttggggtcagtcaggagtgggatgatcttataaaactcgtagaaagagccgggccagccgtgcaccatcagcaagggcttcggggtatggcctgcgggcagctgggggggcttcacgtggatgaagtggatgtccagcccttcaatcttagtcttgaagtgagggtatctgttgagaatctccacctgcttcttccagtcaaattcattccgccagtaggagatgactttcttcaggtagttggagttgaagccatagtggaagcagctgtcctccaaaggtggggtgaaacggaacttatcgatcctctggtgtaagtcgtggatctcctcatctgacgtttccaccttgaaagggcggatgctgtcgtcctccctggctgcggacctcgtgcctggcccccaccacccatcttcaagtggcaaagtttcctctttgtcccgggagatgaaccagtagatggcaaagcccagcactgaagtgaggaggatttctagccacatggctcggtctcggctcgcaggctccggcggcggcaggcgcgcgatctctccggctcctggctc

SEQ ID NO: 440382 - DNA, 1660 bp, Homo sapiens
  misc_feature (29)..(29): n is a, c, g, or t
agcgaactagccgaggagagccaggagcnggagagatcgcgcgcctgccgccgccggagcctgcgagccgagaccgagccatgtggctagaaatcctcctcacttcagtgctgggctttgccatctactggttcatctcccgggacaaagaggaaactttgccacttgaagatgggtggtgggggccaggcacgaggtccgcagccagggaggacgacagcatccgccctttcaaggtggaaacgtcagatgaggagatccacgacttacaccagaggatcgataagttccgtttcaccccacctttggaggacagctgcttccactatggcttcaactccaactacctgaagaaagtcatctcctactggcggaatgaatttgactggaagaagcaggtggagattctcaacagacaccctcacttcaagactaagattgaagggctggacatccacttcatccacgtgaagcccccccagctgcccgcaggccataccccgaagcccttgctgatggtgcacggctggcccggctctttctacgagttttataagatcatcccactcctgactgaccccaagaaccatggcctgagcgatgagcacgtttttgaagtcatctgcccttccatccctggctatggcttctcagaggcatcctccaagaaggggttcaactcggtggccaccgccaggatcttttacaagctgatgctgcggctgggcttccaggaattctacattcaaggaggggactgggggtccctgatctgcactaatatggcccagctggtgcccagccacgtgaaaggcctgcacttgaacatggctttggttttaagcaacttctctaccctgaccctcctcctgggacagcgtttcgggaggtttcttggcctcactgagagggatgtggagctgctgtaccccgtcaaggagaaggtattctacagcctgatgagggagagcggctacatgcacatccagtgcaccaagcctgacaccgtaggctctgctctgaatgactctcctgtgggtctggctgcctatattctagagaagttttccacctggaccaatacggaattccgatacctggaggatggaggcctggaaaggaagttctccctggacgacctgctgaccaacgtcatgctctactggacaacaggcaccatcatctcctcccagcgcttctacaaggagaacctgggacagggctggatgacccagaagcatgagcggatgaaggtctatgtgcccactggcttctctgccttcccttttgagctattgcacacgcctgaaaagtgggtgaggttcaagtacccaaagctcatctcctattcctacatggttcgtgggggccactttgcggcctttgaggagccggagctgctcgcccaggacatccgcaagttcctgtcggtgctggagcggcaatgacccacccctctccccccgcctgccacctccccccacaagtgccctccaggcttttcttggggaagataccccttttctgaggaatgagtttgcctccgtcccctgcccatgctgggagcccacgctcaccccctcacccctccaagctcactccccaacccccaactcctgtaaccgagtgtatatacgtcgctgcaggtgggggagcggga

SEQ ID NO: 440383 - DNA, 1958 bp, Homo sapiens
  misc_feature (29)..(29): n is a, c, g, or t
  misc_feature (1822)..(1822): n is a, c, g, or t
agcgaactagccgaggagagccaggagcnggagagatcgcgcgcctgccgccgccggagcctgcgagccgagaccgagccatgtggctagaaatcctcctcacttcagtgctgggctttgccatctactggttcatctcccgggacaaagaggaaactttgccacttgaagatgggtggtgggggccaggcacgaggtccgcagccagggaggacgacagcatccgccctttcaaggtggaaacgtcagatgaggagatccacgacttacaccagaggatcgataagttccgtttcaccccacctttggaggacagctgcttccactatggcttcaactccaactacctgaagaaagtcatctcctactggcggaatgaatttgactggaagaagcaggtggagattctcaacagacaccctcacttcaagactaagattgaagggctggacatccacttcatccacgtgaagcccccccagctgcccgcaggccataccccgaagcccttgctgatggtgcacggctggcccggctctttctacgagttttataagatcatcccactcctgactgaccccaagaaccatggcctgagcgatgagcacgtttttgaagtcatctgcccttccatccctggctatggcttctcagaggcatcctccaagaaggggttcaactcggtggccaccgccaggatcttttacaagctgatgctgcggctgggcttccaggaattctacattcaaggaggggactgggggtccctgatctgcactaatatggcccagctggtgcccagccacgtgaaaggcctgcacttgaacatggctttggttttaagcaacttctctaccctgaccctcctcctgggacagcgtttcgggaggtttcttggcctcactgagagggatgtggagctgctgtaccccgtcaaggagaaggtattctacagcctgatgagggagagcggctacatgcacatccagtgcaccaagcctgacaccgtaggctctgctctgaatgactctcctgtgggtctggctgcctatattctagagaagttttccacctggaccaatacggaattccgatacctggaggatggaggcctggaaaggaagttctccctggacgacctgctgaccaacgtcatgctctactggacaacaggcaccatcatctcctcccagcgcttctacaaggagaacctgggacagggctggatgacccagaagcatgagcggatgaaggtctatgtgcccactggcttctctgccttcccttttgagctattgcacacgcctgaaaagtgggtgaggttcaagtacccaaagctcatctcctattcctacatggttcgtgggggccactttgcggcctttgaggagccggagctgctcgcccaggacatccgcaagttcctgtcggtgctggagcggcaatgacccaaccccctcacccctccaagctcactccccaacccccaactccgtgtggtaagcaacatggctttgatgataaacgactttactctaaaagcggctggaactcagtgacatgagcgtgcgctgaccccacatgggccccctgtgcaagcagagctggccggcccctccttgctggcagaggcacgggaggcctgctggggatgaggccactggccagggctatgctgcaccagaccaatggcaccgccccacccctcccagcgcaggggcagcttggagcagaggcagcactggccaccgctgcgggggcaagtcagcgtcaagagagtccctgagtgagaaggcccagataagcccaggccccccaggcnagcggacaggcacaggcaggggctacagaggtgccaaggccccaggccagttgtgctaggagcctggacctgctcttccacatcctcccattacccacccctactgcatcaggcttataccttggtgccccctgga

SEQ ID NO: 440384 - DNA, 1537 bp, Homo sapiens
  misc_feature (29)..(29): n is a, c, g, or t
agcgaactagccgaggagagccaggagcnggagagatcgcgcgcctgccgccgccggagcctgcgagccgagaccgagccatgtggctagaaatcctcctcacttcagtgctgggctttgccatctactggttcatctcccgggacaaagaggaaactttgccacttgaagatgggtggtgggggccaggcacgaggtccgcagccagggaggacgacagcatccgccctttcaaggtggaaacgtcagatgaggagatccacgacttacaccagaggatcgataagttccgtttcaccccacctttggaggacagctgcttccactatggcttcaactccaactacctgaagaaagtcatctcctactggcggaatgaatttgactggaagaagcaggtggagattctcaacagacaccctcacttcaagactaagattgaagggctggacatccacttcatccacgtgaagcccccccagctgcccgcaggccataccccgaagcccttgctgatggtgcacggctggcccggctctttctacgagttttataagatcatcccactcctgactgaccccaagaaccatggcctgagcgatgagcacgtttttgaagtcatctgcccttccatccctggctatggcttctcagaggcatcctccaagaaggggttcaactcggtggccaccgccaggatcttttacaagctgatgctgcggctgggcttccaggaattctacattcaaggaggggactgggggtccctgatctgcactaatatggcccagctggtgcccagccacgtgaaaggcctgcacttgaacatggctttggttttaagcaacttctctaccctgaccctcctcctgggacagcgtttcgggaggtttcttggcctcactgagagggatgtggagctgctgtaccccgtcaaggagaaggtattctacagcctgatgagggagagcggctacatgcacatccagtgcaccaagcctgacaccgtaggctctgctctgaatgactctcctgtgggtctggctgcctatattctagagaagttttccacctggaccaatacggaattccgatacctggaggatggaggcctggaaaggaagttctccctggacgacctgctgaccaacgtcatgctctactggacaacaggcaccatcatctcctcccagcgcttctacaaggagaacctgggacagggctggatgacccagaagcatgagcggatgaaggtctatgtgcccactggcttctctgccttcccttttgagctattgcacacgcctgaaaagtgggtgaggttcaagtacccaaagctcatctcctattcctacatggttcgtgggggccactttgcggcctttgaggagccggagctgctcgcccaggacatccgcaagttcctgtcggtgctggagcggcaatgacccaaccccctcacccctccaagctcactccccaacccccaactccgtgtggtaagcaacatggctttgatgataaacgactttactct

SEQ ID NO: 440385 - DNA, 1517 bp, Homo sapiens
  misc_feature (29)..(29): n is a, c, g, or t
  misc_feature (1381)..(1381): n is a, c, g, or t
agcgaactagccgaggagagccaggagcnggagagatcgcgcgcctgccgccgccggagcctgcgagccgagaccgagccatgtggctagaaatcctcctcacttcagtgctgggctttgccatctactggttcatctcccgggacaaagaggaaactttgccacttgaagatgggtggtgggggccaggcacgaggtccgcagccagggaggacgacagcatccgccctttcaaggtggaaacgtcagatgaggagatccacgacttacaccagaggatcgataagttccgtttcaccccacctttggaggacagctgcttccactatggcttcaactccaactacctgaagaaagtcatctcctactggcggaatgaatttgactggaagaagcaggtggagattctcaacagacaccctcacttcaagactaagattgaagggctggacatccacttcatccacgtgaagcccccccagctgcccgcaggccataccccgaagcccttgctgatggtgcacggctggcccggctctttctacgagttttataagatcatcccactcctgactgaccccaagaaccatggcctgagcgatgagcacgtttttgaagtcatctgcccttccatccctggctatggcttctcagaggcatcctccaagaaggggttcaactcggtggccaccgccaggatcttttacaagctgatgctgcggctgggcttccaggaattctacattcaaggaggggactgggggtccctgatctgcactaatatggcccagctggtgcccagccacgtgaaaggcctgcacttgaacatggctttggttttaagcaacttctctaccctgaccctcctcctgggacagcgtttcgggaggtttcttggcctcactgagagggatgtggagctgctgtaccccgtcaaggagaaggtattctacagcctgatgagggagagcggctacatgcacatccagtgcaccaagcctgacaccgtagaccccctcacccctccaagctcactccccaacccccaactccgtgtggtaagcaacatggctttgatgataaacgactttactctaaaagcggctggaactcagtgacatgagcgtgcgctgaccccacatgggccccctgtgcaagcagagctggccggcccctccttgctggcagaggcacgggaggcctgctggggatgaggccactggccagggctatgctgcaccagaccaatggcaccgccccacccctcccagcgcaggggcagcttggagcagaggcagcactggccaccgctgcgggggcaagtcagcgtcaagagagtccctgagtgagaaggcccagataagcccaggccccccaggcnagcggacaggcacaggcaggggctacagaggtgccaaggccccaggccagttgtgctaggagcctggacctgctcttccacatcctcccattacccacccctactgcatcaggcttataccttggtgccccctgga

SEQ ID NO: 440386 - DNA, 1311 bp, Homo sapiens
  misc_feature (29)..(29): n is a, c, g, or t
agcgaactagccgaggagagccaggagcnggagagatcgcgcgcctgccgccgccggagcctgcgagccgagaccgagccatgtggctagaaatcctcctcacttcagtgctgggctttgccatctactggttcatctcccgggacaaagaggaaactttgccacttgaagatgggtggtgggggccaggcacgaggtccgcagccagggaggacgacagcatccgccctttcaaggtggaaacgtcagatgaggagatccacgacttacaccagaggatcgataagttccgtttcaccccacctttggaggacagctgcttccactatggcttcaactccaactacctgaagaaagtcatctcctactggcggaatgaatttgactggaagaagcaggtggagattctcaacagacaccctcacttcaagactaagattgaagggctggacatccacttcatccacgtgaagcccccccagctgcccgcaggccataccccgaagcccttgctgatggtgcacggctggcccggctctttctacgagttttataagatcatcccactcctgactgaccccaagaaccatggcctgagcgatgagcacgtttttgaagtcatctgcccttccatccctggctatggcttctcagaggcatcctccaagaaggggttcaactcggtggccaccgccaggatcttttacaagctgatgctgcggctgggcttccaggaattctacattcaaggaggggactgggggtccctgatctgcactaatatggcccagctggtgcccagccacgtgaaaggcctgcacttgaacatggctttggttttaagcaacttctctaccctgaccctcctcctgggacagcgtttcgggaggtttcttggcctcactgagagggatgtggagctgctgtaccccgtcaaggagaaggtattctacagcctgatgagggagagcggctacatgcacatccagtgcaccaagcctgacaccgtagctctgctctgatcatttcttaccgtggtataaaaggactcttggtggctcctcgtcttcctcgtcttcctccaggatagaacgcatggaattagaccccatggactcttcggaagactggcactctgccaataatgtgatattagactttcatggtcattgcattgtcttgatgactcatcccaagaaaacatttcatgacacatgaccatcgatgcataaagaaaaggttccatgctatacacaactccacactgccaaattcaaacagagtgcgcttctaataaactacattttaaag

SEQ ID NO: 440387 - DNA, 823 bp, Homo sapiens
ggcctagtgggatagtctggtggggcctcacatcttgctccaggtatccgtgtgcaaggagcaggccagaccccctgccaaggtggtcttgcagaagctccatcaacccctgtgtcctgctgaatgtagggcaggggaaacagatcccagacgaaggccctgctgaggctcttggaggaggtgaggacctgcctgcaggaatgagtttgcttttgatctggccccagtgtacctgcttcagcctctggacaagccaccctttccaagcaccctttccttgcatttttattgcttttctctttgcctaagtttctctcctccatccagcaaactcctacttatcctccaaggcccaaatcagatacattctcctggtcatttcccctctctgccgcttagacaaagaatcctccttccactggactctcacagtcctttgcgcattcattcaacatctatgtactgggctctcccactgttcacccggcattgttctaggtgatggggctacagcatggccaagacagagtccctacccccaaggcaggattcagtctcattttactgtctttcccatccccagcactgtctggtcctgtgtgtcactgaaggaataaagggatgggccctggaaagggtgggtcagagctgaccttggtgaagcctgagtcaggccacagagctgggagtcaggcatgtagaggatacagcctctaaggctctgagagattaacagcctcctgtcaggctgacgcacatcgtactcgaaataggcattgagtggtcacttacgattcgacatctatggaatggggtgtaccag

SEQ ID NO: 440388 - DNA, 453 bp, Homo sapiens
ttgctccttgggccctctggtgttctatgaaatttctcaggcccgcctacccccaggtggaggtcagaaaagctcacagaggcaagaaggaatcctggagcccaaatataggggtggcatctccagccccggagggcggtgtgtctggggccggcctctcaggcccctcctttcccagcttcctcgggccaactccctgctcaccccgccggaaggagagcctggtgggaacaccgggcccacccttggcgaggacggggcagttatggaacctctagcagccccgtacccttcttggaggatgcctctgagaagccatagccagggatggaagggcagatgacttcaaaaacgtgctcatcgctcaggccatggttcttggggtcagtcaggagtgggatgatcttataaaactcgtagaaagagccgggccagccgtgcaccatcagcaag

SEQ ID NO: 440389 - DNA, 1131 bp, Homo sapiens
agaatcacttgaacctgggaggcagaggttgcaatgagctgagattgtgccactgcactccactgggcaacagggagagactccatctcaacaacaaaaacaacaacaacaacaaaaaggcaaaaacaaacccctggaaattaactggtaataaagagggggaaaggaactggttggaaactttccttaaaaaaaaaagtcaaaaccctgatttgccaacatgtagacctcagcttaatgtagacttgcagaaagccattaatttagggtagtattgatttatatttgactggtaattaagagcatacatgctgcttctttattatctgggtgacacaaattcatgtggcctgaggaagggtggaaatagtaggggggaaatgtttgtaagctttgagaaagattttttttctgtctgcaagactgcattgaaagcactgtacctaatcaccaccacaccaccaccaccactcctaaaaaaagaaaaaaagagatgctttcacattcacctttccagagcaaattctctgtcactaagcctgcattgcactgaaggtatctttaactcctgcttctgtacaagaggctcatgaacacagctaaaattgagaccatgagcaaagtgcaccaaaccacacacgaggtttgtaaacacacgaggagtgccacatcatgctagatttcagtgagcgcaatggcaggcacacgagaagatgttggggtgggaagaaaatatcccaccttgctgtttagaaccactgtgctgtgagcgctgagacggcagaagagaagccatcccacgcagcacttgcaaggcgatccgagcaccctgtcactcttgtaaactagaaagggcttcttttacttgtgtgaccttaccattcttgaaaataaaaagggagaagagaagggaactaaagtgcaagctaaaagagaaaagctccaagaagacaagcctaccttcaaaaaagaagaggtaaatatgattgaaaagtaatgatcgtaaagcaacagaaaaagcagtcagtgttccaagatatctcaggtctgatgatctcaaaattgtaacctcatatccagtgtatttcaagccatgactcacagtccactgaatagtgagatcagcttaga

SEQ ID NO: 440390 - DNA, 1278 bp, Homo sapiens
tgtgctttctttttattgctgcatttgtgttctacaagacagcctctttctccaagattaacatttcttatgattgttcctgacaatggattcacttccagaggccctgctaaggataaccaaaaaagggcatggagcaggctggttttggcagcgtgcacgcagtttcagagctttttaggtcttgggttttctgatgagtgatttcctgagcatgcctagggaatgacaggcatctccacaggcaggctgcatccaccttggctggggtgtcgtcattggctgcctattagaaaaacgacaggacaatgcataccaccgcctcccgactgtaaacataggggatatgtgttcacttagcatggacttctgggaggggccaaggaagggcggtctggagttttattgaatagagcagtgtgtattcggctgcctgcctgcccgcctgcttgctctctggctgtgctcctgcttaaagaaatcagtccttcctttccgacttagtcctcgggaagaagtttcagactacaaggtatcattggaacatttcaagatcatcaaatcaaattccacagggattggtgaccaaccagaaggctcagacatctgattgctgacctgtccagacatcatctggtctccctgaacctgaaatcacaccatggatgattttgagcgtcgcagagaacttagaaggcaaaagagggaggagatgcgactcgaagcagaaagagacgaggtctcactatgctgcccaggctgctctcaaactcctggactcaagagatcctcctgcctcgggatcccaaagtgtagagattacagacatgagtcaccacacccagtctgtttgctgatctgttttaaaggaatgtctacattcaccttttctaggagtcagttctccaaatcactctacctttcactttgtaagtaacggtggggaagaataaaataacaataaaataaaataaaaacaaaactatattcactccaaagagaagaaaataattcccttttgtcctttaaagagtgaaaatattcattacacaaatcagcaatgtccaccaaaggccactgctcatcagcacttagtgtagtttccagagaaaacatctaaaatgcataaaagttaagcagtttttgtatacctagcttttagctgatttcatgactgctgtatagcttctttgtagatagtttctgcagctgtttcatgaatgttatggtatgcctgcgaattgaattgaaaaagactgagttcacacggcttttgaa

SEQ ID NO: 440391 - DNA, 3177 bp, Homo sapiens
tgagatggagtttcgctcttgttgcccaagctagagtgcaatggtgcaatctcggctcactgcaacctctgcattccaggttcaagcgattctcctgcctcagcctcccaaccgtcttgttttgagcacgactgtatccccagagcctagcaaagtgcccttcatacagtaggcatttaagaagtattgttgaggccaagtgtggtgactcatgcctgtcgtcacagcacttcaggaggccgaggcaggaggatcccttgagcccaggaatttgaaaccagcctgggcaacatagggactatgcctggctaattttttcatttttttctctacaaaatagagagaggcctatggttccagctactcgggaagctgaagtgggaggatcacttgagccctggaggtcgtggctgtagtgagccttgattgtgccactgcactccagcctgggtgacagagcaagaccctgtctcaaaaaaaaacaaaaaagtatctgttgaagaaacgaagtagaatatcaatttcacaacaaatggtgtcccaacaaaaagcatatttcatttttgaaagatcctctgatctagctgtgatggtttattttgagggacatatgtcatcagcatacagttttacaacagaaattatcactctcatttttggtggaggtgtttacacaatgaatttttaagatgataatgttgaggaagacaaactcactataattttatgagaacaaacttcccagcaccaatcctaaaaataactcacaaatttcagggaacaaaaagcgcaaaacctacaaagccggcagcctcggatcttcctgttcctgctgaaggtgtacgcaacatcaagagtatgtgggagaaagggaatgtgttttcatcccccactgcagcaggcacaccaaataaggtgagcatctgatttttgtctcttaagtgtagaggggcatatttttttgcatgtcgattttgatttaggaatcacactagtaaataataaaagcagtgaagaaggtgcaatttgtactttgttttgcaatgaccacaaaagcaagctcagagagaatgtgtttgtgaggttgcatgaggtactaagcccgggccatcttactccaaataaagtgcctgggctgaaatgtccacccttggagttggagtggggtgagttaccagggaaagaaaaccagataacatattctgtaaatatcaagtgttaaggtttatggttatgtgaaatcatacttaatgatattttgaatttgctttgaaaattccttcccaggtaaagtttacttcattctttaatattttggatgattgcccctttgtaggaaactgctggcttgaaggtaggggtttctagccgcatcaatgaatggctaactaaaaccccagatggaaacaagtcacctgctcccaaaccttctgtaagtacctttaggtttttctgagtttctttgatctcccagcttctaccagcagaagaaaacaagcagttggtctgtttacctaggaatggcagtgcccctgttctttgctttccctgatgaatagcaaacaggaaagtgttcagatttacaacagttctaagaagctgcatctcagttactcagagggtaaaatggaaccaaataatcacctctacaccctaactgagaggaggaatcagctagaatactgaggcagttcaaatttagatcctttactcgtctatttgtttagcttctattctataaattctggatagaaatttgaaaatgaaaggtcacatcattttggctacttctttgtcaagagcacccctaaacttattcccaaaagaatatgtatgttgcctattgggaacccatatgttccaatttgcctcatttttataacttggcacaaaaatgcagttattgggtagctgttgaaataattggtctaattgtgttgtcagcacctcctgaggaaagtcataaaactggaaactagaaaaactggttatgaatgatgtttttgagaatctaaaattttcttaatttattaagtgcagctatcttactaaaaagtacatttcttttcacctttttgttgaatgtatacgacaattgcttgcatttgtcattataataagaaaacgtatcaagctccccactgtatattgctgagctttccctgttaagtttgcttttatagctttgttggtgcccaagggagctgagagtccactgtcataatcctacattctagaggaagaagaaaaagtttccaatcctaggcctctgtgcatttaattgcatccattggctccatgccatttaattgcatttgttggctccatatataatctccaaagtcattaaattttgtcactttccaatttaaaaaggaagaaatggaaatgttcacaaatccttcttgggcacaactccttgaaccgtttaattaatctacaccccgagattctttgcataaaggctcacaggaggtatacactaatgtcaacccaatttacaattggaaaatctttatacattgaaaaaagcaacttttcctccccctctcaataggtacaagaatgcgggtttataaaaggacacagttgaggcaagagaccggacccaaaagttatgtgctctttagtgcctcaagttttccaagcatctctggtaacataaggagtagaaattattttcaaaaacaaaataatcactggttccagaccagtgattattaaccctttttgaattatgaacccctttaaaacctaatgaaatttaaggaccctctcccccaaaatatacatataaaaaaacaaggcagtctatggacctactgagtaactctcaagatagtaagtaaggagagaaagatctatgtttccctctttgataagtatgaaatatttggaggagatgctaatttttgcacgtttatgatatttgcaatctttcatttttgtagcagattatactcaaaaatttgatccagaacttggcccctattcttttatcagcactttaacttgtaaactgaaaagtttaccatcatctgtatgacatcctaatgaggttaaaaagataaaatgcagttatgattatgataggtataactgtatccaggtttccacagcaaaaacaaaacaaaacatacaccatgttctggggttattgacagcctcctaaaaaaa

SEQ ID NO: 440392 - DNA, 877 bp, Homo sapiens
caaacaatagtactaccactgctcttgaaaataaaaacctcagtgagatcagggatgatcttaccttcttaaaattgtggtaaaggtgtttgttcacaggctaaaggaccatagctcattctctaagaatttcacctgattccaactctaccacatctgagtggtttctttctgagttttctgccttcctaacaattttgggtcttacttgatgataccaaccaaaacctaataagatttttcttgttctgtttcttcctgatatgtactgttggttagaatcaaagatgaaaagattaaaaaggacaaagaacccaaagaagaagttaagagcttcatggatcgaaagaagggatttacagaagttaagtcgcagaatggagaattcatgacccacaaacttaaacatactgagaatactttcaggtaagaagtagcaactagttaatagaaactgtgttcacatgcaaagaaaaaaaaaaaaaagtcagtcttcccatcctgtgcttccagacagaaacgtgctaagcaggcagcatgcttttgttgtgaggtcattagccattgtcttagagatactcagtcagcaggtccagttcttatatcactaacagaagaccagcagtcatcgctcagacagggcttagtctgcttttcccattattttgaaaggcagatcatgcttggcatccatgtttttgttcactgaccttttgtgagattagtgtattagaaaacattataactgggattcatgtcattcaatgattctctatatggtctgaccaccttcctaagagacctttctcagtaccattttcaagaatgcattttctaaaggttgtaaataaatattgcataagactaagattgtttt

SEQ ID NO: 440393 - DNA, 1043 bp, Homo sapiens
tgtgctttctttttattgctgcatttgtgttctacaagacagcctctttctccaagattaacatttcttatgattgttcctgacaatggattcacttccagaggccctgctaaggataaccaaaaaagggcatggagcaggctggttttggcagcgtgcacgcagtttcagagctttttaggtcttgggttttctgatgagtgatttcctgagcatgcctagggaatgacaggcatctccacaggcaggctgcatccaccttggctggggtgtcgtcattggctgcctattagaaaaacgacaggacaatgcataccaccgcctcccgactgtaaacataggggatatgtgttcacttagcatggacttctgggaggggccaaggaagggcggtctggagttttattgaatagagcagtgtgtattcggctgcctgcctgcccgcctgcttgctctctggctgtgctcctgcttaaagaaatcagtccttcctttccgacttagtcctcgggaagaagtttcagactacaaggtatcattggaacatttcaagatcatcaaatcaaattccacagggattggtgaccaaccagaaggctcagacatctgattgctgacctgtccagacatcatctggtctccctgaacctgaaatcacaccatggatgattttgagcgtcgcagagaacttagaaggcaaaagagggaggagatgcgactcgaagcagaaaggtaaggatctagggtgaaaaatacttgtattcccttattaacaaccttggtttcaggcctcaaagaccatccttttgagaggccaaatgtggtcatatcgcacaccaaactgttcgcaaaagtagttatggaaaatttttctgctaagactctaaattaagcatttaaaaaaggaaaacaaacaagaatcaagaaaaagagagatttgagaggaatcaattgataactgcatattgataattgcatttaatcaatacctttcacattggaatgttttaaatgacaaaagtaatgtgtgaatgaaggtttaa

SEQ ID NO: 440394 - DNA, 2345 bp, Homo sapiens
  misc_feature (1163)..(1163): n is a, c, g, or t
tgagatggagtctcactctgtcactcaggttggagtgcagtggcgccatctcagctcactgcaacctccgcctcctgggttcaagcaattctcctgccgcagcctcccaagtagctgggactacaggcacctgccaccaagcccgggtaatttttgtatttttagtagagacggggtttcaccatgttggccaggctggtctcaaactcctgaccttgatccacctgcctcagcctccccgagtgctgggattacaggcatgagccacctcgcctggcctataaactacgactctgatgaccgcatagtatttaagcaagaaaacaaccaaaatgttctagctaaagtggagaccacttaacctaacccaattaaactttaagttgaacacaagagtagtagatgcagttcagctccatgacattgggtgagttgtctaaatgctctgtgctttggtgtccttgtctgcgtgtgacatgaagccgcagatctcaaagatctctttcattccgtgaaagcgctctcaatgtgtgaagttgactgcttctcctgctgtttaccaagagaataatcttaaccctacattgtggagatcggatttgttctcacttgacagaaagccagtcccacgagcagcttggtacccaaataccagtctgtttagtgctcattagagatgaagaaccatattcataagtcaagctgagacggagtgtcatctccagacagaatcaacaccaccccctcctcaggaactgggatttggctgctttccaagccgctgctgaccaggttccattgcccagcttggctgatgagatcactggcagagtaccatgggtgcagacggggcctgctgtttcaacatgttctcaggagggctcttgcccacatttcttggagaggtgtgagcaccaaacatgctgaaccatccagcccatcactgagcagggccatctctcttcatcccttttcatttggtttgcatttttatgtcatgctccttccctggataaaagggataagaggagtttctcagatttgatttctcagtgggaactgtttgctttggaagccacctacaccaatgctaattgagaacagagctcagaatgggagcctgagaactgcacccggatgaactttttggtgggctgatttcngttgatcttgtcagaattaggttgtatatgcatgtaataccatgatcaactattttccaaaaggctgagcaaatgcatcagtgtctttttcctttgaccagttacttaccttggaaaaattatttgtagttaagcatataaagtcttcatcaggaaaactactggagatcctggccctgactacccagcaataacatttctggaactcccgaagcaatcagtgctctctgatcgctaaacatgatgggcttctattagagagattacagtaaaaaataacaatcagctctctgatgatcctgtgaggagggaacgggttgggaggagtagatttggctgaggacaagcccagactttcgtcacagggacagaccaacgtgttaacacaaagggagaacacgggagcatcctgcaccgtgcatttcagccacagatcacatggcccctccgcgggcccagcccacgccctgaccgcccggcctggccaggtctccgtatctctctgccccgccgccccttcccaactgcggacatgctgggtggatccggatcgcatggaagacgcagcctggccgcgctctcccaaatcgcctaccagaggaatgacgatgatgaagaggaggcagcccgggaacggcgccgccgagcccgacaggaacggctgcggcagaagcaggaggaagaatccttgggacaggtgaccgaccaggtggaggtgaatgcccagaacagtgtgcctgacgaggaggccaagacaaccaccacaaacactcaagtggaaggggatgatgaggccgcattcctggagcgcctggctcggcgtgaggaaagacgccaaaaacgccttcaggaggctctggagcggcagaaggagttcgacccaacaataacagatgcaagtctgtcgctcccaagcagaagaatgcaaaatgacacagcagaaaatgaaactaccgagaaggaagaaaaaagtgaaagtcgccaagaaagatacgagatagaggaacgaacgtcccagtctaccgagatgtggcggtgctgagaaacacgaagagccaggaagggggggagaggaaccagggggctggaatccagccaaaaaaaaaaaagtggcggcccgaattaattgggggccaaaaaagttcaaaggcaaggtcaaacggcgggacagtgtggaacagt

SEQ ID NO: 440395 - DNA, 393 bp, Homo sapiens
  misc_feature (352)..(352): n is a, c, g, or t
tattggaataaaagtcagcagtgatacattctcttctgaactttagattttctagaaaaatatgtaatagtgatcaggaggagctcttgttcaaaagtacaacaaagcaatgttaccttaccataggcctaattcaaaacttttgaaaagtaaattccttgtttactggtttgactataattctctgttatctttacgaggtaaaactgcaagctgactagcatgttctgtgaatctgccattcctaaaaattttataaacacttgatacttttcactgataatggatcgctccaataaacatatattgtgaaaatgcatccacaataaatggaattccttcctgcaaaaanaagtcgacgcggccgcgaatttagtagtagtaggcggccgc

SEQ ID NO: 440396 - DNA, 3707 bp, Homo sapiens
ggtcgcctactactactaaattcgcggccgcgtcgacagggcagcagaggagaggcagaggataaaggaggaagagaaaagggcagcagaggagaggcagaggataaaagaggaagagaaaagggcagcagaggagaggcaaagggccagggcagaggaggaagagaaggctaaggtagaagagcagaaacgtaacaagcagctagaagagaaaaaacatgccatgcaagagacaaagataaaaggggaaaaggtagaacagaaaatagaagggaaatgggtaaatgaaaagaaagcacaagaagataaacttcagacagctgtcctaaagaaacagggagaagagaagggaactaaagtgcaagctaaaagagaaaagctccaagaagacaagcctaccttcaaaaaagaagagatcaaagatgaaaagattaaaaaggacaaagaacccaaagaagaagttaagagcttcatggatcgaaagaagggatttacagaagttaagtcgcagaatggagaattcatgacccacaaacttaaacatactgagaatactttcagccgccctggagggagggccagcgtggacaccaaggaggctgagggcgccccccaggtggaagccggcaaaaggctggaggagcttcgtcgtcgtcgcggggagaccgagagcgaagagttcgagaagctcaaacagaagcagcaggaggcggctttggagctggaggaactcaagaaaaagagggaggagagaaggaaggtcctggaggaggaagagcagaggaggaagcaggaggaagccgatcgaaaactcagagaggaggaagagaagaggaggctaaaggaagagattgaaaggcgaagagcagaagctgctgagaaacgccagaagatgccagaagatggcttgtcagatgacaagaaaccattcaagtgtttcactcctaaaggttcatctctcaagatagaagagcgagcagaatttttgaataagtctgtgcagaaaagcagtggtgtcaaatcgacccatcaagcagcaatagtctccaagattgacagcagactggagcagtataccagtgcaattgagggaacaaaaagcgcaaaacctacaaagccggcagcctcggatcttcctgttcctgctgaaggtgtacgcaacatcaagagtatgtgggagaaagggaatgtgttttcatcccccactgcagcaggcacaccaaataaggaaactgctggcttgaaggtaggggtttctagccgcatcaatgaatggctaactaaaaccccagatggaaacaagtcacctgctcccaaaccttctgacttgagaccaggagacgtatccagcaagcggaacctctgggaaaagcaatctgtggataaggtcacttcccccactaaggtttgagacagttccagaaagaacccaagctcaagacgcaggacgagctcagttgtagagggctaattcgctctgttttgtatttatgttgatttactaaattgggttcattatcttttatttttcaatatcccagtaaacccatgtatattatcactatatttaataatcacagtctagagatgttcatggtaaaagtactgcctttgcacaggagcctgtttctaaagaaacccatgctgtgaaatagagacttttctactgatcatcataactctgtatctgagcagtgataccaaccacatctgaagtcaacagaagatccaagtttaaaattgcctgcggaatgtgtgcagtatctagaaaaatgaaccgtagtttttgtttttttaaatacagaagtcatgttgtttctgcactttataataaagcatggaagaaattatcttagtaggcaattgtaacactttttgaaagtaacccatttcagatttgaaatactgcaataatggttgtctttaaaaaaaaaaaagaaatgtactgttaaggtattactttttttcatgctgatgattcatatctaaattacattattatgttagctgacagtggtactgattttttaggttggttgttttgtggatttctttagtagtgatagtagcctgaaccacattttagataactcaattatgtatgtatgtgcatacacatatacaaacacactaatggtagaatgcttttttatgtgctagactattatatttagtagtatgtcattgtaactagccaatatcacagcttttgaaaaattaaaaaatcacactatattaatatttcatatttgccaacagaaacatggcagataggtatcaatatgttttcaatgcctgatgacctataagaagaaagtattgaaaagaagagagattagaactgttagaaggagttgaaattttctaaaagacatagtatttagtttataattaaatgcattcttgaagtccagtgtgaattttattaatgctatcatctcgaccaagctcaaagcctacttattagaaacaatgaagttcacaataggtcataaggtctcttccttttctaaaattgaaagacaagaaatttagtgccaatattgtacagacagaaattccatgtatgagtctcaacaaagactacctttggctaaatgtctagaagcagagaagtaaagtgagcaaaatccagtgttgaggagtcatgacagtactttgatctttatatactctgaagcatttcttcaaacttttctacttttatttgtcattgatacctgtagtaagttgacaatgtggtgaaatttcaaaattatatgtaacttctactagttttactttctcccccaagtcttttttaactcatgatttttacacacacaatccagaacttattatatagcctctaagtctttattcttcacagtagataatgaaagagtcctccagtgtcttggcaaaatgttctagtatagctggatacatacagtggagttctataaactcatacctcagtggacttaaccaaaattgtgttagtctcaattcctaccacactgagggagcctcccaaataactattttcttatctgcagtattcctccagaagagctaaccagggcagggctggcatgagaagtgacatctgcgttacaaagtctatcttcctcataagtctgtaaagagcaattgaatcttctagctttagcaaacctaagccaaaggaaggaaagccacgaagaatgcagaagtcaaaccctcatgacaaagtaggcacaagtctacaataagctaaatcagaatttacaaatacaagtgtcccaggtagcattgactcccgtcattggagtgaaatggatcaaagtttgaattaaggcctatggtaaggtaacattgctttgttgtacttttgaacaagagctcctcctgatcactattacatatttttctagaaaatctaaagttcagaagagaatgtatcactgctgacttttattccaatatttggatggagtaagttttagggtagaattttgttcagtttggatttaatcttttgaaaagtaaattccttgtttactggtttgactataattctctgttatctttacgaggtaaaactgcaagctgactagcatgttctgtgaatctgccattcctaaaaattttataaacacttgatacttttcactgataatggatcgctccaataaacatatattgtgaaaatgcatccacaataaatggaattccttcctgcaaaa

SEQ ID NO: 440397 - DNA, 3640 bp, Homo sapiens
ggtcgcctactactactaaattcgcggccgcgtcgacagggcagcagaggagaggcagaggataaaggaggaagagaaaagggcagcagaggagaggcagaggataaaagaggaagagaaaagggcagcagaggagaggcaaagggccagggcagaggaggaagagaaggctaaggtagaagagcagaaacgtaacaagcagctagaagagaaaaaacatgccatgcaagagacaaagataaaaggggaaaaggtagaacagaaaatagaagggaaatgggtaaatgaaaagaaagcacaagaagataaacttcagacagctgtcctaaagaaacagggagaagagaagggaactaaagtgcaagctaaaagagaaaagctccaagaagacaagcctaccttcaaaaaagaagagatcaaagatgaaaagattaaaaaggacaaagaacccaaagaagaagttaagagcttcatggatcgaaagaagggatttacagaagttaagtcgcagaatggagaattcatgacccacaaacttaaacatactgagaatactttcagccgccctggagggagggccagcgtggacaccaaggaggctgagggcgccccccaggtggaagccggcaaaaggctggaggagcttcgtcgtcgtcgcggggagaccgagagcgaagagttcgagaagctcaaacagaagcagcaggaggcggctttggagctggaggaactcaagaaaaagagggaggagagaaggaaggtcctggaggaggaagagcagaggaggaagcaggaggaagccgatcgaaaactcagagaggaggaagagaagaggaggctaaaggaagagattgaaaggcgaagagcagaagctgctgagaaacgccagaagatgccagaagatggcttgtcagatgacaagaaaccattcaagtgtttcactcctaaaggttcatctctcaagatagaagagcgagcagaatttttgaataagtctgtgcagaaaagcagtggtgtcaaatcgacccatcaagcagcaatagtctccaagattgacagcagactggagcagtataccagtgcaattgaggcaacatcaagagtatgtgggagaaagggaatgtgttttcatcccccactgcagcaggcacaccaaataaggaaactgctggcttgaaggtaggggtttctagccgcatcaatgaatggctaactaaaaccccagatggaaacaagtcacctgctcccaaaccttctgacttgagaccaggagacgtatccagcaagcggaacctctgggaaaagcaatctgtggataaggtcacttcccccactaaggtttgagacagttccagaaagaacccaagctcaagacgcaggacgagctcagttgtagagggctaattcgctctgttttgtatttatgttgatttactaaattgggttcattatcttttatttttcaatatcccagtaaacccatgtatattatcactatatttaataatcacagtctagagatgttcatggtaaaagtactgcctttgcacaggagcctgtttctaaagaaacccatgctgtgaaatagagacttttctactgatcatcataactctgtatctgagcagtgataccaaccacatctgaagtcaacagaagatccaagtttaaaattgcctgcggaatgtgtgcagtatctagaaaaatgaaccgtagtttttgtttttttaaatacagaagtcatgttgtttctgcactttataataaagcatggaagaaattatcttagtaggcaattgtaacactttttgaaagtaacccatttcagatttgaaatactgcaataatggttgtctttaaaaaaaaaaaagaaatgtactgttaaggtattactttttttcatgctgatgattcatatctaaattacattattatgttagctgacagtggtactgattttttaggttggttgttttgtggatttctttagtagtgatagtagcctgaaccacattttagataactcaattatgtatgtatgtgcatacacatatacaaacacactaatggtagaatgcttttttatgtgctagactattatatttagtagtatgtcattgtaactagccaatatcacagcttttgaaaaattaaaaaatcacactatattaatatttcatatttgccaacagaaacatggcagataggtatcaatatgttttcaatgcctgatgacctataagaagaaagtattgaaaagaagagagattagaactgttagaaggagttgaaattttctaaaagacatagtatttagtttataattaaatgcattcttgaagtccagtgtgaattttattaatgctatcatctcgaccaagctcaaagcctacttattagaaacaatgaagttcacaataggtcataaggtctcttccttttctaaaattgaaagacaagaaatttagtgccaatattgtacagacagaaattccatgtatgagtctcaacaaagactacctttggctaaatgtctagaagcagagaagtaaagtgagcaaaatccagtgttgaggagtcatgacagtactttgatctttatatactctgaagcatttcttcaaacttttctacttttatttgtcattgatacctgtagtaagttgacaatgtggtgaaatttcaaaattatatgtaacttctactagttttactttctcccccaagtcttttttaactcatgatttttacacacacaatccagaacttattatatagcctctaagtctttattcttcacagtagataatgaaagagtcctccagtgtcttggcaaaatgttctagtatagctggatacatacagtggagttctataaactcatacctcagtggacttaaccaaaattgtgttagtctcaattcctaccacactgagggagcctcccaaataactattttcttatctgcagtattcctccagaagagctaaccagggcagggctggcatgagaagtgacatctgcgttacaaagtctatcttcctcataagtctgtaaagagcaattgaatcttctagctttagcaaacctaagccaaaggaaggaaagccacgaagaatgcagaagtcaaaccctcatgacaaagtaggcacaagtctacaataagctaaatcagaatttacaaatacaagtgtcccaggtagcattgactcccgtcattggagtgaaatggatcaaagtttgaattaaggcctatggtaaggtaacattgctttgttgtacttttgaacaagagctcctcctgatcactattacatatttttctagaaaatctaaagttcagaagagaatgtatcactgctgacttttattccaatatttggatggagtaagttttagggtagaattttgttcagtttggatttaatcttttgaaaagtaaattccttgtttactggtttgactataattctctgttatctttacgaggtaaaactgcaagctgactagcatgttctgtgaatctgccattcctaaaaattttataaacacttgatacttttcactgataatggatcgctccaataaacatatattgtgaaaatgcatccacaataaatggaattccttcctgcaaaa

SEQ ID NO: 440398 - DNA, 3516 bp, Homo sapiens
ggtcgcctactactactaaattcgcggccgcgtcgacagggcagcagaggagaggcagaggataaaggaggaagagaaaagggcagcagaggagaggcagaggataaaagaggaagagaaaagggcagcagaggagaggcaaagggccagggcagaggaggaagagaaggctaaggtagaagagcagaaacgtaacaagcagctagaagagaaaaaacatgccatgcaagagacaaagataaaaggggaaaaggtagaacagaaaatagaagggaaatgggtaaatgaaaagaaagcacaagaagataaacttcagacagctgtcctaaagaaacagggagaagagaagggaactaaagtgcaagctaaaagagaaaagctccaagaagacaagcctaccttcaaaaaagaagagatcaaagatgaaaagattaaaaaggacaaagaacccaaagaagaagttaagagcttcatggatcgaaagaagggatttacagaagttaagtcgcagaatggagaattcatgacccacaaacttaaacatactgagaatactttcagccgccctggagggagggccagcgtggacaccaaggaggctgagggcgccccccaggtggaagccggcaaaaggctggaggagcttcgtcgtcgtcgcggggagaccgagagcgaagagttcgagaagctcaaacagaagcagcaggaggcggctttggagctggaggaactcaagaaaaagagggaggagagaaggaaggtcctggaggaggaagagcagaggaggaagcaggaggaagccgatcgaaaactcagagaggaggaagagaagaggaggctaaaggaagagattgaaaggcgaagagcagaagctgctgagaaacgccagaagatgccagaagatggcttgtcagatgacaagaaaccattcaagtgtttcactcctaaaggttcatctctcaagatagaagagcgagcagaatttttgaataagtctgtgcagaaaagcagtggtgtcaaatcgacccatcaagcagcaatagtctccaagattgacagcagactggagcagtataccagtgcaattgagtaaaaccccagatggaaacaagtcacctgctcccaaaccttctgacttgagaccaggagacgtatccagcaagcggaacctctgggaaaagcaatctgtggataaggtcacttcccccactaaggtttgagacagttccagaaagaacccaagctcaagacgcaggacgagctcagttgtagagggctaattcgctctgttttgtatttatgttgatttactaaattgggttcattatcttttatttttcaatatcccagtaaacccatgtatattatcactatatttaataatcacagtctagagatgttcatggtaaaagtactgcctttgcacaggagcctgtttctaaagaaacccatgctgtgaaatagagacttttctactgatcatcataactctgtatctgagcagtgataccaaccacatctgaagtcaacagaagatccaagtttaaaattgcctgcggaatgtgtgcagtatctagaaaaatgaaccgtagtttttgtttttttaaatacagaagtcatgttgtttctgcactttataataaagcatggaagaaattatcttagtaggcaattgtaacactttttgaaagtaacccatttcagatttgaaatactgcaataatggttgtctttaaaaaaaaaaaagaaatgtactgttaaggtattactttttttcatgctgatgattcatatctaaattacattattatgttagctgacagtggtactgattttttaggttggttgttttgtggatttctttagtagtgatagtagcctgaaccacattttagataactcaattatgtatgtatgtgcatacacatatacaaacacactaatggtagaatgcttttttatgtgctagactattatatttagtagtatgtcattgtaactagccaatatcacagcttttgaaaaattaaaaaatcacactatattaatatttcatatttgccaacagaaacatggcagataggtatcaatatgttttcaatgcctgatgacctataagaagaaagtattgaaaagaagagagattagaactgttagaaggagttgaaattttctaaaagacatagtatttagtttataattaaatgcattcttgaagtccagtgtgaattttattaatgctatcatctcgaccaagctcaaagcctacttattagaaacaatgaagttcacaataggtcataaggtctcttccttttctaaaattgaaagacaagaaatttagtgccaatattgtacagacagaaattccatgtatgagtctcaacaaagactacctttggctaaatgtctagaagcagagaagtaaagtgagcaaaatccagtgttgaggagtcatgacagtactttgatctttatatactctgaagcatttcttcaaacttttctacttttatttgtcattgatacctgtagtaagttgacaatgtggtgaaatttcaaaattatatgtaacttctactagttttactttctcccccaagtcttttttaactcatgatttttacacacacaatccagaacttattatatagcctctaagtctttattcttcacagtagataatgaaagagtcctccagtgtcttggcaaaatgttctagtatagctggatacatacagtggagttctataaactcatacctcagtggacttaaccaaaattgtgttagtctcaattcctaccacactgagggagcctcccaaataactattttcttatctgcagtattcctccagaagagctaaccagggcagggctggcatgagaagtgacatctgcgttacaaagtctatcttcctcataagtctgtaaagagcaattgaatcttctagctttagcaaacctaagccaaaggaaggaaagccacgaagaatgcagaagtcaaaccctcatgacaaagtaggcacaagtctacaataagctaaatcagaatttacaaatacaagtgtcccaggtagcattgactcccgtcattggagtgaaatggatcaaagtttgaattaaggcctatggtaaggtaacattgctttgttgtacttttgaacaagagctcctcctgatcactattacatatttttctagaaaatctaaagttcagaagagaatgtatcactgctgacttttattccaatatttggatggagtaagttttagggtagaattttgttcagtttggatttaatcttttgaaaagtaaattccttgtttactggtttgactataattctctgttatctttacgaggtaaaactgcaagctgactagcatgttctgtgaatctgccattcctaaaaattttataaacacttgatacttttcactgataatggatcgctccaataaacatatattgtgaaaatgcatccacaataaatggaattccttcctgcaaaa

SEQ ID NO: 440399 - DNA, 3837 bp, Homo sapiens
  misc_feature (2606)..(2607): n is a, c, g, or t
  misc_feature (2620)..(2620): n is a, c, g, or t
ggtcgcctactactactaaattcgcggccgcgtcgacagggcagcagaggagaggcagaggataaaggaggaagagaaaagggcagcagaggagaggcagaggataaaagaggaagagaaaagggcagcagaggagaggcaaagggccagggcagaggaggaagagaaggctaaggtagaagagcagaaacgtaacaagcagctagaagagaaaaaacatgccatgcaagagacaaagataaaaggggaaaaggtagaacagaaaatagaagggaaatgggtaaatgaaaagaaagcacaagaagataaacttcagacagctgtcctaaagaaacagggagaagagaagggaactaaagtgcaagctaaaagagaaaagctccaagaagacaagcctaccttcaaaaaagaagagatcaaagatgaaaagattaaaaaggacaaagaacccaaagaagaagttaagagcttcatggatcgaaagaagggatttacagaagttaagtcgcagaatggagaattcatgacccacaaacttaaacatactgagaatactttcagccgccctggagggagggccagcgtggacaccaaggaggctgagggcgccccccaggtggaagccggcaaaaggctggaggagcttcgtcgtcgtcgcggggagaccgagagcgaagagttcgagaagctcaaacagaagcagcaggaggcggctttggagctggaggaactcaagaaaaagagggaggagagaaggaaggtcctggaggaggaagagcagaggaggaagcaggaggaagccgatcgaaaactcagagaggaggaagagaagaggaggctaaaggaagagattgaaaggcgaagagcagaagctgctgagaaacgccagaagatgccagaagatggcttgtcagatgacaagaaaccattcaagtgtttcactcctaaaggttcatctctcaagatagaagagcgagcagaatttttgaataagtctgtgcagaaaagcagtggtgtcaaatcgacccatcaagcagcaatagtctccaagattgacagcagactggagcagtataccagtgcaattgagggaacaaaaagcgcaaaacctacaaagccggcagcctcggatcttcctgttcctgctgaaggtgtacgcaacatcaagagtatgtgggagaaagggaatgtgttttcatcccccactgcagcaggcacaccaaataaggaaactgctggcttgaaggtaggggtttctagccgcatcaatgaatggctaactaaaaccccagatggaaacaagtcacctgctcccaaaccttctgacttgagaccaggagacgtatccagcaagcggaacctctgggaaaagcaatctgtggataaggtcacttcccccactaaggtttgagacagttccagaaagaacccaagctcaagacgcaggacgagctcagttgtagagggctaattcgctctgttttgtatttatgttgatttactaaattgggttcattatcttttatttttcaatatcccagtaaacccatgtatattatcactatatttaataatcacagtctagagatgttcatggtaaaagtactgcctttgcacaggagcctgtttctaaagaaacccatgctgtgaaatagagacttttctactgatcatcataactctgtatctgagcagtgataccaaccacatctgaagtcaacagaagatccaagtttaaaattgcctgcggaatgtgtgcagtatctagaaaaatgaaccgtagtttttgtttttttaaatacagaagtcatgttgtttctgcactttataataaagcatggaagaaattatcttagtaggcaattgtaacactttttgaaagtaacccatttcagatttgaaatactgcaataatggttgtctttaaaaaaaaaaaagaaatgtactgttaaggtattactttttttcatgctgatgattcatatctaaattacattattatgttagctgacagtggtactgattttttaggttggttgttttgtggatttctttagtagtgatagtagcctgaaccacattttagataactcaattatgtatgtatgtgcatacacatatacaaacacactaatggtagaatgcttttttatgtgctagactattatatttagtagtatgtcattgtaactagccaatatcacagcttttgaaaaattaaaaaatcacactatattaatatttcatatttgccaacagaaacatggcagataggtatcaatatgttttcaatgcctgatgacctataagaagaaagtattgaaaagaagagagattagaactgttagaaggagttgaaattttctaaaagacatagtatttagtttataattaaatgcattcttgaagtccagtgtgaattttattaatgctatcatctcgaccaagctcaaagcctacttattagaaacaatgaagttcacaataggtcataaggtctcttccttttctaaaattgaaagacaagaaatttagtgccaatattgtacagacagaaattccatgtatgagtctcaacaaagactacctttgggcgttaaaacaannttgggattttccnttttaacggacaacaaaggcggcccaaaccgccacaccgcgacaacaaacccgcggattttaagccaccaaccgcgttgggcaaccggccccaaaaaggaccaacttcccccaaggggttggcgtttccggaagcgggaacggtccacttgaaccaagttaacttttggaactcttttcataataacctctggaaggccaaacttttctacttttatttgtcattgatacctgtagtaagttgacaatgtggtgaaatttcaaaattatatgtaacttctactagttttactttctcccccaagtcttttttaactcatgatttttacacacacaatccagaacttattatatagcctctaagtctttattcttcacagtagataatgaaagagtcctccagtgtcttggcaaaatgttctagtatagctggatacatacagtggagttctataaactcatacctcagtggacttaaccaaaattgtgttagtctcaattcctaccacactgagggagcctcccaaataactattttcttatctgcagtattcctccagaagagctaaccagggcagggctggcatgagaagtgacatctgcgttacaaagtctatcttcctcataagtctgtaaagagcaattgaatcttctagctttagcaaacctaagccaaaggaaggaaagccacgaagaatgcagaagtcaaaccctcatgacaaagtaggcacaagtctacaataagctaaatcagaatttacaaatacaagtgtcccaggtagcattgactcccgtcattggagtgaaatggatcaaagtttgaattaaggcctatggtaaggtaacattgctttgttgtacttttgaacaagagctcctcctgatcactattacatatttttctagaaaatctaaagttcagaagagaatgtatcactgctgacttttattccaatatttggatggagtaagttttagggtagaattttgttcagtttggatttaatcttttgaaaagtaaattccttgtttactggtttgactataattctctgttatctttacgaggtaaaactgcaagctgactagcatgttctgtgaatctgccattcctaaaaattttataaacacttgatacttttcactgataatggatcgctccaataaacatatattgtgaaaatgcatccacaataaatggaattccttcctgcaaaa

SEQ ID NO: 440400 - DNA, 3493 bp, Homo sapiens
ggtcgcctactactactaaattcgcggccgcgtcgacagggcagcagaggagaggcagaggataaaggaggaagagaaaagggcagcagaggagaggcagaggataaaagaggaagagaaaagggcagcagaggagaggcaaagggccagggcagaggaggaagagaaggctaaggtagaagagcagaaacgtaacaagcagctagaagagaaaaaacatgccatgcaagagacaaagataaaaggggaaaaggtagaacagaaaatagaagggaaatgggtaaatgaaaagaaagcacaagaagataaacttcagacagctgtcctaaagaaacagggagaagagaagggaactaaagtgcaagctaaaagagaaaagctccaagaagacaagcctaccttcaaaaaagaagagatcaaagatgaaaagattaaaaaggacaaagaacccaaagaagaagttaagagcttcatggatcgaaagaagggatttacagaagttaagtcgcagaatggagaattcatgacccacaaacttaaacatactgagaatactttcagccgccctggagggagggccagcgtggacaccaaggaggctgagggcgccccccaggtggaagccggcaaaaggctggaggagcttcgtcgtcgtcgcggggagaccgagagcgaagagttcgagaagctcaaacagaagcagcaggaggcggctttggagctggaggaactcaagaaaaagagggaggagagaaggaaggtcctggaggaggaagagcagaggaggaagcaggaggaagccgatcgaaaactcagagaggaggaagagaagaggaggctaaaggaagagattgaaaggcgaagagcagaagctgctgagaaacgccagaagatgccagaagatggcttgtcagatgacaagaaaccattcaagtgtttcactcctaaaggttcatctctcaagatagaagagcgagcagaatttttgaataagtctgtgcagaaaagcagtggtgtcaaatcgacccatcaagcagcaatagtctccaagattgacagcagactggagcagtataccagtgcaattgagggaacaaaaagcgcaaaacctacaaagccggcagcctcggatcttcctgttcctgctgaaggtgtacgcaacatcaagagtatgtgggagaaagggaatgtgttttcatcccccactgcagcaggcacaccaaataaggaaactgctggcttgaaggtaggggtttctagccgcatcaatgaatggctaactaaaaccccagatggaaacaagtcacctgctcccaaaccttctgacttgagaccaggagacgtatccagcaagcggaacctctgggaaaagcaatctgtggataaggtcacttcccccactaaggagcctgtttctaaagaaacccatgctgtgaaatagagacttttctactgatcatcataactctgtatctgagcagtgataccaaccacatctgaagtcaacagaagatccaagtttaaaattgcctgcggaatgtgtgcagtatctagaaaaatgaaccgtagtttttgtttttttaaatacagaagtcatgttgtttctgcactttataataaagcatggaagaaattatcttagtaggcaattgtaacactttttgaaagtaacccatttcagatttgaaatactgcaataatggttgtctttaaaaaaaaaaaagaaatgtactgttaaggtattactttttttcatgctgatgattcatatctaaattacattattatgttagctgacagtggtactgattttttaggttggttgttttgtggatttctttagtagtgatagtagcctgaaccacattttagataactcaattatgtatgtatgtgcatacacatatacaaacacactaatggtagaatgcttttttatgtgctagactattatatttagtagtatgtcattgtaactagccaatatcacagcttttgaaaaattaaaaaatcacactatattaatatttcatatttgccaacagaaacatggcagataggtatcaatatgttttcaatgcctgatgacctataagaagaaagtattgaaaagaagagagattagaactgttagaaggagttgaaattttctaaaagacatagtatttagtttataattaaatgcattcttgaagtccagtgtgaattttattaatgctatcatctcgaccaagctcaaagcctacttattagaaacaatgaagttcacaataggtcataaggtctcttccttttctaaaattgaaagacaagaaatttagtgccaatattgtacagacagaaattccatgtatgagtctcaacaaagactacctttggctaaatgtctagaagcagagaagtaaagtgagcaaaatccagtgttgaggagtcatgacagtactttgatctttatatactctgaagcatttcttcaaacttttctacttttatttgtcattgatacctgtagtaagttgacaatgtggtgaaatttcaaaattatatgtaacttctactagttttactttctcccccaagtcttttttaactcatgatttttacacacacaatccagaacttattatatagcctctaagtctttattcttcacagtagataatgaaagagtcctccagtgtcttggcaaaatgttctagtatagctggatacatacagtggagttctataaactcatacctcagtggacttaaccaaaattgtgttagtctcaattcctaccacactgagggagcctcccaaataactattttcttatctgcagtattcctccagaagagctaaccagggcagggctggcatgagaagtgacatctgcgttacaaagtctatcttcctcataagtctgtaaagagcaattgaatcttctagctttagcaaacctaagccaaaggaaggaaagccacgaagaatgcagaagtcaaaccctcatgacaaagtaggcacaagtctacaataagctaaatcagaatttacaaatacaagtgtcccaggtagcattgactcccgtcattggagtgaaatggatcaaagtttgaattaaggcctatggtaaggtaacattgctttgttgtacttttgaacaagagctcctcctgatcactattacatatttttctagaaaatctaaagttcagaagagaatgtatcactgctgacttttattccaatatttggatggagtaagttttagggtagaattttgttcagtttggatttaatcttttgaaaagtaaattccttgtttactggtttgactataattctctgttatctttacgaggtaaaactgcaagctgactagcatgttctgtgaatctgccattcctaaaaattttataaacacttgatacttttcactgataatggatcgctccaataaacatatattgtgaaaatgcatccacaataaatggaattccttcctgcaaaa

SEQ ID NO: 440401 - DNA, 3656 bp, Homo sapiens
ggtcgcctactactactaaattcgcggccgcgtcgacagggcagcagaggagaggcagaggataaaggaggaagagaaaagggcagcagaggagaggcagaggataaaagaggaagagaaaagggcagcagaggagaggcaaagggccagggcagaggaggaagagaaggctaaggtagaagagcagaaacgtaacaagcagctagaagagaaaaaacatgccatgcaagagacaaagataaaaggggaaaaggtagaacagaaaatagaagggaaatgggtaaatgaaaagaaagcacaagaagataaacttcagacagctgtcctaaagaaacagggagaagagaagggaactaaagtgcaagctaaaagagaaaagctccaagaagacaagcctaccttcaaaaaagaagagatcaaagatgaaaagattaaaaaggacaaagaacccaaagaagaagttaagagcttcatggatcgaaagaagggatttacagaagttaagtcgcagaatggagaattcatgacccacaaacttaaacatactgagaatactttcagccgccctggagggagggccagcgtggacaccaaggaggctgagggcgccccccaggtggaagccggcaaaaggctggaggagcttcgtcgtcgtcgcggggagaccgagagcgaagagttcgagaagctcaaacagaagcagcaggaggcggctttggagctggaggaactcaagaaaaagagggaggagagaaggaaggtcctggaggaggaagagcagaggaggaagcaggaggaagccgatcgaaaactcagagaggaggaagagaagaggaggctaaaggaagagattgaaaggcgaagagcagaagctgctgagaaacgccagaagatgccagaagatggcttgtcagatgacaagaaaccattcaagtgtttcactcctaaaggttcatctctcaagatagaagagcgagcagaatttttgaataagtctgtgcagaaaagcagtggtgtcaaatcgacccatcaagcagcaatagtctccaagattgacagcagactggagcagtataccagtgcaattgagggaacaaaaagcgcaaaacctacaaagccggcagcctcggatcttcctgttcctgctgaaggtgtacgcaacatcaagagtatgtgggagaaagggaatgtgttttcatcccccactgcagcaggcacaccaaataaggaaactgctggcttgaaggtaggggtttctagccgcatcaatgaatggctaactaaaaccccagatggaaacaagtcacctgctcccaaaccttctgacttgagaccaggagacgtatccagcaagcggaacctctgggaaaagcaatctgtggataaggtcacttcccccactaaggtttgagacagttccagaaagaacccaagctcaagacgcaggacgagctcagttgtagagggctaattcgctctgttttgtatttatgttgatttactaaattgggttcattatcttttatttttcaatatcccagtaaacccatgtatattatcactatatttaataatcacagtctagagatgttcatggtaaaagtactgcctttgcacaggagcctgtttctaaagaaacccatgctgtgaaatagagacttttctactgatcatcataactctgtatctgagcagtgataccaaccacatctgaagtcaacagaagatccaagtttaaaattgcctgcggaatgtgtgcagtatctagaaaaatgtataataaagcatggaagaaattatcttagtaggcaattgtaacactttttgaaagtaacccatttcagatttgaaatactgcaataatggttgtctttaaaaaaaaaaaagaaatgtactgttaaggtattactttttttcatgctgatgattcatatctaaattacattattatgttagctgacagtggtactgattttttaggttggttgttttgtggatttctttagtagtgatagtagcctgaaccacattttagataactcaattatgtatgtatgtgcatacacatatacaaacacactaatggtagaatgcttttttatgtgctagactattatatttagtagtatgtcattgtaactagccaatatcacagcttttgaaaaattaaaaaatcacactatattaatatttcatatttgccaacagaaacatggcagataggtatcaatatgttttcaatgcctgatgacctataagaagaaagtattgaaaagaagagagattagaactgttagaaggagttgaaattttctaaaagacatagtatttagtttataattaaatgcattcttgaagtccagtgtgaattttattaatgctatcatctcgaccaagctcaaagcctacttattagaaacaatgaagttcacaataggtcataaggtctcttccttttctaaaattgaaagacaagaaatttagtgccaatattgtacagacagaaattccatgtatgagtctcaacaaagactacctttggctaaatgtctagaagcagagaagtaaagtgagcaaaatccagtgttgaggagtcatgacagtactttgatctttatatactctgaagcatttcttcaaacttttctacttttatttgtcattgatacctgtagtaagttgacaatgtggtgaaatttcaaaattatatgtaacttctactagttttactttctcccccaagtcttttttaactcatgatttttacacacacaatccagaacttattatatagcctctaagtctttattcttcacagtagataatgaaagagtcctccagtgtcttggcaaaatgttctagtatagctggatacatacagtggagttctataaactcatacctcagtggacttaaccaaaattgtgttagtctcaattcctaccacactgagggagcctcccaaataactattttcttatctgcagtattcctccagaagagctaaccagggcagggctggcatgagaagtgacatctgcgttacaaagtctatcttcctcataagtctgtaaagagcaattgaatcttctagctttagcaaacctaagccaaaggaaggaaagccacgaagaatgcagaagtcaaaccctcatgacaaagtaggcacaagtctacaataagctaaatcagaatttacaaatacaagtgtcccaggtagcattgactcccgtcattggagtgaaatggatcaaagtttgaattaaggcctatggtaaggtaacattgctttgttgtacttttgaacaagagctcctcctgatcactattacatatttttctagaaaatctaaagttcagaagagaatgtatcactgctgacttttattccaatatttggatggagtaagttttagggtagaattttgttcagtttggatttaatcttttgaaaagtaaattccttgtttactggtttgactataattctctgttatctttacgaggtaaaactgcaagctgactagcatgttctgtgaatctgccattcctaaaaattttataaacacttgatacttttcactgataatggatcgctccaataaacatatattgtgaaaatgcatccacaataaatggaattccttcctgcaaaa

SEQ ID NO: 440402 - DNA, 3445 bp, Homo sapiens
ggtcgcctactactactaaattcgcggccgcgtcgacagggcagcagaggagaggcagaggataaaggaggaagagaaaagggcagcagaggagaggcagaggataaaagaggaagagaaaagggcagcagaggagaggcaaagggccagggcagaggaggaagagaaggctaaggtagaagagcagaaacgtaacaagcagctagaagagaaaaaacatgccatgcaagagacaaagataaaaggggaaaaggtagaacagaaaatagaagggaaatgggtaaatgaaaagaaagcacaagaagataaacttcagacagctgtcctaaagaaacagggagaagagaagggaactaaagtgcaagctaaaagagaaaagctccaagaagacaagcctaccttcaaaaaagaagagatcaaagatgaaaagattaaaaaggacaaagaacccaaagaagaagttaagagcttcatggatcgaaagaagggatttacagaagttaagtcgcagaatggagaattcatgacccacaaacttaaacatactgagaatactttcagccgccctggagggagggccagcgtggacaccaaggaggctgagggcgccccccaggtggaagccggcaaaaggctggaggagcttcgtcgtcgtcgcggggagaccgagagcgaagagttcgagaagctcaaacagaagcagcaggaggcggctttggagctggaggaactcaagaaaaagagggaggagagaaggaaggtcctggaggaggaagagcagaggaggaagcaggaggaagccgatcgaaaactcagagaggaggaagagaagaggaggctaaaggaagagattgaaaggcgaagagcagaagctgctgagaaacgccagaagatgccagaagatggcttgtcagatgacaagaaaccattcaagtgtttcactcctaaaggttcatctctcaagatagaagagcgagcagaatttttgaataagtctgtgcagaaaagcagtggtgtcaaatcgacccatcaagcagcaatagtctccaagattgacagcagactggagcagtataccagtgcaattgagggaacaaaaagcgcaaaacctacaaagccggcagcctcggatcttcctgttcctgctgaaggtgtacgcaacatcaagagtatgtgggagaaagggaatgtgttttcatcccccactgcagcaggcacaccaaataaggaaactgctggcttgaaggtaggggtttctagccgcatcaatgaatggctaactaaaaccccagatggaaacaagtcacctgctcccaaaccttctgacttgagaccaggagacgtatccagcaagcggaacctctgggaaaagcaatctgtggataaggtcacttcccccactaaggagcctgtttctaaagaaacccatgctgtgaaatagagacttttctactgatcatcataactctgtatctgagcagtgataccaaccacatctgaagtcaacagaagatccaagtttaaaattgcctgcggaatgtgtgcagtatctagaaaaatgaaccgtagtttttgtttttttaaatacagaagtcatgttgtttctgcactttataataaagcatggaagaaattatcttagtaggcaattgtaacactttttgaaagtaacccatttcagatttgaaatactgcaataatggttgtctttaaaaaaaaaaatctaaattacattattatgttagctgacagtggtactgattttttaggttggttgttttgtggatttctttagtagtgatagtagcctgaaccacattttagataactcaattatgtatgtatgtgcatacacatatacaaacacactaatggtagaatgcttttttatgtgctagactattatatttagtagtatgtcattgtaactagccaatatcacagcttttgaaaaattaaaaaatcacactatattaatatttcatatttgccaacagaaacatggcagataggtatcaatatgttttcaatgcctgatgacctataagaagaaagtattgaaaagaagagagattagaactgttagaaggagttgaaattttctaaaagacatagtatttagtttataattaaatgcattcttgaagtccagtgtgaattttattaatgctatcatctcgaccaagctcaaagcctacttattagaaacaatgaagttcacaataggtcataaggtctcttccttttctaaaattgaaagacaagaaatttagtgccaatattgtacagacagaaattccatgtatgagtctcaacaaagactacctttggctaaatgtctagaagcagagaagtaaagtgagcaaaatccagtgttgaggagtcatgacagtactttgatctttatatactctgaagcatttcttcaaacttttctacttttatttgtcattgatacctgtagtaagttgacaatgtggtgaaatttcaaaattatatgtaacttctactagttttactttctcccccaagtcttttttaactcatgatttttacacacacaatccagaacttattatatagcctctaagtctttattcttcacagtagataatgaaagagtcctccagtgtcttggcaaaatgttctagtatagctggatacatacagtggagttctataaactcatacctcagtggacttaaccaaaattgtgttagtctcaattcctaccacactgagggagcctcccaaataactattttcttatctgcagtattcctccagaagagctaaccagggcagggctggcatgagaagtgacatctgcgttacaaagtctatcttcctcataagtctgtaaagagcaattgaatcttctagctttagcaaacctaagccaaaggaaggaaagccacgaagaatgcagaagtcaaaccctcatgacaaagtaggcacaagtctacaataagctaaatcagaatttacaaatacaagtgtcccaggtagcattgactcccgtcattggagtgaaatggatcaaagtttgaattaaggcctatggtaaggtaacattgctttgttgtacttttgaacaagagctcctcctgatcactattacatatttttctagaaaatctaaagttcagaagagaatgtatcactgctgacttttattccaatatttggatggagtaagttttagggtagaattttgttcagtttggatttaatcttttgaaaagtaaattccttgtttactggtttgactataattctctgttatctttacgaggtaaaactgcaagctgactagcatgttctgtgaatctgccattcctaaaaattttataaacacttgatacttttcactgataatggatcgctccaataaacatatattgtgaaaatgcatccacaataaatggaattccttcctgcaaaa

SEQ ID NO: 440403 - DNA, 4371 bp, Homo sapiens
ggtcgcctactactactaaattcgcggccgcgtcgacagggcagcagaggagaggcagaggataaaggaggaagagaaaagggcagcagaggagaggcagaggataaaagaggaagagaaaagggcagcagaggagaggcaaagggccagggcagaggaggaagagaaggctaaggtagaagagcagaaacgtaacaagcagctagaagagaaaaaacatgccatgcaagagacaaagataaaaggggaaaaggtagaacagaaaatagaagggaaatgggtaaatgaaaagaaagcacaagaagataaacttcagacagctgtcctaaagaaacagggagaagagaagggaactaaagtgcaagctaaaagagaaaagctccaagaagacaagcctaccttcaaaaaagaagagatcaaagatgaaaagattaaaaaggacaaagaacccaaagaagaagttaagagcttcatggatcgaaagaagggatttacagaagttaagtcgcagaatggagaattcatgacccacaaacttaaacatactgagaatactttcagccgccctggagggagggccagcgtggacaccaaggaggctgagggcgccccccaggtggaagccggcaaaaggctggaggagcttcgtcgtcgtcgcggggagaccgagagcgaagagttcgagaagctcaaacagaagcagcaggaggcggctttggagctggaggaactcaagaaaaagagggaggagagaaggaaggtcctggaggaggaagagcagaggaggaagcaggaggaagccgatcgaaaactcagagaggaggaagagaagaggaggctaaaggaagagattgaaaggcgaagagcagaagctgctgagaaacgccagaagatgccagaagatggcttgtcagatgacaagaaaccattcaagtgtttcactcctaaaggttcatctctcaagatagaagagcgagcagaatttttgaataagtctgtgcagaaaagcagtggtgtcaaatcgacccatcaagcagcaatagtctccaagattgacagcagactggagcagtataccagtgcaattgagggaacaaaaagcgcaaaacctacaaagccggcagcctcggatcttcctgttcctgctgaaggtgtacgcaacatcaagagtatgtgggagaaagggaatgtgttttcatcccccactgcagcaggcacaccaaataaggaaactgctggcttgaaggtaggggtttctagccgcatcaatgaatggctaactaaaaccccagatggaaacaagtcacctgctcccaaaccttctgacttgagaccaggagacgtatccagcaagcggaacctctgggaaaagcaatctgtggataaggtcacttcccccactaaggtttgagacagttccagaaagaacccaagctcaagacgcaggacgagctcagttgtagagggctaattcgctctgttttgtatttatgttgatttactaaattgggttcattatcttttatttttcaatatcccagtaaacccatgtatattatcactatatttaataatcacagtctagagatgttcatggtaaaagtactgcctttgcacaggagcctgtttctaaagaaacccatgctgtgaaatagagacttttctactgatcatcataactctgtatctgagcagtgataccaaccacatctgaagtcaacagaagatccaagtttaaaattgcctgcggaatgtgtgcagtatctagaaaaatgaaccgtagtttttgtttttttaaatacagaagtcatgttgtttctgcactttataataaagcatggaagaaattatcttagtaggcaattgtaacactttttgaaagtaacccatttcagatttgaaatactgcaataatggttgtctttaaaaaaaaaaaagaaatgtactgttaaggtattactttttttcatgctgatgattcatatctaaattacattattatgttagctgacagtggtactgattttttaggttggttgttttgtggatttctttagtagtgatagtagcctgaaccacattttagataactcaattatgtatgtatgtgcatacacatatacaaacacactaatggtagaatgcttttttatgtgctagactattatatttagtagtatgtcattgtaactagccaatatcacagcttttgaaaaattaaaaaatcacactatattaatatttcatatttgccaacagaaacatggcagataggtatcaatatgttttcaatgcctgatgacctataagaagaaagtattgaaaagaagagagattagaactgttagaaggagttgaaattttctaaaagacatagtatttagtttataattaaatgcattcttgaagtccagtgtgaattttattaatgctatcatctcgaccaagctcaaagcctacttattagaaacaatgaagttcacaataggtcataaggtctcttccttttctaaaattgaaagacaagaaatttagtgccaatattgtacagacagaaattccatgtatgagtctcaacaaagactacctttggctaaatgtctagaagcagagaagtaaagtgagcaaaatccagtgttgaggagtcatgacagtactttgatctttatatactctgaagcatttcttcaaacttttctacttttatttgtcattgatacctgtagtaagttgacaatgtggtgaaatttcaaaattatatgtaacttctactagttttactttctcccccaagtcttttttaactcatgatttttacacacacaatccagaacttattatatagcctctaagtctttattcttcacagtagataatgaaagagtcctccagtgtcttggcaaaatgttctagtatagctggatacatacagtggagttctataaactcatacctcagtggacttaaccaaaattgtgttagtctcaattcctaccacactgagggagcctcccaaataactattttcttatctgcagtattcctccagaagagctaaccagggcagggctggcatgagaagtgacatctgcgttacaaagtctatcttcctcataagtctgtaaagagcaattgaatcttctagctttagcaaacctaagccaaaggaaggaaagccacgaagaatgcagaagtcaaaccctcatgacaaagtaggcacaagtctacaataagctaaatcagaatttacaaatacaagtgtcccaggtagcattgactcccgtcattggagtgaaatggatcaaagtttgaattaaggcctatggtaaggtaacattgctttgttgtacttttgaacaagagctcctcctgatcactattacatatttttctagaaaatctaaagttcagaagagaatgtatcactgctgacttttattccaatatttggatggagtaagttttagggtagaattttgttcagtttggatttaatcttttgaaaagtaaattccttgtttactggtttgactataattctctgttatctttacgaggtaaaactgcaagctgactagcatgttctgtgaatctgccattcctaaaaattttataaacacttgatacttttcactgataatggatcgctccaataaacatatattgtgaaaatgcatccacaataaatggaattccttcctgcaaaaaaaaaaaagaagaggaaaaagaaaatcttggggggggctgggcccccggaaaagttttcaagagccaatgcgtttggggggggggcccctgggttgtgaccaggggtccatactgggtcccataaaagaaacaccgggccacggagaaggcgtgtgggcattcaactacaccaaaaataaaaacacgcgcgggggggcaacaagacggactttattgtaatacaaagccaagcagggggtcgccgagggggccagacaggggcacatcgaacagggagctcgcaggcagcacccgattcaaaattaccgccccgacctgggattgcaaaaaggaagcgataccgacgaagaggtcgatgaacaaggctcgaagtcaacggaacacgaaagcgatgcaacaagcaaatgttcgagagcaccgagcgcgacaccgcagaaaagaagtagtagctgaaagcaagagggacaaccaggaacaggcgcaaataatgagaaaaacgagtacgcagagagggaaaggagggaatagaaaaagaggattgggggaccaaaaaaagaaaacaatcgacaaatcacataacgggacggacaaaaagaacaaaagtagacaacaaagcgagagaaaaagaaaaaggcaagcgaaaaaaagaaagaacgaataacc

SEQ ID NO: 440404 - DNA, 1971 bp, Homo sapiens
ggtcgcctactactactaaattcgcggccgcgtcgacagaaccgtagtttttgtttttttaaatacagaagtcatgttgtttctgcactttataataaagcatggaagaaattatcttagtaggcaattgtaacactttttgaaagtaacccatttcagatttgaaatactgcaataatggttgtctttaaaaaaaaaaaagaaatgtactgttaaggtattactttttttcatgctgatgattcatatctaaattacattattatgttagctgacagtggtactgattttttaggttggttgttttgtggatttctttagtagtgatagtagcctgaaccacattttagataactcaattatgtatgtatgtgcatacacatatacaaacacactaatggtagaatgcttttttatgtgctagactattatatttagtagtatgtcattgtaactagccaatatcacagcttttgaaaaattaaaaaatcacactatattaatatttcatatttgccaacagaaacatggcagataggtatcaatatgttttcaatgcctgatgacctataagaagaaagtattgaaaagaagagagattagaactgttagaaggagttgaaattttctaaaagacatagtatttagtttataattaaatgcattcttgaagtccagtgtgaattttattaatgctatcatctcgaccaagctcaaagcctacttattagaaacaatgaagttcacaataggtcataaggtctcttccttttctaaaattgaaagacaagaaatttagtgccaatattgtacagacagaaattccatgtatgagtctcaacaaagactacctttggctaaatgtctagaagcagagaagtaaagtgagcaaaatccagtgttgaggagtcatgacagtactttgatctttatatactctgaagcatttcttcaaacttttctacttttatttgtcattgatacctgtagtaagttgacaatgtggtgaaatttcaaaattatatgtaacttctactagttttactttctcccccaagtcttttttaactcatgatttttacacacacaatccagaacttattatatagcctctaagtctttattcttcacagtagataatgaaagagtcctccagtgtcttggcaaaatgttctagtatagctggatacatacagtggagttctataaactcatacctcagtggacttaaccaaaattgtgttagtctcaattcctaccacactgagggagcctcccaaataactattttcttatctgcagtattcctccagaagagctaaccagggcagggctggcatgagaagtgacatctgcgttacaaagtctatcttcctcataagtctgtaaagagcaattgaatcttctagctttagcaaacctaagccaaaggaaggaaagccacgaagaatgcagaagtcaaaccctcatgacaaagtaggcacaagtctacaataagctaaatcagaatttacaaatacaagtgtcccaggtagcattgactcccgtcattggagtgaaatggatcaaagtttgaattaaggcctatggtaaggtaacattgctttgttgtacttttgaacaagagctcctcctgatcactattacatatttttctagaaaatctaaagttcagaagagaatgtatcactgctgacttttattccaatatttggatggagtaagttttagggtagaattttgttcagtttggatttaatcttttgaaaagtaaattccttgtttactggtttgactataattctctgttatctttacgaggtaaaactgcaagctgactagcatgttctgtgaatctgccattcctaaaaattttataaacacttgatacttttcactgataatggatcgctccaataaacatatattgtgaaaatgcatccacaataaatggaattccttcctgcaaaa

SEQ ID NO: 440405 - DNA, 3893 bp, Homo sapiens
  misc_feature (3841)..(3842): n is a, c, g, or t
  misc_feature (3892)..(3892): n is a, c, g, or t
ggtcgcctactactactaaattcgcggccgcgtcgacagggcagcagaggagaggcagaggataaaggaggaagagaaaagggcagcagaggagaggcagaggataaaagaggaagagaaaagggcagcagaggagaggcaaagggccagggcagaggaggaagagaaggctaaggtagaagagcagaaacgtaacaagcagctagaagagaaaaaacatgccatgcaagagacaaagataaaaggggaaaaggtagaacagaaaatagaagggaaatgggtaaatgaaaagaaagcacaagaagataaacttcagacagctgtcctaaagaaacagggagaagagaagggaactaaagtgcaagctaaaagagaaaagctccaagaagacaagcctaccttcaaaaaagaagagatcaaagatgaaaagattaaaaaggacaaagaacccaaagaagaagttaagagcttcatggatcgaaagaagggatttacagaagttaagtcgcagaatggagaattcatgacccacaaacttaaacatactgagaatactttcagccgccctggagggagggccagcgtggacaccaaggaggctgagggcgccccccaggtggaagccggcaaaaggctggaggagcttcgtcgtcgtcgcggggagaccgagagcgaagagttcgagaagctcaaacagaagcagcaggaggcggctttggagctggaggaactcaagaaaaagagggaggagagaaggaaggtcctggaggaggaagagcagaggaggaagcaggaggaagccgatcgaaaactcagagaggaggaagagaagaggaggctaaaggaagagattgaaaggcgaagagcagaagctgctgagaaacgccagaagatgccagaagatggcttgtcagatgacaagaaaccattcaagtgtttcactcctaaaggttcatctctcaagatagaagagcgagcagaatttttgaataagtctgtgcagaaaagcagtggtgtcaaatcgacccatcaagcagcaatagtctccaagattgacagcagactggagcagtataccagtgcaattgagggaacaaaaagcgcaaaacctacaaagccggcagcctcggatcttcctgttcctgctgaaggtgtacgcaacatcaagagtatgtgggagaaagggaatgtgttttcatcccccactgcagcaggcacaccaaataaggaaactgctggcttgaaggtaggggtttctagccgcatcaatgaatggctaactaaaaccccagatggaaacaagtcacctgctcccaaaccttctgacttgagaccaggagacgtatccagcaagcggaacctctgggaaaagcaatctgtggataaggtcacttcccccactaaggtttgagacagttccagaaagaacccaagctcaagacgcaggacgagctcagttgtagagggctaattcgctctgttttgtatttatgttgatttactaaattgggttcattatcttttatttttcaatatcccagtaaacccatgtatattatcactatatttaataatcacagtctagagatgttcatggtaaaagtactgcctttgcacaggagcctgtttctaaagaaacccatgctgtgaaatagagacttttctactgatcatcataactctgtatctgagcagtgataccaaccacatctgaagtcaacagaagatccaagtttaaaattgcctgcggaatgtgtgcagtatctagaaaaatgaaccgtagtttttgtttttttaaatacagaagtcatgttgtttctgcactttataataaagcatggaagaaattatcttagtaggcaattgtaacactttttgaaagtaacccatttcagatttgaaatactgcaataatggttgtctttaaaaaaaaaaaagaaatgtactgttaaggtattactttttttcatgctgatgattcatatctaaattacattattatgttagctgacagtggtactgattttttaggttggttgttttgtggatttctttagtagtgatagtagcctgaaccacattttagataactcaattatgtatgtatgtgcatacacatatacaaacacactaatggtagaatgcttttttatgtgctagactattatatttagtagtatgtcattgtaactagccaatatcacagcttttgaaaaattaaaaaatcacactatattaatatttcatatttgccaacagaaacatggcagataggtatcaatatgttttcaatgcctgatgacctataagaagaaagtattgaaaagaagagagattagaactgttagaaggagttgaaattttctaaaagacatagtatttagtttataattaaatgcattcttgaagtccagtgtgaattttattaatgctatcatctcgaccaagctcaaagcctacttattagaaacaatgaagttcacaataggtcataaggtctcttccttttctaaaattgaaagacaagaaatttagtgccaatattgtacagacagaaattccatgtatgagtctcaacaaagactacctttggctaaatgtctagaagcagagaagtaaagtgagcaaaatccagtgttgaggagtcatgacagtactttgatctttatatactctgaagcatttcttcaaacttttctacttttatttgtcattgatacctgtagtaagttgacaatgtggtgaaatttcaaaattatatgtaacttctactagttttactttctcccccaagtcttttttaactcatgatttttacacacacaatccagaacttattatatagcctctaagtctttattcttcacagtagataatgaaagagtcctccagtgtcttggcaaaatgttctagtatagctggatacatacagtggagttctataaactcatacctcagtggacttaaccaaaattgtgttagtctcaattcctaccacactgagggagcctcccaaataactattttcttatctgcagtattcctccagaagagctaaccagggcagggctggcatgagaagtgacatctgcgttacaaagtctatcttcctcataagtctgtaaagagcaattgaatcttctagctttagcaaacctaagccaaaggaaggaaagccacgaagaatgcagaagtcaaaccctcatgacaaagtaggcacaagtctacaataagctaaatcagaatttacaaatacaagtgtcccaggtagcattgactcccgtcattggagtgaaatggatcaaagtttgaattaaggcctatggtaaggtaacattgctttgttgtacttttgaacaagagctcctcctgatcactattacatatttttctagaaaatctaaagttcagaagagaatgtatcactgctgacttttattccaatatttggatggagtaagttttagggtagaattttgttcagtttggatttaatcttttgaaaagtaaattccttgtttactggtttgactataattctctgttatctttacgaggtaaaactgcaagctgactagcatgttctgtgaatctgccattcctaaaaattttataaacacttgatacttttcactgataatggatcgctccaataaacatatattgtgaaaatgcatccacaataaatggaattccttcctgcaaaaaaaaaaaaaaaaaaaactcgtttgcctatctgtaaaggtaatacattctgattacaaaaaatgaaaatgttacatagaaatgtaccgttatccatctaccagataactattattaataatgtgtattatttttnnaggaattaaaaaacatctatcatataagtattgcaaataaaacttaaaang

SEQ ID NO: 440406 - DNA, 3750 bp, Homo sapiens
  misc_feature (3709)..(3709): n is a, c, g, or t
ggtcgcctactactactaaattcgcggccgcgtcgacagggcagcagaggagaggcagaggataaaggaggaagagaaaagggcagcagaggagaggcagaggataaaagaggaagagaaaagggcagcagaggagaggcaaagggccagggcagaggaggaagagaaggctaaggtagaagagcagaaacgtaacaagcagctagaagagaaaaaacatgccatgcaagagacaaagataaaaggggaaaaggtagaacagaaaatagaagggaaatgggtaaatgaaaagaaagcacaagaagataaacttcagacagctgtcctaaagaaacagggagaagagaagggaactaaagtgcaagctaaaagagaaaagctccaagaagacaagcctaccttcaaaaaagaagagatcaaagatgaaaagattaaaaaggacaaagaacccaaagaagaagttaagagcttcatggatcgaaagaagggatttacagaagttaagtcgcagaatggagaattcatgacccacaaacttaaacatactgagaatactttcagccgccctggagggagggccagcgtggacaccaaggaggctgagggcgccccccaggtggaagccggcaaaaggctggaggagcttcgtcgtcgtcgcggggagaccgagagcgaagagttcgagaagctcaaacagaagcagcaggaggcggctttggagctggaggaactcaagaaaaagagggaggagagaaggaaggtcctggaggaggaagagcagaggaggaagcaggaggaagccgatcgaaaactcagagaggaggaagagaagaggaggctaaaggaagagattgaaaggcgaagagcagaagctgctgagaaacgccagaagatgccagaagatggcttgtcagatgacaagaaaccattcaagtgtttcactcctaaaggttcatctctcaagatagaagagcgagcagaatttttgaataagtctgtgcagaaaagcagtggtgtcaaatcgacccatcaagcagcaatagtctccaagattgacagcagactggagcagtataccagtgcaattgagggaacaaaaagcgcaaaacctacaaagccggcagcctcggatcttcctgttcctgctgaaggtgtacgcaacatcaagagtatgtgggagaaagggaatgtgttttcatcccccactgcagcaggcacaccaaataaggaaactgctggcttgaaggtaggggtttctagccgcatcaatgaatggctaactaaaaccccagatggaaacaagtcacctgctcccaaaccttctgacttgagaccaggagacgtatccagcaagcggaacctctgggaaaagcaatctgtggataaggtcacttcccccactaaggtttgagacagttccagaaagaacccaagctcaagacgcaggacgagctcagttgtagagggctaattcgctctgttttgtatttatgttgatttactaaattgggttcattatcttttatttttcaatatcccagtaaacccatgtatattatcactatatttaataatcacagtctagagatgttcatggtaaaagtactgcctttgcacaggagcctgtttctaaagaaacccatgctgtgaaatagagacttttctactgatcatcataactctgtatctgagcagtgataccaaccacatctgaagtcaacagaagatccaagtttaaaattgcctgcggaatgtgtgcagtatctagaaaaatgaaccgtagtttttgtttttttaaatacagaagtcatgttgtttctgcactttataataaagcatggaagaaattatcttagtaggcaattgtaacactttttgaaagtaacccatttcagatttgaaatactgcaataatggttgtctttaaaaaaaaaaaagaaatgtactgttaaggtattactttttttcatgctgatgattcatatctaaattacattattatgttagctgacagtggtactgattttttaggttggttgttttgtggatttctttagtagtgatagtagcctgaaccacattttagataactcaattatgtatgtatgtgcatacacatatacaaacacactaatggtagaatgcttttttatgtgctagactattatatttagtagtatgtcattgtaactagccaatatcacagcttttgaaaaattaaaaaatcacactatattaatatttcatatttgccaacagaaacatggcagataggtatcaatatgttttcaatgcctgatgacctataagaagaaagtattgaaaagaagagagattagaactgttagaaggagttgaaattttctaaaagacatagtatttagtttataattaaatgcattcttgaagtccagtgtgaattttattaatgctatcatctcgaccaagctcaaagcctacttattagaaacaatgaagttcacaataggtcataaggtctcttccttttctaaaattgaaagacaagaaatttagtgccaatattgtacagacagaaattccatgtatgagtctcaacaaagactacctttggctaaatgtctagaagcagagaagtaaagtgagcaaaatccagtgttgaggagtcatgacagtactttgatctttatatactctgaagcatttcttcaaacttttctacttttatttgtcattgatacctgtagtaagttgacaatgtggtgaaatttcaaaattatatgtaacttctactagttttactttctcccccaagtcttttttaactcatgatttttacacacacaatccagaacttattatatagcctctaagtctttattcttcacagtagataatgaaagagtcctccagtgtcttggcaaaatgttctagtatagctggatacatacagtggagttctataaactcatacctcagtggacttaaccaaaattgtgttagtctcaattcctaccacactgagggagcctcccaaataactattttcttatctgcagtattcctccagaagagctaaccagggcagggctggcatgagaagtgacatctgcgttacaaagtctatcttcctcataagtctgtaaagagcaattgaatcttctagctttagcaaacctaagccaaaggaaggaaagccacgaagaatgcagaagtcaaaccctcatgacaaagtaggcacaagtctacaataagctaaatcagaatttacaaatacaagtgtcccaggtagcattgactcccgtcattggagtgaaatggatcaaagtttgaattaaggcctatggtaaggtaacattgctttgttgtacttttgaacaagagctcctcctgatcactattacatatttttctagaaaatctaaagttcagaagagaatgtatcactgctgacttttattccaatatttggatggagtaagttttagggtagaattttgttcagtttggatttaatcttttgaaaagtaaattccttgtttactggtttgactataattctctgttatctttacgaggtaaaactgcaagctgactagcatgttctgtgaatctgccattcctaaaaattttataaacacttgatacttttcactgataatggatcgctccaataaacatatattgtgaaaatgcatccacaataaatggaattccttcctgcaaaaanaagtcgacgcggccgcgaatttagtagtagtaggcggccgc

SEQ ID NO: 440407 - DNA, 3711 bp, Homo sapiens
ggtcgcctactactactaaattcgcggccgcgtcgacagggcagcagaggagaggcagaggataaaggaggaagagaaaagggcagcagaggagaggcagaggataaaagaggaagagaaaagggcagcagaggagaggcaaagggccagggcagaggaggaagagaaggctaaggtagaagagcagaaacgtaacaagcagctagaagagaaaaaacatgccatgcaagagacaaagataaaaggggaaaaggtagaacagaaaatagaagggaaatgggtaaatgaaaagaaagcacaagaagataaacttcagacagctgtcctaaagaaacagggagaagagaagggaactaaagtgcaagctaaaagagaaaagctccaagaagacaagcctaccttcaaaaaagaagagatcaaagatgaaaagattaaaaaggacaaagaacccaaagaagaagttaagagcttcatggatcgaaagaagggatttacagaagttaagtcgcagaatggagaattcatgacccacaaacttaaacatactgagaatactttcagccgccctggagggagggccagcgtggacaccaaggaggctgagggcgccccccaggtggaagccggcaaaaggctggaggagcttcgtcgtcgtcgcggggagaccgagagcgaagagttcgagaagctcaaacagaagcagcaggaggcggctttggagctggaggaactcaagaaaaagagggaggagagaaggaaggtcctggaggaggaagagcagaggaggaagcaggaggaagccgatcgaaaactcagagaggaggaagagaagaggaggctaaaggaagagattgaaaggcgaagagcagaagctgctgagaaacgccagaagatgccagaagatggcttgtcagatgacaagaaaccattcaagtgtttcactcctaaaggttcatctctcaagatagaagagcgagcagaatttttgaataagtctgtgcagaaaagcagtggtgtcaaatcgacccatcaagcagcaatagtctccaagattgacagcagactggagcagtataccagtgcaattgagggaacaaaaagcgcaaaacctacaaagccggcagcctcggatcttcctgttcctgctgaaggtgtacgcaacatcaagagtatgtgggagaaagggaatgtgttttcatcccccactgcagcaggcacaccaaataaggaaactgctggcttgaaggtaggggtttctagccgcatcaatgaatggctaactaaaaccccagatggaaacaagtcacctgctcccaaaccttctgacttgagaccaggagacgtatccagcaagcggaacctctgggaaaagcaatctgtggataaggtcacttcccccactaaggtttgagacagttccagaaagaacccaagctcaagacgcaggacgagctcagttgtagagggctaattcgctctgttttgtatttatgttgatttactaaattgggttcattatcttttatttttcaatatcccagtaaacccatgtatattatcactatatttaataatcacagtctagagatgttcatggtaaaagtactgcctttgcacaggagcctgtttctaaagaaacccatgctgtgaaatagagacttttctactgatcatcataactctgtatctgagcagtgataccaaccacatctgaagtcaacagaagatccaagtttaaaattgcctgcggaatgtgtgcagtatctagaaaaatgaaccgtagtttttgtttttttaaatacagaagtcatgttgtttctgcactttataataaagcatggaagaaattatcttagtaggcaattgtaacactttttgaaagtaacccatttcagatttgaaatactgcaataatggttgtctttaaaaaaaaaaaagaaatgtactgttaaggtattactttttttcatgctgatgattcatatctaaattacattattatgttagctgacagtggtactgattttttaggttggttgttttgtggatttctttagtagtgatagtagcctgaaccacattttagataactcaattatgtatgtatgtgcatacacatatacaaacacactaatggtagaatgcttttttatgtgctagactattatatttagtagtatgtcattgtaactagccaatatcacagcttttgaaaaattaaaaaatcacactatattaatatttcatatttgccaacagaaacatggcagataggtatcaatatgttttcaatgcctgatgacctataagaagaaagtattgaaaagaagagagattagaactgttagaaggagttgaaattttctaaaagacatagtatttagtttataattaaatgcattcttgaagtccagtgtgaattttattaatgctatcatctcgaccaagctcaaagcctacttattagaaacaatgaagttcacaataggtcataaggtctcttccttttctaaaattgaaagacaagaaatttagtgccaatattgtacagacagaaattccatgtatgagtctcaacaaagactacctttggctaaatgtctagaagcagagaagtaaagtgagcaaaatccagtgttgaggagtcatgacagtactttgatctttatatactctgaagcatttcttcaaacttttctacttttatttgtcattgatacctgtagtaagttgacaatgtggtgaaatttcaaaattatatgtaacttctactagttttactttctcccccaagtcttttttaactcatgatttttacacacacaatccagaacttattatatagcctctaagtctttattcttcacagtagataatgaaagagtcctccagtgtcttggcaaaatgttctagtatagctggatacatacagtggagttctataaactcatacctcagtggacttaaccaaaattgtgttagtctcaattcctaccacactgagggagcctcccaaataactattttcttatctgcagtattcctccagaagagctaaccagggcagggctggcatgagaagtgacatctgcgttacaaagtctatcttcctcataagtctgtaaagagcaattgaatcttctagctttagcaaacctaagccaaaggaaggaaagccacgaagaatgcagaagtcaaaccctcatgacaaagtaggcacaagtctacaataagctaaatcagaatttacaaatacaagtgtcccaggtagcattgactcccgtcattggagtgaaatggatcaaagtttgaattaaggcctatggtaaggtaacattgctttgttgtacttttgaacaagagctcctcctgatcactattacatatttttctagaaaatctaaagttcagaagagaatgtatcactgctgacttttattccaatatttggatggagtaagttttagggtagaattttgttcagtttggatttaatcttttgaaaagtaaattccttgtttactggtttcgcgagaggtgtttccaagtccaacgaccgttggtaaaagatccgacgccatgtagctcagcatgtgtatgtgaagtcatgctagttctctaagaatattatacaacaattgatactggtcagtgataatggctcgtcgtccaaatcatacattgtgggagatcactcttagagtcagacct

SEQ ID NO: 440408 - DNA, 2427 bp, Homo sapiens
ggtcgcctactactactaaattcgcggccgcgtcgacagggcagcagaggagaggcagaggataaaggaggaagagaaaagggcagcagaggagaggcagaggataaaagaggaagagaaaagggcagcagaggagaggcaaagggccagggcagaggaggaagagaaggctaaggtagaagagcagaaacgtaacaagcagctagaagagaaaaaacatgccatgcaagagacaaagataaaaggggaaaaggtagaacagaaaatagaagggaaatgggtaaatgaaaagaaagcacaagaagataaacttcagacagctgtcctaaagaaacagggagaagagaagggaactaaagtgcaagctaaaagagaaaagctccaagaagacaagcctaccttcaaaaaagaagagatcaaagatgaaaagattaaaaaggacaaagaacccaaagaagaagttaagagcttcatggatcgaaagaagggatttacagaagttaagtcgcagaatggagaattcatgacccacaaacttaaacatactgagaatactttcagccgccctggagggagggccagcgtggacaccaaggaggctgagggcgccccccaggtggaagccggcaaaaggctggaggagcttcgtcgtcgtcgcggggagaccgagagcgaagagttcgagaagctcaaacagaagcagcaggaggcggctttggagctggaggaactcaagaaaaagagggaggagagaaggaaggtcctggaggaggaagagcagaggaggaagcaggaggaagccgatcgaaaactcagagaggaggaagagaagaggaggctaaaggaagagattgaaaggcgaagagcagaagctgctgagaaacgccagaagatgccagaagatggcttgtcagatgacaagaaaccattcaagtgtttcactcctaaaggttcatctctcaagatagaagagcgagcagaatttttgaataagtctgtgcagaaaagcagtggtgtcaaatcgacccatcaagcagcaatagtctccaagattgacagcagactggagcagtataccagtgcaattgagggaacaaaaagcgcaaaacctacaaagccggcagcctcggatcttcctgttcctgctgaaggtgtacgcaacatcaagagtatgtgggagaaagggaatgtgttttcatcccccactgcagcaggcacaccaaataaggaaactgctggcttgaaggtaggggtttctagccgcatcaatgaatggctaactaaaaccccagatggaaacaagtcacctgctcccaaaccttctgacttgagaccaggagacgtatccagcaagcggaacctctgggaaaagcaatctgtggataaggtcacttcccccactaaggtttgagacagttccagaaagaacccaagctcaagacgcaggacgagctcagttgtagagggctaattcgctctgttttgtatttatgttgatttactaaattgggttcattatcttttatttttcaatatcccagtaaacccatgtatattatcactatatttaataatcacagtctagagatgttcatggtaaaagtactgcctttgcacaggagcctgtttctaaagaaacccatgctgtgaaatagagacttttctactgatcatcataactctgtatctgagcagtgataccaaccacatctgaagtcaacagaagatccaagtttaaaattgcctgcggaatgtgtgcagtatctagaaaaatgaaccgtagtttttgtttttttaaatacagaagtcatgttgtttctgcactttataataaagcatggaagaaattatcttagtaggcaattgtaacactttttgaaagtaacccatttcagatttgaaatactgcaataatggttgtctttaaaaaaaaaacaacgcacatggtcgcgctcagggacatcacttttgtccaggcgggaagagtccatatcctacaatccatatatcaagtgaagcctgccactgtgcacgagacacccaaggagagagacgaccggacgacaccacacaaacagacaacacgccggcaacacaccttaaataacccaccggcgagcagaggtggccaacccaatgacatagaggcattgtcgcagtagcaacacaatgggtgagcgccagccaagactatacgcaaggaccaggctgacagtcaccaacaatcaactagtagaaacaaaacacaacgatatatacatccactgagccaccagagagagccgcactacacacacagcagccacaacaaaacacgtgcagaaacaggcgagcggacatcaacactatcatcaaacgatccatgcatactagcaaagcacatacactatatgactatatatttgtattgtctttttgatcatatct

SEQ ID NO: 440409 - DNA, 3069 bp, Homo sapiens
ggtcgcctactactactaaattcgcggccgcgtcgacagggcagcagaggagaggcagaggataaaggaggaagagaaaagggcagcagaggagaggcagaggataaaagaggaagagaaaagggcagcagaggagaggcaaagggccagggcagaggaggaagagaaggctaaggtagaagagcagaaacgtaacaagcagctagaagagaaaaaacatgccatgcaagagacaaagataaaaggggaaaaggtagaacagaaaatagaagggaaatgggtaaatgaaaagaaagcacaagaagataaacttcagacagctgtcctaaagaaacagggagaagagaagggaactaaagtgcaagctaaaagagaaaagctccaagaagacaagcctaccttcaaaaaagaagagatcaaagatgaaaagattaaaaaggacaaagaacccaaagaagaagttaagagcttcatggatcgaaagaagggatttacagaagttaagtcgcagaatggagaattcatgacccacaaacttaaacatactgagaatactttcagccgccctggagggagggccagcgtggacaccaaggaggctgagggcgccccccaggtggaagccggcaaaaggctggaggagcttcgtcgtcgtcgcggggagaccgagagcgaagagttcgagaagctcaaacagaagcagcaggaggcggctttggagctggaggaactcaagaaaaagagggaggagagaaggaaggtcctggaggaggaagagcagaggaggaagcaggaggaagccgatcgaaaactcagagaggaggaagagaagaggaggctaaaggaagagattgaaaggcgaagagcagaagctgctgagaaacgccagaagatgccagaagatggcttgtcagatgacaagaaaccattcaagtgtttcactcctaaaggttcatctctcaagatagaagagcgagcagaatttttgaataagtctgtgcagaaaagcagtggtgtcaaatcgacccatcaagcagcaatagtctccaagattgacagcagactggagcagtataccagtgcaattgagggaacaaaaagcgcaaaacctacaaagccggcagcctcggatcttcctgttcctgctgaaggtgtacgcaacatcaagagtatgtgggagaaagggaatgtgttttcatcccccactgcagcaggcacaccaaataaggaaactgctggcttgaaggtaggggtttctagccgcatcaatgaatggctaactaaaaccccagatggaaacaagtcacctgctcccaaaccttctgtaagtacctttaggtttttctgagtttctttgatctcccagcttctaccagcagaagaaaacaagcagttggtctgtttacctaggaatggcagtgcccctgttctttgctttccctgatgaatagcaaacaggaaagtgttcagatttacaacagttctaagaagctgcatctcagttactcagagggtaaaatggaaccaaataatcacctctacaccctaactgagaggaggaatcagctagaatactgaggcagttcaaatttagatcctttactcgtctatttgtttagcttctattctataaattctggatagaaatttgaaaatgaaaggtcacatcattttggctacttctttgtcaagagcacccctaaacttattcccaaaagaatatgtatgttgcctattgggaacccatatgttccaatttgcctcatttttataacttggcacaaaaatgcagttattgggtagctgttgaaataattggtctaattgtgttgtcagcacctcctgaggaaagtcataaaactggaaactagaaaaactggttatgaatgatgtttttgagaatctaaaattttcttaatttattaagtgcagctatcttactaaaaagtacatttcttttcacctttttgttgaatgtatacgacaattgcttgcatttgtcattataataagaaaacgtatcaagctccccactgtatattgctgagctttccctgttaagtttgcttttatagctttgttggtgcccaagggagctgagagtccactgtcataatcctacattctagaggaagaagaaaaagtttccaatcctaggcctctgtgcatttaattgcatccattggctccatgccatttaattgcatttgttggctccatatataatctccaaagtcattaaattttgtcactttccaatttaaaaaggaagaaatggaaatgttcacaaatccttcttgggcacaactccttgaaccgtttaattaatctacaccccgagattctttgcataaaggctcacaggaggtatacactaatgtcaacccaatttacaattggaaaatctttatacattgaaaaaagcaacttttcctccccctctcaataggtacaagaatgcgggtttataaaaggacacagttgaggcaagagaccggacccaaaagttatgtgctctttagtgcctcaagttttccaagcatctctggtaacataaggagtagaaattattttcaaaaacaaaataatcactggttccagaccagtgattattaaccctttttgaattatgaacccctttaaaacctaatgaaatttaaggaccctctcccccaaaatatacatataaaaaaacaaggcagtctatggacctactgagtaactctcaagatagtaagtaaggagagaaagatctatgtttccctctttgataagtatgaaatatttggaggagatgctaatttttgcacgtttatgatatttgcaatctttcatttttgtagcagattatactcaaaaatttgatccagaacttggcccctattcttttatcagcactttaacttgtaaactgaaaagtttaccatcatctgtatgacatcctaatgaggttaaaaagataaaatgcagttatgattatgataggtataactgtatccaggtttccacagcaaaaacaaaacaaaacatacaccatgttctggggttattgacagcctcctaaaaaaa

SEQ ID NO: 440410 - DNA, 1456 bp, Homo sapiens
ggtcgcctactactactaaattcgcggccgcgtcgacagggcagcagaggagaggcagaggataaaggaggaagagaaaagggcagcagaggagaggcagaggataaaagaggaagagaaaagggcagcagaggagaggcaaagggccagggcagaggaggaagagaaggctaaggtagaagagcagaaacgtaacaagcagctagaagagaaaaaacatgccatgcaagagacaaagataaaaggggaaaaggtagaacagaaaatagaagggaaatgggtaaatgaaaagaaagcacaagaagataaacttcagacagctgtcctaaagaaacagggagaagagaagggaactaaagtgcaagctaaaagagaaaagctccaagaagacaagcctaccttcaaaaaagaagagatcaaagatgaaaagattaaaaaggacaaagaacccaaagaagaagttaagagcttcatggatcgaaagaagggatttacagaagttaagtcgcagaatggagaattcatgacccacaaacttaaacatactgagaatactttcagccgccctggagggagggccagcgtggacaccaaggaggctgagggcgccccccaggtggaagccggcaaaaggctggaggagcttcgtcgtcgtcgcggggagaccgagagcgaagagttcgagaagctcaaacagaagcagcaggaggcggctttggagctggaggaactcaagaaaaagagggaggagagaaggaaggtcctggaggaggaagagcagaggaggaagcaggaggaagccgatcgaaaactcagagaggaggaagagaagaggaggctaaaggaagagattgaaaggcgaagagcagaagctgctgagaaacgccagaagatgccagaagatggcttgtcagatgacaagaaaccattcaagtgtttcactcctaaaggttcatctctcaagatagaagagcgagcagaatttttgaataagtctgtgcagaaaagcagtggtgtcaaatcgacccatcaagcagcaatagtctccaagattgacagcagactggagcagtataccagtgcaattgagggaacaaaaagcgcaaaacctacaaagccggcagcctcggatcttcctgttcctgctgaaggtgtacgcaacatcaagagtatgtgggagaaagggaatgtgttttcatcccccactgcagcaggcacaccaaataaggaaactgctggcttgaaggtaggggtttctagccgcatcaatgaatggctaactaaaaccccagatggaaacaagtcacctgctcccaaaccttctgacttgagaccaggagacgtatccagcaagcggaacctctgggaaaagcaatctgtggataaggtcacttcccccactaaggtaatctattgggaagactagtatttcagaggtttgttttcctgatgtatg

SEQ ID NO: 440411 - DNA, 1823 bp, Homo sapiens
  misc_feature (1163)..(1163): n is a, c, g, or t
tgagatggagtctcactctgtcactcaggttggagtgcagtggcgccatctcagctcactgcaacctccgcctcctgggttcaagcaattctcctgccgcagcctcccaagtagctgggactacaggcacctgccaccaagcccgggtaatttttgtatttttagtagagacggggtttcaccatgttggccaggctggtctcaaactcctgaccttgatccacctgcctcagcctccccgagtgctgggattacaggcatgagccacctcgcctggcctataaactacgactctgatgaccgcatagtatttaagcaagaaaacaaccaaaatgttctagctaaagtggagaccacttaacctaacccaattaaactttaagttgaacacaagagtagtagatgcagttcagctccatgacattgggtgagttgtctaaatgctctgtgctttggtgtccttgtctgcgtgtgacatgaagccgcagatctcaaagatctctttcattccgtgaaagcgctctcaatgtgtgaagttgactgcttctcctgctgtttaccaagagaataatcttaaccctacattgtggagatcggatttgttctcacttgacagaaagccagtcccacgagcagcttggtacccaaataccagtctgtttagtgctcattagagatgaagaaccatattcataagtcaagctgagacggagtgtcatctccagacagaatcaacaccaccccctcctcaggaactgggatttggctgctttccaagccgctgctgaccaggttccattgcccagcttggctgatgagatcactggcagagtaccatgggtgcagacggggcctgctgtttcaacatgttctcaggagggctcttgcccacatttcttggagaggtgtgagcaccaaacatgctgaaccatccagcccatcactgagcagggccatctctcttcatcccttttcatttggtttgcatttttatgtcatgctccttccctggataaaagggataagaggagtttctcagatttgatttctcagtgggaactgtttgctttggaagccacctacaccaatgctaattgagaacagagctcagaatgggagcctgagaactgcacccggatgaactttttggtgggctgatttcngttgatcttgtcagaattaggttgtatatgcatgtaataccatgatcaactattttccaaaaggctgagcaaatgcatcagtgtctttttcctttgaccagttacttaccttggaaaaattatttgtagttaagcatataaagtcttcatcaggaaaactactggagatcctggccctgactacccagcaataacatttctggaactcccgaagcaatcagtgctctctgatcgctaaacatgatgggcttctattagagagattacagtaaaaaataacaatcagctctctgatgatcctgtgaggagggaacgggttgggaggagtagatttggctgaggacaagcccagactttcgtcacagggacagaccaacgtgttaacacaaagggagaacacgggagcatcctgcaccgtgcatttcagccacagatcacatggcccctccgcgggcccagcccacgccctgaccgcccggcctggccaggtctccgtatctctctgccccgccgccccttcccaactgcggacatgctgggtggatccggatcgcatggaagacgcagcctggccgcgctctcccagtgagtcctcatttcgcctctttggttttttcctttcttttttttttttataaaaaacaaacgaattgttgtaaa

SEQ ID NO: 440412 - DNA, 4357 bp, Homo sapiens
tgtgctttctttttattgctgcatttgtgttctacaagacagcctctttctccaagattaacatttcttatgattgttcctgacaatggattcacttccagaggccctgctaaggataaccaaaaaagggcatggagcaggctggttttggcagcgtgcacgcagtttcagagctttttaggtcttgggttttctgatgagtgatttcctgagcatgcctagggaatgacaggcatctccacaggcaggctgcatccaccttggctggggtgtcgtcattggctgcctattagaaaaacgacaggacaatgcataccaccgcctcccgactgtaaacataggggatatgtgttcacttagcatggacttctgggaggggccaaggaagggcggtctggagttttattgaatagagcagtgtgtattcggctgcctgcctgcccgcctgcttgctctctggctgtgctcctgcttaaagaaatcagtccttcctttccgacttagtcctcgggaagaagtttcagactacaaggtatcattggaacatttcaagatcatcaaatcaaattccacagggattggtgaccaaccagaaggctcagacatctgattgctgacctgtccagacatcatctggtctccctgaacctgaaatcacaccatggatgattttgagcgtcgcagagaacttagaaggcaaaagagggaggagatgcgactcgaagcagaaagaatcgcctaccagaggaatgacgatgatgaagaggaggcagcccgggaacggcgccgccgagcccgacaggaacggctgcggcagaagcaggaggaagaatccttgggacaggtgaccgaccaggtggaggtgaatgcccagaacagtgtgcctgacgaggaggccaagacaaccaccacaaacactcaagtggaaggggatgatgaggccgcattcctggagcgcctggctcggcgtgaggaaagacgccaaaaacgccttcaggaggctctggagcggcagaaggagttcgacccaacaataacagatgcaagtctgtcgctcccaagcagaagaatgcaaaatgacacagcagaaaatgaaactaccgagaaggaagaaaaaagtgaaagtcgccaagaaagatacgagatagaggaaacagaaacagtcaccaagtcctaccagaagaatgattggagggatgctgaagaaaacaagaaagaagacaaggaaaaggaggaggaggaagaggagaagccaaagcgagggagcattggagaaaatcagatcaaagatgaaaagattaaaaaggacaaagaacccaaagaagaagttaagagcttcatggatcgaaagaagggatttacagaagttaagtcgcagaatggagaattcatgacccacaaacttaaacatactgagaatactttcagccgccctggagggagggccagcgtggacaccaaggaggctgagggcgccccccaggtggaagccggcaaaaggctggaggagcttcgtcgtcgtcgcggggagaccgagagcgaagagttcgagaagctcaaacagaagcagcaggaggcggctttggagctggaggaactcaagaaaaagagggaggagagaaggaaggtcctggaggaggaagagcagaggaggaagcaggaggaagccgatcgaaaactcagagaggaggaagagaagaggaggctaaaggaagagattgaaaggcgaagagcagaagctgctgagaaacgccagaagatgccagaagatggcttgtcagatgacaagaaaccattcaagtgtttcactcctaaaggttcatctctcaagatagaagagcgagcagaatttttgaataagtctgtgcagaaaagcagtggtgtcaaatcgacccatcaagcagcaatagtctccaagattgacagcagactggagcagtataccagtgcaattgagggaacaaaaagcgcaaaacctacaaagccggcagcctcggatcttcctgttcctgctgaaggtgtacgcaacatcaagagtatgtgggagaaagggaatgtgttttcatcccccactgcagcaggcacaccaaataaggtgagcatctgatttttgtctcttaagtgtagaggggcatatttttttgcatgtcgattttgatttaggaatcacactagtaaataataaaagcagtgaagaaggtgcaatttgtactttgttttgcaatgaccacaaaagcaagctcagagagaatgtgtttgtgaggttgcatgaggtactaagcccgggccatcttactccaaataaagtgcctgggctgaaatgtccacccttggagttggagtggggtgagttaccagggaaagaaaaccagataacatattctgtaaatatcaagtgttaaggtttatggttatgtgaaatcatacttaatgatattttgaatttgctttgaaaattccttcccaggtaaagtttacttcattctttaatattttggatgattgcccctttgtaggaaactgctggcttgaaggtaggggtttctagccgcatcaatgaatggctaactaaaaccccagatggaaacaagtcacctgctcccaaaccttctgtaagtacctttaggtttttctgagtttctttgatctcccagcttctaccagcagaagaaaacaagcagttggtctgtttacctaggaatggcagtgcccctgttctttgctttccctgatgaatagcaaacaggaaagtgttcagatttacaacagttctaagaagctgcatctcagttactcagagggtaaaatggaaccaaataatcacctctacaccctaactgagaggaggaatcagctagaatactgaggcagttcaaatttagatcctttactcgtctatttgtttagcttctattctataaattctggatagaaatttgaaaatgaaaggtcacatcattttggctacttctttgtcaagagcacccctaaacttattcccaaaagaatatgtatgttgcctattgggaacccatatgttccaatttgcctcatttttataacttggcacaaaaatgcagttattgggtagctgttgaaataattggtctaattgtgttgtcagcacctcctgaggaaagtcataaaactggaaactagaaaaactggttatgaatgatgtttttgagaatctaaaattttcttaatttattaagtgcagctatcttactaaaaagtacatttcttttcacctttttgttgaatgtatacgacaattgcttgcatttgtcattataataagaaaacgtatcaagctccccactgtatattgctgagctttccctgttaagtttgcttttatagctttgttggtgcccaagggagctgagagtccactgtcataatcctacattctagaggaagaagaaaaagtttccaatcctaggcctctgtgcatttaattgcatccattggctccatgccatttaattgcatttgttggctccatatataatctccaaagtcattaaattttgtcactttccaatttaaaaaggaagaaatggaaatgttcacaaatccttcttgggcacaactccttgaaccgtttaattaatctacaccccgagattctttgcataaaggctcacaggaggtatacactaatgtcaacccaatttacaattggaaaatctttatacattgaaaaaagcaacttttcctccccctctcaataggtacaagaatgcgggtttataaaaggacacagttgaggcaagagaccggacccaaaagttatgtgctctttagtgcctcaagttttccaagcatctctggtaacataaggagtagaaattattttcaaaaacaaaataatcactggttccagaccagtgattattaaccctttttgaattatgaacccctttaaaacctaatgaaatttaaggaccctctcccccaaaatatacatataaaaaaacaaggcagtctatggacctactgagtaactctcaagatagtaagtaaggagagaaagatctatgtttccctctttgataagtatgaaatatttggaggagatgctaatttttgcacgtttatgatatttgcaatctttcatttttgtagcagattatactcaaaaatttgatccagaacttggcccctattcttttatcagcactttaacttgtaaactgaaaagtttaccatcatctgtatgacatcctaatgaggttaaaaagataaaatgcagttatgattatgataggtataactgtatccaggtttccacagcaaaaacaaaacaaaacatacaccatgttctggggttattgacagcctcctaaaaaaa

SEQ ID NO: 440413 - DNA, 3653 bp, Homo sapiens
ggtcgcctactactactaaattcgcggccgcgtcgacagggcagcagaggagaggcagaggataaaggaggaagagaaaagggcagcagaggagaggcagaggataaaagaggaagagaaaagggcagcagaggagaggcaaagggccagggcagaggaggaagagaaggctaaggtagaagagcagaaacgtaacaagcagctagaagagaaaaaacatgccatgcaagagacaaagataaaaggggaaaaggtagaacagaaaatagaagggaaatgggtaaatgaaaagaaagcacaagaagataaacttcagacagctgtcctaaagaaacagggagaagagaagggaactaaagtgcaagctaaaagagaaaagctccaagaagacaagcctaccttcaaaaaagaagagatcaaagatgaaaagattaaaaaggacaaagaacccaaagaagaagttaagagcttcatggatcgaaagaagggatttacagaagttaagtcgcagaatggagaattcatgacccacaaacttaaacatactgagaatactttcagccgccctggagggagggccagcgtggacaccaaggaggctgagggcgccccccaggtggaagccggcaaaaggctggaggagcttcgtcgtcgtcgcggggagaccgagagcgaagagttcgagaagctcaaacagaagcagcaggaggcggctttggagctggaggaactcaagaaaaagagggaggagagaaggaaggtcctggaggaggaagagcagaggaggaagcaggaggaagccgatcgaaaactcagagaggaggaagagaagaggaggctaaaggaagagattgaaaggcgaagagcagaagctgctgagaaacgccagaagatgccagaagatggcttgtcagatgacaagaaaccattcaagtgtttcactcctaaaggttcatctctcaagatagaagagcgagcagaatttttgaataagtctgtgcagaaaagcagtggtgtcaaatcgacccatcaagcagcaatagtctccaagattgacagcagactggagcagtataccagtgcaattgagggaacaaaaagcgcaaaacctacaaagccggcagcctcggatcttcctgttcctgctgaaggtgtacgcaacatcaagagtatgtgggagaaagggaatgtgttttcatcccccactgcagcaggcacaccaaataaggaaactgctggcttgaaggtaggggtttctagccgcatcaatgaatggctaactaaaaccccagatggaaacaagtcacctgctcccaaaccttctgacttgagaccaggagacgtatccagcaagcggaacctctgggaaaagcaatctgtggataaggtcacttcccccactaaggtttgagacagttccagaaagaacccaagctcaagacgcaggacgagctcagttgtagagggctaattcgctctgttttgtatttatgttgatttactaaattgggttcattatcttttatttttcaatatcccagtaaacccatgtatattatcactatatttaataatcacagtctagagatgttcatggtaaaagtactgcctttgcacaggagcctgtttctaaagaaacccatgctgtgaaatagagacttttctactgatcatcataactctgtatctgagcagtgataccaaccacatctgaagtcaacagaagatccaagtttaaaattgcctgcggaatgtgtgcagtatctagaaaaatgaaccgtagtttttgtttttttaaatacagaagtcatgttgtttctgcactttataataaagcatggaagaaattatcttagtaggcaattgtaacactttttgaaagtaacccatttcagatttgaaatactgcaataatggttgtctttaaaaaaaaaaaagaaatgtactgttaaggtattactttttttcatgctgatgattcatatctaaattacattattatgttagctgacagtggtactgattttttaggttggttgttttgtggatttctttagtagtgatagtagcctgaaccacattttagataactcaattatgtatgtatgtgcatacacatatacaaacacactaatggtagaatgcttttttatgtgctagactattatatttagtagtatgtcattgtaactagccaatatcacagcttttgaaaaattaaaaaatcacactatattaatatttcatatttgccaacagaaacatggcagataggtatcaatatgttttcaatgcctgatgacctataagaagaaagtattgaaaagaagagagattagaactgttagaaggagttgaaattttctttttattaatgctatcatctcgaccaagctcaaagcctacttattagaaacaatgaagttcacaataggtcataaggtctcttccttttctaaaattgaaagacaagaaatttagtgccaatattgtacagacagaaattccatgtatgagtctcaacaaagactacctttggctaaatgtctagaagcagagaagtaaagtgagcaaaatccagtgttgaggagtcatgacagtactttgatctttatatactctgaagcatttcttcaaacttttctacttttatttgtcattgatacctgtagtaagttgacaatgtggtgaaatttcaaaattatatgtaacttctactagttttactttctcccccaagtcttttttaactcatgatttttacacacacaatccagaacttattatatagcctctaagtctttattcttcacagtagataatgaaagagtcctccagtgtcttggcaaaatgttctagtatagctggatacatacagtggagttctataaactcatacctcagtggacttaaccaaaattgtgttagtctcaattcctaccacactgagggagcctcccaaataactattttcttatctgcagtattcctccagaagagctaaccagggcagggctggcatgagaagtgacatctgcgttacaaagtctatcttcctcataagtctgtaaagagcaattgaatcttctagctttagcaaacctaagccaaaggaaggaaagccacgaagaatgcagaagtcaaaccctcatgacaaagtaggcacaagtctacaataagctaaatcagaatttacaaatacaagtgtcccaggtagcattgactcccgtcattggagtgaaatggatcaaagtttgaattaaggcctatggtaaggtaacattgctttgttgtacttttgaacaagagctcctcctgatcactattacatatttttctagaaaatctaaagttcagaagagaatgtatcactgctgacttttattccaatatttggatggagtaagttttagggtagaattttgttcagtttggatttaatcttttgaaaagtaaattccttgtttactggtttgactataattctctgttatctttacgaggtaaaactgcaagctgactagcatgttctgtgaatctgccattcctaaaaattttataaacacttgatacttttcactgataatggatcgctccaataaacatatattgtgaaaatgcatccacaataaatggaattccttcctgcaaaa

SEQ ID NO: 440414 - DNA, 3653 bp, Homo sapiens
ggtcgcctactactactaaattcgcggccgcgtcgacagggcagcagaggagaggcagaggataaaggaggaagagaaaagggcagcagaggagaggcagaggataaaagaggaagagaaaagggcagcagaggagaggcaaagggccagggcagaggaggaagagaaggctaaggtagaagagcagaaacgtaacaagcagctagaagagaaaaaacatgccatgcaagagacaaagataaaaggggaaaaggtagaacagaaaatagaagggaaatgggtaaatgaaaagaaagcacaagaagataaacttcagacagctgtcctaaagaaacagggagaagagaagggaactaaagtgcaagctaaaagagaaaagctccaagaagacaagcctaccttcaaaaaagaagagatcaaagatgaaaagattaaaaaggacaaagaacccaaagaagaagttaagagcttcatggatcgaaagaagggatttacagaagttaagtcgcagaatggagaattcatgacccacaaacttaaacatactgagaatactttcagccgccctggagggagggccagcgtggacaccaaggaggctgagggcgccccccaggtggaagccggcaaaaggctggaggagcttcgtcgtcgtcgcggggagaccgagagcgaagagttcgagaagctcaaacagaagcagcaggaggcggctttggagctggaggaactcaagaaaaagagggaggagagaaggaaggtcctggaggaggaagagcagaggaggaagcaggaggaagccgatcgaaaactcagagaggaggaagagaagaggaggctaaaggaagagattgaaaggcgaagagcagaagctgctgagaaacgccagaagatgccagaagatggcttgtcagatgacaagaaaccattcaagtgtttcactcctaaaggttcatctctcaagatagaagagcgagcagaatttttgaataagtctgtgcagaaaagcagtggtgtcaaatcgacccatcaagcagcaatagtctccaagattgacagcagactggagcagtataccagtgcaattgagggaacaaaaagcgcaaaacctacaaagccggcagcctcggatcttcctgttcctgctgaaggtgtacgcaacatcaagagtatgtgggagaaagggaatgtgttttcatcccccactgcagcaggcacaccaaataaggaaactgctggcttgaaggtaggggtttctagccgcatcaatgaatggctaactaaaaccccagatggaaacaagtcacctgctcccaaaccttctgacttgagaccaggagacgtatccagcaagcggaacctctgggaaaagcaatctgtggataaggtcacttcccccactaaggtttgagacagttccagaaagaacccaagctcaagacgcaggacgagctcagttgtagagggctaattcgctctgttttgtatttatgttgatttactaaattgggttcattatcttttatttttcaatatcccagtaaacccatgtatattatcactatatttaataatcacagtctagagatgttcatggtaaaagtactgcctttgcacaggagcctgtttctaaagaaacccatgctgtgaaatagagacttttctactgatcatcataactctgtatctgagcagtgataccaaccacatctgaagtcaacagaagatccaagtttaaaattgcctgcggaatgtgtgcagtatctagaaaaatgaaccgtagtttttgtttttttaaatacagaagtcatgttgtttctgcactttataataaagcatggaagaaattatcttagtaggcaattgtaacactttttgaaagtaacccatttcagatttgaaatactgcaataatggttgtctttaaaaaaaaaaaagaaatgtactgttaaggtattactttttttcatgctgatgattcatatctaaattacattattatgttagctgacagtggtactgattttttaggttggttgttttgtggatttctttagtagtgatagtagcctgaaccacattttagataactcaattatgtatgtatgtgcatacacatatacaaacacactaatggtagaatgcttttttatgtgctagactattatatttagtagtatgtcattgtaactagccaatatcacagcttttgaaaaattaaaaaatcacactatattaatatttcatatttgccaacagaaacatggcagataggtatcaatatgttttcaatgcctgatgacctataagaagaaagtattgaaaagaagagagattagaactgttagaaggagttgaaattttctaaaagacatagtatttagtttataattaaatgcattcttgaagtccagtgtgaattttattaatgctatcatctcgaccaagctcaaagcctacttattagaaacaatgaagttcacaataggtcataaggtctcttccttttcttatgagtctcaacaaagactacctttggctaaatgtctagaagcagagaagtaaagtgagcaaaatccagtgttgaggagtcatgacagtactttgatctttatatactctgaagcatttcttcaaacttttctacttttatttgtcattgatacctgtagtaagttgacaatgtggtgaaatttcaaaattatatgtaacttctactagttttactttctcccccaagtcttttttaactcatgatttttacacacacaatccagaacttattatatagcctctaagtctttattcttcacagtagataatgaaagagtcctccagtgtcttggcaaaatgttctagtatagctggatacatacagtggagttctataaactcatacctcagtggacttaaccaaaattgtgttagtctcaattcctaccacactgagggagcctcccaaataactattttcttatctgcagtattcctccagaagagctaaccagggcagggctggcatgagaagtgacatctgcgttacaaagtctatcttcctcataagtctgtaaagagcaattgaatcttctagctttagcaaacctaagccaaaggaaggaaagccacgaagaatgcagaagtcaaaccctcatgacaaagtaggcacaagtctacaataagctaaatcagaatttacaaatacaagtgtcccaggtagcattgactcccgtcattggagtgaaatggatcaaagtttgaattaaggcctatggtaaggtaacattgctttgttgtacttttgaacaagagctcctcctgatcactattacatatttttctagaaaatctaaagttcagaagagaatgtatcactgctgacttttattccaatatttggatggagtaagttttagggtagaattttgttcagtttggatttaatcttttgaaaagtaaattccttgtttactggtttgactataattctctgttatctttacgaggtaaaactgcaagctgactagcatgttctgtgaatctgccattcctaaaaattttataaacacttgatacttttcactgataatggatcgctccaataaacatatattgtgaaaatgcatccacaataaatggaattccttcctgcaaaa

SEQ ID NO: 440415 - DNA, 3653 bp, Homo sapiens
ggtcgcctactactactaaattcgcggccgcgtcgacagggcagcagaggagaggcagaggataaaggaggaagagaaaagggcagcagaggagaggcagaggataaaagaggaagagaaaagggcagcagaggagaggcaaagggccagggcagaggaggaagagaaggctaaggtagaagagcagaaacgtaacaagcagctagaagagaaaaaacatgccatgcaagagacaaagataaaaggggaaaaggtagaacagaaaatagaagggaaatgggtaaatgaaaagaaagcacaagaagataaacttcagacagctgtcctaaagaaacagggagaagagaagggaactaaagtgcaagctaaaagagaaaagctccaagaagacaagcctaccttcaaaaaagaagagatcaaagatgaaaagattaaaaaggacaaagaacccaaagaagaagttaagagcttcatggatcgaaagaagggatttacagaagttaagtcgcagaatggagaattcatgacccacaaacttaaacatactgagaatactttcagccgccctggagggagggccagcgtggacaccaaggaggctgagggcgccccccaggtggaagccggcaaaaggctggaggagcttcgtcgtcgtcgcggggagaccgagagcgaagagttcgagaagctcaaacagaagcagcaggaggcggctttggagctggaggaactcaagaaaaagagggaggagagaaggaaggtcctggaggaggaagagcagaggaggaagcaggaggaagccgatcgaaaactcagagaggaggaagagaagaggaggctaaaggaagagattgaaaggcgaagagcagaagctgctgagaaacgccagaagatgccagaagatggcttgtcagatgacaagaaaccattcaagtgtttcactcctaaaggttcatctctcaagatagaagagcgagcagaatttttgaataagtctgtgcagaaaagcagtggtgtcaaatcgacccatcaagcagcaatagtctccaagattgacagcagactggagcagtataccagtgcaattgagggaacaaaaagcgcaaaacctacaaagccggcagcctcggatcttcctgttcctgctgaaggtgtacgcaacatcaagagtatgtgggagaaagggaatgtgttttcatcccccactgcagcaggcacaccaaataaggaaactgctggcttgaaggtaggggtttctagccgcatcaatgaatggctaactaaaaccccagatggaaacaagtcacctgctcccaaaccttctgacttgagaccaggagacgtatccagcaagcggaacctctgggaaaagcaatctgtggataaggtcacttcccccactaaggtttgagacagttccagaaagaacccaagctcaagacgcaggacgagctcagttgtagagggctaattcgctctgttttgtatttatgttgatttactaaattgggttcattatcttttatttttcaatatcccagtaaacccatgtatattatcactatatttaataatcacagtctagagatgttcatggtaaaagtactgcctttgcacaggagcctgtttctaaagaaacccatgctgtgaaatagagacttttctactgatcatcataactctgtatctgagcagtgataccaaccacatctgaagtcaacagaagatccaagtttaaaattgcctgcggaatgtgtgcagtatctagaaaaatgaaccgtagtttttgtttttttaaatacagaagtcatgttgtttctgcactttataataaagcatggaagaaattatcttagtaggcaattgtaacactttttgaaagtaacccatttcagatttgaaatactgcaataatggttgtctttaaaaaaaaaaaagaaatgtactgttaaggtattactttttttcatgctgatgattcatatctaaattacattattatgttagctgacagtggtactgattttttaggttggttgttttgtggatttctttagtagtgatagtagcctgaaccacattttagataactcaattatgtatgtatgtgcatacacatatacaaacacactaatggtagaatgcttttttatgtgctagactattatatttagtagtatgtcattgtaactagccaatatcacagcttttgaaaaattaaaaaatcacactatattaatatttcatatttgccaacagaaacatggcagataggtatcaatatgttttcaatgcctgatgacctataagaagaaagtattgaaaagaagagagattagaactgttagaaggagttgaaattttctaaaagacatagtatttagtttataattaaatgcattcttgaagtccagtgtgaattttattaatgctatcatctcgaccaagctcaaagcctacttattagaaacaatgaagttcacaataggtcataaggtctcttccttttctaaaattgaaagacaagaaatttagtgccaatattgtacagacagaaattccatgtatgagtctcaacaaagactacctttggctaaatgtctagaagcagagaagtaaagtgagcaaaatccagtgttgaggagtcatgacagtactttgatctttatatactctgaagcatttcttcaaacttttctacttttatttgtcattgatacctgtagtaagttgacaatgtggtgaaatttcaaaattatatgtaacttctactagttttactttctcccccaagtcttttttaactcatgatttttacacacacaatccagaacttattatatagcctctaagtctttattcttcacagtagataatgaaagagtcctccagtgtcttggcaaaatgttctagtatagctggatacatacagtggagttctataaactcatacctcagtggacttaaccttttcttatctgcagtattcctccagaagagctaaccagggcagggctggcatgagaagtgacatctgcgttacaaagtctatcttcctcataagtctgtaaagagcaattgaatcttctagctttagcaaacctaagccaaaggaaggaaagccacgaagaatgcagaagtcaaaccctcatgacaaagtaggcacaagtctacaataagctaaatcagaatttacaaatacaagtgtcccaggtagcattgactcccgtcattggagtgaaatggatcaaagtttgaattaaggcctatggtaaggtaacattgctttgttgtacttttgaacaagagctcctcctgatcactattacatatttttctagaaaatctaaagttcagaagagaatgtatcactgctgacttttattccaatatttggatggagtaagttttagggtagaattttgttcagtttggatttaatcttttgaaaagtaaattccttgtttactggtttgactataattctctgttatctttacgaggtaaaactgcaagctgactagcatgttctgtgaatctgccattcctaaaaattttataaacacttgatacttttcactgataatggatcgctccaataaacatatattgtgaaaatgcatccacaataaatggaattccttcctgcaaaa

SEQ ID NO: 440416 - DNA, 3550 bp, Homo sapiens
ggtcgcctactactactaaattcgcggccgcgtcgacagggcagcagaggagaggcagaggataaaggaggaagagaaaagggcagcagaggagaggcagaggataaaagaggaagagaaaagggcagcagaggagaggcaaagggccagggcagaggaggaagagaaggctaaggtagaagagcagaaacgtaacaagcagctagaagagaaaaaacatgccatgcaagagacaaagataaaaggggaaaaggtagaacagaaaatagaagggaaatgggtaaatgaaaagaaagcacaagaagataaacttcagacagctgtcctaaagaaacagggagaagagaagggaactaaagtgcaagctaaaagagaaaagctccaagaagacaagcctaccttcaaaaaagaagagatcaaagatgaaaagattaaaaaggacaaagaacccaaagaagaagttaagagcttcatggatcgaaagaagggatttacagaagttaagtcgcagaatggagaattcatgacccacaaacttaaacatactgagaatactttcagccgccctggagggagggccagcgtggacaccaaggaggctgagggcgccccccaggtggaagccggcaaaaggctggaggagcttcgtcgtcgtcgcggggagaccgagagcgaagagttcgagaagctcaaacagaagcagcaggaggcggctttggagctggaggaactcaagaaaaagagggaggagagaaggaaggtcctggaggaggaagagcagaggaggaagcaggaggaagccgatcgaaaactcagagaggaggaagagaagaggaggctaaaggaagagattgaaaggcgaagagcagaagctgctgagaaacgccagaagatgccagaagatggcttgtcagatgacaagaaaccattcaagtgtttcactcctaaaggttcatctctcaagatagaagagcgagcagaatttttgaataagtctgtgcagaaaagcagtggtgtcaaatcgacccatcaagcagcaatagtctccaagattgacagcagactggagcagtataccagtgcaattgagggaacaaaaagcgcaaaacctacaaagccggcagcctcggatcttcctgttcctgctgaaggtgtacgcaacatcaagagtatgtgggagaaagggaatgtgttttcatcccccactgcagcaggcacaccaaataaggaaactgctggcttgaaggtaggggtttctagccgcatcaatgaatggctaactaaaaccccagatggaaacaagtcacctgctcccaaaccttctgacttgagaccaggagacgtatccagcaagcggaacctctgggaaaagcaatctgtggataaggtcacttcccccactaaggtttgagacagttccagaaagaacccaagctcaagacgcaggacgagctcagttgtagagggctaattcgctctgttttgtatttatgttgatttactaaattgggttcattatcttttatttttcaatatcccagtaaacccatgtatattatcactatatttaataatcacagtctagagatgttcatggtaaaagtactgcctttgcacaggagcctgtttctaaagaaacccatgctgtgaaatagagacttttctactgatcatcataactctgtatctgagcagtgataccaaccacatctgaagtcaacagaagatccaagtttaaaattgcctgcggaatgtgtgcagtatctagaaaaatgaaccgtagtttttgtttttttaaatacagaagtcatgttgtttctgcacttatctaaattacattattatgttagctgacagtggtactgattttttaggttggttgttttgtggatttctttagtagtgatagtagcctgaaccacattttagataactcaattatgtatgtatgtgcatacacatatacaaacacactaatggtagaatgcttttttatgtgctagactattatatttagtagtatgtcattgtaactagccaatatcacagcttttgaaaaattaaaaaatcacactatattaatatttcatatttgccaacagaaacatggcagataggtatcaatatgttttcaatgcctgatgacctataagaagaaagtattgaaaagaagagagattagaactgttagaaggagttgaaattttctaaaagacatagtatttagtttataattaaatgcattcttgaagtccagtgtgaattttattaatgctatcatctcgaccaagctcaaagcctacttattagaaacaatgaagttcacaataggtcataaggtctcttccttttctaaaattgaaagacaagaaatttagtgccaatattgtacagacagaaattccatgtatgagtctcaacaaagactacctttggctaaatgtctagaagcagagaagtaaagtgagcaaaatccagtgttgaggagtcatgacagtactttgatctttatatactctgaagcatttcttcaaacttttctacttttatttgtcattgatacctgtagtaagttgacaatgtggtgaaatttcaaaattatatgtaacttctactagttttactttctcccccaagtcttttttaactcatgatttttacacacacaatccagaacttattatatagcctctaagtctttattcttcacagtagataatgaaagagtcctccagtgtcttggcaaaatgttctagtatagctggatacatacagtggagttctataaactcatacctcagtggacttaaccaaaattgtgttagtctcaattcctaccacactgagggagcctcccaaataactattttcttatctgcagtattcctccagaagagctaaccagggcagggctggcatgagaagtgacatctgcgttacaaagtctatcttcctcataagtctgtaaagagcaattgaatcttctagctttagcaaacctaagccaaaggaaggaaagccacgaagaatgcagaagtcaaaccctcatgacaaagtaggcacaagtctacaataagctaaatcagaatttacaaatacaagtgtcccaggtagcattgactcccgtcattggagtgaaatggatcaaagtttgaattaaggcctatggtaaggtaacattgctttgttgtacttttgaacaagagctcctcctgatcactattacatatttttctagaaaatctaaagttcagaagagaatgtatcactgctgacttttattccaatatttggatggagtaagttttagggtagaattttgttcagtttggatttaatcttttgaaaagtaaattccttgtttactggtttgactataattctctgttatctttacgaggtaaaactgcaagctgactagcatgttctgtgaatctgccattcctaaaaattttataaacacttgatacttttcactgataatggatcgctccaataaacatatattgtgaaaatgcatccacaataaatggaattccttcctgcaaaa

SEQ ID NO: 440417 - DNA, 2282 bp, Homo sapiens
ggtcgcctactactactaaattcgcggccgcgtcgacaggggtttctagccgcatcaatgaatggctaactaaaaccccagatggaaacaagtcacctgctcccaaaccttctgacttgagaccaggagacgtatccagcaagcggaacctctgggaaaagcaatctgtggataaggtcacttcccccactaaggagcctgtttctaaagaaacccatgctgtgaaatagagacttttctactgatcatcataactctgtatctgagcagtgataccaaccacatctgaagtcaacagaagatccaagtttaaaattgcctgcggaatgtgtgcagtatctagaaaaatgaaccgtagtttttgtttttttaaatacagaagtcatgttgtttctgcactttataataaagcatggaagaaattatcttagtaggcaattgtaacactttttgaaagtaacccatttcagatttgaaatactgcaataatggttgtctttaaaaaaaaaaaagaaatgtactgttaaggtattactttttttcatgctgatgattcatatctaaattacattattatgttagctgacagtggtactgattttttaggttggttgttttgtggatttctttagtagtgatagtagcctgaaccacattttagataactcaattatgtatgtatgtgcatacacatatacaaacacactaatggtagaatgcttttttatgtgctagactattatatttagtagtatgtcattgtaactagccaatatcacagcttttgaaaaattaaaaaatcacactatattaatatttcatatttgccaacagaaacatggcagataggtatcaatatgttttcaatgcctgatgacctataagaagaaagtattgaaaagaagagagattagaactgttagaaggagttgaaattttctaaaagacatagtatttagtttataattaaatgcattcttgaagtccagtgtgaattttattaatgctatcatctcgaccaagctcaaagcctacttattagaaacaatgaagttcacaataggtcataaggtctcttccttttctaaaattgaaagacaagaaatttagtgccaatattgtacagacagaaattccatgtatgagtctcaacaaagactacctttggctaaatgtctagaagcagagaagtaaagtgagcaaaatccagtgttgaggagtcatgacagtactttgatctttatatactctgaagcatttcttcaaacttttctacttttatttgtcattgatacctgtagtaagttgacaatgtggtgaaatttcaaaattatatgtaacttctactagttttactttctcccccaagtcttttttaactcatgatttttacacacacaatccagaacttattatatagcctctaagtctttattcttcacagtagataatgaaagagtcctccagtgtcttggcaaaatgttctagtatagctggatacatacagtggagttctataaactcatacctcagtggacttaaccaaaattgtgttagtctcaattcctaccacactgagggagcctcccaaataactattttcttatctgcagtattcctccagaagagctaaccagggcagggctggcatgagaagtgacatctgcgttacaaagtctatcttcctcataagtctgtaaagagcaattgaatcttctagctttagcaaacctaagccaaaggaaggaaagccacgaagaatgcagaagtcaaaccctcatgacaaagtaggcacaagtctacaataagctaaatcagaatttacaaatacaagtgtcccaggtagcattgactcccgtcattggagtgaaatggatcaaagtttgaattaaggcctatggtaaggtaacattgctttgttgtacttttgaacaagagctcctcctgatcactattacatatttttctagaaaatctaaagttcagaagagaatgtatcactgctgacttttattccaatatttggatggagtaagttttagggtagaattttgttcagtttggatttaatcttttgaaaagtaaattccttgtttactggtttgactataattctctgttatctttacgaggtaaaactgcaagctgactagcatgttctgtgaatctgccattcctaaaaattttataaacacttgatacttttcactgataatggatcgctccaataaacatatattgtgaaaatgcatccacaataaatggaattccttcctgcaaaa

SEQ ID NO: 440418 - DNA, 4396 bp, Homo sapiens
ggtcgcctactactactaaattcgcggccgcgtcgacagggcagcagaggagaggcagaggataaaggaggaagagaaaagggcagcagaggagaggcagaggataaaagaggaagagaaaagggcagcagaggagaggcaaagggccagggcagaggaggaagagaaggctaaggtagaagagcagaaacgtaacaagcagctagaagagaaaaaacatgccatgcaagagacaaagataaaaggggaaaaggtagaacagaaaatagaagggaaatgggtaaatgaaaagaaagcacaagaagataaacttcagacagctgtcctaaagaaacagggagaagagaagggaactaaagtgcaagctaaaagagaaaagctccaagaagacaagcctaccttcaaaaaagaagagatcaaagatgaaaagattaaaaaggacaaagaacccaaagaagaagttaagagcttcatggatcgaaagaagggatttacagaagttaagtcgcagaatggagaattcatgacccacaaacttaaacatactgagaatactttcagccgccctggagggagggccagcgtggacaccaaggaggctgagggcgccccccaggtggaagccggcaaaaggctggaggagcttcgtcgtcgtcgcggggagaccgagagcgaagagttcgagaagctcaaacagaagcagcaggaggcggctttggagctggaggaactcaagaaaaagagggaggagagaaggaaggtcctggaggaggaagagcagaggaggaagcaggaggaagccgatcgaaaactcagagaggaggaagagaagaggaggctaaaggaagagattgaaaggcgaagagcagaagctgctgagaaacgccagaagatgccagaagatggcttgtcagatgacaagaaaccattcaagtgtttcactcctaaaggttcatctctcaagatagaagagcgagcagaatttttgaataagtctgtgcagaaaagcagtggtgtcaaatcgacccatcaagcagcaatagtctccaagattgacagcagactggagcagtataccagtgcaattgagggaacaaaaagcgcaaaacctacaaagccggcagcctcggatcttcctgttcctgctgaaggtgtacgcaacatcaagagtatgtgggagaaagggaatgtgttttcatcccccactgcagcaggcacaccaaataaggaaactgctggcttgaaggtaggggtttctagccgcatcaatgaatggctaactaaaaccccagatggaaacaagtcacctgctcccaaaccttctgacttgagaccaggagacgtatccagcaagcggaacctctgggaaaagcaatctgtggataaggtcacttcccccactaaggtttgagacagttccagaaagaacccaagctcaagacgcaggacgagctcagttgtagagggctaattcgctctgttttgtatttatgttgatttactaaattgggttcattatcttttatttttcaatatcccagtaaacccatgtatattatcactatatttaataatcacagtctagagatgttcatggtaaaagtactgcctttgcacaggagcctgtttctaaagaaacccatgctgtgaaatagagacttttctactgatcatcataactctgtatctgagcagtgataccaaccacatctgaagtcaacagaagatccaagtttaaaattgcctgcggaatgtgtgcagtatctagaaaaatgaaccgtagtttttgtttttttaaatacagaagtcatgttgtttctgcactttataataaagcatggaagaaattatcttagtaggcaattgtaacactttttgaaagtaacccatttcagatttgaaatactgcaataatggttgtctttaaaaaaaaaaaagaaatgtactgttaaggtattactttttttcatgctgatgattcatatctaaattacattattatgttagctgacagtggtactgattttttaggttggttgttttgtggatttctttagtagtgatagtagcctgaaccacattttagataactcaattatgtatgtatgtgcatacacatatacaaacacactaatggtagaatgcttttttatgtgctagactattatatttagtagtatgtcattgtaactagccaatatcacagcttttgaaaaattaaaaaatcacactatattaatatttcatatttgccaacagaaacatggcagataggtatcaatatgttttcaatgcctgatgacctataagaagaaagtattgaaaagaagagagattagaactgttagaaggagttgaaattttctaaaagacatagtatttagtttataattaaatgcattcttgaagtccagtgtgaattttattaatgctatcatctcgaccaagctcaaagcctacttattagaaacaatgaagttcacaataggtcataaggtctcttccttttctaaaattgaaagacaagaaatttagtgccaatattgtacagacagaaattccatgtatgagtctcaacaaagactacctttggctaaatgtctagaagcagagaagtaaagtgagcaaaatccagtgttgaggagtcatgacagtactttgatctttatatactctgaagcatttcttcaaacttttctacttttatttgtcattgatacctgtagtaagttgacaatgtggtgaaatttcaaaattatatgtaacttctactagttttactttctcccccaagtcttttttaactcatgatttttacacacacaatccagaacttattatatagcctctaagtctttattcttcacagtagataatgaaagagtcctccagtgtcttggcaaaatgttctagtatagctggatacatacagtggagttctataaactcatacctcagtggacttaaccaaaattgtgttagtctcaattcctaccacactgagggagcctcccaaataactattttcttatctgcagtattcctccagaagagctaaccagggcagggctggcatgagaagtgacatctgcgttacaaagtctatcttcctcataagtctgtaaagagcaattgaatcttctagctttagcaaacctaagccaaaggaaggaaagccacgaagaatgcagaagtcaaaccctcatgacaaagtaggcacaagtctacaataagctaaatcagaatttacaaatacaagtgtcccaggtagcattgactcccgtcattggagtgaaatggatcaaagtttgaattaaggcctatggtaaggtaacattgctttgttgtacttttgaacaagagctcctcctgatcactattacatatttttctagaaaatctaaagttcagaagagaatgtatcactgctgacttttattccaatatttggatggagtaagttttagggtagaattttgttcagtttggatttaatcttttgaaaagtaaattccttgtttactggtttgactataattctctgttatctttacgaggtaaaactgcaagctgactagcatgttctgtgaatctgccattcctaaaaattttataaacacttgatacttttcactgataatggatcgctccaataaacatatattgtgaaaatgcatccacaataaatggaattccttcctgcaaaatgtctttttctcacttatttttatgtacaatattgatagtgagaggtatgtctattataataaagattatggcacagtaaaacctgtaaaaaaaaaaaaaaaaaaaaaaaagaacaagaaaacgaaagaaaaacagaagagaagcagaaagaagaggaagcgaaaaggacgacagcccaaggcaagaaaaaagggagaacacaaaagacgcaggcgggtgggcgggggggcggggggcggaggaagaactaggagcgagcaagaaggcgggacgcggacggggggcgacgacaaaaggaggaaggagagcgaggagagtgacgaacagaaaaggaaagcggcggggtaggagagaaaggggagggacgacaccaaaagaaagagacgggcgggggagaaaagaggagggagagaaaagcgaaacacgaagaaggcgagaggcgagacagagagaaaagagagaagccaatacacagcgaacaaaaagaaagagaggaaaaataaagacagcacggcgagaggcgggcgcaaacaaggaggagaaagaaacagacagcagaagaacacacaacaacaaaaagggaggacagagacagaagagcgagaaaaccgacaaacacgagacaagcacaaaacaaaagaagaaacaaagagagaagagaagcacaggcgaaggcgacacaagacag

SEQ ID NO: 440419 - DNA, 3915 bp, Homo sapiens
  misc_feature (3900)..(3900): n is a, c, g, or t
ggtcgcctactactactaaattcgcggccgcgtcgacagggcagcagaggagaggcagaggataaaggaggaagagaaaagggcagcagaggagaggcagaggataaaagaggaagagaaaagggcagcagaggagaggcaaagggccagggcagaggaggaagagaaggctaaggtagaagagcagaaacgtaacaagcagctagaagagaaaaaacatgccatgcaagagacaaagataaaaggggaaaaggtagaacagaaaatagaagggaaatgggtaaatgaaaagaaagcacaagaagataaacttcagacagctgtcctaaagaaacagggagaagagaagggaactaaagtgcaagctaaaagagaaaagctccaagaagacaagcctaccttcaaaaaagaagagatcaaagatgaaaagattaaaaaggacaaagaacccaaagaagaagttaagagcttcatggatcgaaagaagggatttacagaagttaagtcgcagaatggagaattcatgacccacaaacttaaacatactgagaatactttcagccgccctggagggagggccagcgtggacaccaaggaggctgagggcgccccccaggtggaagccggcaaaaggctggaggagcttcgtcgtcgtcgcggggagaccgagagcgaagagttcgagaagctcaaacagaagcagcaggaggcggctttggagctggaggaactcaagaaaaagagggaggagagaaggaaggtcctggaggaggaagagcagaggaggaagcaggaggaagccgatcgaaaactcagagaggaggaagagaagaggaggctaaaggaagagattgaaaggcgaagagcagaagctgctgagaaacgccagaagatgccagaagatggcttgtcagatgacaagaaaccattcaagtgtttcactcctaaaggttcatctctcaagatagaagagcgagcagaatttttgaataagtctgtgcagaaaagcagtggtgtcaaatcgacccatcaagcagcaatagtctccaagattgacagcagactggagcagtataccagtgcaattgagggaacaaaaagcgcaaaacctacaaagccggcagcctcggatcttcctgttcctgctgaaggtgtacgcaacatcaagagtatgtgggagaaagggaatgtgttttcatcccccactgcagcaggcacaccaaataaggaaactgctggcttgaaggtaggggtttctagccgcatcaatgaatggctaactaaaaccccagatggaaacaagtcacctgctcccaaaccttctgacttgagaccaggagacgtatccagcaagcggaacctctgggaaaagcaatctgtggataaggtcacttcccccactaaggtttgagacagttccagaaagaacccaagctcaagacgcaggacgagctcagttgtagagggctaattcgctctgttttgtatttatgttgatttactaaattgggttcattatcttttatttttcaatatcccagtaaacccatgtatattatcactatatttaataatcacagtctagagatgttcatggtaaaagtactgcctttgcacaggagcctgtttctaaagaaacccatgctgtgaaatagagacttttctactgatcatcataactctgtatctgagcagtgataccaaccacatctgaagtcaacagaagatccaagtttaaaattgcctgcggaatgtgtgcagtatctagaaaaatgaaccgtagtttttgtttttttaaatacagaagtcatgttgtttctgcactttataataaagcatggaagaaattatcttagtaggcaattgtaacactttttgaaagtaacccatttcagatttgaaatactgcaataatggttgtctttaaaaaaaaaaaagaaatgtactgttaaggtattactttttttcatgctgatgattcatatctaaattacattattatgttagctgacagtggtactgattttttaggttggttgttttgtggatttctttagtagtgatagtagcctgaaccacattttagataactcaattatgtatgtatgtgcatacacatatacaaacacactaatggtagaatgcttttttatgtgctagactattatatttagtagtatgtcattgtaactagccaatatcacagcttttgaaaaattaaaaaatcacactatattaatatttcatatttgccaacagaaacatggcagataggtatcaatatgttttcaatgcctgatgacctataagaagaaagtattgaaaagaagagagattagaactgttagaaggagttgaaattttctaaaagacatagtatttagtttataattaaatgcattcttgaagtccagtgtgaattttattaatgctatcatctcgaccaagctcaaagcctacttattagaaacaatgaagttcacaataggtcataaggtctcttccttttctaaaattgaaagacaagaaatttagtgccaatattgtacagacagaaattccatgtatgagtctcaacaaagactacctttggctaaatgtctagaagcagagaagtaaagtgagcaaaatccagtgttgaggagtcatgacagtactttgatctttatatactctgaagcatttcttcaaacttttctacttttatttgtcattgatacctgtagtaagttgacaatgtggtgaaatttcaaaattatatgtaacttctactagttttactttctcccccaagtcttttttaactcatgatttttacacacacaatccagaacttattatatagcctctaagtctttattcttcacagtagataatgaaagagtcctccagtgtcttggcaaaatgttctagtatagctggatacatacagtggagttctataaactcatacctcagtggacttaaccaaaattgtgttagtctcaattcctaccacactgagggagcctcccaaataactattttcttatctgcagtattcctccagaagagctaaccagggcagggctggcatgagaagtgacatctgcgttacaaagtctatcttcctcataagtctgtaaagagcaattgaatcttctagctttagcaaacctaagccaaaggaaggaaagccacgaagaatgcagaagtcaaaccctcatgacaaagtaggcacaagtctacaataagctaaatcagaatttacaaatacaagtgtcccaggtagcattgactcccgtcattggagtgaaatggatcaaagtttgaattaaggcctatggtaaggtaacattgctttgttgtacttttgaacaagagctcctcctgatcactattacatatttttctagaaaatctaaagttcagaagagaatgtatcactgctgacttttattccaatatttggatggagtaagttttagggtagaattttgttcagtttggatttaatcttttgaaaagtaaattccttgtttactggtttgactataattctctgttatctttacgaggtaaaactgcaagctgactagcatgttctgtgaatctgccattcctaaaaattttataaaccgtttgatatcacgatatgatcgcataatttgtgaatgctcaataagatctctgcaaaaaaaaataagcggcaattctgggcagtgtcgtttgcaggctagaataaagcgcgttaatagaagctacctgggatcttgggaagaccctactcgtgttgcatatggacaactccctacgaattaagcctaggtaatatacatttcgtgttacgtgtaactagcgcatatgctggtgaagtcgctacggagtatgatttgaacattatcccggactattaaaagnaaaaccaaaaaaggc

SEQ ID NO: 440420 - DNA, 3627 bp, Homo sapiens
ggtcgcctactactactaaattcgcggccgcgtcgacagggcagcagaggagaggcagaggataaaggaggaagagaaaagggcagcagaggagaggcagaggataaaagaggaagagaaaagggcagcagaggagaggcaaagggccagggcagaggaggaagagaaggctaaggtagaagagcagaaacgtaacaagcagctagaagagaaaaaacatgccatgcaagagacaaagataaaaggggaaaaggtagaacagaaaatagaagggaaatgggtaaatgaaaagaaagcacaagaagataaacttcagacagctgtcctaaagaaacagggagaagagaagggaactaaagtgcaagctaaaagagaaaagctccaagaagacaagcctaccttcaaaaaagaagagatcaaagatgaaaagattaaaaaggacaaagaacccaaagaagaagttaagagcttcatggatcgaaagaagggatttacagaagttaagtcgcagaatggagaattcatgacccacaaacttaaacatactgagaatactttcagccgccctggagggagggccagcgtggacaccaaggaggctgagggcgccccccaggtggaagccggcaaaaggctggaggagcttcgtcgtcgtcgcggggagaccgagagcgaagagttcgagaagctcaaacagaagcagcaggaggcggctttggagctggaggaactcaagaaaaagagggaggagagaaggaaggtcctggaggaggaagagcagaggaggaagcaggaggaagccgatcgaaaactcagagaggaggaagagaagaggaggctaaaggaagagattgaaaggcgaagagcagaagctgctgagaaacgccagaagatgccagaagatggcttgtcagatgacaagaaaccattcaagtgtttcactcctaaaggttcatctctcaagatagaagagcgagcagaatttttgaataagtctgtgcagaaaagcagtggtgtcaaatcgacccatcaagcagcaatagtctccaagattgacagcagactggagcagtataccagtgcaattgagggaacaaaaagcgcaaaacctacaaagccggcagcctcggatcttcctgttcctgctgaaggtgtacgcaacatcaagagtatgtgggagaaagggaatgtgttttcatcccccactgcagcaggcacaccaaataaggaaactgctggcttgaaggtaggggtttctagccgcatcaatgaatggctaactaaaaccccagatggaaacaagtcacctgctcccaaaccttctgacttgagaccaggagacgtatccagcaagcggaacctctgggaaaagcaatctgtggataaggtcacttcccccactaaggtttgagacagttccagaaagaacccaagctcaagacgcaggacgagctcagttgtagagggctaattcgctctgttttgtatttatgttgatttactaaattgggttcattatcttttatttttcaatatcccagtaaacccatgtatattatcactatatttaataatcacagtctagagatgttcatggtaaaagtactgcctttgcacaggagcctgtttctaaagaaacccatgctgtgaaatagagacttttctactgatcatcataactctgtatctgagcagtgataccaaccacatctgaagtcaacagaagatccaagtttaaaattgcctgcggaatgtgtgcagtatctagaaaaatgaaccgtagtttttgtttttttaaatacagaagtcatgttgtttctgcactttataataaagcatggaagaaattatcttagtaggcaattgtaacactttttgaaagtaacccatttcagatttgaaatactgcaataatggttgtctttaaaaaaaaaaaagaaatgtactgttaaggtattactttttttcatgctgatgattcatatctaaattacattattatgttagctgacagtggtactgattttttaggttggttgttttgtggatttctttagtagtgatagtagcctgaaccacattttagataactcaattatgtatgtatgtgcatacacatatacaaacacactaatggtagaatgcttttttatgtgctagactattatatttagtagtatgtcattgtaactagccaatatcacagcttttgaaaaattaaaaaatcacactatattaatatttcatatttgccaacagaaacatggcagataggtatcaatatgttttcaatgcctgatgacctataagaagaaagtattgaaaagaagagagattagaactgttagaaggagttgaaattttctaaaagacatagtatttagtttataattaaatgcattcttgaagtccagtgtgaattttattaatgctatcatctcgaccaagctcaaagcctacttattagaaacaatgaagttcacaataggtcataaggtctcttccttttctaaaattgaaagacaagaaatttagtgccaatattgtacagacagaaattccatgtatgagtctcaacaaagactacctttggctaaatgtctagaagcagagaagtaaagtgagcaaaatccagtgttgaggagtcatgacagtactttgatctttatatactctgaagcatttcttcaaacttttctacttttatttgtcattgatacctgtagtaagttgacaatgtggtgaaatttcaaaattatatgtaacttctactagttttactttctcccccaagtcttttttaactcatgatttttacacacacaatccagaacttattatatagcctctaagtctttattcttcacagtagataatgaaagagtcctccagtgtcttggcaaaatgttctagtatagctggatacatacagtggagttctataaactcatacctcagtggacttaaccaaaattgtgttagtctcaattcctaccacactgagggagcctcccaaataactattttcttatctgcagtattcctccagaagagctaaccagggcagggctggcatgagaagtgacatctgcgttacaaagtctatcttcctcataagtctgtaaagagcaattgaatcttctagctttagcaaacctaagccaaaggaaggaaagccacgaagaatgcagaagtcaaaccctcatgacaaagtaggcacaagtctacaataagctaaatcagaatttacaaatacaagtgtcccaggtagcattgactcccgtcattggagtgaaatggatcaaagtttgaattaaggcctatggtaaggtaacattgctttgttgtacttttgaacaagagctcctcctgccccaagtcttatattaactcatgatttctacacacacaatccagaagtttttatatagcctctaagtcttaattcttcatagtagataatgaaagagtcctccagggtcatggcgaaatgtactagtatagctggatacatacaggtggagtgctataaactcatacctcagtggacttaaccaaagattgtgttagtctcaattcctaccacactgagggagcctcccaaataactattttcttatctgcagt

SEQ ID NO: 440421 - DNA, 2340 bp, Homo sapiens
ggtcgcctactactactaaattcgcggccgcgtcgacagggcagcagaggagaggcagaggataaaggaggaagagaaaagggcagcagaggagaggcagaggataaaagaggaagagaaaagggcagcagaggagaggcaaagggccagggcagaggaggaagagaaggctaaggtagaagagcagaaacgtaacaagcagctagaagagaaaaaacatgccatgcaagagacaaagataaaaggggaaaaggtagaacagaaaatagaagggaaatgggtaaatgaaaagaaagcacaagaagataaacttcagacagctgtcctaaagaaacagggagaagagaagggaactaaagtgcaagctaaaagagaaaagctccaagaagacaagcctaccttcaaaaaagaagagatcaaagatgaaaagattaaaaaggacaaagaacccaaagaagaagttaagagcttcatggatcgaaagaagggatttacagaagttaagtcgcagaatggagaattcatgacccacaaacttaaacatactgagaatactttcagccgccctggagggagggccagcgtggacaccaaggaggctgagggcgccccccaggtggaagccggcaaaaggctggaggagcttcgtcgtcgtcgcggggagaccgagagcgaagagttcgagaagctcaaacagaagcagcaggaggcggctttggagctggaggaactcaagaaaaagagggaggagagaaggaaggtcctggaggaggaagagcagaggaggaagcaggaggaagccgatcgaaaactcagagaggaggaagagaagaggaggctaaaggaagagattgaaaggcgaagagcagaagctgctgagaaacgccagaagatgccagaagatggcttgtcagatgacaagaaaccattcaagtgtttcactcctaaaggttcatctctcaagatagaagagcgagcagaatttttgaataagtctgtgcagaaaagcagtggtgtcaaatcgacccatcaagcagcaatagtctccaagattgacagcagactggagcagtataccagtgcaattgagggaacaaaaagcgcaaaacctacaaagccggcagcctcggatcttcctgttcctgctgaaggtgtacgcaacatcaagagtatgtgggagaaagggaatgtgttttcatcccccactgcagcaggcacaccaaataaggaaactgctggcttgaaggtaggggtttctagccgcatcaatgaatggctaactaaaaccccagatggaaacaagtcacctgctcccaaaccttctgacttgagaccaggagacgtatccagcaagcggaacctctgggaaaagcaatctgtggataaggtcacttcccccactaaggtttgagacagttccagaaagaacccaagctcaagacgcaggacgagctcagttgtagagggctaattcgctctgttttgtatttatgttgatttactaaattgggttcattatcttttatttttcaatatcccagtaaacccatgtatattatcactatatttaataatcacagtctagagatgttcatggtaaaagtactgcctttgcacaggagcctgtttctaaagaaacccatgctgtgaaatagagacttttctactgatcatcataactctgtatctgagcagtgataccaaccacatctgaagtcaacagaagatccaagtttaaaattgcctgcggaatgtgtgcagtatctagaaaaatgaaccgtagtttttgtttttttaaatacagaagtcatgttgtttctgcactttataataaagcatggaagaaattatcttagtaggcaattgtaacactttttgaaagtaacccatttcagatttgaaatactgcaataatggttgtctttaaaaaaaaaaatctaaattacattattatgttagctgacagtggtactgattttttaggttggttgttttgtggatttctttagtagtgatagtagcctgaaccacattttagataactcactctcgctgcacgtccactcccctctcccctcccctccaggcccaccgctctctacgttgctcaccactcactcacccctttcccctctccctcgctcccatctcccctttccatcccctcccacccccactctcccactcctccctatctcctccctctcccctcacacccccctccacatcctccctctcctctcgccttctcatccgccctctctccctcctccctgcttccccaccttcccctcccctgcttctccccaccttccccactcgtcccttcctccctccccc

SEQ ID NO: 440422 - DNA, 911 bp, Homo sapiens
ggtcgcctactactactaaattcgcggccgcgtcgacagggcagcagaggagaggcagaggataaaggaggaagagaaaagggcagcagaggagaggcagaggataaaagaggaagagaaaagggcagcagaggagaggcaaagggccagggcagaggaggaagagaaggctaaggtagaagagcagaaacgtaacaagcagctagaagagaaaaaacatgccatgcaagagacaaagataaaaggggaaaaggtagaacagaaaatagaagggaaatgggtaaatgaaaagaaagcacaagaagataaacttcagacagctgtcctaaagaaacaggtacagtaaacattttgcaccaaatgtgtgatgcctgtgacttgtgagaaatgtaatgcacatctgatttgggactgaggccacatgcatatagctcacatgcttgatcatttggcaagctgttcattttttcaggccatagcgatacacaagcatgcagcaattgattgatggctgaatattcaatcaaccaaatttactgggacagccagtaaatttggctgtccagaagacagagagaaattaattgctctgtgcttgattgttatgaatacccaaaaaaagaattaatccaaagatgataaatgtggtggtggtgtgttggcttctgattctgcgcttgcatctaaactcgttcttttaattatctttcctctatccataggtctgcatgaggcaagaggcccataactccttacctcactcatgggtttgacgttgaattaaaaaaatgataaaagctggggtgggaaagagacatgaagaataatggtcagacatttcatcttaagaaggcaaaaacaggctgggtacagtggctcacacctgtaatcccagcactttgggaggctga

SEQ ID NO: 440423 - DNA, 3550 bp, Homo sapiens
gcagagtgttgctgtgtgtgcttgtgatttgtattttatttgatgtaaacgtgaaggcagagtattttctaacactgtaattcaactaggttttgtgtctcctggatctatttttttttcttgttgttctgaggagctgatatacttggaaatattaggtttaagatatgcagatgtccaacttatatacatagtcaagggtttagagtctggagacaggaggctggcaatttcaactagggggcagcaagaagcgaaaccctggccttaaaattccaaaagaagcatttgaacaacctcagaccagttccacaccacctcgagatttagactccaaggcttgcatttctattggaaatcagaactttgaggtgaaggcagatgacctggagcctataatggaactgggacgaggtgcgtacggggtggtggagaagatgcggcacgtgcccagcgggcagatcatggcagtgaagcggatccgagccacagtaaatagccaggaacagaaacggctactgatggatttggatatttccatgaggacggtggactgtccattcactgtcaccttttatggcgcactgtttcgggagggtgatgtgtggatctgcatggagctcatggatacatcactagataaattctacaaacaagttattgataaaggccagacaattccagaggacatcttagggaaaatagcagtttctattgtaaaagcattagaacatttacatagtaagctgtctgtcattcacagagacgtcaagccttctaatgtactcatcaatgctctcggtcaagtgaagatgtgcgattttggaatcagtggctacttggtggactctgttgctaaaacaattgatgcaggttgcaaaccatacatggcccctgaaagaataaacccagagctcaaccagaagggatacagtgtgaagtctgacatttggagtctgggcatcacgatgattgagttggccatccttcgatttccctatgattcatggggaactccatttcagcagctcaaacaggtggtagaggagccatcgccacaactcccagcagacaagttctctgcagagtttgttgactttacctcacagtgcttaaagaagaattccaaagaacggcctacatacccagagctaatgcaacatccatttttcaccctacatgaatccaaaggaacagatgtggcatcttttgtaaaactgattcttggagactaaaaagcagtggacttaatcggttgaccctactgtggattggtgggtttcggggtgaagcaagttcactacagcatcaatagaaagtcatctttgagataatttaaccctgcctctcagagggttttctctcccaattttctttttactccccctcttaagggggccttggaatctatagtatagaatgaactgtctagatggatgaattatgataaaggcttaggacttcaaaaggtgattaaatatttaatgatgtgtcatatgagtcctcaagcttctcagacttctcttattctttacaaaatgaatgcattggccctgacaaaaaggtgctacggtagtgatgaaattataagtagatttgtagtttgtcccatttattattttaatatttatgtttaagtgcttggttgaaaagattccattttatacaagaagggagattcaaaaaaaaaatataaggttgggttagcaatatttatagggcttttattttttaagttcaattgtgtctgtggtccagaagaaattatttaatatgcatctttgagaatattataaaaatatcaaaaaggagctcttcttgtgaaatgtctgttccagctgttgtgactgctgccatttttggaaacatctgcccaatcctgggtgatcaccacatcttttaggggaagtgacaagatgctctggtcatactctttttcccaactttggaaaacataaaaatcactcatataacagctcaaagagtaaaacatttggttcttctgacacttgtggtatagtattagtggaaagtgatttgtaatatgattttatatccacctacctattcatctacctgtgtgtatgtgtgtgtttgtgtgtctatttggcaattcacaagtcctgccaagtggtttctatgagcatctctgtttggtaaggaggacaattgtcagttttgagggggacatgtgttaaatcacagaaaaaaatggtgccttcttctgcgtttgtccctcctgccatgtgtaagttgtaaggattgcctttgtagttaatgtactctttggctttgtttgtttgttttcttcttcagtgaagcagccttactattcatagaagggctagaataggagaaaatgaaaggtagtgagtaattctttgataagatgaggaaataatgggaaaggttgaattaattcctgggcatggactaccagatgaccacaagttgcgttgaggccgcatctttcttcagcagcgtgcaatagctggctcctctataggagatgagcttcattgggagttcctagcaagttgactaaacagcaaaagttctttctcgtgggtaaatatacccacaggttctatgatttgtagctctaggtttcttgatgatcaaggagtgaagtaattgacagggaaaatatagacctatgataaataaccaggaagcattgcttttggacaaggaagaacagagggttttgattttaaaaagaagaaaaaaaaaccttattttttctttcttggcctcaagttcaatatggagaggattgcttccctgaatcctctcttccttccccttttagattttgaagtgcaatcatatgtttttctctgtttgcattttttcctccttgttcttgacaaggaggagttgctcctgcccagaatgagcgtgacacttccgaacacttcttcatattcagttccaagatatatctgcttgattaaacatgagcttcctctgctctgaagctacctctgtcctcattttattctagccagaaaaggagtatcaccctagtgattatggctgttcactttcccatctatcttcctaaatctggaagttcttctcttggagatcaagagaaaaattacaattgtattccttactttattcacccacctatgaaaacaggaagcaataggaaaaaaaatccggttactccattttagcttttggtgaacgatgtagagcaaattgtctctctggtctaggtccgattactcttacctgtttttccactttgagacattctaaacagaatgtgtaacttctcatatgtatgcctctcccatctgtgaacctaggccaaagttgcaaaaacaatcatattaatagtagagtagagaaaaagttagtctatggttctcaaccctcgtgtacattggaaccatctgggagctgtgaacactgtcgctgccaatgttccagccaccagagatttggatttaactggtggggcctaggaattggtgtttttttgttttgttttgttttttacacaccttcatgtgattctgatgtgaagctgggttca

SEQ ID NO: 440424 - DNA, 540 bp, Homo sapiens
agaagaggaaagtccaaagaataggagggctgtgttttcaataccacttttaaaagctgaattatgttttagtgttctacaggttctgaaaatccttgtctaatgaaaatatatatggcttctagattttaatgattatttttttttctttaagcttaaagaagaattccaaagaacggcctacatacccagagctaatgcaacatccatttttcaccctacatgaatccaaaggaacagatgtggcatcttttgtaaaactgattcttggagactaaaaagcagtggacttaatcggttgaccctactgtggattggtgggtttcggggtgaagcaagttcactacagcatcaatagaaagtcatctttgagataatttaaccctgcctctcagagggttttctctcccaattttctttttactccccctcttaagggggccttggaatctatagtatagaatgaactgtctagatggatgaattatgataaaggcttaggacttcaaaaggtgattaaatatttaatgatgtgtcata

SEQ ID NO: 440425 - DNA, 728 bp, Homo sapiens
gacttctgttaggttttcctctgctggtcttccttgcagcctcgaaaacctcaccagagtcgcctctgctggtctcttactgtgctgctctgtcagagatgggcaagcaagaagcgaaaccctggccttaaaattccaaaagaagcatttgaacaacctcagaccagttccacaccacctcgagatttagactccaaggcttgcatttctattggaaatcagaactttgaggtgaaggcagatgacctggagcctataatggaactgggacgaggtgcgtacggggtggtggagaagatgcggcacgtgcccagcgggcagatcatggcagtgaagcggatccgagccacagtaaatagccaggaacagaaacggctactgatggatttggatatttccatgaggacggtggactgtccattcactgtcaccttttatggcgcactgtttcgggagggtgatgtgtggatctgcatggagctcatggatacatcactagataaattctacaaacaagttattgataaaggccagacaattccagaggacatcttagggaaaatagcagtttctattgtaaaagcattagaacatttacatagtaagctgtctgtcattcacagaggtaagcatccatgagctgccttggctgttcctttgataaagttcatctctttcacctggagtccgtctctacccccagtcccccatgggtggaagtagaattg

SEQ ID NO: 440426 - DNA, 1811 bp, Homo sapiens
ttccaagtttggagcttttagctgccagccctggcccatcatgtagctgcagcacagccttccctaacgttgcaactgggggaaaaatcactttccagtctgttttgcaaggtgtgcatttccatcttgattccctgaaagtccatctgctgcatcggtcaagagaaactccacttgcatgaagattgcacgcctgcagcttgcatctttgttgcaaaactagctacagaagagaagcaaggcaaagtcttttgtgctcccctcccccatcaaaggaaaggggaaaatgtctcagtcgaaaggcaagaagcgaaaccctggccttaaaattccaaaagaagcatttgaacaacctcagaccagttccacaccacctcgagatttagactccaaggcttgcatttctattggaaatcagaactttgaggtgaaggcagatgacctggagcctataatggaactgggacgaggtgcgtacggggtggtggagaagatgcggcacgtgcccagcgggcagatcatggcagtgaagcggatccgagccacagtaaatagccaggaacagaaacggctactgatggatttggatatttccatgaggacggtggactgtccattcactgtcaccttttatggcgcactgtttcgggagggtgatgtgtggatctgcatggagctcatggatacatcactagataaattctacaaacaagttattgataaaggccagacaattccagaggacatcttagggaaaatagcagtttctattgtaaaagcattagaacatttacatagtaagctgtctgtcattcacagagacgtcaagccttctaatgtactcatcaatgctctcggtcaagtgaagatgtgcgattttggaatcagtggctacttggtggactctgttgctaaaacaattgatgcaggttgcaaaccatacatggcccctgaaagaataaacccagagctcaaccagaagggatacagtgtgaagtctgacatttggagtctgggcatcacgatgattgagttggccatccttcgatttccctatgattcatggggaactccatttcagcagctcaaacaggtggtagaggagccatcgccacaactcccagcagacaagttctctgcagagtttgttgactttacctcacagtgcttaaagaagaattccaaagaacggcctacatacccagagctaatgcaacatccatttttcaccctacatgaatccaaaggaacagatgtggcatcttttgtaaaactgattcttggagactaaaaagcagtggacttaatcggttgaccctactgtggattggtgggtttcggggtgaagcaagttcactacagcatcaatagaaagtcatctttgagataatttaaccctgcctctcagagggttttctctcccaattttctttttactccccctcttaagggggccttggaatctatagtatagaatgaactgtctagatggatgaattatgataaaggcttaggacttcaaaaggtgattaaatatttaatgatgtgtcataaaaaaaacaaatccaccagcacacaagtgttggggcccctgggcccctgaaaaaagttttgaaaaccctggtgggggccggggccccaggggggcagagcgaacatgtgccaaaacaggccccaagaagaaaccgggcaacgaccacgcgcgggatctctcccgagtaaaaagacgccgggggacaacgggcgctggaacacccagaggagtctgagacacaagggactacacccgggagcacgggaggcgaatagac

SEQ ID NO: 440427 - DNA, 2977 bp, Homo sapiens
cttatctcccaattttctttttactccccctcttaagggggccttggaatctatagtatagaatgaactgtctagatggatgaattattgataaaggccagacaattccagaggacatcttagggaaaatagcagtttctattgtaaaagcattagaacatttacatagtaagctgtctgtcattcacagagacgtcaagccttctaatgtactcatcaatgctctcggtcaagtgaagatgtgcgattttggaatcagtggctacttggtggactctgttgctaaaacaattgatgcaggttgcaaaccatacatggcccctgaaagaataaacccagagctcaaccagaagggatacagtgtgaagtctgacatttggagtctgggcatcacgatgattgagttggccatccttcgatttccctatgattcatggggaactccatttcagcagctcaaacaggtggtagaggagccatcgccacaactcccagcagacaagttctctgcagagtttgttgactttacctcacagtgcttaaagaagaattccaaagaacggcctacatacccagagctaatgcaacatccatttttcaccctacatgaatccaaaggaacagatgtggcatcttttgtaaaactgattcttggagactaaaaagcagtggacttaatcggttgaccctactgtggattggtgggtttcggggtgaagcaagttcactacagcatcaatagaaagtcatctttgagataatttaaccctgcctctcagagggttttctctcccaattttctttttactccccctcttaagggggccttggaatctatagtatagaatgaactgtctagatggatgaattatgataaaggcttaggacttcaaaaggtgattaaatatttaatgatgtgtcatatgagtcctcaagcttctcagacttctcttattctttacaaaatgaatgcattggccctgacaaaaaggtgctacggtagtgatgaaattataagtagatttgtagtttgtcccatttattattttaatatttatgtttaagtgcttggttgaaaagattccattttatacaagaagggagattcaaaaaaaaaatataaggttgggttagcaatatttatagggcttttattttttaagttcaattgtgtctgtggtccagaagaaattatttaatatgcatctttgagaatattataaaaatatcaaaaaggagctcttcttgtgaaatgtctgttccagctgttgtgactgctgccatttttggaaacatctgcccaatcctgggtgatcaccacatcttttaggggaagtgacaagatgctctggtcatactctttttcccaactttggaaaacataaaaatcactcatataacagctcaaagagtaaaacatttggttcttctgacacttgtggtatagtattagtggaaagtgatttgtaatatgattttatatccacctacctattcatctacctgtgtgtatgtgtgtgtttgtgtgtctatttggcaattcacaagtcctgccaagtggtttctatgagcatctctgtttggtaaggaggacaattgtcagttttgagggggacatgtgttaaatcacagaaaaaaatggtgccttcttctgcgtttgtccctcctgccatgtgtaagttgtaaggattgcctttgtagttaatgtactctttggctttgtttgtttgttttcttcttcagtgaagcagccttactattcatagaagggctagaataggagaaaatgaaaggtagtgagtaattctttgataagatgaggaaataatgggaaaggttgaattaattcctgggcatggactaccagatgaccacaagttgcgttgaggccgcatctttcttcagcagcgtgcaatagctggctcctctataggagatgagcttcattgggagttcctagcaagttgactaaacagcaaaagttctttctcgtgggtaaatatacccacaggttctatgatttgtagctctaggtttcttgatgatcaaggagtgaagtaattgacagggaaaatatagacctatgataaataaccaggaagcattgcttttggacaaggaagaacagagggttttgattttaaaaagaagaaaaaaaaaccttattttttctttcttggcctcaagttcaatatggagaggattgcttccctgaatcctctcttccttccccttttagattttgaagtgcaatcatatgtttttctctgtttgcattttttcctccttgttcttgacaaggaggagttgctcctgcccagaatgagcgtgacacttccgaacacttcttcatattcagttccaagatatatctgcttgattaaacatgagcttcctctgctctgaagctacctctgtcctcattttattctagccagaaaaggagtatcaccctagtgattatggctgttcactttcccatctatcttcctaaatctggaagttcttctcttggagatcaagagaaaaattacaattgtattccttactttattcacccacctatgaaaacaggaagcaataggaaaaaaaatccggttactccattttagcttttggtgaacgatgtagagcaaattgtctctctggtctaggtccgattactcttacctgtttttccactttgagacattctaaacagaatgtgtaacttctcatatgtatgcctctcccatctgtgaacctaggccaaagttgcaaaaacaatcatattaatagtagagtagagaaaaagttagtctatggttctcaaccctcgtgtacattggaaccatctgggagctgtgaacactgtcgctgccaatgttccagccaccagagatttggatttaactggtggggcctaggaattggtgtttttttgttttgttttgttttttacacaccttcatgtgattctgatgtgaagctgggttca

SEQ ID NO: 440428 - DNA, 367 bp, Homo sapiens
tggtaacctaaagccaaggataataaaccttgatatacttaacattcaatttctttccagcaatgtgataaataaatctatcttgtgtttctcttgcagattgtaaaagcattagaacatttacatagtaagctgtctgtcattcacagaggtaagcatccatgagctgccttggctgttcctttgataaagttcatctctttcacctggagtccgtctctacccccagtcccccatgggtggaagtagaattgactcaggcaagagaactaaggggctttcctttgagattggatagcaaaccatataagtagtattccttatcatggctgaggacataagaagaagacgtgatctttgtcttaca

SEQ ID NO: 440429 - DNA, 3606 bp, Homo sapiens
ttccaagtttggagcttttagctgccagccctggcccatcatgtagctgcagcacagccttccctaacgttgcaactgggggaaaaatcactttccagtctgttttgcaaggtgtgcatttccatcttgattccctgaaagtccatctgctgcatcggtcaagagaaactccacttgcatgaagattgcacgcctgcagcttgcatctttgttgcaaaactagctacagaagagaagcaaggcaaagtcttttgtgctcccctcccccatcaaaggaaaggggaaaatgtctcagtcgaaaggcaagaagcgaaaccctggccttaaaattccaaaagaagcatttgaacaacctcagaccagttccacaccacctcgagatttagactccaaggcttgcatttctattggaaatcagaactttgaggtgaaggcagatgacctggagcctataatggaactgggacgaggtgcgtacggggtggtggagaagatgcggcacgtgcccagcgggcagatcatggcagtgaagcggatccgagccacagtaaatagccaggaacagaaacggctactgatggatttggatatttccatgaggacggtggactgtccattcactgtcaccttttatggcgcactgtttcgggagggtgatgtgtggatctgcatggagctcatggatacatcactagataaattctacaaacaagttattgataaaggccagacaattccagaggacatcttagggaaaatagcagtttctattgtaaaagcattagaacatttacatagtaagctgtctgtcattcacagagacgtcaagccttctaatgtactcatcaatgctctcggtcaagtgaagatgtgcgattttggaatcagtggctacttggtggactctgttgctaaaacaattgatgcaggttgcaaaccatacatggcccctgaaagaataaacccagagctcaaccagaagggatacagtgtgaagtctgacatttggagtctgggcatcacgatgattgagttggccatccttcgatttccctatgattcatggggaactccatttcagcagctcaaacaggtggtagaggagccatcgccacaactcccagcagacaagttctctgcagagtttgttgactttacctcacagtgcttaaagaagaattccaaagaacggcctacatacccagagctaatgcaacatccatttttcaccctacatgaatccaaaggaacagatgtggcatcttttgtaaaactgattcttggagactaaaaagcagtggacttaatcggttgaccctactgtggattggtgggtttcggggtgaagcaagttcactacagcatcaatagaaagtcatctttgagataatttaaccctgcctctcagagggttttctctcccaattttctttttactccccctcttaagggggccttggaatctatagtatagaatgaactgtctagatggatgaattatgataaaggcttaggacttcaaaaggtgattaaatatttaatgatgtgtcatatgagtcctcaagcttctcagacttctcttattctttacaaaatgaatgcattggccctgacaaaaaggtgctacggtagtgatgaaattataagtagatttgtagtttgtcccatttattattttaatatttatgtttaagtgcttggttgaaaagattccattttatacaagaagggagattcaaaaaaaaaatataaggttgggttagcaatatttatagggcttttattttttaagttcaattgtgtctgtggtccagaagaaattatttaatatgcatctttgagaatattataaaaatatcaaaaaggagctcttcttgtgaaatgtctgttccagctgttgtgactgctgccatttttggaaacatctgcccaatcctgggtgatcaccacatcttttaggggaagtgacaagatgctctggtcatactctttttcccaactttggaaaacataaaaatcactcatataacagctcaaagagtaaaacatttggttcttctgacacttgtggtatagtattagtggaaagtgatttgtaatatgattttatatccacctacctattcatctacctgtgtgtatgtgtgtgtttgtgtgtctatttggcaattcacaagtcctgccaagtggtttctatgagcatctctgtttggtaaggaggacaattgtcagttttgagggggacatgtgttaaatcacagaaaaaaatggtgccttcttctgcgtttgtccctcctgccatgtgtaagttgtaaggattgcctttgtagttaatgtactctttggctttgtttgtttgttttcttcttcagtgaagcagccttactattcatagaagggctagaataggagaaaatgaaaggtagtgagtaattctttgataagatgaggaaataatgggaaaggttgaattaattcctgggcatggactaccagatgaccacaagttgcgttgaggccgcatctttcttcagcagcgtgcaatagctggctcctctataggagatgagcttcattgggagttcctagcaagttgactaaacagcaaaagttctttctcgtgggtaaatatacccacaggttctatgatttgtagctctaggtttcttgatgatcaaggagtgaagtaattgacagggaaaatatagacctatgataaataaccaggaagcattgcttttggacaaggaagaacagagggttttgattttaaaaagaagaaaaaaaaaccttattttttctttcttggcctcaagttcaatatggagaggattgcttccctgaatcctctcttccttccccttttagattttgaagtgcaatcatatgtttttctctgtttgcattttttcctccttgttcttgacaaggaggagttgctcctgcccagaatgagcgtgacacttccgaacacttcttcatattcagttccaagatatatctgcttgattaaacatgagcttcctctgctctgaagctacctctgtcctcattttattctagccagaaaaggagtatcaccctagtgattatggctgttcactttcccatctatcttcctaaatctggaagttcttctcttggagatcaagagaaaaattacaattgtattccttactttattcacccacctatgaaaacaggaagcaataggaaaaaaaatccggttactccattttagcttttggtgaacgatgtagagcaaattgtctctctggtctaggtccgattactcttacctgtttttccactttgagacattctaaacagaatgtgtaacttctcatatgtatgcctctcccatctgtgaacctaggccaaagttgcaaaaacaatcatattaatagtagagtagagaaaaagttagtctatggttctcaaccctcgtgtacattggaaccatctgggagctgtgaacactgtcgctgccaatgttccagccaccagagatttggatttaactggtggggcctaggaattggtgtttttttgttttgttttgttttttacacaccttcatgtgattctgatgtgaagctgggttca

SEQ ID NO: 440430 - DNA, 1512 bp, Homo sapiens
tagaattcagcggccgctgaattctaggttgcaactgggggaaaaatcactttccagtctgttttgcaaggtgtgcatttccatcttgattccctgaaagtccatctgctgcatcggtcaagagaaactccacttgcatgaagattgcacgcctgcagcttgcatctttgttgcaaaactagctacagaagagaagcaaggcaaagtcttttgtgctcccctcccccatcaaaggaaaggggaaaatgtctcagtcgaaaggcaagaagcgaaaccctggccttaaaattccaaaagaagcatttgaacaacctcagaccagttccacaccacctcgagatttagactccaaggcttgcatttctattggaaatcagaactttgaggtgaaggcagatgacctggagcctataatggaactgggacgaggtgcgtacggggtggtggagaagatgcggcacgtgcccagcgggcagatcatggcagtgaagcggatccgagccacagtaaatagccaggaacagaaacggctactgatggatttggatatttccatgaggacggtggactgtccattcactgtcaccttttatggcgcactgtttcgggagggtgatgtgtggatctgcatggagctcatggatacatcactagataaattctacaaacaagttattgataaaggccagacaattccagaggacatcttagggaaaatagcagtttctattgtaaaagcattagaacatttacatagtaagctgtctgtcattcacagagacgtcaagccttctaatgtactcatcaatgctctcggtcaagtgaagatgtgcgattttggaatcagtggctacttggtggactctgttgctaaaacaattgatgcaggttgcaaaccatacatggcccctgaaagaataaacccagagctcaaccagaagggatacagtgtgaagtctgacatttggagtctgggcatcacgatgattgagttggccatccttcgatttccctatgattcatggggaactccatttcagcagctcaaacaggtggtagaggagccatcgccacaactcccagcagacaagttctctgcagagtttgttgactttacctcacagtgcttaaagaagaattccaaagaacggcctacatacccagagctaatgcaacatccatttttcaccctacatgaatccaaaggaacagatgtggcatcttttgtaaaactgattcttggagactaaaaagcagtggacttaatcggttgaccctactgtggattggtgggtttcggggtgaagcaagttcactacagcatcaatagaaagtcatctttgagataatttaaccctgcctctcagagggttttctctcccaattttctttttactccccctcttaagggggccttggaatctatagtatagaatgaactgtctagatggatgaattatgataaaggcttaggacttcaaaaggtgattaaatatttaatgatgtgtcata

SEQ ID NO: 440431 - DNA, 3410 bp, Homo sapiens
gacttctgttaggttttcctctgctggtcttccttgcagcctcgaaaacctcaccagagtcgcctctgctggtctcttactgtgctgctctgtcagagatgggcaagcaagaagcgaaaccctggccttaaaattccaaaagaagcatttgaacaacctcagaccagttccacaccacctcgagatttagactccaaggcttgcatttctattggaaatcagaactttgaggtgaaggcagatgacctggagcctataatggaactgggacgaggtgcgtacggggtggtggagaagatgcggcacgtgcccagcgggcagatcatggcagtgaagcggatccgagccacagtaaatagccaggaacagaaacggctactgatggatttggatatttccatgaggacggtggactgtccattcactgtcaccttttatggcgcactgtttcgggagggtgatgtgtggatctgcatggagctcatggatacatcactagataaattctacaaacaagttattgataaaggccagacaattccagaggacatcttagggaaaatagcagtttctattgtaaaagcattagaacatttacatagtaagctgtctgtcattcacagagacgtcaagccttctaatgtactcatcaatgctctcggtcaagtgaagatgtgcgattttggaatcagtggctacttggtggactctgttgctaaaacaattgatgcaggttgcaaaccatacatggcccctgaaagaataaacccagagctcaaccagaagggatacagtgtgaagtctgacatttggagtctgggcatcacgatgattgagttggccatccttcgatttccctatgattcatggggaactccatttcagcagctcaaacaggtggtagaggagccatcgccacaactcccagcagacaagttctctgcagagtttgttgactttacctcacagtgcttaaagaagaattccaaagaacggcctacatacccagagctaatgcaacatccatttttcaccctacatgaatccaaaggaacagatgtggcatcttttgtaaaactgattcttggagactaaaaagcagtggacttaatcggttgaccctactgtggattggtgggtttcggggtgaagcaagttcactacagcatcaatagaaagtcatctttgagataatttaaccctgcctctcagagggttttctctcccaattttctttttactccccctcttaagggggccttggaatctatagtatagaatgaactgtctagatggatgaattatgataaaggcttaggacttcaaaaggtgattaaatatttaatgatgtgtcatatgagtcctcaagcttctcagacttctcttattctttacaaaatgaatgcattggccctgacaaaaaggtgctacggtagtgatgaaattataagtagatttgtagtttgtcccatttattattttaatatttatgtttaagtgcttggttgaaaagattccattttatacaagaagggagattcaaaaaaaaaatataaggttgggttagcaatatttatagggcttttattttttaagttcaattgtgtctgtggtccagaagaaattatttaatatgcatctttgagaatattataaaaatatcaaaaaggagctcttcttgtgaaatgtctgttccagctgttgtgactgctgccatttttggaaacatctgcccaatcctgggtgatcaccacatcttttaggggaagtgacaagatgctctggtcatactctttttcccaactttggaaaacataaaaatcactcatataacagctcaaagagtaaaacatttggttcttctgacacttgtggtatagtattagtggaaagtgatttgtaatatgattttatatccacctacctattcatctacctgtgtgtatgtgtgtgtttgtgtgtctatttggcaattcacaagtcctgccaagtggtttctatgagcatctctgtttggtaaggaggacaattgtcagttttgagggggacatgtgttaaatcacagaaaaaaatggtgccttcttctgcgtttgtccctcctgccatgtgtaagttgtaaggattgcctttgtagttaatgtactctttggctttgtttgtttgttttcttcttcagtgaagcagccttactattcatagaagggctagaataggagaaaatgaaaggtagtgagtaattctttgataagatgaggaaataatgggaaaggttgaattaattcctgggcatggactaccagatgaccacaagttgcgttgaggccgcatctttcttcagcagcgtgcaatagctggctcctctataggagatgagcttcattgggagttcctagcaagttgactaaacagcaaaagttctttctcgtgggtaaatatacccacaggttctatgatttgtagctctaggtttcttgatgatcaaggagtgaagtaattgacagggaaaatatagacctatgataaataaccaggaagcattgcttttggacaaggaagaacagagggttttgattttaaaaagaagaaaaaaaaaccttattttttctttcttggcctcaagttcaatatggagaggattgcttccctgaatcctctcttccttccccttttagattttgaagtgcaatcatatgtttttctctgtttgcattttttcctccttgttcttgacaaggaggagttgctcctgcccagaatgagcgtgacacttccgaacacttcttcatattcagttccaagatatatctgcttgattaaacatgagcttcctctgctctgaagctacctctgtcctcattttattctagccagaaaaggagtatcaccctagtgattatggctgttcactttcccatctatcttcctaaatctggaagttcttctcttggagatcaagagaaaaattacaattgtattccttactttattcacccacctatgaaaacaggaagcaataggaaaaaaaatccggttactccattttagcttttggtgaacgatgtagagcaaattgtctctctggtctaggtccgattactcttacctgtttttccactttgagacattctaaacagaatgtgtaacttctcatatgtatgcctctcccatctgtgaacctaggccaaagttgcaaaaacaatcatattaatagtagagtagagaaaaagttagtctatggttctcaaccctcgtgtacattggaaccatctgggagctgtgaacactgtcgctgccaatgttccagccaccagagatttggatttaactggtggggcctaggaattggtgtttttttgttttgttttgttttttacacaccttcatgtgattctgatgtgaagctgggttca

SEQ ID NO: 440432 - DNA, 1663 bp, Homo sapiens
ttccaagtttggagcttttagctgccagccctggcccatcatgtagctgcagcacagccttccctaacgttgcaactgggggaaaaatcactttccagtctgttttgcaaggtgtgcatttccatcttgattccctgaaagtccatctgctgcatcggtcaagagaaactccacttgcatgaagattgcacgcctgcagcttgcatctttgttgcaaaactagctacagaagagaagcaaggcaaagtcttttgtgctcccctcccccatcaaaggaaaggggaaaatgtctcagtcgaaaggcaagaagcgaaaccctggccttaaaattccaaaagaagcatttgaacaacctcagaccagttccacaccacctcgagatttagactccaaggcttgcatttctattggaaatcagaactttgaggtgaaggcagatgacctggagcctataatggaactgggacgaggtgcgtacggggtggtggagaagatgcggcacgtgcccagcgggcagatcatggcagtgaagcggatccgagccacagtaaatagccaggaacagaaacggctactgatggatttggatatttccatgaggacggtggactgtccattcactgtcaccttttatggcgcactgtttcgggagggtgatgtgtggatctgcatggagctcatggatacatcactagataaattctacaaacaagttattgataaaggccagacaattccagaggacatcttagggaaaatagcagtttctattgtaaaagcattagaacatttacatagtaagctgtctgtcattcacagagacgtcaagccttctaatgtactcatcaatgctctcggtcaagtgaagatgtgcgattttggaatcagtggctacttggtggactctgttgctaaaacaattgatgcaggttgcaaaccatacatggcccctgaaagaataaacccagagctcaaccagacaagttctctgcagagtttgttgactttacctcacagtgcttaaagaagaattccaaagaacggcctacatacccagagctaatgcaacatccatttttcaccctacatgaatccaaaggaacagatgtggcatcttttgtaaaactgattcttggagactaaaaagcagtggacttaatcggttgaccctactgtggattggtgggtttcggggtgaagcaagttcactacagcatcaatagaaagtcatctttgagataatttaaccctgcctctcagagggttttctctcccaattttctttttactccccctcttaagggggccttggaatctatagtatagaatgaactgtctagatggatgaattatgataaaggcttaggacttcaaaaggtgattaaatatttaatgatgtgtcataaaaaaaacaaatccaccagcacacaagtgttggggcccctgggcccctgaaaaaagttttgaaaaccctggtgggggccggggccccaggggggcagagcgaacatgtgccaaaacaggccccaagaagaaaccgggcaacgaccacgcgcgggatctctcccgagtaaaaagacgccgggggacaacgggcgctggaacacccagaggagtctgagacacaagggactacacccgggagcacgggaggcgaatagac

SEQ ID NO: 440433 - DNA, 1002 bp, Homo sapiens
taggctaggtagaggctggtgttgaatcgggattctgcttcttcaactctgtagccatcaccgcaaaactcctacagcagaagttgaacgtgggcaaggtcctcatcgtggactgggacattcaccatggcaatggcacccagcaggcgttctacaatgacccctctgtgctctacatctctctgcatcgctatgacaacgggaacttctttccaggctctggggctcctgaagaggttggtggaggaccaggcgtggggtacaatgtgaacgtggcatggacaggaggtgtggacccccccattggagacgtggagtaccttacagccttcaggacagtggtgatgcccattgcccacgagttctcacctgatgtggtcctagtctccgccgggtttgatgctgttgaaggacatctgtctcctctgggtggctactctgtcaccgccagatgttttggccacttgaccaggcagctgatgaccctggcagggggccgggtggtgctggccctggagggaggccatgacttgaccgccatctgtgatgcctctgaggcttgtgtctcggctctgctcagtgtagagctgcagcccttggatgaggcagtcttgcagcaaaagcccaacatcaacgcagtggccacgctagagaaagtcatcgagatccagagcaaacactggagctgtgtgcagaagttcgccgctggtctgggccggtccctgcgagaggcccaagcaggtgagaccgaggaggccgagactgtgagcgccatggccttgctgtcggtgggggccgagcaggcccaggctgcggcagcccgggaacacagccccaggccggcagaggagcccatggagcaggagcctgccctgtgacgccccggcccccatccctctgggcttcaccattgtgattttgtttattttttctattaaaaacaaaaagtcacacattcaaaaaataaaaaaaaaaaatcgcttttggggaaaaataaggctt

SEQ ID NO: 440434 - DNA, 529 bp, Homo sapiens
  misc_feature (1)..(1): n is a, c, g, or t
  misc_feature (18)..(18): n is a, c, g, or t
ncagactcaccaacagcnatacaagcaccaaaacgatgtaaatatctcatagagtgtaggcccacaaccaaatccctgaacaacaaatgatctccaaaccctggtgtcattcctcgtgccgaattcggcacgagctcggctctgctcagtgtagagctgcagcccttggatgaggcagtcttgcagcaaaagcccaacatcaacgcagtggccacgctagagaaagtcatcgagatccagagcaaacactggagctgtgtgcagaagttcgccgctggtctgggccggtccctgcgagaggcccaagcaggtgagaccgaggaggccgagactgtgagcgccatggccttgctgtcggtgggggccgagcaggcccaggctgcggcagcccgggaacacagccccaggccggcagaggagcccatggagcaggagcctgccctgtgacgccccggcccccatccctctgggcttcaccattgtgattttgtttattttttctattaaaaacaaaaagtcacacattcaa

SEQ ID NO: 440435 - DNA, 494 bp, Homo sapiens
catgctcatagctgactctagaggataaaaggagtggacagtgacaccgtgtggaatgagatgcactcctccagtgctgtgcgcatggcagtgggctgcctgctggagctggccttcaaggtggctgcaggagagctcaaggtgagcgtgtgcttgtgacctcggtgccccttggcatggccctgctcctcagaggcagaggacaggggcagccttgggatcctttcagtgaggcactgtcctttgcaagctcaactctcaggcaccagggtgggaaggagttgccagctgggaattcaggttatgagggaccaacaaaaagacactaatgcccagtgctctcgtgggtgtctcgaggcagaaatagtgtctgcctgctcaagcctcatggttggcattcaaaatggtccgttgaggctgggcacagtggctcatacctgtaatctcaacactttgggaggccgaggtgggcagatagcttgagcccaggagtt

SEQ ID NO: 440436 - DNA, 3825 bp, Homo sapiens
gctgtcacccagggttgggagggaacacagagcccgcctgcccgctgagctccccttcctgtcccaagtgctcagccataccccagctcccaggaaccagggagaggctggtggtcggatgcccctctagagcagagctgggcctgcagctctagggcctccctgcccctcctgccgccaggagtgcccaggccggatgaggcacttccctacagtgtgggtcccgtcggcagtggcctgagggaacctgtgctctgcgggctgcccgaccaccttcccttcggtctgctccccgcctctggcggccccctccctggcatgctgctggtgcccaaggctcaggggctcgtggagatgctgcagaccatctatgagacagaatcctgtttctcagcgatgggatgtcaggtcgggaaccatccttggaaatcctgccgcggacttctctgcacagcatccctgtgacagtggaggtgaagccggtgctgccaagagccatgcccagttccatggggggtgggggtggaggcagccccagccctgtggagctacggggggctctggtgggctctgtggaccccacactgcgggagcagcaactgcagcaggagctcctggcgctcaagcagcagcagcagctgcagaagcagctcctgttcgctgagttccagaaacagcatgaccacctgacaaggcagcatgaggtccagctgcagaagcacctcaagcagcagcaggagatgctggcagccaagcagcagcaggagatgctggcagccaagcggcagcaggagctggagcagcagcggcagcgggagcagcagcggcaggaagagctggagaagcagcggctggagcagcagctgctcatcctgcggaacaaggagaagagcaaagagagtgccattgccagcactgaggtaaagctgaggctccaggaattcctcttgtcgaagtcaaaggagcccacaccaggcggcctcaaccattccctcccacagcaccccaaatgctggggagcccaccatgcttctttggaccagagttcccctccccagagcggcccccctgggacgcctccctcctacaaactgcctttgcctgggccctacgacagtcgagacgacttccccctccgcaaaacagcctctgaacccaacttgaaagtgcgttcaaggctaaaacagaaggtggctgagcggagaagcagtcccctcctgcgtcgcaaggatgggactgttattagcacctttaagaagagagctgttgagatcacaggtgccgggcctggggcgtcgtccgtgtgtaacagcgcacccggctccggccccagctctcccaacagctcccacagcaccatcgctgagaatggctttactggctcagtccccaacatccccactgagatgctccctcagcaccgagccctccctctggacagctcccccaaccagttcagcctctacacgtctccttctctgcccaacatctccctagggctgcaggccacggtcactgtcaccaactcacacctcactgcctccccgaagctgtcgacacagcaggaggccgagaggcaggccctccagtccctgcggcagggtggcacgctgaccggcaagttcatgagcacatcctctattcctggctgcctgctgggcgtggcactggagggcgacgggagcccccacgggcatgcctccctgctgcagcatgtgctgttgctggagcaggcccggcagcagagcaccctcattgctgtgccactccacgggcagtccccactagtgacgggtgaacgtgtggccaccagcatgcggacggtaggcaagctcccgcggcatcggcccctgagccgcactcagtcctcaccgctgccgcagagtccccaggccctgcagcagctggtcatgcaacaacagcaccagcagttcctggagaagcagaagcagcagcagctacagctgggcaagatcctcaccaagacaggggagctgcccaggcagcccaccacccaccctgaggagacagaggaggagctgacggagcagcaggaggtcttgctgggggagggagccctgaccatgccccgggagggctccacagagagtgagagcacacaggaagacctggaggaggaggacgaggaagaggatggggaggaggaggaggattgcatccaggttaaggacgaggagggcgagagtggtgctgaggaggggcccgacttggaggagcctggtgctggatacaaaaaactgttctcagatgcccagccgctgcagcctttgcaggtgtaccaggcgcccctcagcctggccactgtgccccaccaggccctgggccgtacccagtcctcccctgctgcccctgggggcatgaagagccccccagaccagcccgtcaagcacctcttcaccacaggtgtggtctacgacacgttcatgctaaagcaccagtgcatgtgcgggaacacacacgtgcaccctgagcatgctggccggatccagagcatctggtcccggctgcaggagacaggcctgcttagcaagtgcgagcggatccgaggtcgcaaagccacgctagatgagatccagacagtgcactctgaataccacaccctgctctatgggaccagtcccctcaaccggcagaagctagacagcaagaagttgctcggccccatcagccagaagatgtatgctgtgctgccttgtgggggcatcggggtggacagtgacaccgtgtggaatgagatgcactcctccagtgctgtgcgcatggcagtgggctgcctgctggagctggccttcaaggtggctgcaggagagctcaagaatggatttgccatcatccggcccccaggacaccacgccgaggaatccacagccatgggattctgcttcttcaactctgtagccatcaccgcaaaactcctacagcagaagttgaacgtgggcaaggtcctcatcgtggactgggacattcaccatggcaatggcacccagcaggcgttctacaatgacccctctgtgctctacatctctctgcatcgctatgacaacgggaacttctttccaggctctggggctcctgaagaggttggtggaggaccaggcgtggggtacaatgtgaacgtggcatggacaggaggtgtggacccccccattggagacgtggagtaccttacagccttcaggacagtggtgatgcccattgcccacgagttctcacctgatgtggtcctagtctccgccgggtttgatgctgttgaaggacatctgtctcctctgggtggctactctgtcaccgccagatgttttggccacttgaccaggcagctgatgaccctggcagggggccgggtggtgctggccctggagggaggccatgacttgaccgccatctgtgatgcctctgaggcttgtgtctcggctctgctcagtgtagagctgcagcccttggatgaggcagtcttgcagcaaaagcccaacatcaacgcagtggccacgctagagaaagtcatcgagatccagagcaaacactggagctgtgtgcagaagttcgccgctggtctgggccggtccctgcgagaggcccaagcaggtgagaccgaggaggccgagactgtgagcgccatggccttgctgtcggtgggggccgagcaggcccaggctgcggcagcccgggaacacagccccaggccggcagaggagcccatggagcaggagcctgccctgtgacgccccggcccccatccctctgggcttcaccattgtgattttgtttattttttctattaaaaacaaaaagtcacacattcaa

SEQ ID NO: 440437 - DNA, 5316 bp, Homo sapiens
gcggcgagcggagccggaggagccgccgcgaagatggaggagccgtcgaggaggtgctgccgccgctgccgccgccgctgctgccgccgccgcccgcgaagccggagctcgagccgcagcggggatgccgttctgagtgcctgactgcctcgccccgaaggatggcctcggatgggcattagaggcacggcggccccgggctcccgtcccgtccgtctgtctgttatcgtctgtctctcttgacatcaccgcagctccaccccctcccgtcccagcccccaacgccagcttcctgcaggcccagagccggcatgaactctcccaacgagtcgcgatgggatgtcaggtcgggaaccatccttggaaatcctgccgcggacttctctgcacagcatccctgtgacagtggaggtgaagccggtgctgccaagagccatgcccagttccatggggggtgggggtggaggcagccccagccctgtggagctacggggggctctggtgggctctgtggaccccacactgcgggagcagcaactgcagcaggagctcctggcgctcaagcagcagcagcagctgcagaagcagctcctgttcgctgagttccagaaacagcatgaccacctgacaaggcagcatgaggtccagctgcagaagcacctcaagcagcagcaggagatgctggcagccaagcagcagcaggagatgctggcagccaagcggcagcaggagctggagcagcagcggcagcgggagcagcagcggcaggaagagctggagaagcagcggctggagcagcagctgctcatcctgcggaacaaggagaagagcaaagagagtgccattgccagcactgaggtaaagctgaggctccaggaattcctcttgtcgaagtcaaaggagcccacaccaggcggcctcaaccattccctcccacagcaccccaaatgctggggagcccaccatgcttctttggaccagagttcccctccccagagcggcccccctgggacgcctccctcctacaaactgcctttgcctgggccctacgacagtcgagacgacttccccctccgcaaaacagcctctgaacccaacttgaaagtgcgttcaaggctaaaacagaaggtggctgagcggagaagcagtcccctcctgcgtcgcaaggatgggactgttattagcacctttaagaagagagctgttgagatcacaggtgccgggcctggggcgtcgtccgtgtgtaacagcgcacccggctccggccccagctctcccaacagctcccacagcaccatcgctgagaatggctttactggctcagtccccaacatccccactgagatgctccctcagcaccgagccctccctctggacagctcccccaaccagttcagcctctacacgtctccttctctgcccaacatctccctagggctgcaggccacggtcactgtcaccaactcacacctcactgcctccccgaagctgtcgacacagcaggaggccgagaggcaggccctccagtccctgcggcagggtggcacgctgaccggcaagttcatgagcacatcctctattcctggctgcctgctgggcgtggcactggagggcgacgggagcccccacgggcatgcctccctgctgcagcatgtgctgttgctggagcaggcccggcagcagagcaccctcattgctgtgccactccacgggcagtccccactagtgacgggtgaacgtgtggccaccagcatgcggacggtaggcaagctcccgcggcatcggcccctgagccgcactcagtcctcaccgctgccgcagagtccccaggccctgcagcagctggtcatgcaacaacagcaccagcagttcctggagaagcagaagcagcagcagctacagctgggcaagatcctcaccaagacaggggagctgcccaggcagcccaccacccaccctgaggagacagaggaggagctgacggagcagcaggaggtcttgctgggggagggagccctgaccatgccccgggagggctccacagagagtgagagcacacaggaagacctggaggaggaggacgaggaagaggatggggaggaggaggaggattgcatccaggttaaggacgaggagggcgagagtggtgctgaggaggggcccgacttggaggagcctggtgctggatacaaaaaactgttctcagatgcccagccgctgcagcctttgcaggtgtaccaggcgcccctcagcctggccactgtgccccaccaggccctgggccgtacccagtcctcccctgctgcccctgggggcatgaagagccccccagaccagcccgtcaagcacctcttcaccacaggtgtggtctacgacacgttcatgctaaagcaccagtgcatgtgcgggaacacacacgtgcaccctgagcatgctggccggatccagagcatctggtcccggctgcaggagacaggcctgcttagcaagtgcgagcggatccgaggtcgcaaagccacgctagatgagatccagacagtgcactctgaataccacaccctgctctatgggaccagtcccctcaaccggcagaagctagacagcaagaagttgctcggccccatcagccagaagatgtatgctgtgctgccttgtgggggcatcggggtggacagtgacaccgtgtggaatgagatgcactcctccagtgctgtgcgcatggcagtgggctgcctgctggagctggccttcaaggtggctgcaggagagctcaagaatggatttgccatcatccggcccccaggacaccacgccgaggaatccacagccatgggattctgcttcttcaactctgtagccatcaccgcaaaactcctacagcagaagttgaacgtgggcaaggtcctcatcgtggactgggacattcaccatggcaatggcacccagcaggcgttctacaatgacccctctgtgctctacatctctctgcatcgctatgacaacgggaacttctttccaggctctggggctcctgaagaggttggtggaggaccaggcgtggggtacaatgtgaacgtggcatggacaggaggtgtggacccccccattggagacgtggagtaccttacagccttcaggacagtggtgatgcccattgcccacgagttctcacctgatgtggtcctagtctccgccgggtttgatgctgttgaaggacatctgtctcctctgggtggctactctgtcaccgccagatgttttggccacttgaccaggcagctgatgaccctggcagggggccgggtggtgctggccctggagggaggccatgacttgaccgccatctgtgatgcctctgaggcttgtgtctcggctctgctcagtgtagagctgcagcccttggatgaggcagtcttgcagcaaaagcccaacatcaacgcagtggccacgctagagaaagtcatcgagatccagagcaaacactggagctgtgtgcagaagttcgccgctggtctgggccggtccctgcgagaggcccaagcaggtgagaccgaggaggccgagactgtgagcgccatggccttgctgtcggtgggggccgagcaggcccaggctgcggcagcccgggaacacagccccaggccggcagaggagcccatggagcaggagcctgccctgtgacgccccggcccccatccctctgggcttcaccattgtgattttgtttattttttctattaaaaacaaaaagtcacacattcaacaaggtgtgccgtgtgggtctctcagccttgcccctcctgctcctctacgctgcctcaggcccccagccctgtggcttccacctcagctctagaagcctgctccctctgcagggggtggtggtgtcttcccagccctgtcccatgtgtccctccacccattttcctgcattctgtctgtccttttcctccttggagcctgggccagctcaaggtgggcacgggggcccagacagtactctccagttctggggccccccgagtgaggagggaacgggaagtcggtgccttggtttcagctgatttggggggaaatgccttaatttcactctcctcccttctccagcctcaggggaggatctggaggatccactactgtctttaagatgcagagtggaggggaggtgggcacccaccctgcgattctccaccctttccccttctttcgtcctcaccatctctgcagacccctctcctcctccttcctcttggtctcagcactgatgggaggctggtgcccaagctgtggcctgcagtctgtgaggagggctgtcttgcctcacactcctcacagcctacttccccttccccggggctgagagggtgaaagtgtgtggggaaggagaggactggtttcctgggttctcaggggccaggaggagtaacagaaccaggtctgctccccaccttactcggatggcctccctgcccctctgctggcacagcctgggcaaggggagaaggtggtccctgcagaggggctccaggctggtgagagcccccctgctgtcaggaccagattttcccagccatccagcatgctgcggggagaaggggcagaggctcacctccctcctggggccttttgttttggatcctggggatggtgagaatggaggttctagaaggggtaaggccagaacccagggatccaggagtcggctctcagctggagcttccataccttctgggctccctttgctgaccaccagcccaagggagctaagaccaggagggggctgggcgctgtcccttctctttcccaggagccctgccaggggctgtgggcctacaaggcttccaggggatgccatccagcctgtaggaaaccaaagatgggaagtggctcctagggggctgactcttccttcctcctcctccccagtaccacatatactttctctccttctatctccagggccccaccaatctgtttacatatttattatcctatgggggcctgagcaggattgagggagccaggggaggggcaggagtcccagcaccatcggttcatagtgtgcttgtgtgtttgttttagatcctcctgggggatggggatggggccaggctcagtgtactaggcctctctgtgctgagccccaggctcccggccccttacccactctctccctgtggctggtctggttctcatgtaaacccactccttgctttgtctccctggatatggatttcagttaagtattttgtaacccgttacactgtgtgtccttgtgtaaataaacttgtttctggcagtgccatctggggccaa

SEQ ID NO: 440438 - DNA, 5273 bp, Homo sapiens
gcggcgagcggagccggaggagccgccgcgaagatggaggagccgtcgaggaggtgctgccgccgctgccgccgccgctgctgccgccgccgcccgcgaagccggagctcgagccgcagcggggatgccgttctgagtgcctgactgcctcgccccgaaggatggcctcggatgggcattagaggcacggcggccccgggctcccgtcccgtccgtctgtctgttatcgtctgtctctcttgacatcaccgcagctccaccccctcccgtcccagcccccaacgccagcttcctgcaggcccagagccggcatgaactctcccaacgagtcgcgatgggatgtcaggtcgggaaccatccttggaaatcctgccgcggacttctctgcacagcatccctgtgacagtggaggtgaagccggtgctgccaagagccatgcccagttccatggggggtgggggtggaggcagccccagccctgtggagctacggggggctctggtgggctctgtggaccccacactgcgggagcagcaactgcagcaggagctcctggcgctcaagcagcagcagcagctgcagaagcagctcctgttcgctgagttccagaaacagcatgaccacctgacaaggcagcatgaggtccagctgcagaagcacctcaagcagcagcaggagatgctggcagccaagcagcagcaggagatgctggcagccaagcggcagcaggagctggagcagcagcggcagcgggagcagcagcggcaggaagagctggagaagcagcggctggagcagcagctgctcatcctgcggaacaaggagaagagcaaagagagtgccattgccagcactgaggtaaagctgaggctccaggaattcctcttgtcgaagtcaaaggagcccacaccaggcggcctcaaccattccctcccacagcaccccaaatgctggggagcccaccatgcttctttggaccagagttcccctccccagagcggcccccctgggacgcctccctcctacaaactgcctttgcctgggccctacgacagtcgagacgacttccccctccgcaaaacagcctctgaacccaacttgaaagtgcgttcaaggctaaaacagaaggtggctgagcggagaagcagtcccctcctgcgtcgcaaggatgggactgttattagcacctttaagaagagagctgttgagatcacaggtgccgggcctggggcgtcgtccgtgtgtaacagcgcacccggctccggccccagctctcccaacagctcccacagcaccatcgctgagaatggctttactggctcagtccccaacatccccactgagatgctccctcagcaccgagccctccctctggacagctcccccaaccagttcagcctctacacgtctccttctctgcccaacatctccctagggctgcaggccacggtcactgtcaccaactcacacctcactgcctccccgaagctgtcgacacagcaggaggccgagaggcaggccctccagtccctgcggcagggtggcacgctgaccggcaagttcatgagcacatcctctattcctggctgcctgctgggcgtggcactggagggcgacgggagcccccacgggcatgcctccctgctgcagcatgtgctgttgctggagcaggcccggcagcagagcaccctcattgctgtgccactccacgggcagtccccactagtgacgggtgaacgtgtggccaccagcatgcggacggtaggcaagctcccgcggcatcggcccctgagccgcactcagtcctcaccgctgccgcagagtccccaggccctgcagcagctggtcatgcaacaacagcaccagcagttcctggagaagcagaagcagcagcagctacagctgggcaagatcctcaccaagacaggggagctgcccaggcagcccaccacccaccctgaggagacagaggaggagctgacggagcagcaggaggtcttgctgggggagggagccctgaccatgccccgggagggctccacagagagtgagagcacacaggaagacctggaggaggaggacgaggaagaggatggggaggaggaggaggattgcatccaggttaaggacgaggagggcgagagtggtgctgaggaggggcccgacttggaggagcctggtgctggatacaaaaaactgttctcagatgcccagccgctgcagcctttgcaggtgtaccaggcgcccctcagcctggccactgtgccccaccaggccctgggccgtacccagtcctcccctgctgcccctgggggcatgaagagccccccagaccagcccgtcaagcacctcttcaccacaggtgtggtctacgacacgttcatgctaaagcaccagtgcatgtgcgggaacacacacgtgcaccctgagcatgctggccggatccagagcatctggtcccggctgcaggagacaggcctgcttagcaagtgcgagcggatccgaggtcgcaaagccacgctagatgagatccagacagtgcactctgaataccacaccctgctctatgggaccagtcccctcaaccggcagaagctagacagcaagaagttgctcggccccatcagccagaagatgtatgctgtgctgccttgtgggggcatcggggtggacagtgacaccgtgtggaatgagatgcactcctccagtgctgtgcgcatggcagtgggctgcctgctggagctggccttcaaggtggctgcaggagagctcaagaatggatttgccatcatccggcccccaggacaccacgccgaggaatccacagccatgggattctgcttcttcaactctgtagccatcaccgcaaaactcctacagcagaagttgaacgtgggcaaggtcctcatcgtggactgggacattcaccatggcaatggcacccagcaggcgttctacaatgacccctctgtgctctacatctctctgcatcgctatgacaacgggaacttctttccaggctctggggctcctgaagaggttggtggaggaccaggcgtggggtacaatgtgaacgtggcatggacaggaggtgtggacccccccattggagacgtggagtaccttacagccttcaggacagtggtgatgcccattgcccacgagttctcacctgatgtggtcctagtctccgccgggtttgatgctgttgaaggacatctgtctcctctgggtggctactctgtcaccgccagatgttttggccacttgaccaggcagctgatgaccctggcagggggccgggtggtgctggccctggagggaggccatgacttgaccgccatctgtgatgcctctgaggcttgtgtctcggctctgctcagtgtagagctgcagcccttggatgaggcagtcttgcagcaaaagcccaacatcaacgcagtggccacgctagagaaagtcatcgagatccagagcaaacactggagctgtgtgcagaagttcgccgctggtctgggccggtccctgcgagaggcccaagcaggtgagaccgaggaggccgagactgtgagcgccatggccttgctgtcggtgggggccgagcaggcccaggctgcggcagcccgggaacacagccccaggccggcagaggagcccatggagcaggagcctgccctgtgacgccccggcccccatccctctgggcttcaccattgtgattttgtttattttttctattaaaaacaaaaagtcacacattcaacaaggtgtgccgtgtgggtctctcagccttgcccctcctgctcctctacgctgcctcaggcccccagccctgtggcttccacctcagctctagaagcctgctccctctgcagggggtggtggtgtcttcccagccctgtcccatgtgtccctccacccattttcctgcattctgtctgtccttttcctccttggagcctgggccagctcaaggtgggcacgggggcccagacagtactctccagttctggggccccccgagtgaggagggaacgggaagtcggtgccttggtttcagctgatttggggggaaatgccttaatttcactctcctcccttctccagcctcaggggaggatctggaggatccactactgtctttaagatgcagagtggaggggaggtgggcacccaccctgcgattctccaccctttccccttctttcgtcctcaccatctctgcagacccctctcctcctccttcctcttggtctcagcactgatgggaggctggtgcccaagctgtggcctgcagtctgtgaggagggctgtcttgcctcacactcctcacagcctacttccccttccccggggctgagagggtgaaagtgtgtggggaaggagaggactggtttcctgggttctcaggggccaggaggagtaacagaaccaggtctgctccccaccttactcggatggcctccctgcccctctgctggcacagcctgggcaaggggagaaggtggtccctgcagaggggctccaggctggtgagagcccccctgctgtcaggaccagattttcccagccatccagcatgctgcggggagaaggggcagaggctcacctccctcctggggccttttgttttggatcctggggatggtgagaatggaggttctagaaggggtaaggccagaacccagggatccaggagtcggctctcagctggagcttccataccttctgggctccctttgctgaccaccagcccaagggagctaagaccaggagggggctgggcgctgtcccttctctttcccaggagccctgccaggggctgtgggcctacaaggcttccaggggatgccatccagcctgtaggaaaccaaagatgggaagtggctcctagggggctgactcttccttcctcctcctccccagtaccacatatactttctctccttctatctccagggccccaccaatctgtttacatatttattatcctatgggggcctgagcaggattgagggagccaggggaggggcaggagtcccctcctgggggatggggatggggccaggctcagtgtactaggcctctctgtgctgagccccaggctcccggccccttacccactctctccctgtggctggtctggttctcatgtaaacccactccttgctttgtctccctggatatggatttcagttaagtattttgtaacccgttacactgtgtgtccttgtgtaaataaacttgtttctggcagtgccatctggggccaa

SEQ ID NO: 440439 - DNA, 2209 bp, Homo sapiens
gcgctaggctacgacgcccctggtactcggccgagggctgtgggcgtggcactggagggcgacgggagcccccacgggcatgcctccctgctgcagcatgtgctgttgctggagcaggcccggcagcagagcaccctcattgctgtgccactccacgggcagtccccactagtgacgggtgaacgtgtggccaccagcatgcggacggtaggcaagctcccgcggcatcggcccctgagccgcactcagtcctcaccgctgccgcagagtccccaggccctgcagcagctggtcatgcaacaacagcaccagcagttcctggagaagcagaagcagcagcagctacagctgggcaagatcctcaccaagacaggggagctgcccaggcagcccaccacccaccctgaggagacagaggaggagctgacggagcagcaggaggtcttgctgggggagggagccctgaccatgccccgggagggctccacagagagtgagagcacacaggaagacctggaggaggaggacgaggaagaggatggggaggaggaggaggattgcatccaggttaaggacgaggagggcgagagtggtgctgaggaggggcccgacttggaggagcctggtgctggatacaaaaaactgttctcagatgcccagccgctgcagcctttgcaggtgtaccaggcgcccctcagcctggccactgtgccccaccaggccctgggccgtacccagtcctcccctgctgcccctgggggcatgaagagccccccagaccagcccgtcaagcacctcttcaccacaggtgtggtctacgacacgttcatgctaaagcaccagtgcatgtgcgggaacacacacgtgcaccctgagcatgctggccggatccagagcatctggtcccggctgcaggagacaggcctgcttagcaagtgcgagcggatccgaggtcgcaaagccacgctagatgagatccagacagtgcactctgaataccacaccctgctctatgggaccagtcccctcaaccggcagaagctagacagcaagaagttgctcggccccatcagccagaagatgtatgctgtgctgccttgtgggggcatcggggtggacagtgacaccgtgtggaatgagatgcactcctccagtgctgtgcgcatggcagtgggctgcctgctggagctggccttcaaggtggctgcaggagagctcaagaatggatttgccatcatccggcccccaggacaccacgccgaggaatccacagccatgggattctgcttcttcaactctgtagccatcaccgcaaaactcctacagcagaagttgaacgtgggcaaggtcctcatcgtggactgggacattcaccatggcaatggcacccagcaggcgttctacaatgacccctctgtgctctacatctctctgcatcgctatgacaacgggaacttctttccaggctctggggctcctgaagaggttggtggaggaccaggcgtggggtacaatgtgaacgtggcatggacaggaggtgtggacccccccattggagacgtggagtaccttacagccttcaggacagtggtgatgcccattgcccacgagttctcacctgatgtggtcctagtctccgccgggtttgatgctgttgaaggacatctgtctcctctgggtggctactctgtcaccgccagatgttttggccacttgaccaggcagctgatgaccctggcagggggccgggtggtgctggccctggagggaggccatgacttgaccgccatctgtgatgcctctgaggcttgtgtctcggctctgctcagtgtagagctgcagcccttggatgaggcagtcttgcagcaaaagcccaacatcaacgcagtggccacgctagagaaagtcatcgagatccagagcaaacactggagctgtgtgcagaagttcgccgctggtctgggccggtccctgcgagaggcccaagcaggtgagaccgaggaggccgagactgtgagcgccatggccttgctgtcggtgggggccgagcaggcccaggctgcggcagcccgggaacacagccccaggccggcagaggagcccatggagcaggagcctgccctgtgacgccccggcccccatccctctgggcttcaccattgtgattttgtttattttttctattaaaaacaaaaagtcacacattcaa

SEQ ID NO: 440440 - DNA, 3847 bp, Homo sapiens
gcggcgagcggagccggaggagccgccgcgaagatggaggagccgtcgaggaggtgctgccgccgctgccgccgccgctgctgccgccgccgcccgcgaagccggagctcgagccgcagcggggatgccgttctgagtgcctgactgcctcgccccgaaggatggcctcggatgggcattagaggcacggcggccccgggctcccgtcccgtccgtctgtctgttatcgtctgtctctcttgacatcaccgcagctccaccccctcccgtcccagcccccaacgccagcttcctgcaggcccagagccggcatgaactctcccaacgagtcgcgatgggatgtcaggtcgggaaccatccttggaaatcctgccgcggacttctctgcacagcatccctgtgacagtggaggtgaagccggtgctgccaagagccatgcccagttccatggggggtgggggtggaggcagccccagccctgtggagctacggggggctctggtgggctctgtggaccccacactgcgggagcagcaactgcagcaggagctcctggcgctcaagcagcagcagcagctgcagaagcagctcctgttcgctgagttccagaaacagcatgaccacctgacaaggcagcatgaggtccagctgcagaagcacctcaagcagcagcaggagatgctggcagccaagcagcagcaggagatgctggcagccaagcggcagcaggagctggagcagcagcggcagcgggagcagcagcggcaggaagagctggagaagcagcggctggagcagcagctgctcatcctgcggaacaaggagaagagcaaagagagtgccattgccagcactgaggtaaagctgaggctccaggaattcctcttgtcgaagtcaaaggagcccacaccaggcggcctcaaccattccctcccacagcaccccaaatgctggggagcccaccatgcttctttggaccagagttcccctccccagagcggcccccctgggacgcctccctcctacaaactgcctttgcctgggccctacgacagtcgagacgacttccccctccgcaaaacagcctctgaacccaacttgaaagtgcgttcaaggctaaaacagaaggtggctgagcggagaagcagtcccctcctgcgtcgcaaggatgggactgttattagcacctttaagaagagagctgttgagatcacaggtgccgggcctggggcgtcgtccgtgtgtaacagcgcacccggctccggccccagctctcccaacagctcccacagcaccatcgctgagaatggctttactggctcagtccccaacatccccactgagatgctccctcagcaccgagccctccctctggacagctcccccaaccagttcagcctctacacgtctccttctctgcccaacatctccctagggctgcaggccacggtcactgtcaccaactcacacctcactgcctccccgaagctgtcgacacagcaggaggccgagaggcaggccctccagtccctgcggcagggtggcacgctgaccggcaagttcatgagcacatcctctattcctggctgcctgctgggcgtggcactggagggcgacgggagcccccacgggcatgcctccctgctgcagcatgtgctgttgctggagcaggcccggcagcagagcaccctcattgctgtgccactccacgggcagtccccactagtgacgggtgaacgtgtggccaccagcatgcggacggtaggcaagctcccgcggcatcggcccctgagccgcactcagtcctcaccgctgccgcagagtccccaggccctgcagcagctggtcatgcaacaacagcaccagcagttcctggagaagcagaagcagcagcagctacagctgggcaagatcctcaccaagacaggggagctgcccaggcagcccaccacccaccctgaggagacagaggaggagctgacggagcagcaggaggtcttgctgggggagggagccctgaccatgccccgggagggctccacagagagtgagagcacacaggaagacctggaggaggaggacgaggaagaggatggggaggaggaggaggattgcatccaggttaaggacgaggagggcgagagtggtgctgaggaggggcccgacttggaggagcctggtgctggatacaaaaaactgttctcagatgcccagccgctgcagcctttgcaggtgtaccaggcgcccctcagcctggccactgtgccccaccaggccctgggccgtacccagtcctcccctgctgcccctgggggcatgaagagccccccagaccagcccgtcaagcacctcttcaccacaggtgtggtctacgacacgttcatgctaaagcaccagtgcatgtgcgggaacacacacgtgcaccctgagcatgctggccggatccagagcatctggtcccggctgcaggagacaggcctgcttagcaagtgcgagcggatccgaggtcgcaaagccacgctagatgagatccagacagtgcactctgaataccacaccctgctctatgggaccagtcccctcaaccggcagaagctagacagcaagaagttgctcggccccatcagccagaagatgtatgctgtgctgccttgtgggggcatcggggtggacagtgacaccgtgtggaatgagatgcactcctccagtgctgtgcgcatggcagtgggctgcctgctggagctggccttcaaggtggctgcaggagagctcaagaatggatttgccatcatccggcccccaggacaccacgccgaggaatccacagccatgggattctgcttcttcaactctgtagccatcaccgcaaaactcctacagcagaagttgaacgtgggcaaggtcctcatcgtggactgggacattcaccatggcaatggcacccagcaggcgttctacaatgacccctctgtgctctacatctctctgcatcgctatgacaacgggaacttctttccaggctctggggctcctgaagaggttggtggaggaccaggcgtggggtacaatgtgaacgtggcatggacaggaggtgtggacccccccattggagacgtggagtaccttacagccttcaggacagtggtgatgcccattgcccacgagttctcacctgatgtggtcctagtctccgccgggtttgatgctgttgaaggacatctgtctcctctgggtggctactctgtcaccgccagatgttttggccacttgaccaggcagctgatgaccctggcagggggccgggtggtgctggccctggagggaggccatgacttgaccgccatctgtgatgcctctgaggcttgtgtctcggctctgctcagtgtagagctgcagcccttggatgaggcagtcttgcagcaaaagcccaacatcaacgcagtggccacgctagagaaagtcatcgagatccagagcaaacactggagctgtgtgcagaagttcgccgctggtctgggccggtccctgcgagaggcccaagcaggtgagaccgaggaggccgagactgtgagcgccatggccttgctgtcggtgggggccgagcaggcccaggctgcggcagcccgggaacacagccccaggtaagcagcaacccgcaccacctctctgccctcacccctgctggtgcgccccactcaataccctcccctgtgcttgccccacaggccggcagaggagcccatggagcaggagcctgccctgtgacgccccggcccccatccctctgggcttcaccattgtgattttgtttattttttctattaaaaacaaaaagtcacacattcaa

SEQ ID NO: 440441 - DNA, 3909 bp, Homo sapiens
gcggcgagcggagccggaggagccgccgcgaagatggaggagccgtcgaggaggtgctgccgccgctgccgccgccgctgctgccgccgccgcccgcgaagccggagctcgagccgcagcggggatgccgttctgagtgcctgactgcctcgccccgaaggatggcctcggatgggcattagaggcacggcggccccgggctcccgtcccgtccgtctgtctgttatcgtctgtctctcttgacatcaccgcagctccaccccctcccgtcccagcccccaacgccagcttcctgcaggcccagagccggcatgaactctcccaacgagtcgcgatgggatgtcaggtcgggaaccatccttggaaatcctgccgcggacttctctgcacagcatccctgtgacagtggaggtgaagccggtgctgccaagagccatgcccagttccatggggggtgggggtggaggcagccccagccctgtggagctacggggggctctggtgggctctgtggaccccacactgcgggagcagcaactgcagcaggagctcctggcgctcaagcagcagcagcagctgcagaagcagctcctgttcgctgagttccagaaacagcatgaccacctgacaaggcagcatgaggtccagctgcagaagcacctcaagcagcagcaggagatgctggcagccaagcagcagcaggagatgctggcagccaagcggcagcaggagctggagcagcagcggcagcgggagcagcagcggcaggaagagctggagaagcagcggctggagcagcagctgctcatcctgcggaacaaggagaagagcaaagagagtgccattgccagcactgaggtaaagctgaggctccaggaattcctcttgtcgaagtcaaaggagcccacaccaggcggcctcaaccattccctcccacagcaccccaaatgctggggagcccaccatgcttctttggaccagagttcccctccccagagcggcccccctgggacgcctccctcctacaaactgcctttgcctgggccctacgacagtcgagacgacttccccctccgcaaaacagcctctgaacccaacttgaaagtgcgttcaaggctaaaacagaaggtggctgagcggagaagcagtcccctcctgcgtcgcaaggatgggactgttattagcacctttaagaagagagctgttgagatcacaggtgccgggcctggggcgtcgtccgtgtgtaacagcgcacccggctccggccccagctctcccaacagctcccacagcaccatcgctgagaatggctttactggctcagtccccaacatccccactgagatgctccctcagcaccgagccctccctctggacagctcccccaaccagttcagcctctacacgtctccttctctgcccaacatctccctagggctgcaggccacggtcactgtcaccaactcacacctcactgcctccccgaagctgtcgacacagcaggaggccgagaggcaggccctccagtccctgcggcagggtggcacgctgaccggcaagttcatgagcacatcctctattcctggctgcctgctgggcgtggcactggagggcgacgggagcccccacgggcatgcctccctgctgcagcatgtgctgttgctggagcaggcccggcagcagagcaccctcattgctgtgccactccacgggcagtccccactagtgacgggtgaacgtgtggccaccagcatgcggacggtaggcaagctcccgcggcatcggcccctgagccgcactcagtcctcaccgctgccgcagagtccccaggccctgcagcagctggtcatgcaacaacagcaccagcagttcctggagaagcagaagcagcagcagctacagctgggcaagatcctcaccaagacaggggagctgcccaggcagcccaccacccaccctgaggagacagaggaggagctgacggagcagcaggaggtcttgctgggggagggagccctgaccatgccccgggagggctccacagagagtgagagcacacaggaagacctggaggaggaggacgaggaagaggatggggaggaggaggaggattgcatccaggttaaggacgaggagggcgagagtggtgctgaggaggggcccgacttggaggagcctggtgctggatacaaaaaactgttctcagatgcccagccgctgcagcctttgcaggtgtaccaggcgcccctcagcctggccactgtgccccaccaggccctgggccgtacccagtcctcccctgctgcccctgggggcatgaagagccccccagaccagcccgtcaagcacctcttcaccacaggtgtggtctacgacacgttcatgctaaagcaccagtgcatgtgcgggaacacacacgtgcaccctgagcatgctggccggatccagagcatctggtcccggctgcaggagacaggcctgcttagcaagtgcgagcggatccgaggtcgcaaagccacgctagatgagatccagacagtgcactctgaataccacaccctgctctatgggaccagtcccctcaaccggcagaagctagacagcaagaagttgctcggccccatcagccagaagatgtatgctgtgctgccttgtgggggcatcggggtggacagtgacaccgtgtggaatgagatgcactcctccagtgctgtgcgcatggcagtgggctgcctgctggagctggccttcaaggtggctgcaggagagctcaagaatggatttgccatcatccggcccccaggacaccacgccgaggaatccacagccatgggattctgcttcttcaactctgtagccatcaccgcaaaactcctacagcagaagttgaacgtgggcaaggtcctcatcgtggactgggtaggcagtgagctggtggggctgggcaggggcgggtagagctaggaccagggtcagccttcaggaagtctcctcccccagccccaccttcaagcaccccagtcgtcctcatcctcgggtgctgggtgtgggtgcagaaggaagggcgctggggctcctgccggatgactaacgtcacattccaacagggctccctcctcaactatgaaagacatttagctcctgttccatcttggccctcacgttgcagtttcaagcaacgaaggggatttcctaccttgaacggtagtgacgctgccgccattgctagtagccgatatttcctcccaccccctacaattaggagcagactgtataccaggaacacaatgagtactttatggccacctcgagtagtaagaacgaggatgtccatttctgtgaacaaaggtgttgttgcgtgacttacccaaggccactcagctggggatgtcggcactgggtttcagaccaaggcttttggccccagcactctgctcttgctaccatgggtgcttcccaaaccctgctcctaatggtggaggcagaggcacacaccactctctgtgagctggggaagtagccaggaccaagcctcaggaaggacaaaatctcttggaagcccaattctggcttaaaaattcatgtaaatgttggatcctccttcagaatcttacgtgcttgtggttgggcacaatggctcaaagcctgtaatcccagcattttgggaggccaaggtgggtgaatcacttggggtcaggagttcgagaccaggatggccaacatggtgaaaccctgtctccactgaaaattcaaaaaaattagctaggtgtggtggcgggagcctgtaatcccacctattggggaggctgaggcaggagaattccttgaacctgggaagtggaggttgcagtgagtcaagatcatgccactgcactccagcctcgatgacagagtgagattctgtctcaa

SEQ ID NO: 440442 - DNA, 3128 bp, Homo sapiens
gcggcgagcggagccggaggagccgccgcgaagatggaggagccgtcgaggaggtgctgccgccgctgccgccgccgctgctgccgccgccgcccgcgaagccggagctcgagccgcagcggggatgccgttctgagtgcctgactgcctcgccccgaaggatggcctcggatgggcattagaggcacggcggccccgggctcccgtcccgtccgtctgtctgttatcgtctgtctctcttgacatcaccgcagctccaccccctcccgtcccagcccccaacgccagcttcctgcaggcccagagccggcatgaactctcccaacgagtcgcgatgggatgtcaggtcgggaaccatccttggaaatcctgccgcggacttctctgcacagcatccctgtgacagtggaggtgaagccggtgctgccaagagccatgcccagttccatggggggtgggggtggaggcagccccagccctgtggagctacggggggctctggtgggctctgtggaccccacactgcgggagcagcaactgcagcaggagctcctggcgctcaagcagcagcagcagctgcagaagcagctcctgttcgctgagttccagaaacagcatgaccacctgacaaggcagcatgaggtccagctgcagaagcacctcaagcagcagcaggagatgctggcagccaagcagcagcaggagatgctggcagccaagcggcagcaggagctggagcagcagcggcagcgggagcagcagcggcaggaagagctggagaagcagcggctggagcagcagctgctcatcctgcggaacaaggagaagagcaaagagagtgccattgccagcactgaggtaaagctgaggctccaggaattcctcttgtcgaagtcaaaggagcccacaccaggcggcctcaaccattccctcccacagcaccccaaatgctggggagcccaccatgcttctttggaccagagttcccctccccagagcggcccccctgggacgcctccctcctacaaactgcctttgcctgggccctacgacagtcgagacgacttccccctccgcaaaacagcctctgaacccaacttgaaagtgcgttcaaggctaaaacagaaggtggctgagcggagaagcagtcccctcctgcgtcgcaaggatgggactgttattagcacctttaagaagagagctgttgagatcacaggtgccgggcctggggcgtcgtccgtgtgtaacagcgcacccggctccggccccagctctcccaacagctcccacagcaccatcgctgagaatggctttactggctcagtccccaacatccccactgagatgctccctcagcaccgagccctccctctggacagctcccccaaccagttcagcctctacacgtctccttctctgcccaacatctccctagggctgcaggccacggtcactgtcaccaactcacacctcactgcctccccgaagctgtcgacacagcaggaggccgagaggcaggccctccagtccctgcggcagggtggcacgctgaccggcaagttcatgagcacatcctctattcctggctgcctgctgggcgtggcactggagggcgacgggagcccccacgggcatgcctccctgctgcagcatgtgctgttgctggagcaggcccggcagcagagcaccctcattgctgtgccactccacgggcagtccccactagtgacgggtgaacgtgtggccaccagcatgcggacggtaggcaagctcccgcggcatcggcccctgagccgcactcagtcctcaccgctgccgcagagtccccaggccctgcagcagctggtcatgcaacaacagcaccagcagttcctggagaagcagaagcagcagcagctacagctgggcaagatcctcaccaagacaggggagctgcccaggcagcccaccacccaccctgaggagacagaggaggagctgacggagcagcaggaggtcttgctgggggagggagccctgaccatgccccgggagggctccacagagagtgagagcacacaggaagacctggaggaggaggacgaggaagaggatggggaggaggaggaggattgcatccaggttaaggacgaggagggcgagagtggtgctgaggaggggcccgacttggaggagcctggtgctggatacaaaaaactgttctcagatgcccagccgctgcagcctttgcaggtgtaccaggcgcccctcagcctggccactgtgccccaccaggccctgggccgtacccagtcctcccctgctgcccctgggggcatgaagagccccccagaccagcccgtcaagcacctcttcaccacaggtgtggtctacgacacgttcatgctaaagcaccagtgcatgtgcgggaacacacacgtgcaccctgagcatgctggccggatccagagcatctggtcccggctgcaggagacaggcctgcttagcaagtgcgagcggatccgaggtcgcaaagccacgctagatgagatccagacagtgcactctgaataccacaccctgctctatgggaccagtcccctcaaccggcagaagctagacagcaagaagttgctcggccccatcagccagaagatgtatgctgtgctgccttgtgggggcatcggggtggacagtgacaccgtgtggaatgagatgcactcctccagtgctgtgcgcatggcagtgggctgcctgctggagctggccttcaaggtggctgcaggagagctcaaggtgagcgtgtgcttgtgacctcggtgccccttggcatggccctgctcctcagaggcagaggacaggggcagccttgggatcctttcagtgaggcactgtcctttgcaagctcaactctcaggcaccagggtgggaaggagttgccagctgggaattcaggttatgagggaccaacaaaaagacactaatgcccagtgctctcgtgggtgtctcgaggcagaaatagtgtctgcctgctcaagcctcatggttggcattcaaaatggtccgttgaggctgggcacagtggctcatacctgtaatctcaacactttgggaggccgaggtgggcagatagcttgagcccaggagtt

SEQ ID NO: 440443 - DNA, 613 bp, Homo sapiens
acaacataatctagtttacagaaaaatcttgtgctagaatacttttttctaaatcttgttgaaggacatctgtctcctctgggtggctactctgtcaccgccagatgttttggccacttgaccaggcagctgatgaccctggcagggggccgggtggtgctggccctggagggaggccatgacttgaccgccatctgtgatgcctctgaggcttgtgtctcggctctgctcagtgtagagctgcagcccttggatgaggcagtcttgcagcaaaagcccaacatcaacgcagtggccacgctagagaaagtcatcgagatccagagcaaacactggagctgtgtgcagaagttcgccgctggtctgggccggtccctgcgagaggcccaagcaggtgagaccgaggaggccgagactgtgagcgccatggccttgctgtcggtgggggccgagcaggcccaggctgcggcagcccgggaacacagccccaggccggcagaggagcccatggagcaggagcctgccctgtgacgccccggcccccatccctctgggcttcaccattgtgattttgtttattttttctattaaaaacaaaaagtcacacattcaa

SEQ ID NO: 440444 - DNA, 1288 bp, Homo sapiens
gcggcgagcggagccggaggagccgccgcgaagatggaggagccgtcgaggaggtgctgccgccgctgccgccgccgctgctgccgccgccgcccgcgaagccggagctcgagccgcagcggggatgccgttctgagtgcctgactgcctcgccccgaaggatggcctcggatgggcattagaggcacggcggccccgggctcccgtcccgtccgtctgtctgttatcgtctgtctctcttgacatcaccgcagctccaccccctcccgtcccagcccccaacgccagcttcctgcaggcccagagccggcatgaactctcccaacgagtcgcgatgggatgtcaggtcgggaaccatccttggaaatcctgccgcggacttctctgcacagcatccctgtgacagtggaggtgaagccggtgctgccaagagccatgcccagttccatggggggtgggggtggaggcagccccagccctgtggagctacggggggctctggtgggctctgtggaccccacactgcgggagcagcaactgcagcaggagctcctggcgctcaagcagcagcagcagctgcagaagcagctcctgttcgctgagttccagaaacagcatgaccacctgacaaggcagcatgaggtccagctgcagaagcacctcaagcagcagcaggagatgctggcagccaagcagcagcaggagatgctggcagccaagcggcagcaggagctggagcagcagcggcagcgggagcagcagcggcaggaagagctggagaagcagcggctggagcagcagctgctcatcctgcggaacaaggagaagagcaaagagagtgccattgccagcactgaggtaaagctgaggctccaggaattcctcttgtcgaagtcaaaggagcccacaccaggcggcctcaaccattccctcccacagcaccccaaatgctggggagcccaccatgcttctttggaccagagttcccctccccagagcggcccccctgggacgcctccctcctacaaactgcctttgcctgggccctacgacagtcgagacgacttccccctccgcaaaacagcctctgaacccaacttgaaagtgcgttcaaggctaaaacagaaggtggctgagcggagaagcagtcccctcctgcgtcgcaaggatgggactgttattagcacctttaagaagagagctgttgagatcacaggtgccgggcctgggggtaagggctgctctcatgtacctgttctgagggtctgggaatcaggggtcgggggta

SEQ ID NO: 440445 - DNA, 479 bp, Homo sapiens
gcggcgagcggagccggaggagccgccgcgaagatggaggagccgtcgaggaggtgctgccgccgctgccgccgccgctgctgccgccgccgcccgcgaagccggagctcgagccgcagcggggatgccgttctgagtgcctgactgcctcgccccgaaggatggcctcggatgggcattagaggcacggcggccccgggctcccgtcccgtccgtctgtctgttatcgtctgtctctcttgacatcaccgcagctccaccccctcccgtcccagcccccaacgccagcttcctgcaggcccagagccggcatgaactctcccaacgagtcgcgatgggatgtcaggtcgggaaccatccttggaaatcctgccgcggacttctctgcacagcatccctgtgacagtggggagaagacagagagccagaagagctgggattaagccctgggtcctccatctcctttccaggtgaccttg

SEQ ID NO: 440446 - DNA, 358 bp, Homo sapiens
gtgagcgcgccgccccggcccagatcccatcttccccggaccccgggacgcgaggcggcgccccctcctcctgctgtctctgtccgcgggctcccagcgcgcgcgccgcgctccgcgccccccttccttcctcccggccctgggagccagccggcgccccccgggagcatcggcagcccgtgagcgggacatcggggttgctgcgcgcgcccctccctgcccctcccagacaggggcgccttccctacaggtaagggaggggcccgccttctcgcgccctgcgcccccaaatggctcggagaccggccggggttgtctgatttgccccttccctggcggcgcatgttgcgttgcagag

SEQ ID NO: 440447 - DNA, 388 bp, Homo sapiens
caggccagagggctgaggggccagcaaggggtcagccagcactgggagccccttaggaagcttttccttggtcctaaggaacagctaatggccaggctttctgagtatgcgtttgtccaaaaaggccatgtttgcccctgttgtgagggatatctggggctgagtggggcagttagaggggtatgcatggcaaccctactccccaccctaagccttctcttctttcccctgccagctgcagcccttggatgaggcagtcttgcagcaaaagcccaacatcaacgcagtggccacgctagagaaagtcatcgagatccagagtgcgtgaggacacgtagaggggctcaggctgccaagggggcacggagcttgtgggagcaccaggact

SEQ ID NO: 440448 - DNA, 324 bp, Homo sapiens
ccggatgaggcacttccctacagtgtgggtcccgtcggcagtggcctgagggaacctgtgctctgcgggctgcccgaccaccttcccttcggtctgctccccgcctctggcggccccctccctggcatgctgctggtgcccaaggctcaggggctcgtggagatgctgcagaccatctatgagacagaatcctgtttctcagcgatgggatgtcaggtcgggaaccatccttggaaatcctgccgcggacttctctgcacagcatccctgtgacaggtaagtgccttgatgtccctgcctgccctctgtcatctggcatccttg

SEQ ID NO: 440449 - DNA, 1746 bp, Homo sapiens
gaccctgtttcaaagaaaaaaaaaaaaagctggagaggagagggggcaggtttgtggcagggtggctgcagtggccatggggaggtgtttggacctgggggttggagacagctccatgagccctgctgaggatcatggtagccaggctgggatcctgggcccagagcagtgctggctgacacataggtctgtggcccaggtgtggtctacgacacgttcatgctaaagcaccagtgcatgtgcgggaacacacacgtgcaccctgagcatgctggccggatccagagcatctggtcccggctgcaggagacaggcctgcttagcaagtgcgagcggatccgaggtcgcaaagccacgctagatgagatccagacagtgcactctgaataccacaccctgctctatgggaccagtcccctcaaccggcagaagctagacagcaagaagttgctcggccccatcagccagaagatgtatgctgtgctgccttgtgggggcatcggggtggacagtgacaccgtgtggaatgagatgcactcctccagtgctgtgcgcatggcagtgggctgcctgctggagctggccttcaaggtggctgcaggagagctcaagaatggatttgccatcatccggcccccaggacaccacgccgaggaatccacagccatgggattctgcttcttcaactctgtagccatcaccgcaaaactcctacagcagaagttgaacgtgggcaaggtcctcatcgtggactgggtaggcagtgagctggtggggctgggcaggggcgggtagagctaggaccagggtcagccttcaggaagtctcctcccccagccccaccttcaagcaccccagtcgtcctcatcctcgggtgctgggtgtgggtgcagaaggaagggcgctggggctcctgccggatgactaacgtcacattccaacagggctccctcctcaactatgaaagacatttagctcctgttccatcttggccctcacgttgcagtttcaagcaacgaaggggatttcctaccttgaacggtagtgacgctgccgccattgctagtagccgatatttcctcccaccccctacaattaggagcagactgtataccaggaacacaatgagtactttatggccacctcgagtagtaagaacgaggatgtccatttctgtgaacaaaggtgttgttgcgtgacttacccaaggccactcagctggggatgtcggcactgggtttcagaccaaggcttttggccccagcactctgctcttgctaccatgggtgcttcccaaaccctgctcctaatggtggaggcagaggcacacaccactctctgtgagctggggaagtagccaggaccaagcctcaggaaggacaaaatctcttggaagcccaattctggcttaaaaattcatgtaaatgttggatcctccttcagaatcttacgtgcttgtggttgggcacaatggctcaaagcctgtaatcccagcattttgggaggccaaggtgggtgaatcacttggggtcaggagttcgagaccaggatggccaacatggtgaaaccctgtctccactgaaaattcaaaaaaattagctaggtgtggtggcgggagcctgtaatcccacctattggggaggctgaggcaggagaattccttgaacctgggaagtggaggttgcagtgagtcaagatcatgccactgcactccagcctcgatgacagagtgagattctgtctcaa

SEQ ID NO: 440450 - DNA, 3763 bp, Homo sapiens
gcggcgagcggagccggaggagccgccgcgaagatggaggagccgtcgaggaggtgctgccgccgctgccgccgccgctgctgccgccgccgcccgcgaagccggagctcgagccgcagcggggatgccgttctgagtgcctgactgcctcgccccgaaggatggcctcggatgggcattagaggcacggcggccccgggctcccgtcccgtccgtctgtctgttatcgtctgtctctcttgacatcaccgcagctccaccccctcccgtcccagcccccaacgccagcttcctgcaggcccagagccggcatgaactctcccaacgagtcgcgatgggatgtcaggtcgggaaccatccttggaaatcctgccgcggacttctctgcacagcatccctgtgacagtggaggtgaagccggtgctgccaagagccatgcccagttccatggggggtgggggtggaggcagccccagccctgtggagctacggggggctctggtgggctctgtggaccccacactgcgggagcagcaactgcagcaggagctcctggcgctcaagcagcagcagcagctgcagaagcagctcctgttcgctgagttccagaaacagcatgaccacctgacaaggcagcatgaggtccagctgcagaagcacctcaagcagcagcaggagatgctggcagccaagcagcagcaggagatgctggcagccaagcggcagcaggagctggagcagcagcggcagcgggagcagcagcggcaggaagagctggagaagcagcggctggagcagcagctgctcatcctgcggaacaaggagaagagcaaagagagtgccattgccagcactgaggtaaagctgaggctccaggaattcctcttgtcgaagtcaaaggagcccacaccaggcggcctcaaccattccctcccacagcaccccaaatgctggggagcccaccatgcttctttggaccagagttcccctccccagagcggcccccctgggacgcctccctcctacaaactgcctttgcctgggccctacgacagtcgagacgacttccccctccgcaaaacagcctctgaacccaacttgaaagtgcgttcaaggctaaaacagaaggtggctgagcggagaagcagtcccctcctgcgtcgcaaggatgggactgttattagcacctttaagaagagagctgttgagatcacaggtgccgggcctggggcgtcgtccgtgtgtaacagcgcacccggctccggccccagctctcccaacagctcccacagcaccatcgctgagaatggctttactggctcagtccccaacatccccactgagatgctccctcagcaccgagccctccctctggacagctcccccaaccagttcagcctctacacgtctccttctctgcccaacatctccctagggctgcaggccacggtcactgtcaccaactcacacctcactgcctccccgaagctgtcgacacagcaggaggccgagaggcaggccctccagtccctgcggcagggtggcacgctgaccggcaagttcatgagcacatcctctattcctggctgcctgctgggcgtggcactggagggcgacgggagcccccacgggcatgcctccctgctgcagcatgtgctgttgctggagcaggcccggcagcagagcaccctcattgctgtgccactccacgggcagtccccactagtgacgggtgaacgtgtggccaccagcatgcggacggtaggcaagctcccgcggcatcggcccctgagccgcactcagtcctcaccgctgccgcagagtccccaggccctgcagcagctggtcatgcaacaacagcaccagcagttcctggagaagcagaagcagcagcagctacagctgggcaagatcctcaccaagacaggggagctgcccaggcagcccaccacccaccctgaggagacagaggaggagctgacggagcagcaggaggtcttgctgggggagggagccctgaccatgccccgggagggctccacagagagtgagagcacacaggaagacctggaggaggaggacgaggaagaggatggggaggaggaggaggattgcatccaggttaaggacgaggagggcgagagtggtgctgaggaggggcccgacttggaggagcctggtgctggatacaaaaaactgttctcagatgcccagccgctgcagcctttgcaggtgtaccaggcgcccctcagcctggccactgtgccccaccaggccctgggccgtacccagtcctcccctgctgcccctgggggcatgaagagccccccagaccagcccgtcaagcacctcttcaccacaggtgtggtctacgacacgttcatgctaaagcaccagtgcatgtgcgggaacacacacgtgcaccctgagcatgctggccggatccagagcatctggtcccggctgcaggagacaggcctgcttagcaagtgcgagcggatccgaggtcgcaaagccacgctagatgagatccagacagtgcactctgaataccacaccctgctctatgggaccagtcccctcaaccggcagaagctagacagcaagaagttgctcggccccatcagccagaagatgtatgctgtgctgccttgtgggggcatcggggtggacagtgacaccgtgtggaatgagatgcactcctccagtgctgtgcgcatggcagtgggctgcctgctggagctggccttcaaggtggctgcaggagagctcaagaatggatttgccatcatccggcccccaggacaccacgccgaggaatccacagccatgggattctgcttcttcaactctgtagccatcaccgcaaaactcctacagcagaagttgaacgtgggcaaggtcctcatcgtggactgggacattcaccatggcaatggcacccagcaggcgttctacaatgacccctctgtgctctacatctctctgcatcgctatgacaacgggaacttctttccaggctctggggctcctgaagaggttggtggaggaccaggcgtggggtacaatgtgaacgtggcatggacaggaggtgtggacccccccattggagacgtggagtaccttacagccttcaggacagtggtgatgcccattgcccacgagttctcacctgatgtggtcctagtctccgccgggtttgatgctgttgaaggacatctgtctcctctgggtggctactctgtcaccgccagatgttttggccacttgaccaggcagctgatgaccctggcagggggccgggtggtgctggccctggagggaggccatgacttgaccgccatctgtgatgcctctgaggcttgtgtctcggctctgctcagtgtagagctgcagcccttggatgaggcagtcttgcagcaaaagcccaacatcaacgcagtggccacgctagagaaagtcatcgagatccagagcaaacactggagctgtgtgcagaagttcgccgctggtctgggccggtccctgcgagaggcccaagcaggtgagaccgaggaggccgagactgtgagcgccatggccttgctgtcggtgggggccgagcaggcccaggctgcggcagcccgggaacacagccccaggccggcagaggagcccatggagcaggagcctgccctgtgacgccccggcccccatccctctgggcttcaccattgtgattttgtttattttttctattaaaaacaaaaagtcacacattcaa

SEQ ID NO: 440451 - DNA, 3805 bp, Homo sapiens
gcggcgagcggagccggaggagccgccgcgaagatggaggagccgtcgaggaggtgctgccgccgctgccgccgccgctgctgccgccgccgcccgcgaagccggagctcgagccgcagcggggatgccgttctgagtgcctgactgcctcgccccgaaggatggcctcggatgggcattagaggcacggcggccccgggctcccgtcccgtccgtctgtctgttatcgtctgtctctcttgacatcaccgcagctccaccccctcccgtcccagcccccaacgccagcttcctgcaggcccagagccggcatgaactctcccaacgagtcgcgatgggatgtcaggtcgggaaccatccttggaaatcctgccgcggacttctctgcacagcatccctgtgacagtggaggtgaagccggtgctgccaagagccatgcccagttccatggggggtgggggtggaggcagccccagccctgtggagctacggggggctctggtgggctctgtggaccccacactgcgggagcagcaactgcagcaggagctcctggcgctcaagcagcagcagcagctgcagaagcagctcctgttcgctgagttccagaaacagcatgaccacctgacaaggcagcatgaggtccagctgcagaagcacctcaagcagcagcaggagatgctggcagccaagcagcagcaggagatgctggcagccaagcggcagcaggagctggagcagcagcggcagcgggagcagcagcggcaggaagagctggagaagcagcggctggagcagcagctgctcatcctgcggaacaaggagaagagcaaagagagtgccattgccagcactgaggtaaagctgaggctccaggaattcctcttgtcgaagtcaaaggagcccacaccaggcggcctcaaccattccctcccacagcaccccaaatgctggggagcccaccatgcttctttggaccagagttcccctccccagagcggcccccctgggacgcctccctcctacaaactgcctttgcctgggccctacgacagtcgagacgacttccccctccgcaaaacagcctctgaacccaacttgaaagtgcgttcaaggctaaaacagaaggtggctgagcggagaagcagtcccctcctgcgtcgcaaggatgggactgttattagcacctttaagaagagagctgttgagatcacaggtgccgggcctggggcgtcgtccgtgtgtaacagcgcacccggctccggccccagctctcccaacagctcccacagcaccatcgctgagaatggctttactggctcagtccccaacatccccactgagatgctccctcagcaccgagccctccctctggacagctcccccaaccagttcagcctctacacgtctccttctctgcccaacatctccctagggctgcaggccacggtcactgtcaccaactcacacctcactgcctccccgaagctgtcgacacagcaggaggccgagaggcaggccctccagtccctgcggcagggtggcacgctgaccggcaagttcatgagcacatcctctattcctggctgcctgctgggcgtggcactggagggcgacgggagcccccacgggcatgcctccctgctgcagcatgtgctgttgctggagcaggcccggcagcagagcaccctcattgctgtgccactccacgggcagtccccactagtgacgggtgaacgtgtggccaccagcatgcggacggtaggcaagctcccgcggcatcggcccctgagccgcactcagtcctcaccgctgccgcagagtccccaggccctgcagcagctggtcatgcaacaacagcaccagcagttcctggagaagcagaagcagcagcagctacagctgggcaagatcctcaccaagacaggggagctgcccaggcagcccaccacccaccctgaggagacagaggaggagctgacggagcagcaggaggtcttgctgggggagggagccctgaccatgccccgggagggctccacagagagtgagagcacacaggaagacctggaggaggaggacgaggaagaggatggggaggaggaggaggattgcatccaggttaaggacgaggagggcgagagtggtgctgaggaggggcccgacttggaggagcctggtgctggatacaaaaaactgttctcagatgcccagccgctgcagcctttgcaggtgtaccaggcgcccctcagcctggccactgtgccccaccaggccctgggccgtacccagtcctcccctgctgcccctgggggcatgaagagccccccagaccagcccgtcaagcacctcttcaccacaggtgtggtctacgacacgttcatgctaaagcaccagtgcatgtgcgggaacacacacgtgcaccctgagcatgctggccggatccagagcatctggtcccggctgcaggagacaggcctgcttagcaagtgcgagcggatccgaggtcgcaaagccacgctagatgagatccagacagtgcactctgaataccacaccctgctctatgggaccagtcccctcaaccggcagaagctagacagcaagaagttgctcggccccatcagccagaagatgtatgctgtgctgccttgtgggggcatcggggtggacagtgacaccgtgtggaatgagatgcactcctccagtgctgtgcgcatggcagtgggctgcctgctggagctggccttcaaggtggctgcaggagagctcaagaatggatttgccatcatccggcccccaggacaccacgccgaggaatccacagccatgggattctgcttcttcaactctgtagccatcaccgcaaaactcctacagcagaagttgaacgtgggcaaggtcctcatcgtggactgggacattcaccatggcaatggcacccagcaggcgttctacaatgacccctctgtgctctacatctctctgcatcgctatgacaacgggaacttctttccaggctctggggctcctgaagaggttggtggaggaccaggcgtggggtacaatgtgaacgtggcatggacaggaggtgtggacccccccattggagacgtggagtaccttacagccttcaggacagtggtgatgcccattgcccacgagttctcacctgatgtggtcctagtctccgccgggtttgatgctgttgaaggacatctgtctcctctgggtggctactctgtcaccgccagatgttttggccacttgaccaggcagctgatgaccctggcagggggccgggtggtgctggccctggagggaggccatgacttgaccgccatctgtgatgcctctgaggcttgtgtctcggctctgctcagtgtagagctgcagcccttggatgaggcagtcttgcagcaaaagcccaacatcaacgcagtggccacgctagagaaagtcatcgagatccagagcaaacactggagctgtgtgcagaagttcgccgctggtctgggccggtccctgcgagaggcccaagcaggtgagaccgaggaggccgagactgtgagcgccatggccttgctgtcggtgggggccgagcaggcccaggctgcggcagcccgggaacacagccccaggccggcagaggagcccatggagcaggagcctgccctgtgacgccccggcccccatccctctgggcttcaccattgtgattttgtttattttttctattaaaaacaaaaagtcacacattcaaaaaataaaaaaaaaaaatcgcttttggggaaaaataaggctt

SEQ ID NO: 440452 - DNA, 4608 bp, Homo sapiens
gcggcgagcggagccggaggagccgccgcgaagatggaggagccgtcgaggaggtgctgccgccgctgccgccgccgctgctgccgccgccgcccgcgaagccggagctcgagccgcagcggggatgccgttctgagtgcctgactgcctcgccccgaaggatggcctcggatgggcattagaggcacggcggccccgggctcccgtcccgtccgtctgtctgttatcgtctgtctctcttgacatcaccgcagctccaccccctcccgtcccagcccccaacgccagcttcctgcaggcccagagccggcatgaactctcccaacgagtcgcgatgggatgtcaggtcgggaaccatccttggaaatcctgccgcggacttctctgcacagcatccctgtgacagtggaggtgaagccggtgctgccaagagccatgcccagttccatggggggtgggggtggaggcagccccagccctgtggagctacggggggctctggtgggctctgtggaccccacactgcgggagcagcaactgcagcaggagctcctggcgctcaagcagcagcagcagctgcagaagcagctcctgttcgctgagttccagaaacagcatgaccacctgacaaggcagcatgaggtccagctgcagaagcacctcaagcagcagcaggagatgctggcagccaagcagcagcaggagatgctggcagccaagcggcagcaggagctggagcagcagcggcagcgggagcagcagcggcaggaagagctggagaagcagcggctggagcagcagctgctcatcctgcggaacaaggagaagagcaaagagagtgccattgccagcactgaggtaaagctgaggctccaggaattcctcttgtcgaagtcaaaggagcccacaccaggcggcctcaaccattccctcccacagcaccccaaatgctggggagcccaccatgcttctttggaccagagttcccctccccagagcggcccccctgggacgcctccctcctacaaactgcctttgcctgggccctacgacagtcgagacgacttccccctccgcaaaacagcctctgaacccaacttgaaagtgcgttcaaggctaaaacagaaggtggctgagcggagaagcagtcccctcctgcgtcgcaaggatgggactgttattagcacctttaagaagagagctgttgagatcacaggtgccgggcctggggcgtcgtccgtgtgtaacagcgcacccggctccggccccagctctcccaacagctcccacagcaccatcgctgagaatggctttactggctcagtccccaacatccccactgagatgctccctcagcaccgagccctccctctggacagctcccccaaccagttcagcctctacacgtctccttctctgcccaacatctccctagggctgcaggccacggtcactgtcaccaactcacacctcactgcctccccgaagctgtcgacacagcaggaggccgagaggcaggccctccagtccctgcggcagggtggcacgctgaccggcaagttcatgagcacatcctctattcctggctgcctgctgggcgtggcactggagggcgacgggagcccccacgggcatgcctccctgctgcagcatgtgctgttgctggagcaggcccggcagcagagcaccctcattgctgtgccactccacgggcagtccccactagtgacgggtgaacgtgtggccaccagcatgcggacggtaggcaagctcccgcggcatcggcccctgagccgcactcagtcctcaccgctgccgcagagtccccaggccctgcagcagctggtcatgcaacaacagcaccagcagttcctggagaagcagaagcagcagcagctacagctgggcaagatcctcaccaagacaggggagctgcccaggcagcccaccacccaccctgaggagacagaggaggagctgacggagcagcaggaggtcttgctgggggagggagccctgaccatgccccgggagggctccacagagagtgagagcacacaggaagacctggaggaggaggacgaggaagaggatggggaggaggaggaggattgcatccaggttaaggacgaggagggcgagagtggtgctgaggaggggcccgacttggaggagcctggtgctggatacaaaaaactgttctcagatgcccagccgctgcagcctttgcaggtgtaccaggcgcccctcagcctggccactgtgccccaccaggccctgggccgtacccagtcctcccctgctgcccctgggggcatgaagagccccccagaccagcccgtcaagcacctcttcaccacaggtgtggtctacgacacgttcatgctaaagcaccagtgcatgtgcgggaacacacacgtgcaccctgagcatgctggccggatccagagcatctggtcccggctgcaggagacaggcctgcttagcaagtgcgagcggatccgaggtcgcaaagccacgctagatgagatccagacagtgcactctgaataccacaccctgctctatgggaccagtcccctcaaccggcagaagctagacagcaagaagttgctcggccccatcagccagaagatgtatgctgtgctgccttgtgggggcatcggggtggacagtgacaccgtgtggaatgagatgcactcctccagtgctgtgcgcatggcagtgggctgcctgctggagctggccttcaaggtggctgcaggagagctcaagaatggatttgccatcatccggcccccaggacaccacgccgaggaatccacagccatgggattctgcttcttcaactctgtagccatcaccgcaaaactcctacagcagaagttgaacgtgggcaaggtcctcatcgtggactgggtaggcagtgagctggtggggctgggcaggggcgggtagagctaggaccagggtcagccttcaggaagtctcctcccccagccccaccttcaagcaccccagtcgtcctcatcctcgggtgctgggtgtgggtgcagaaggaagggcgctggggctcctgccggatgactaacgtcacattccaacagggctccctcctcaactatgaaagacatttagctcctgttccatcttggccctcacgttgcagtttcaagcaacgaaggggatttcctaccttgaacggtagtgacgctgccgccattgctagtagccgatatttcctcccaccccctacaattaggagcagactgtataccaggaacacaatgagtactttatggccacctcgagtagtaagaacgaggatgtccatttctgtgaacaaaggtgttgttgcgtgacttacccaaggccactcagctggggatgtcggcactgggtttcagaccaaggcttttggccccagcactctgctcttgctaccatgggtgcttcccaaaccctgctcctaatggtggaggcagaggcacacaccactctctgtgagctggggaagtagccaggaccaagcctcaggaaggacaaaatctcttggaagcccaattctggcttaaaaattcatgtaaatgttggatcctccttcagaatcttacgtgcttgtggttgggcacaatggctcaaagcctgtaatcccaaaatgctaggattacaggcatgagctacagtgctcagctgacaggtggcatttgaccattgggtcagagcgcgggccattttcccgatgcttctacctcccctcataggacattcaccatggcaatggcacccagcaggcgttctacaatgacccctctgtgctctacatctctctgcatcgctatgacaacgggaacttctttccaggctctggggctcctgaagaggttggtggaggaccaggcgtggggtacaatgtgaacgtggcatggacaggaggtgtggacccccccattggagacgtggagtaccttacagccttcaggacagtggtgatgcccattgcccacgagttctcacctgatgtggtcctagtctccgccgggtttgatgctgttgaaggacatctgtctcctctgggtggctactctgtcaccgccagatgttttggccacttgaccaggcagctgatgaccctggcagggggccgggtggtgctggccctggagggaggccatgacttgaccgccatctgtgatgcctctgaggcttgtgtctcggctctgctcagtgtagagctgcagcccttggatgaggcagtcttgcagcaaaagcccaacatcaacgcagtggccacgctagagaaagtcatcgagatccagagcaaacactggagctgtgtgcagaagttcgccgctggtctgggccggtccctgcgagaggcccaagcaggtgagaccgaggaggccgagactgtgagcgccatggccttgctgtcggtgggggccgagcaggcccaggctgcggcagcccgggaacacagccccaggccggcagaggagcccatggagcaggagcctgccctgtgacgccccggcccccatccctctgggcttcaccattgtgattttgtttattttttctattaaaaacaaaaagtcacacattcaa

SEQ ID NO: 440453 - DNA, 3112 bp, Homo sapiens
gcggcgagcggagccggaggagccgccgcgaagatggaggagccgtcgaggaggtgctgccgccgctgccgccgccgctgctgccgccgccgcccgcgaagccggagctcgagccgcagcggggatgccgttctgagtgcctgactgcctcgccccgaaggatggcctcggatgggcattagaggcacggcggccccgggctcccgtcccgtccgtctgtctgttatcgtctgtctctcttgacatcaccgcagctccaccccctcccgtcccagcccccaacgccagcttcctgcaggcccagagccggcatgaactctcccaacgagtcgcgatgggatgtcaggtcgggaaccatccttggaaatcctgccgcggacttctctgcacagcatccctgtgacagtggaggtgaagccggtgctgccaagagccatgcccagttccatggggggtgggggtggaggcagccccagccctgtggagctacggggggctctggtgggctctgtggaccccacactgcgggagcagcaactgcagcaggagctcctggcgctcaagcagcagcagcagctgcagaagcagctcctgttcgctgagttccagaaacagcatgaccacctgacaaggcagcatgaggtccagctgcagaagcacctcaagcagcagcaggagatgctggcagccaagcagcagcaggagatgctggcagccaagcggcagcaggagctggagcagcagcggcagcgggagcagcagcggcaggaagagctggagaagcagcggctggagcagcagctgctcatcctgcggaacaaggagaagagcaaagagagtgccattgccagcactgaggtaaagctgaggctccaggaattcctcttgtcgaagtcaaaggagcccacaccaggcggcctcaaccattccctcccacagcaccccaaatgctggggagcccaccatgcttctttggaccagagttcccctccccagagcggcccccctgggacgcctccctcctacaaactgcctttgcctgggccctacgacagtcgagacgacttccccctccgcaaaacagcctctgaacccaacttgaaagtgcgttcaaggctaaaacagaaggtggctgagcggagaagcagtcccctcctgcgtcgcaaggatgggactgttattagcacctttaagaagagagctgttgagatcacaggtgccgggcctggggcgtcgtccgtgtgtaacagcgcacccggctccggccccagctctcccaacagctcccacagcaccatcgctgagaatggctttactggctcagtccccaacatccccactgaggtcttgctgggggagggagccctgaccatgccccgggagggctccacagagagtgagagcacacaggaagacctggaggaggaggacgaggaagaggatggggaggaggaggaggattgcatccaggttaaggacgaggagggcgagagtggtgctgaggaggggcccgacttggaggagcctggtgctggatacaaaaaactgttctcagatgcccagccgctgcagcctttgcaggtgtaccaggcgcccctcagcctggccactgtgccccaccaggccctgggccgtacccagtcctcccctgctgcccctgggggcatgaagagccccccagaccagcccgtcaagcacctcttcaccacaggtgtggtctacgacacgttcatgctaaagcaccagtgcatgtgcgggaacacacacgtgcaccctgagcatgctggccggatccagagcatctggtcccggctgcaggagacaggcctgcttagcaagtgcgagcggatccgaggtcgcaaagccacgctagatgagatccagacagtgcactctgaataccacaccctgctctatgggaccagtcccctcaaccggcagaagctagacagcaagaagttgctcggccccatcagccagaagatgtatgctgtgctgccttgtgggggcatcggggtggacagtgacaccgtgtggaatgagatgcactcctccagtgctgtgcgcatggcagtgggctgcctgctggagctggccttcaaggtggctgcaggagagctcaagaatggatttgccatcatccggcccccaggacaccacgccgaggaatccacagccatgggattctgcttcttcaactctgtagccatcaccgcaaaactcctacagcagaagttgaacgtgggcaaggtcctcatcgtggactgggacattcaccatggcaatggcacccagcaggcgttctacaatgacccctctgtgctctacatctctctgcatcgctatgacaacgggaacttctttccaggctctggggctcctgaagaggttggtggaggaccaggcgtggggtacaatgtgaacgtggcatggacaggaggtgtggacccccccattggagacgtggagtaccttacagccttcaggacagtggtgatgcccattgcccacgagttctcacctgatgtggtcctagtctccgccgggtttgatgctgttgaaggacatctgtctcctctgggtggctactctgtcaccgccagatgttttggccacttgaccaggcagctgatgaccctggcagggggccgggtggtgctggccctggagggaggccatgacttgaccgccatctgtgatgcctctgaggcttgtgtctcggctctgctcagtgtagagctgcagcccttggatgaggcagtcttgcagcaaaagcccaacatcaacgcagtggccacgctagagaaagtcatcgagatccagagcaaacactggagctgtgtgcagaagttcgccgctggtctgggccggtccctgcgagaggcccaagcaggtgagaccgaggaggccgagactgtgagcgccatggccttgctgtcggtgggggccgagcaggcccaggctgcggcagcccgggaacacagccccaggccggcagaggagcccatggagcaggagcctgccctgtgacgccccggcccccatccctctgggcttcaccattgtgattttgtttattttttctattaaaaacaaaaagtcacacattcaa

SEQ ID NO: 440454 - DNA, 1209 bp, Homo sapiens
tcccatctgcctgttttaaattccctactagccttaatgttttccccaaaactgtgaggtggaatgggttctgtagggagatatgccacatttatcccatggttttgaatatcacctacacagtgccaccccacagaggctcagacctagttagagaagtgtggggtgtgcaataccattgtgaacagaatatggatgccctgtggccaagggtggagtcctgggctcaagcgatcctcccagccctcagcctcccaaaatgctaggattacaggcatgagctacagtgctcagctgacaggtggcatttgaccattgggtcagagcgcgggccattttcccgatgcttctacctcccctcataggacattcaccatggcaatggcacccagcaggcgttctacaatgacccctctgtgctctacatctctctgcatcgctatgacaacgggaacttctttccaggctctggggctcctgaagaggttggtggaggaccaggcgtggggtacaatgtgaacgtggcatggacaggaggtgtggacccccccattggagacgtggagtaccttacagccttcaggacagtggtgatgcccattgcccacgagttctcacctgatgtggtcctagtctccgccgggtttgatgctgttgaaggacatctgtctcctctgggtggctactctgtcaccgccagatgttttggccacttgaccaggcagctgatgaccctggcagggggccgggtggtgctggccctggagggaggccatgacttgaccgccatctgtgatgcctctgaggcttgtgtctcggctctgctcagtgtagagctgcagcccttggatgaggcagtcttgcagcaaaagcccaacatcaacgcagtggccacgctagagaaagtcatcgagatccagagcaaacactggagctgtgtgcagaagttcgccgctggtctgggccggtccctgcgagaggcccaagcaggtgagaccgaggaggccgagactgtgagcgccatggccttgctgtcggtgggggccgagcaggcccaggctgcggcagcccgggaacacagccccaggccggcagaggagcccatggagcaggagcctgccctgtgacgccccggcccccatccctctgggcttcaccattgtgattttgtttattttttctattaaaaacaaaaagtcacacattcaa

SEQ ID NO: 440455 - DNA, 2036 bp, Homo sapiens
gcggcgagcggagccggaggagccgccgcgaagatggaggagccgtcgaggaggtgctgccgccgctgccgccgccgctgctgccgccgccgcccgcgaagccggagctcgagccgcagcggggatgccgttctgagtgcctgactgcctcgccccgaaggatggcctcggatgggcattagaggcacggcggccccgggctcccgtcccgtccgtctgtctgttatcgtctgtctctcttgacatcaccgcagctccaccccctcccgtcccagcccccaacgccagcttcctgcaggcccagagccggcatgaactctcccaacgagtcgcgatgggatgtcaggtcgggaaccatccttggaaatcctgccgcggacttctctgcacagcatccctgtgacagtggaggtgaagccggtgctgccaagagccatgcccagttccatggggggtgggggtggaggcagccccagccctgtggagctacggggggctctggtgggctctgtggaccccacactgcgggagcagcaactgcagcaggagctcctggcgctcaagcagcagcagcagctgcagaagcagctcctgttcgctgagttccagaaacagcatgaccacctgacaaggcagcatgaggtccagctgcagaagcacctcaagcagcagcaggagatgctggcagccaagcagcagcaggagatgctggcagccaagcggcagcaggagctggagcagcagcggcagcgggagcagcagcggcaggaagagctggagaagcagcggctggagcagcagctgctcatcctgcggaacaaggagaagagcaaagagagtgccattgccagcactgaggtaaagctgaggctccaggaattcctcttgtcgaagtcaaaggagcccacaccaggcggcctcaaccattccctcccacagcaccccaaatgctggggagcccaccatgcttctttggaccagagttcccctccccagagcggcccccctgggacgcctccctcctacaaactgcctttgcctgggccctacgacagtcgagacgacttccccctccgcaaaacagcctctgaacccaacttgaaagtgcgttcaaggctaaaacagaaggtggctgagcggagaagcagtcccctcctgcgtcgcaaggatgggactgttattagcacctttaagaagagagctgttgagatcacaggtgccgggcctggggcgtcgtccgtgtgtaacagcgcacccggctccggccccagctctcccaacagctcccacagcaccatcgctgagaatggctttactggctcagtccccaacatccccactgagatgctccctcagcaccgagccctccctctggacagctcccccaaccagttcagcctctacacgtctccttctctgcccaacatctccctagggctgcaggccacggtcactgtcaccaactcacacctcactgcctccccgaagctgtcgacacagcaggaggccgagaggcaggccctccagtccctgcggcagggtggcacgctgaccggcaagttcatgagcacatcctctattcctggctgcctgcggaggccatgacttgaccgccatctgtgatgcctctgaggcttgtgtctcggctctgctcagtgtagagctgcagcccttggatgaggcagtcttgcagcaaaagcccaacatcaacgcagtggccacgctagagaaagtcatcgagatccagagcaaacactggagctgtgtgcagaagttcgccgctggtctgggccggtccctgcgagaggcccaagcaggtgagaccgaggaggccgagactgtgagcgccatggccttgctgtcggtgggggccgagcaggcccaggctgcggcagcccgggaacacagccccaggccggcagaggagcccatggagcaggagcctgccctgtgacgccccggcccccatccctctgggcttcaccattgtgattttgtttattttttctattaaaaacaaaaagtcacacattcaa

SEQ ID NO: 440456 - DNA, 581 bp, Homo sapiens
ctcctcttactggctcttgaattgattgattacctttcgccatttcttcttcctcccttcacccatcctcaaaggttttggccacttgaccaggcagctgatgaccctggcagggggccgggtggtgctggccctggagggaggccatgacttgaccgccatctgtgatgcctctgaggcttgtgtctcggctctgctcagtgtagagctgcagcccttggatgaggcagtcttgcagcaaaagcccaacatcaacgcagtggccacgctagagaaagtcatcgagatccagagcaaacactggagctgtgtgcagaagttcgccgctggtctgggccggtccctgcgagaggcccaagcaggtgagaccgaggaggccgagactgtgagcgccatggccttgctgtcggtgggggccgagcaggcccaggctgcggcagcccgggaacacagccccaggccggcagaggagcccatggagcaggagcctgccctgtgacgccccggcccccatccctctgggcttcaccattgtgattttgtttattttttctattaaaaacaaaaagtcacacattcaa

SEQ ID NO: 440457 - DNA, 2774 bp, Homo sapiens
acgccggtgggcggggggaggaggcggccctagcgccattttgtgggagcgaagcggtggctgggctgcgcttgggtccgtcgctgcttcggtgtccctgtcgggcttcccagcagcggcctagcgggaaaagtaaaagatgtctgaatatattcgggtaaccgaagatgagaacgatgagcccattgaaataccatcggaagacgatgggacggtgctgctctccacggttacagcccagtttccaggggcgtgtgggcttcgctacaggaatccagtgtctcagtgtatgagaggtgtccggctggtagaaggaattctgcatgccccagatgctggctggggaaatctggtgtatgttgtcaactatccaaaagataacaaaagaaaaatggatgagacagatgcttcatcagcagtgaaagtgaaaagagcagtccagaaaacatccgatttaatagtgttgggtctcccatggaaaacaaccgaacaggacctgaaagagtattttagtacctttggagaagttcttatggtgcaggtcaagaaagatcttaagactggtcattcaaaggggtttggctttgttcgttttacggaatatgaaacacaagtgaaagtaatgtcacagcgacatatgatagatggacgatggtgtgactgcaaacttcctaattctaagcaaagccaagatgagcctttgagaagcagaaaagtgtttgtggggcgctgtacagaggacatgactgaggatgagctgcgggagttcttctctcagtacggggatgtgatggatgtcttcatccccaagccattcagggcctttgcctttgttacatttgcagatgatcagattgcgcagtctctttgtggagaggacttgatcattaaaggaatcagcgttcatatatccaatgccgaacctaagcacaatagcaatagacagttagaaagaagtggaagatttggtggtaatccaggtggctttgggaatcagggtggatttggtaatagcagagggggtggagctggtttgggaaacaatcaaggtagtaatatgggtggtgggatgaactttggtgcgttcagcattaatccagccatgatggctgccgcccaggcagcactacagagcagttggggtatgatgggcatgttagccagccagcagaaccagtcaggcccatcgggtaataaccaaaaccaaggcaacatgcagagggagccaaaccaggccttcggttctggaaataactcttatagtggctctaattctggtgcagcaattggttggggatcagcatccaatgcagggtcgggcagtggttttaatggaggctttggctcaagcatggattctaagtcttctggctggggaatgtagacagtggggttgtggttggttggtatagaatggtgggaattcaaatttttctaaactcatggtaagtatattgtaaaatacatatgtactaagaattttcaaaattggtttgttcagtgtggagtatattcagcagtatttttgacatttttctttagaaaaaggaagagctaaaggaattttataagttttgttacatgaaaggttgaaatattgagtggttgaaagtgaactgctgtttgcctgattggtaaaccaacacactacaattgatatcaaaaggtttctcctgtaatattttatccctggacttgtcaagtgaattctttgcatgttcaaaacggaaaccattgattagaactacattctttaccccttgttttaatttgaaccccaccatatggatttttttccttaagaaaatctccttttaggagatcatggtgtcacagtgtttggttcttttgttttgttttttaacacttgtctcccctcatacacaaaagtacaatatgaagccttcatttaatctctgcagttcatctcatttcaaatgtttatggaagaagcacttcattgaaagtagtgctgtaaatattctgccataggaatactgtctacatgctttctcattcaagaattcgtcatcacgcatcacaggccgcgtctttgacggtgggtgtcccatttttatccgctactctttatttcatggagtcgtatcaacgctatgaacgcaaggctgtgatatggaaccagaaggctgtctgaacttttgaaaccttgtgtgggattgatggtggtgccgaggcatgaaaggctagtatgagcgagaaaaggagagagcgcgtgcagagacttggtggtgcataatggatattttttaacttggcgagatgtgtctctcaatcctgtggctttggtgagagagtgtgcagagagcaatgatagcaaataatgtacgaatgttttttgcattcaaaggacatccacatctgttggaagacttttaagtgagtttttgttcttagataacccacattagatgaatgtgttaagtgaaatgatacttgtactccccctacccctttgtcaactgctgtgaatgctgtatggtgtgtgttctcttctgttactgatatgtaagtgtggcaatgtgaactgaagctgatgggctgagaacatggactgagcttgtggtgtgctttgcaggaggacttgaagcagagttcaccagtgagctcaggtgtctcaaagaagggtggaagttctaatgtctgttagctacccataagaatgctgtttgctgcagttctgtgtcctgtgcttggatgctttttataagagttgtcattgttggaaattcttaaataagactgatttaaataat

SEQ ID NO: 440458 - DNA, 2733 bp, Homo sapiens
acgccggtgggcggggggaggaggcggccctagcgccattttgtgggagcgaagcggtggctgggctgcgcttgggtccgtcgctgcttcggtgtccctgtcgggcttcccagcagcggcctagcgggaaaagtaaaagatgtctgaatatattcgggtaaccgaagatgagaacgatgagcccattgaaataccatcggaagacgatgggacggtgctgctctccacggttacagcccagtttccaggggcgtgtgggcttcgctacaggaatccagtgtctcagtgtatgagaggtgtccggctggtagaaggaattctgcatgccccagatgctggctggggaaatctggtgtatgttgtcaactatccaaaagataacaaaagaaaaatggatgagacagatgcttcatcagcagtgaaagtgaaaagagcagtccagaaaacatccgatttaatagtgttgggtctcccatggaaaacaaccgaacaggacctgaaagagtattttagtacctttggagaagttcttatggtgcaggtcaagaaagatcttaagactggtcattcaaaggggtttggctttgttcgttttacggaatatgaaacacaagtgaaagtaatgtcacagcgacatatgatagatggacgatggtgtgactgcaaacttcctaattctaagcaaagccaagatgagcctttgagaagcagaaaagtgtttgtggggcgctgtacagaggacatgactgaggatgagctgcgggagttcttctctcagtacggggatgtgatggatgtcttcatccccaagccattcagggcctttgcctttgttacatttgcagatgatcagattgcgcagtctctttgtggagaggacttgatcattaaaggaatcagcgttcatatatccaatgccgaacctaagcacaatagcaatagacagttagaaagaagtggaagatttggtggtaatccaggtggctttgggaatcagggtggatttggtaatagcagagggggtggagctggtttgggaaacaatcaaggtagtaatatgggtggtgggatgaactttggtgcgttcagcattaatccagccatgatggctgccgcccaggcagcactacagagcagttggggtatgatgggcatgttagccagccagcagaaccagtcaggcccatcgggtaataaccaaaaccaaggcaacatgcagagggagccaaaccaggccttcggttctggaaataactcttatagtggctctaattctggtgcagcaattggttggggatcagcatccaatgcagggtcgggcagtggttttaatggaggctttggctcaagcatggattctaagtcttctggctggggaatgtagacagtggggttgtggttggttggtatagaatggtgggaattcaaatttttctaaactcatggtaagtatattgtaaaatacatatgtactaagaattttcaaaattggtttgttcagtgtggagtatattcagcagtatttttgacatttttctttagaaaaaggaagagctaaaggaattttataagttttgttacatgaaaggttgaaatattgagtggttgaaagtgaactgctgtttgcctgattggtaaaccaacacactacaattgatatcaaaaggtttctcctgtaatattttatccctggacttgtcaagtgaattctttgcatgttcaaaacggaaaccattgattagaactacattctttaccccttgttttaatttgaaccccaccatatggatttttttccttaagaaaatctccttttaggagatcatggtgtcacagtgtttggttcttttgttttgttttttaacacttgtctcccctcatacactctcatttcaaatgtttatggaagaagcacttcattgaaagtagtgctgtaaatattctgccataggaatactgtctacatgctttctcattcaagaattcgtcatcacgcatcacaggccgcgtctttgacggtgggtgtcccatttttatccgctactctttatttcatggagtcgtatcaacgctatgaacgcaaggctgtgatatggaaccagaaggctgtctgaacttttgaaaccttgtgtgggattgatggtggtgccgaggcatgaaaggctagtatgagcgagaaaaggagagagcgcgtgcagagacttggtggtgcataatggatattttttaacttggcgagatgtgtctctcaatcctgtggctttggtgagagagtgtgcagagagcaatgatagcaaataatgtacgaatgttttttgcattcaaaggacatccacatctgttggaagacttttaagtgagtttttgttcttagataacccacattagatgaatgtgttaagtgaaatgatacttgtactccccctacccctttgtcaactgctgtgaatgctgtatggtgtgtgttctcttctgttactgatatgtaagtgtggcaatgtgaactgaagctgatgggctgagaacatggactgagcttgtggtgtgctttgcaggaggacttgaagcagagttcaccagtgagctcaggtgtctcaaagaagggtggaagttctaatgtctgttagctacccataagaatgctgtttgctgcagttctgtgtcctgtgcttggatgctttttataagagttgtcattgttggaaattcttaaataagactgatttaaataat

SEQ ID NO: 440459 - DNA, 2719 bp, Homo sapiens
agcggagctccgaccgagacctgggccggcggttggtcggccgaaaccatctgctacgttacgtggggggaggaaaagtaaaagatgtctgaatatattcgggtaaccgaagatgagaacgatgagcccattgaaataccatcggaagacgatgggacggtgctgctctccacggttacagcccagtttccaggggcgtgtgggcttcgctacaggaatccagtgtctcagtgtatgagaggtgtccggctggtagaaggaattctgcatgccccagatgctggctggggaaatctggtgtatgttgtcaactatccaaaagataacaaaagaaaaatggatgagacagatgcttcatcagcagtgaaagtgaaaagagcagtccagaaaacatccgatttaatagtgttgggtctcccatggaaaacaaccgaacaggacctgaaagagtattttagtacctttggagaagttcttatggtgcaggtcaagaaagatcttaagactggtcattcaaaggggtttggctttgttcgttttacggaatatgaaacacaagtgaaagtaatgtcacagcgacatatgatagatggacgatggtgtgactgcaaacttcctaattctaagcaaagccaagatgagcctttgagaagcagaaaagtgtttgtggggcgctgtacagaggacatgactgaggatgagctgcgggagttcttctctcagtacggggatgtgatggatgtcttcatccccaagccattcagggcctttgcctttgttacatttgcagatgatcagattgcgcagtctctttgtggagaggacttgatcattaaaggaatcagcgttcatatatccaatgccgaacctaagcacaatagcaatagacagttagaaagaagtggaagatttggtggtaatccaggtggctttgggaatcagggtggatttggtaatagcagagggggtggagctggtttgggaaacaatcaaggtagtaatatgggtggtgggatgaactttggtgcgttcagcattaatccagccatgatggctgccgcccaggcagcactacagagcagttggggtatgatgggcatgttagccagccagcagaaccagtcaggcccatcgggtaataaccaaaaccaaggcaacatgcagagggagccaaaccaggccttcggttctggaaataactcttatagtggctctaattctggtgcagcaattggttggggatcagcatccaatgcagggtcgggcagtggttttaatggaggctttggctcaagcatggattctaagtcttctggctggggaatgtagacagtggggttgtggttggttggtatagaatggtgggaattcaaatttttctaaactcatggtaagtatattgtaaaatacatatgtactaagaattttcaaaattggtttgttcagtgtggagtatattcagcagtatttttgacatttttctttagaaaaaggaagagctaaaggaattttataagttttgttacatgaaaggttgaaatattgagtggttgaaagtgaactgctgtttgcctgattggtaaaccaacacactacaattgatatcaaaaggtttctcctgtaatattttatccctggacttgtcaagtgaattctttgcatgttcaaaacggaaaccattgattagaactacattctttaccccttgttttaatttgaaccccaccatatggatttttttccttaagaaaatctccttttaggagatcatggtgtcacagtgtttggttcttttgttttgttttttaacacttgtctcccctcatacacaaaagtacaatatgaagccttcatttaatctctgcagttcatctcatttcaaatgtttatggaagaagcacttcattgaaagtagtgctgtaaatattctgccataggaatactgtctacatgctttctcattcaagaattcgtcatcacgcatcacaggccgcgtctttgacggtgggtgtcccatttttatccgctactctttatttcatggagtcgtatcaacgctatgaacgcaaggctgtgatatggaaccagaaggctgtctgaacttttgaaaccttgtgtgggattgatggtggtgccgaggcatgaaaggctagtatgagcgagaaaaggagagagcgcgtgcagagacttggtggtgcataatggatattttttaacttggcgagatgtgtctctcaatcctgtggctttggtgagagagtgtgcagagagcaatgatagcaaataatgtacgaatgttttttgcattcaaaggacatccacatctgttggaagacttttaagtgagtttttgttcttagataacccacattagatgaatgtgttaagtgaaatgatacttgtactccccctacccctttgtcaactgctgtgaatgctgtatggtgtgtgttctcttctgttactgatatgtaagtgtggcaatgtgaactgaagctgatgggctgagaacatggactgagcttgtggtgtgctttgcaggaggacttgaagcagagttcaccagtgagctcaggtgtctcaaagaagggtggaagttctaatgtctgttagctacccataagaatgctgtttgctgcagttctgtgtcctgtgcttggatgctttttataagagttgtcattgttggaaattcttaaataagactgatttaaataat

SEQ ID NO: 440460 - DNA, 2717 bp, Homo sapiens
cgggatcgaagcggtgagctttggtgcttgcgcctttggggttccggtccgcttgctttccggtgtcccttcgctccacacgcacggaaataagatttgattttcggtacgagtgaacgatgagcccattgaaataccatcggaagacgatgggacggtgctgctctccacggttacagcccagtttccaggggcgtgtgggcttcgctacaggaatccagtgtctcagtgtatgagaggtgtccggctggtagaaggaattctgcatgccccagatgctggctggggaaatctggtgtatgttgtcaactatccaaaagataacaaaagaaaaatggatgagacagatgcttcatcagcagtgaaagtgaaaagagcagtccagaaaacatccgatttaatagtgttgggtctcccatggaaaacaaccgaacaggacctgaaagagtattttagtacctttggagaagttcttatggtgcaggtcaagaaagatcttaagactggtcattcaaaggggtttggctttgttcgttttacggaatatgaaacacaagtgaaagtaatgtcacagcgacatatgatagatggacgatggtgtgactgcaaacttcctaattctaagcaaagccaagatgagcctttgagaagcagaaaagtgtttgtggggcgctgtacagaggacatgactgaggatgagctgcgggagttcttctctcagtacggggatgtgatggatgtcttcatccccaagccattcagggcctttgcctttgttacatttgcagatgatcagattgcgcagtctctttgtggagaggacttgatcattaaaggaatcagcgttcatatatccaatgccgaacctaagcacaatagcaatagacagttagaaagaagtggaagatttggtggtaatccaggtggctttgggaatcagggtggatttggtaatagcagagggggtggagctggtttgggaaacaatcaaggtagtaatatgggtggtgggatgaactttggtgcgttcagcattaatccagccatgatggctgccgcccaggcagcactacagagcagttggggtatgatgggcatgttagccagccagcagaaccagtcaggcccatcgggtaataaccaaaaccaaggcaacatgcagagggagccaaaccaggccttcggttctggaaataactcttatagtggctctaattctggtgcagcaattggttggggatcagcatccaatgcagggtcgggcagtggttttaatggaggctttggctcaagcatggattctaagtcttctggctggggaatgtagacagtggggttgtggttggttggtatagaatggtgggaattcaaatttttctaaactcatggtaagtatattgtaaaatacatatgtactaagaattttcaaaattggtttgttcagtgtggagtatattcagcagtatttttgacatttttctttagaaaaaggaagagctaaaggaattttataagttttgttacatgaaaggttgaaatattgagtggttgaaagtgaactgctgtttgcctgattggtaaaccaacacactacaattgatatcaaaaggtttctcctgtaatattttatccctggacttgtcaagtgaattctttgcatgttcaaaacggaaaccattgattagaactacattctttaccccttgttttaatttgaaccccaccatatggatttttttccttaagaaaatctccttttaggagatcatggtgtcacagtgtttggttcttttgttttgttttttaacacttgtctcccctcatacacaaaagtacaatatgaagccttcatttaatctctgcagttcatctcatttcaaatgtttatggaagaagcacttcattgaaagtagtgctgtaaatattctgccataggaatactgtctacatgctttctcattcaagaattcgtcatcacgcatcacaggccgcgtctttgacggtgggtgtcccatttttatccgctactctttatttcatggagtcgtatcaacgctatgaacgcaaggctgtgatatggaaccagaaggctgtctgaacttttgaaaccttgtgtgggattgatggtggtgccgaggcatgaaaggctagtatgagcgagaaaaggagagagcgcgtgcagagacttggtggtgcataatggatattttttaacttggcgagatgtgtctctcaatcctgtggctttggtgagagagtgtgcagagagcaatgatagcaaataatgtacgaatgttttttgcattcaaaggacatccacatctgttggaagacttttaagtgagtttttgttcttagataacccacattagatgaatgtgttaagtgaaatgatacttgtactccccctacccctttgtcaactgctgtgaatgctgtatggtgtgtgttctcttctgttactgatatgtaagtgtggcaatgtgaactgaagctgatgggctgagaacatggactgagcttgtggtgtgctttgcaggaggacttgaagcagagttcaccagtgagctcaggtgtctcaaagaagggtggaagttctaatgtctgttagctacccataagaatgctgtttgctgcagttctgtgtcctgtgcttggatgctttttataagagttgtcattgttggaaattcttaaataagactgatttaaataat

SEQ ID NO: 440461 - DNA, 2709 bp, Homo sapiens
acgccggtgggcggggggaggaggcggccctagcgccattttgtgggagcgaagcggtggctgggctgcgcttgggtccgtcgctgcttcggtgtccctgtcgggcttcccagcagcggcctagcgggaaaagtaaaagatgtctgaatatattcgggtaaccgaagatgagaacgatgagcccattgaaataccatcggaagacgatgggacggtgctgctctccacggttacagcccagtttccaggggcgtgtgggcttcgctacaggaatccagtgtctcagtgtatgagaggtgtccggctggtagaaggaattctgcatgccccagatgctggctggggaaatctggtgtatgttgtcaactatccaaaagataacaaaagaaaaatggatgagacagatgcttcatcagcagtgaaagtgaaaagagcagtccagaaaacatccgatttaatagtgttgggtctcccatgtcaagaaagatcttaagactggtcattcaaaggggtttggctttgttcgttttacggaatatgaaacacaagtgaaagtaatgtcacagcgacatatgatagatggacgatggtgtgactgcaaacttcctaattctaagcaaagccaagatgagcctttgagaagcagaaaagtgtttgtggggcgctgtacagaggacatgactgaggatgagctgcgggagttcttctctcagtacggggatgtgatggatgtcttcatccccaagccattcagggcctttgcctttgttacatttgcagatgatcagattgcgcagtctctttgtggagaggacttgatcattaaaggaatcagcgttcatatatccaatgccgaacctaagcacaatagcaatagacagttagaaagaagtggaagatttggtggtaatccaggtggctttgggaatcagggtggatttggtaatagcagagggggtggagctggtttgggaaacaatcaaggtagtaatatgggtggtgggatgaactttggtgcgttcagcattaatccagccatgatggctgccgcccaggcagcactacagagcagttggggtatgatgggcatgttagccagccagcagaaccagtcaggcccatcgggtaataaccaaaaccaaggcaacatgcagagggagccaaaccaggccttcggttctggaaataactcttatagtggctctaattctggtgcagcaattggttggggatcagcatccaatgcagggtcgggcagtggttttaatggaggctttggctcaagcatggattctaagtcttctggctggggaatgtagacagtggggttgtggttggttggtatagaatggtgggaattcaaatttttctaaactcatggtaagtatattgtaaaatacatatgtactaagaattttcaaaattggtttgttcagtgtggagtatattcagcagtatttttgacatttttctttagaaaaaggaagagctaaaggaattttataagttttgttacatgaaaggttgaaatattgagtggttgaaagtgaactgctgtttgcctgattggtaaaccaacacactacaattgatatcaaaaggtttctcctgtaatattttatccctggacttgtcaagtgaattctttgcatgttcaaaacggaaaccattgattagaactacattctttaccccttgttttaatttgaaccccaccatatggatttttttccttaagaaaatctccttttaggagatcatggtgtcacagtgtttggttcttttgttttgttttttaacacttgtctcccctcatacacaaaagtacaatatgaagccttcatttaatctctgcagttcatctcatttcaaatgtttatggaagaagcacttcattgaaagtagtgctgtaaatattctgccataggaatactgtctacatgctttctcattcaagaattcgtcatcacgcatcacaggccgcgtctttgacggtgggtgtcccatttttatccgctactctttatttcatggagtcgtatcaacgctatgaacgcaaggctgtgatatggaaccagaaggctgtctgaacttttgaaaccttgtgtgggattgatggtggtgccgaggcatgaaaggctagtatgagcgagaaaaggagagagcgcgtgcagagacttggtggtgcataatggatattttttaacttggcgagatgtgtctctcaatcctgtggctttggtgagagagtgtgcagagagcaatgatagcaaataatgtacgaatgttttttgcattcaaaggacatccacatctgttggaagacttttaagtgagtttttgttcttagataacccacattagatgaatgtgttaagtgaaatgatacttgtactccccctacccctttgtcaactgctgtgaatgctgtatggtgtgtgttctcttctgttactgatatgtaagtgtggcaatgtgaactgaagctgatgggctgagaacatggactgagcttgtggtgtgctttgcaggaggacttgaagcagagttcaccagtgagctcaggtgtctcaaagaagggtggaagttctaatgtctgttagctacccataagaatgctgtttgctgcagttctgtgtcctgtgcttggatgctttttataagagttgtcattgttggaaattcttaaataagactgatttaaataat

SEQ ID NO: 440462 - DNA, 2682 bp, Homo sapiens
acgccggtgggcggggggaggaggcggccctagcgccattttgtgggagcgaagcggtggctgggctgcgcttgggtccgtcgctgcttcggtgtccctgtcgggcttcccagcagcggcctagcgggaaaagtaaaagatgtctgaatatattcgggtaaccgaagatgagaacgatgagcccattgaaataccatcggaagacgatgggacggtgctgctctccacggttacagcccaatgctggctggggaaatctggtgtatgttgtcaactatccaaaagataacaaaagaaaaatggatgagacagatgcttcatcagcagtgaaagtgaaaagagcagtccagaaaacatccgatttaatagtgttgggtctcccatggaaaacaaccgaacaggacctgaaagagtattttagtacctttggagaagttcttatggtgcaggtcaagaaagatcttaagactggtcattcaaaggggtttggctttgttcgttttacggaatatgaaacacaagtgaaagtaatgtcacagcgacatatgatagatggacgatggtgtgactgcaaacttcctaattctaagcaaagccaagatgagcctttgagaagcagaaaagtgtttgtggggcgctgtacagaggacatgactgaggatgagctgcgggagttcttctctcagtacggggatgtgatggatgtcttcatccccaagccattcagggcctttgcctttgttacatttgcagatgatcagattgcgcagtctctttgtggagaggacttgatcattaaaggaatcagcgttcatatatccaatgccgaacctaagcacaatagcaatagacagttagaaagaagtggaagatttggtggtaatccaggtggctttgggaatcagggtggatttggtaatagcagagggggtggagctggtttgggaaacaatcaaggtagtaatatgggtggtgggatgaactttggtgcgttcagcattaatccagccatgatggctgccgcccaggcagcactacagagcagttggggtatgatgggcatgttagccagccagcagaaccagtcaggcccatcgggtaataaccaaaaccaaggcaacatgcagagggagccaaaccaggccttcggttctggaaataactcttatagtggctctaattctggtgcagcaattggttggggatcagcatccaatgcagggtcgggcagtggttttaatggaggctttggctcaagcatggattctaagtcttctggctggggaatgtagacagtggggttgtggttggttggtatagaatggtgggaattcaaatttttctaaactcatggtaagtatattgtaaaatacatatgtactaagaattttcaaaattggtttgttcagtgtggagtatattcagcagtatttttgacatttttctttagaaaaaggaagagctaaaggaattttataagttttgttacatgaaaggttgaaatattgagtggttgaaagtgaactgctgtttgcctgattggtaaaccaacacactacaattgatatcaaaaggtttctcctgtaatattttatccctggacttgtcaagtgaattctttgcatgttcaaaacggaaaccattgattagaactacattctttaccccttgttttaatttgaaccccaccatatggatttttttccttaagaaaatctccttttaggagatcatggtgtcacagtgtttggttcttttgttttgttttttaacacttgtctcccctcatacacaaaagtacaatatgaagccttcatttaatctctgcagttcatctcatttcaaatgtttatggaagaagcacttcattgaaagtagtgctgtaaatattctgccataggaatactgtctacatgctttctcattcaagaattcgtcatcacgcatcacaggccgcgtctttgacggtgggtgtcccatttttatccgctactctttatttcatggagtcgtatcaacgctatgaacgcaaggctgtgatatggaaccagaaggctgtctgaacttttgaaaccttgtgtgggattgatggtggtgccgaggcatgaaaggctagtatgagcgagaaaaggagagagcgcgtgcagagacttggtggtgcataatggatattttttaacttggcgagatgtgtctctcaatcctgtggctttggtgagagagtgtgcagagagcaatgatagcaaataatgtacgaatgttttttgcattcaaaggacatccacatctgttggaagacttttaagtgagtttttgttcttagataacccacattagatgaatgtgttaagtgaaatgatacttgtactccccctacccctttgtcaactgctgtgaatgctgtatggtgtgtgttctcttctgttactgatatgtaagtgtggcaatgtgaactgaagctgatgggctgagaacatggactgagcttgtggtgtgctttgcaggaggacttgaagcagagttcaccagtgagctcaggtgtctcaaagaagggtggaagttctaatgtctgttagctacccataagaatgctgtttgctgcagttctgtgtcctgtgcttggatgctttttataagagttgtcattgttggaaattcttaaataagactgatttaaataat

SEQ ID NO: 440463 - DNA, 2338 bp, Homo sapiens
catggatttgctggtgcagtacaactaggcttaatagggaggaaaacaaccgaacaggacctgaaagagtattttagtacctttggagaagttcttatggtgcaggtcaagaaagatcttaagactggtcattcaaaggggtttggctttgttcgttttacggaatatgaaacacaagtgaaagtaatgtcacagcgacatatgatagatggacgatggtgtgactgcaaacttcctaattctaagcaaagccaagatgagcctttgagaagcagaaaagtgtttgtggggcgctgtacagaggacatgactgaggatgagctgcgggagttcttctctcagtacggggatgtgatggatgtcttcatccccaagccattcagggcctttgcctttgttacatttgcagatgatcagattgcgcagtctctttgtggagaggacttgatcattaaaggaatcagcgttcatatatccaatgccgaacctaagcacaatagcaatagacagttagaaagaagtggaagatttggtggtaatccaggtggctttgggaatcagggtggatttggtaatagcagagggggtggagctggtttgggaaacaatcaaggtagtaatatgggtggtgggatgaactttggtgcgttcagcattaatccagccatgatggctgccgcccaggcagcactacagagcagttggggtatgatgggcatgttagccagccagcagaaccagtcaggcccatcgggtaataaccaaaaccaaggcaacatgcagagggagccaaaccaggccttcggttctggaaataactcttatagtggctctaattctggtgcagcaattggttggggatcagcatccaatgcagggtcgggcagtggttttaatggaggctttggctcaagcatggattctaagtcttctggctggggaatgtagacagtggggttgtggttggttggtatagaatggtgggaattcaaatttttctaaactcatggtaagtatattgtaaaatacatatgtactaagaattttcaaaattggtttgttcagtgtggagtatattcagcagtatttttgacatttttctttagaaaaaggaagagctaaaggaattttataagttttgttacatgaaaggttgaaatattgagtggttgaaagtgaactgctgtttgcctgattggtaaaccaacacactacaattgatatcaaaaggtttctcctgtaatattttatccctggacttgtcaagtgaattctttgcatgttcaaaacggaaaccattgattagaactacattctttaccccttgttttaatttgaaccccaccatatggatttttttccttaagaaaatctccttttaggagatcatggtgtcacagtgtttggttcttttgttttgttttttaacacttgtctcccctcatacacaaaagtacaatatgaagccttcatttaatctctgcagttcatctcatttcaaatgtttatggaagaagcacttcattgaaagtagtgctgtaaatattctgccataggaatactgtctacatgctttctcattcaagaattcgtcatcacgcatcacaggccgcgtctttgacggtgggtgtcccatttttatccgctactctttatttcatggagtcgtatcaacgctatgaacgcaaggctgtgatatggaaccagaaggctgtctgaacttttgaaaccttgtgtgggattgatggtggtgccgaggcatgaaaggctagtatgagcgagaaaaggagagagcgcgtgcagagacttggtggtgcataatggatattttttaacttggcgagatgtgtctctcaatcctgtggctttggtgagagagtgtgcagagagcaatgatagcaaataatgtacgaatgttttttgcattcaaaggacatccacatctgttggaagacttttaagtgagtttttgttcttagataacccacattagatgaatgtgttaagtgaaatgatacttgtactccccctacccctttgtcaactgctgtgaatgctgtatggtgtgtgttctcttctgttactgatatgtaagtgtggcaatgtgaactgaagctgatgggctgagaacatggactgagcttgtggtgtgctttgcaggaggacttgaagcagagttcaccagtgagctcaggtgtctcaaagaagggtggaagttctaatgtctgttagctacccataagaatgctgtttgctgcagttctgtgtcctgtgcttggatgctttttataagagttgtcattgttggaaattcttaaataagactgatttaaataat

SEQ ID NO: 440464 - DNA, 2348 bp, Homo sapiens
agggggaggatcctccagcttcagcctcccaagtagctaggacagatgcatgccactacgcccagctaatgtggcttttttgtggttttttttgatagaggtggggtctccctgtgttgtctaggcttccaggctagtcttgaactattggcctcacacagtcctcccaccttggcctcccaaagcgctaggattacaggcatgagccaccatgcccagcctatgtcttttgaaaatcgactgaaatatcactgctgctgttaataaaactaaaagctgtattgggggtttaaatgaaatgatgttcattgcttatttttcctctggctttagataaattaatgcttgtaatctaagttttgttgctactttaaatatatgaatcagtggtttaatcttctttgtttacatcccttatttcttatagattgcgcagtctctttgtggagaggacttgatcattaaaggaatcagcgttcatatatccaatgccgaacctaagcacaatagcaatagacagttagaaagaagtggaagatttggtggtaatccaggtggctttgggaatcagggtggatttggtaatagcagagggggtggagctggtttgggaaacaatcaaggtagtaatatgggtggtgggatgaactttggtgcgttcagcattaatccagccatgatggctgccgcccaggcagcactacagagcagttggggtatgatgggcatgttagccagccagcagaaccagtcaggcccatcgggtaataaccaaaaccaaggcaacatgcagagggagccaaaccaggccttcggttctggaaataactcttatagtggctctaattctggtgcagcaattggttggggatcagcatccaatgcagggtcgggcagtggttttaatggaggctttggctcaagcatggattctaagtcttctggctggggaatgtagacagtggggttgtggttggttggtatagaatggtgggaattcaaatttttctaaactcatggtaagtatattgtaaaatacatatgtactaagaattttcaaaattggtttgttcagtgtggagtatattcagcagtatttttgacatttttctttagaaaaaggaagagctaaaggaattttataagttttgttacatgaaaggttgaaatattgagtggttgaaagtgaactgctgtttgcctgattggtaaaccaacacactacaattgatatcaaaaggtttctcctgtaatattttatccctggacttgtcaagtgaattctttgcatgttcaaaacggaaaccattgattagaactacattctttaccccttgttttaatttgaaccccaccatatggatttttttccttaagaaaatctccttttaggagatcatggtgtcacagtgtttggttcttttgttttgttttttaacacttgtctcccctcatacacaaaagtacaatatgaagccttcatttaatctctgcagttcatctcatttcaaatgtttatggaagaagcacttcattgaaagtagtgctgtaaatattctgccataggaatactgtctacatgctttctcattcaagaattcgtcatcacgcatcacaggccgcgtctttgacggtgggtgtcccatttttatccgctactctttatttcatggagtcgtatcaacgctatgaacgcaaggctgtgatatggaaccagaaggctgtctgaacttttgaaaccttgtgtgggattgatggtggtgccgaggcatgaaaggctagtatgagcgagaaaaggagagagcgcgtgcagagacttggtggtgcataatggatattttttaacttggcgagatgtgtctctcaatcctgtggctttggtgagagagtgtgcagagagcaatgatagcaaataatgtacgaatgttttttgcattcaaaggacatccacatctgttggaagacttttaagtgagtttttgttcttagataacccacattagatgaatgtgttaagtgaaatgatacttgtactccccctacccctttgtcaactgctgtgaatgctgtatggtgtgtgttctcttctgttactgatatgtaagtgtggcaatgtgaactgaagctgatgggctgagaacatggactgagcttgtggtgtgctttgcaggaggacttgaagcagagttcaccagtgagctcaggtgtctcaaagaagggtggaagttctaatgtctgttagctacccataagaatgctgtttgctgcagttctgtgtcctgtgcttggatgctttttataagagttgtcattgttggaaattcttaaataagactgatttaaataat

SEQ ID NO: 440465 - DNA, 1638 bp, Homo sapiens
caccgtaagcacactgcaacatgcttttattaaaacatactggttttcatgtttctgattcggaagcacactgcaacatgcagagggagccaaaccaggccttcggttctggaaataactcttatagtggctctaattctggtgcagcaattggttggggatcagcatccaatgcagggtcgggcagtggttttaatggaggctttggctcaagcatggattctaagtcttctggctggggaatgtagacagtggggttgtggttggttggtatagaatggtgggaattcaaatttttctaaactcatggtaagtatattgtaaaatacatatgtactaagaattttcaaaattggtttgttcagtgtggagtatattcagcagtatttttgacatttttctttagaaaaaggaagagctaaaggaattttataagttttgttacatgaaaggttgaaatattgagtggttgaaagtgaactgctgtttgcctgattggtaaaccaacacactacaattgatatcaaaaggtttctcctgtaatattttatccctggacttgtcaagtgaattctttgcatgttcaaaacggaaaccattgattagaactacattctttaccccttgttttaatttgaaccccaccatatggatttttttccttaagaaaatctccttttaggagatcatggtgtcacagtgtttggttcttttgttttgttttttaacacttgtctcccctcatacacaaaagtacaatatgaagccttcatttaatctctgcagttcatctcatttcaaatgtttatggaagaagcacttcattgaaagtagtgctgtaaatattctgccataggaatactgtctacatgctttctcattcaagaattcgtcatcacgcatcacaggccgcgtctttgacggtgggtgtcccatttttatccgctactctttatttcatggagtcgtatcaacgctatgaacgcaaggctgtgatatggaaccagaaggctgtctgaacttttgaaaccttgtgtgggattgatggtggtgccgaggcatgaaaggctagtatgagcgagaaaaggagagagcgcgtgcagagacttggtggtgcataatggatattttttaacttggcgagatgtgtctctcaatcctgtggctttggtgagagagtgtgcagagagcaatgatagcaaataatgtacgaatgttttttgcattcaaaggacatccacatctgttggaagacttttaagtgagtttttgttcttagataacccacattagatgaatgtgttaagtgaaatgatacttgtactccccctacccctttgtcaactgctgtgaatgctgtatggtgtgtgttctcttctgttactgatatgtaagtgtggcaatgtgaactgaagctgatgggctgagaacatggactgagcttgtggtgtgctttgcaggaggacttgaagcagagttcaccagtgagctcaggtgtctcaaagaagggtggaagttctaatgtctgttagctacccataagaatgctgtttgctgcagttctgtgtcctgtgcttggatgctttttataagagttgtcattgttggaaattcttaaataagactgatttaaataat

SEQ ID NO: 440466 - DNA, 1436 bp, Homo sapiens
  misc_feature (15)..(15): n is a, c, g, or t
  misc_feature (22)..(22): n is a, c, g, or t
  misc_feature (53)..(53): n is a, c, g, or t
  misc_feature (92)..(92): n is a, c, g, or t
  misc_feature (99)..(99): n is a, c, g, or t
  misc_feature (106)..(106): n is a, c, g, or t
  misc_feature (265)..(265): n is a, c, g, or t
ccaattttaagtttnccccgtngtttttttcctccttttgggggttaaattcnggattaaaatatagtggatgtttttattggggggggtgnaggaganagtaatngttatttgcagtgaagtagatgtctaaacattaatgtcaaataatttcaaatttaatgtcctgcttcaacatggaagggcagagctacaaaaacatgtatatttcaaaagacaaaaaggaagcagcagcagtatctgttctctaattcatagacaagtngagtgtgtttgtggtgctgtttgcctgattggtaaaccaacacactacaattgatatcaaaaggtttctcctgtaatattttatccctggacttgtcaagtgaattctttgcatgttcaaaacggaaaccattgattagaactacattctttaccccttgttttaatttgaaccccaccatatggatttttttccttaagaaaatctccttttaggagatcatggtgtcacagtgtttggttcttttgttttgttttttaacacttgtctcccctcatacacaaaagtacaatatgaagccttcatttaatctctgcagttcatctcatttcaaatgtttatggaagaagcacttcattgaaagtagtgctgtaaatattctgccataggaatactgtctacatgctttctcattcaagaattcgtcatcacgcatcacaggccgcgtctttgacggtgggtgtcccatttttatccgctactctttatttcatggagtcgtatcaacgctatgaacgcaaggctgtgatatggaaccagaaggctgtctgaacttttgaaaccttgtgtgggattgatggtggtgccgaggcatgaaaggctagtatgagcgagaaaaggagagagcgcgtgcagagacttggtggtgcataatggatattttttaacttggcgagatgtgtctctcaatcctgtggctttggtgagagagtgtgcagagagcaatgatagcaaataatgtacgaatgttttttgcattcaaaggacatccacatctgttggaagacttttaagtgagtttttgttcttagataacccacattagatgaatgtgttaagtgaaatgatacttgtactccccctacccctttgtcaactgctgtgaatgctgtatggtgtgtgttctcttctgttactgatatgtaagtgtggcaatgtgaactgaagctgatgggctgagaacatggactgagcttgtggtgtgctttgcaggaggacttgaagcagagttcaccagtgagctcaggtgtctcaaagaagggtggaagttctaatgtctgttagctacccataagaatgctgtttgctgcagttctgtgtcctgtgcttggatgctttttataagagttgtcattgttggaaattcttaaataagactgatttaaataat

SEQ ID NO: 440467 - DNA, 492 bp, Homo sapiens
agatgctgggattacaggtgcctgccaccacacccggctgatttttgtattagtagaggtggggtttcaccatgttgaccaggctggtttgaactcctgacctcaagtgatccacccgcctcggcctctcaaagtgctgggattacaggtgtcagccaccacacctggccacgatgatgaaattgtgtaatggctcatgatgtatttatatccatcattatgtgatgcatgactgtgtacttttgtaacttaaaacgttactcttcactgaagccttacaagaaaaagaaatgctgatggaaaaaattaagggtacgtctactttttaatggttcactgctatccaaggcgaatgattttgttatatcccttaccttaatgtttttttcattgttcataacatatttctgagtttttttcttccttttgatttgatcagcaaagccaagatgagcctttgagaagcagaaaagtgtttgtggggcgctgtac

SEQ ID NO: 440468 - DNA, 556 bp, Homo sapiens
atgtctgaatatattcgggtaaccgaagatgagaacgatgagcccattgaaataccatcggaagacgatgggacggtgctgctctccacggttacagcccagtttccaggggcgtgtgggcttcgctacaggaatccagtgtctcagtgtatgagaggtgtccggctggtagaaggaattctgcatgccccagatgctggctggggaaatctggtgtatgttgtcaactatccaaaaggtttgttaccatttggtttttgtaatcatgctgaagtgtgttcaggtgtgtgtctcatccatggatcttagcctcttttggtggcagaatgtctcctgaaacttaagtatttccttgaacttcagtgttagacaagtttggaagaccacgagtctaaatttatggaaactggggattgtagatcattttaaaagagaaaacaatgtatttaaaaaatatctgaataaactttgccaagttgatgataaatttcaggaatcactaagaatgttttgtacataaatcattgttgtaaatagattcttctgaagtgcttca

SEQ ID NO: 440469 - DNA, 2263 bp, Homo sapiens
acgccggtgggcggggggaggaggcggccctagcgccattttgtgggagcgaagcggtggctgggctgcgcttgggtccgtcgctgcttcggtgtccctgtcgggcttcccagcagcggcctagcgggaaaagtaaaagatgtctgaatatattcgggtaaccgaagatgagaacgatgagcccattgaaataccatcggaagacgatgggacggtgctgctctccacggttacagcccagtttccaggggcgtgtgggcttcgctacaggaatccagtgtctcagtgtatgagaggtgtccggctggtagaaggaattctgcatgccccagatgctggctggggaaatctggtgtatgttgtcaactatccaaaagataacaaaagaaaaatggatgagacagatgcttcatcagcagtgaaagtgaaaagagcagtccagaaaacatccgatttaatagtgttgggtctcccatggaaaacaaccgaacaggacctgaaagagtattttagtacctttggagaagttcttatggtgcaggtcaagaaagatcttaagactggtcattcaaaggggtttggctttgttcgttttacggaatatgaaacacaagtgaaagtaatgtcacagcgacatatgatagatggacgatggtgtgactgcaaacttcctaattctaagcaaagccaagatgagcctttgagaagcagaaaagtgtttgtggggcgctgtacagaggacatgactgaggatgagctgcgggagttcttctctcagtacggggatgtgatggatgtcttcatccccaagccattcagggcctttgcctttgttacatttgcagatgatcagattgcgcagtctctttgtggagaggacttgatcattaaaggaatcagcgttcatatatccaatgccgaacctaagcacaatagcaatagacagttagaaagaagtggaagatttggtggtaatccaggtggctttgggaatcagggtggatttggtaatagcagagggggtggagctggtttgggaaacaatcaaggtagtaatatgggtggtgggatgaactttggtgcgttcagcattaatccagccatgatggctgccgcccaggcagcactacagagcagttggggtatgatgggcatgttagccagccagcagaaccagtcaggcccatcgggtaataaccaaaaccaaggcaacatgcagagggagccaaaccaggccttcggttctggaaataactcttatagtggctctaattctggtgcagcaattggttggggatcagcatccaatgcagggtcgggcagtggttttaatggaggctttggctcaagcatggattctaagtcttctggctggggaatgtagacagtggggttgtggttggttggtatagaatggtgggaattcaaatttttctaaactcatggtaagtatattgtaaaatacatatgtactaagaattttcaaaattggtttgttcagtgtggagtatattcagcagtatttttgacatttttctttagaaaaaggaagagctaaaggaattttataagttttgttacatgaaaggttgaaatattgagtggttgaaagtgaactgctgtttgcctgattggtaaaccaacacactacaattgatatcaaaaggtttctcctgtaatattttatccctggacttgtcaagtgaattctttgcatgttcaaaacggaaaccattgattagaactacattctttaccccttgttttaatttgaaccccaccatatggatttttttccttaagaaaatctccttttaggagatcatggtgtcacagtgtttggttcttttgttttgttttttaacacttgtctcccctcatacacaaaagtacaatatgaagccttcatttaatctctgcagttcatctcatttcaaatgtttatggaagaagcacttcattgaaagtagtgctgtaaatattctgccataggaatactgtctacatgctttctcattcaagaattcgtcatcacgcatcacaggccgcgtctttgacgccctgaatgcaaagaattcatagcagttaattccccttttttgacccttttgagatggaactttcataaagtttcttggcagtagtttattttgcttcaaataaacttatttgaaaagttgtctcaagtcaaatggattcatcacctgtcatgcattgacacctgatacccagacttaattggtatttgttcttgcattggcca

SEQ ID NO: 440470 - DNA, 2720 bp, Homo sapiens
acgccggtgggcggggggaggaggcggccctagcgccattttgtgggagcgaagcggtggctgggctgcgcttgggtccgtcgctgcttcggtgtccctgtcgggcttcccagcagcggcctagcgggaaaagtaaaagatgtctgaatatattcgggtaaccgaagatgagaacgatgagcccattgaaataccatcggaagacgatgggacggtgctgctctccacggttacagcccagtttccaggggcgtgtgggcttcgctacaggaatccagtgtctcagtgtatgagaggtgtccggctggtagaaggaattctgcatgccccagatgctggctggggaaatctggtgtatgttgtcaactatccaaaagataacaaaagaaaaatggatgagacagatgcttcatcagcagtgaaagtgaaaagagcagtccagaaaacatccgatttaatagtgttgggtctcccatggaaaacaaccgaacaggacctgaaagagtattttagtacctttggagaagttcttatggtgcaggtcaagaaagatcttaagactggtcattcaaaggggtttggctttgttcgttttacggaatatgaaacacaagtgaaagtaatgtcacagcgacatatgatagatggacgatggtgtgactgcaaacttcctaattctaagcaaagccaagatgagcctttgagaagcagattcttctctcagtacggggatgtgatggatgtcttcatccccaagccattcagggcctttgcctttgttacatttgcagatgatcagattgcgcagtctctttgtggagaggacttgatcattaaaggaatcagcgttcatatatccaatgccgaacctaagcacaatagcaatagacagttagaaagaagtggaagatttggtggtaatccaggtggctttgggaatcagggtggatttggtaatagcagagggggtggagctggtttgggaaacaatcaaggtagtaatatgggtggtgggatgaactttggtgcgttcagcattaatccagccatgatggctgccgcccaggcagcactacagagcagttggggtatgatgggcatgttagccagccagcagaaccagtcaggcccatcgggtaataaccaaaaccaaggcaacatgcagagggagccaaaccaggccttcggttctggaaataactcttatagtggctctaattctggtgcagcaattggttggggatcagcatccaatgcagggtcgggcagtggttttaatggaggctttggctcaagcatggattctaagtcttctggctggggaatgtagacagtggggttgtggttggttggtatagaatggtgggaattcaaatttttctaaactcatggtaagtatattgtaaaatacatatgtactaagaattttcaaaattggtttgttcagtgtggagtatattcagcagtatttttgacatttttctttagaaaaaggaagagctaaaggaattttataagttttgttacatgaaaggttgaaatattgagtggttgaaagtgaactgctgtttgcctgattggtaaaccaacacactacaattgatatcaaaaggtttctcctgtaatattttatccctggacttgtcaagtgaattctttgcatgttcaaaacggaaaccattgattagaactacattctttaccccttgttttaatttgaaccccaccatatggatttttttccttaagaaaatctccttttaggagatcatggtgtcacagtgtttggttcttttgttttgttttttaacacttgtctcccctcatacacaaaagtacaatatgaagccttcatttaatctctgcagttcatctcatttcaaatgtttatggaagaagcacttcattgaaagtagtgctgtaaatattctgccataggaatactgtctacatgctttctcattcaagaattcgtcatcacgcatcacaggccgcgtctttgacggtgggtgtcccatttttatccgctactctttatttcatggagtcgtatcaacgctatgaacgcaaggctgtgatatggaaccagaaggctgtctgaacttttgaaaccttgtgtgggattgatggtggtgccgaggcatgaaaggctagtatgagcgagaaaaggagagagcgcgtgcagagacttggtggtgcataatggatattttttaacttggcgagatgtgtctctcaatcctgtggctttggtgagagagtgtgcagagagcaatgatagcaaataatgtacgaatgttttttgcattcaaaggacatccacatctgttggaagacttttaagtgagtttttgttcttagataacccacattagatgaatgtgttaagtgaaatgatacttgtactccccctacccctttgtcaactgctgtgaatgctgtatggtgtgtgttctcttctgttactgatatgtaagtgtggcaatgtgaactgaagctgatgggctgagaacatggactgagcttgtggtgtgctttgcaggaggacttgaagcagagttcaccagtgagctcaggtgtctcaaagaagggtggaagttctaatgtctgttagctacccataagaatgctgtttgctgcagttctgtgtcctgtgcttggatgctttttataagagttgtcattgttggaaattcttaaataagactgatttaaataat

SEQ ID NO: 440471 - DNA, 2906 bp, Homo sapiens
acgccggtgggcggggggaggaggcggccctagcgccattttgtgggagcgaagcggtggctgggctgcgcttgggtccgtcgctgcttcggtgtccctgtcgggcttcccagcagcggcctagcgggaaaagtaaaagatgtctgaatatattcgggtaaccgaagatgagaacgatgagcccattgaaataccatcggaagacgatgggacggtgctgctctccacggttacagcccagtttccaggggcgtgtgggcttcgctacaggaatccagtgtctcagtgtatgagaggtgtccggctggtagaaggaattctgcatgccccagatgctggctggggaaatctggtgtatgttgtcaactatccaaaagtatagacggcgtttcaccatcttggccaggctggtcttgaactcctgaccttgtgatccacctgcctcagactcccaaagtgctgggattacaagtgtgagccaccgcgcccagccagttatgtttttttaaataacaaaagaaaaatggatgagacagatgcttcatcagcagtgaaagtgaaaagagcagtccagaaaacatccgatttaatagtgttgggtctcccatggaaaacaaccgaacaggacctgaaagagtattttagtacctttggagaagttcttatggtgcaggtcaagaaagatcttaagactggtcattcaaaggggtttggctttgttcgttttacggaatatgaaacacaagtgaaagtaatgtcacagcgacatatgatagatggacgatggtgtgactgcaaacttcctaattctaagcaaagccaagatgagcctttgagaagcagaaaagtgtttgtggggcgctgtacagaggacatgactgaggatgagctgcgggagttcttctctcagtacggggatgtgatggatgtcttcatccccaagccattcagggcctttgcctttgttacatttgcagatgatcagattgcgcagtctctttgtggagaggacttgatcattaaaggaatcagcgttcatatatccaatgccgaacctaagcacaatagcaatagacagttagaaagaagtggaagatttggtggtaatccaggtggctttgggaatcagggtggatttggtaatagcagagggggtggagctggtttgggaaacaatcaaggtagtaatatgggtggtgggatgaactttggtgcgttcagcattaatccagccatgatggctgccgcccaggcagcactacagagcagttggggtatgatgggcatgttagccagccagcagaaccagtcaggcccatcgggtaataaccaaaaccaaggcaacatgcagagggagccaaaccaggccttcggttctggaaataactcttatagtggctctaattctggtgcagcaattggttggggatcagcatccaatgcagggtcgggcagtggttttaatggaggctttggctcaagcatggattctaagtcttctggctggggaatgtagacagtggggttgtggttggttggtatagaatggtgggaattcaaatttttctaaactcatggtaagtatattgtaaaatacatatgtactaagaattttcaaaattggtttgttcagtgtggagtatattcagcagtatttttgacatttttctttagaaaaaggaagagctaaaggaattttataagttttgttacatgaaaggttgaaatattgagtggttgaaagtgaactgctgtttgcctgattggtaaaccaacacactacaattgatatcaaaaggtttctcctgtaatattttatccctggacttgtcaagtgaattctttgcatgttcaaaacggaaaccattgattagaactacattctttaccccttgttttaatttgaaccccaccatatggatttttttccttaagaaaatctccttttaggagatcatggtgtcacagtgtttggttcttttgttttgttttttaacacttgtctcccctcatacacaaaagtacaatatgaagccttcatttaatctctgcagttcatctcatttcaaatgtttatggaagaagcacttcattgaaagtagtgctgtaaatattctgccataggaatactgtctacatgctttctcattcaagaattcgtcatcacgcatcacaggccgcgtctttgacggtgggtgtcccatttttatccgctactctttatttcatggagtcgtatcaacgctatgaacgcaaggctgtgatatggaaccagaaggctgtctgaacttttgaaaccttgtgtgggattgatggtggtgccgaggcatgaaaggctagtatgagcgagaaaaggagagagcgcgtgcagagacttggtggtgcataatggatattttttaacttggcgagatgtgtctctcaatcctgtggctttggtgagagagtgtgcagagagcaatgatagcaaataatgtacgaatgttttttgcattcaaaggacatccacatctgttggaagacttttaagtgagtttttgttcttagataacccacattagatgaatgtgttaagtgaaatgatacttgtactccccctacccctttgtcaactgctgtgaatgctgtatggtgtgtgttctcttctgttactgatatgtaagtgtggcaatgtgaactgaagctgatgggctgagaacatggactgagcttgtggtgtgctttgcaggaggacttgaagcagagttcaccagtgagctcaggtgtctcaaagaagggtggaagttctaatgtctgttagctacccataagaatgctgtttgctgcagttctgtgtcctgtgcttggatgctttttataagagttgtcattgttggaaattcttaaataagactgatttaaataat

SEQ ID NO: 440472 - DNA, 1319 bp, Homo sapiens
acgccggtgggcggggggaggaggcggccctagcgccattttgtgggagcgaagcggtggctgggctgcgcttgggtccgtcgctgcttcggtgtccctgtcgggcttcccagcagcggcctagcgggaaaagtaaaagatgtctgaatatattcgggtaaccgaagatgagaacgatgagcccattgaaataccatcggaagacgatgggacggtgctgctctccacggttacagcccagtttccaggggcgtgtgggcttcgctacaggaatccagtgtctcagtgtatgagaggtgtccggctggtagaaggaattctgcatgccccagatgctggctggggaaatctggtgtatgttgtcaactatccaaaagataacaaaagaaaaatggatgagacagatgcttcatcagcagtgaaagtgaaaagagcagtccagaaaacatccgatttaatagtgttgggtctcccatggaaaacaaccgaacaggacctgaaagagtattttagtacctttggagaagttcttatggtgcaggtcaagaaagatcttaagactggtcattcaaaggggtttggctttgttcgttttacggaatatgaaacacaagtgaaagtaatgtcacagcgacatatgatagatggacgatggtgtgactgcaaacttcctaattctaagcaaagccaagatgagcctttgagaagcagaaaagtgtttgtggggcgctgtacagaggacatgactgaggatgagctgcgggagttcttctctcagtacggggatgtgatggatgtcttcatccccaagccattcagggcctttgcctttgttacatttgcagatgatcagattgcgcagtctctttgtggagaggacttgatcattaaaggaatcagcgttcatatatccaatgccgaacctaagcacaatagcaatagacagttagaaagaagtggaagatttggtggtaatccaggttctcatttcaaatgtttatggaagaagcacttcattgaaagtagtgctgtaaatattctgccataggaatactgtctacatgctttctcattcaagaattcgtcatcacgcatcacaggccgcgtctttgacgccctgaatgcaaagaattcatagcagttaattccccttttttgacccttttgagatggaactttcataaagtttcttggcagtagtttattttgcttcaaataaacttatttgaaaagttgtctcaagtcaaatggattcatcacctgtcatgcattgacacctgatacccagacttaattggtatttgttcttgcattggcca

SEQ ID NO: 440473 - DNA, 1755 bp, Homo sapiens
acgccggtgggcggggggaggaggcggccctagcgccattttgtgggagcgaagcggtggctgggctgcgcttgggtccgtcgctgcttcggtgtccctgtcgggcttcccagcagcggcctagcgggaaaagtaaaagatgtctgaatatattcgggtaaccgaagatgagaacgatgagcccattgaaataccatcggaagacgatgggacggtgctgctctccacggttacagcccagtttccaggggcgtgtgggcttcgctacaggaatccagtgtctcagtgtatgagaggtgtccggctggtagaaggaattctgcatgccccagatgctggctggggaaatctggtgtatgttgtcaactatccaaaagataacaaaagaaaaatggatgagacagatgcttcatcagcagtgaaagtgaaaagagcagtccagaaaacatccgatttaatagtgttgggtctcccatggaaaacaaccgaacaggacctgaaagagtattttagtacctttggagaagttcttatggtgcaggtcaagaaagatcttaagactggtcattcaaaggggtttggctttgttcgttttacggaatatgaaacacaagtgaaagtaatgtcacagcgacatatgatagatggacgatggtgtgactgcaaacttcctaattctaagcaaagccaagatgagcctttgagaagcagaaaagtgtttgtggggcgctgtacagaggacatgactgaggatgagctgcgggagttcttctctcagtacggggatgtgatggatgtcttcatccccaagccattcagggcctttgcctttgttacatttgcagatgatcagattgcgcagtctctttgtggagaggacttgatcattaaaggaatcagcgttcattctcatttcaaatgtttatggaagaagcacttcattgaaagtagtgctgtaaatattctgccataggaatactgtctacatgctttctcattcaagaattcgtcatcacgcatcacaggccgcgtctttgacggtgggtgtcccatttttatccgctactctttatttcatggagtcgtatcaacgctatgaacgcaaggctgtgatatggaaccagaaggctgtctgaacttttgaaaccttgtgtgggattgatggtggtgccgaggcatgaaaggctagtatgagcgagaaaaggagagagcgcgtgcagagacttggtggtgcataatggatattttttaacttggcgagatgtgtctctcaatcctgtggctttggtgagagagtgtgcagagagcaatgatagcaaataatgtacgaatgttttttgcattcaaaggacatccacatctgttggaagacttttaagtgagtttttgttcttagataacccacattagatgaatgtgttaagtgaaatgatacttgtactccccctacccctttgtcaactgctgtgaatgctgtatggtgtgtgttctcttctgttactgatatgtaagtgtggcaatgtgaactgaagctgatgggctgagaacatggactgagcttgtggtgtgctttgcaggaggacttgaagcagagttcaccagtgagctcaggtgtctcaaagaagggtggaagttctaatgtctgttagctacccataagaatgctgtttgctgcagttctgtgtcctgtgcttggatgctttttataagagttgtcattgttggaaattcttaaataagactgatttaaataat

SEQ ID NO: 440474 - DNA, 730 bp, Homo sapiens
  misc_feature (696)..(696): n is a, c, g, or t
acgccggtgggcggggggaggaggcggccctagcgccattttgtgggagcgaagcggtggctgggctgcgcttgggtccgtcgctgcttcggtgtccctgtcgggcttcccagcagcggcctagcgggaaaagtaaaagatgtctgaatatattcgggtaaccgaagatgagaacgatgagcccattgaaataccatcggaagacgatgggacggtgctgctctccacggttacagcccagtttccaggggcgtgtgggcttcgctacaggaatccagtgtctcagtgtatgagaggtgtccggctggtagaaggaattctgcatgccccagatgctggctggggaaatctggtgtatgttgtcaactatccaaaagataacaaaagaaaaatggatgagacagatgcttcatcagcagtgaaagtgaaaagagcagtccagaaaacatccgatttaatagtgttgggtctcccatggaaaacaaccgaacaggacctgaaagagtattttagtacctttggagaagttcttatggtgcaggtcaagaaagatcttaagactggtcattcaaaggggtttggctttgttcgttttacggaatatgaaacacaagtgaaagtaatgtcacagcgacatatgatagatggacgatggtgtgactgcaaacttcctaattctaagcaaagccaagatgngccttgagatcagcatggccggtacgagctgatt

SEQ ID NO: 440475 - DNA, 1952 bp, Homo sapiens
ctgaagagccggtgcagagcgggcggcggcggcggcggcagcggaggcggcggctccagccggcgcggcgcgaggctcggcggtgggatccggcgggcggtgctagctccgcgctccctgcctcgctcgctgccgggggcggtcggaaggcgcggcgcgaagcccgggtggcccgagggcgcgatggctgctcctgtcccgtgggcctgctgtgctgtgcttgccgccgccgccgcagttgtctacgcccagagacacagtccacaggaggcaccccatgtgcagtacgagcgcctgggctctgacgtgacactgccatgtgggacagcaaactgggatgctgcggtgacgtggcgggtaaatgggacagacctggcccctgacctgctcaacggctctcagctggtgctccatggcctggaactgggccacagtggcctctacgcctgcttccaccgtgactcctggcacctgcgccaccaagtcctgctgcatgtgggcttgccgccgcgggagcctgtgctcagctgccgctccaacacttaccccaagggcttctactgcagctggcatctgcccacccccacctacattcccaacaccttcaatgtgactgtgctgcatggctccaaaattatggtctgtgagaaggacccagccctcaagaaccgctgccacattcgctacatgcacctgttctccaccatcaagtacaaggtctccataagtgtcagcaatgccctgggccacaatgccacagctatcacctttgacgagttcaccattgtgaagcctgatcctccagaaaatgtggtagcccggccagtgcccagcaaccctcgccggctggaggtgacgtggcagaccccctcgacctggcctgaccctgagtcttttcctctcaagttctttctgcgctaccgacccctcatcctggaccagtggcagcatgtggagctgtccgacggcacagcacacaccatcacagatgcctacgccgggaaggagtacattatccaggtggcagccaaggacaatgagattgggacatggagtgactggagcgtagccgcccacagctacgccctggactgaggaaccgcgacacctcaccacggaggcccaggctgcggagaccacgaccagcaccaccagctccctggcacccccacctaccacgaagatctgtgaccctggggagctgggcagcggcgggggaccctcggcacccttcttggtcagcgtccccatcactctggccctggctgccgctgccgccactgccagcagtctcttgatctgagcccggcaccccatgaggacatgcagagcacctgcagaggagcaggaggccggagctgagcctgcagaccccggtttctattttgcacacgggcaggaggaccttttgcattctcttcagacacaatttgtggagaccccggcgggcccgggcctgccgccccccagccctgccgcaccaagctggccctccttcctccctcaggggaggtgggccatgcagctaacccacccaccaaagaccccctcaccctggccccttgggctggaccctccaatgccagcgactcccaggagcccttgggggacgtgaggggagcctctcacatccgatttctcctcctgccccagcctcctgtctatcccagggtctctgttgccaccatcagattataagctcctgatgctgggggggcccagccatccccctccccccagcacccacaattttcagtcccctcccctctgccctgttttgtatacccctcccctgaccctgctcctatcccacagtatttaatgccctgtcagtcccttctagtctgactcaatggtaacttgctgtatttgaattttttatagatgtatatacagggtggggggagtgggcggttctcattaaacgtcaccatttcatgaaaaaaggaaca

SEQ ID NO: 440476 - DNA, 1811 bp, Homo sapiens
gcacggggaccacagccgtcttgagggcgcgcccgagaaaggatggctgctcctgtcccgtgggcctgctgtgctgtgcttgccgccgccgccgcagttgtctacgcccagagacacagtccacaggaggcaccccatgtgcagtacgagcgcctgggctctgacgtgacactgccatgtgggacagcaaactgggatgctgcggtgacgtggcgggtaaatgggacagacctggcccctgacctgctcaacggctctcagctggtgctccatggcctggaactgggccacagtggcctctacgcctgcttccaccgtgactcctggcacctgcgccaccaagtcctgctgcatgtgggcttgccgccgcgggagcctgtgctcagctgccgctccaacacttaccccaagggcttctactgcagctggcatctgcccacccccacctacattcccaacaccttcaatgtgactgtgctgcatggctccaaaattatggtctgtgagaaggacccagccctcaagaaccgctgccacattcgctacatgcacctgttctccaccatcaagtacaaggtctccataagtgtcagcaatgccctgggccacaatgccacagctatcacctttgacgagttcaccattgtgaagcctgatcctccagaaaatgtggtagcccggccagtgcccagcaaccctcgccggctggaggtgacgtggcagaccccctcgacctggcctgaccctgagtcttttcctctcaagttctttctgcgctaccgacccctcatcctggaccagtggcagcatgtggagctgtccgacggcacagcacacaccatcacagatgcctacgccgggaaggagtacattatccaggtggcagccaaggacaatgagattgggacatggagtgactggagcgtagccgcccacagctacgccctggactgaggaaccgcgacacctcaccacggaggcccaggctgcggagaccacgaccagcaccaccagctccctggcacccccacctaccacgaagatctgtgaccctggggagctgggcagcggcgggggaccctcggcacccttcttggtcagcgtccccatcactctggccctggctgccgctgccgccactgccagcagtctcttgatctgagcccggcaccccatgaggacatgcagagcacctgcagaggagcaggaggccggagctgagcctgcagaccccggtttctattttgcacacgggcaggaggaccttttgcattctcttcagacacaatttgtggagaccccggcgggcccgggcctgccgccccccagccctgccgcaccaagctggccctccttcctccctcaggggaggtgggccatgcagctaacccacccaccaaagaccccctcaccctggccccttgggctggaccctccaatgccagcgactcccaggagcccttgggggacgtgaggggagcctctcacatccgatttctcctcctgccccagcctcctgtctatcccagggtctctgttgccaccatcagattataagctcctgatgctgggggggcccagccatccccctccccccagcacccacaattttcagtcccctcccctctgccctgttttgtatacccctcccctgaccctgctcctatcccacagtatttaatgccctgtcagtcccttctagtctgactcaatggtaacttgctgtatttgaattttttatagatgtatatacagggtggggggagtgggcggttctcattaaacgtcaccatttcatgaaaaaaggaaca

SEQ ID NO: 440477 - DNA, 2063 bp, Homo sapiens
ctgaagagccggtgcagagcgggcggcggcggcggcggcagcggaggcggcggctccagccggcgcggcgcgaggctcggcggtgggatccggcgggcggtgctagctccgcgctccctgcctcgctcgctgccgggggcggtcggaaggcgcggcgcgaagcccgggtggcccgagggcgcgactctagccttgtcacctcatcttgcccccttggttttggaagtcctgaagagttggtctggaggaggaggaggacattgatgtgcttggtgtgtggccagtggtgaagagatggctgctcctgtcccgtgggcctgctgtgctgtgcttgccgccgccgccgcagttgtctacgcccagagacacagtccacaggaggcaccccatgtgcagtacgagcgcctgggctctgacgtgacactgccatgtgggacagcaaactgggatgctgcggtgacgtggcgggtaaatgggacagacctggcccctgacctgctcaacggctctcagctggtgctccatggcctggaactgggccacagtggcctctacgcctgcttccaccgtgactcctggcacctgcgccaccaagtcctgctgcatgtgggcttgccgccgcgggagcctgtgctcagctgccgctccaacacttaccccaagggcttctactgcagctggcatctgcccacccccacctacattcccaacaccttcaatgtgactgtgctgcatggctccaaaattatggtctgtgagaaggacccagccctcaagaaccgctgccacattcgctacatgcacctgttctccaccatcaagtacaaggtctccataagtgtcagcaatgccctgggccacaatgccacagctatcacctttgacgagttcaccattgtgaagcctgatcctccagaaaatgtggtagcccggccagtgcccagcaaccctcgccggctggaggtgacgtggcagaccccctcgacctggcctgaccctgagtcttttcctctcaagttctttctgcgctaccgacccctcatcctggaccagtggcagcatgtggagctgtccgacggcacagcacacaccatcacagatgcctacgccgggaaggagtacattatccaggtggcagccaaggacaatgagattgggacatggagtgactggagcgtagccgcccacagctacgccctggactgaggaaccgcgacacctcaccacggaggcccaggctgcggagaccacgaccagcaccaccagctccctggcacccccacctaccacgaagatctgtgaccctggggagctgggcagcggcgggggaccctcggcacccttcttggtcagcgtccccatcactctggccctggctgccgctgccgccactgccagcagtctcttgatctgagcccggcaccccatgaggacatgcagagcacctgcagaggagcaggaggccggagctgagcctgcagaccccggtttctattttgcacacgggcaggaggaccttttgcattctcttcagacacaatttgtggagaccccggcgggcccgggcctgccgccccccagccctgccgcaccaagctggccctccttcctccctcaggggaggtgggccatgcagctaacccacccaccaaagaccccctcaccctggccccttgggctggaccctccaatgccagcgactcccaggagcccttgggggacgtgaggggagcctctcacatccgatttctcctcctgccccagcctcctgtctatcccagggtctctgttgccaccatcagattataagctcctgatgctgggggggcccagccatccccctccccccagcacccacaattttcagtcccctcccctctgccctgttttgtatacccctcccctgaccctgctcctatcccacagtatttaatgccctgtcagtcccttctagtctgactcaatggtaacttgctgtatttgaattttttatagatgtatatacagggtggggggagtgggcggttctcattaaacgtcaccatttcatgaaaaaaggaaca

SEQ ID NO: 440478 - DNA, 1922 bp, Homo sapiens
gcacggggaccacagccgtcttgagggcgcgcccgagaaaggactctagccttgtcacctcatcttgcccccttggttttggaagtcctgaagagttggtctggaggaggaggaggacattgatgtgcttggtgtgtggccagtggtgaagagatggctgctcctgtcccgtgggcctgctgtgctgtgcttgccgccgccgccgcagttgtctacgcccagagacacagtccacaggaggcaccccatgtgcagtacgagcgcctgggctctgacgtgacactgccatgtgggacagcaaactgggatgctgcggtgacgtggcgggtaaatgggacagacctggcccctgacctgctcaacggctctcagctggtgctccatggcctggaactgggccacagtggcctctacgcctgcttccaccgtgactcctggcacctgcgccaccaagtcctgctgcatgtgggcttgccgccgcgggagcctgtgctcagctgccgctccaacacttaccccaagggcttctactgcagctggcatctgcccacccccacctacattcccaacaccttcaatgtgactgtgctgcatggctccaaaattatggtctgtgagaaggacccagccctcaagaaccgctgccacattcgctacatgcacctgttctccaccatcaagtacaaggtctccataagtgtcagcaatgccctgggccacaatgccacagctatcacctttgacgagttcaccattgtgaagcctgatcctccagaaaatgtggtagcccggccagtgcccagcaaccctcgccggctggaggtgacgtggcagaccccctcgacctggcctgaccctgagtcttttcctctcaagttctttctgcgctaccgacccctcatcctggaccagtggcagcatgtggagctgtccgacggcacagcacacaccatcacagatgcctacgccgggaaggagtacattatccaggtggcagccaaggacaatgagattgggacatggagtgactggagcgtagccgcccacagctacgccctggactgaggaaccgcgacacctcaccacggaggcccaggctgcggagaccacgaccagcaccaccagctccctggcacccccacctaccacgaagatctgtgaccctggggagctgggcagcggcgggggaccctcggcacccttcttggtcagcgtccccatcactctggccctggctgccgctgccgccactgccagcagtctcttgatctgagcccggcaccccatgaggacatgcagagcacctgcagaggagcaggaggccggagctgagcctgcagaccccggtttctattttgcacacgggcaggaggaccttttgcattctcttcagacacaatttgtggagaccccggcgggcccgggcctgccgccccccagccctgccgcaccaagctggccctccttcctccctcaggggaggtgggccatgcagctaacccacccaccaaagaccccctcaccctggccccttgggctggaccctccaatgccagcgactcccaggagcccttgggggacgtgaggggagcctctcacatccgatttctcctcctgccccagcctcctgtctatcccagggtctctgttgccaccatcagattataagctcctgatgctgggggggcccagccatccccctccccccagcacccacaattttcagtcccctcccctctgccctgttttgtatacccctcccctgaccctgctcctatcccacagtatttaatgccctgtcagtcccttctagtctgactcaatggtaacttgctgtatttgaattttttatagatgtatatacagggtggggggagtgggcggttctcattaaacgtcaccatttcatgaaaaaaggaaca

SEQ ID NO: 440479 - DNA, 1034 bp, Homo sapiens
  misc_feature (932)..(932): n is a, c, g, or t
  misc_feature (960)..(960): n is a, c, g, or t
  misc_feature (971)..(971): n is a, c, g, or t
ctgaagagccggtgcagagcgggcggcggcggcggcggcagcggaggcggcggctccagccggcgcggcgcgaggctcggcggtgggatccggcgggcggtgctagctccgcgctccctgcctcgctcgctgccgggggcggtcggaaggcgcggcgcgaagcccgggtggcccgagggcgcgactctagccttgtcacctcatcttgcccccttggttttggaagtcctgaagagttggtctggaggaggaggaggacattgatgtgcttggtgtgtggccagtggtgaagagatggctgctcctgtcccgtgggcctgctgtgctgtgcttgccgccgccgccgcagttgtctacgcccagagacacagtccacaggaggcaccccatgtgcagtacgagcgcctgggctctgacgtgacactgccatgtgggacagcaaactgggatgctgcggtgacgtggcgggtaaatgggacagacctggcccctgacctgctcaacggctctcagctggtgctccatggcctggaactgggccacagtggcctctacgcctgcttccaccgtgactcctggcacctgcgccaccaagtcctgctgcatgtgggcttgccgccgcgggagcctgtgctcagctgccgctccaacacttaccccaagggcttctactgcagctggcatctgcccacccccacctacattcccaacaccttcaatgtgactgtgctgcatggctccaaaattatggtctgtgagaaggacccagccctcaagaaccgctgccacattcgctacatgcacctgttctccaccatcaagtacaaggtctccataagtgtcagcaatgccctgggccacaatgccacagctatcacctttgacgagttcaccattgtctggtctgaacactccagagactaccgcagggnattatcccaactgcctttggagatgttncaatcattatntacccaatgaagaatcacatgttattcatcgcgataacaagggggatgacataggatcctgct

SEQ ID NO: 440480 - DNA, 1500 bp, Homo sapiens
atctgtggggattctcacaacttccatttctggtgaacagctgaggtcagagaggagttggtccaggcgcaatgttcagcgtatttgaggaaatcacaagaattgtagttaaggagatggatgctggaggggatatgattgccgttagaagccttgttgatgctgatagattccgctgcttccatctggtgggggagaagagaactttctttggatgccggcactacacaacaggcctcaccctgatggacattctggacacagatggggacaagtggttagatgaactggattctgggctccaaggtcaaaaggctgagtttcaaattctggataatgtagactcaacgggagagttgatagtgagattacccaaagaaataacaatttcaggcagtttccagggcttccaccatcagaaaatcaagatatcggagaaccggatatcccagcagtatctggctacccttgaaaacaggaagctgaagagggaactacccttttcattccgatcaattaatacgagagaaaacctgtatctggtgacagaaactctggagacggtaaaggaggaaaccctgaaaagcgaccggcaatataaattttggagccagatctctcagggccatctcagctataaacacaagggccaaagggaagtgaccatccccccaaatcgggtcctgagctatcgagtaaagcagcttgtcttccccaacaaggagacgatgaagaaggatggtgcttcatcctgtttaggaaagtctttgggttcggaggattccagaaacatgaaggagaagttggaggacatggagagtgtcctcaaggacctgacagaggagaagagaaaagatgtgctaaactccctcgctaagtgcctcggcaaggaggatattcggcaggatctagagcaaagagtatctgaggtcctgatttccggggagctacacatggaggacccagacaagcctctcctaagcagcctttttaatgctgctggggtcttggtagaagcgcgtgcaaaagccattctggacttcctggatgccctgctagagctgtctgaagagcagcagtttgtggctgaggccctggagaaggggacccttcctctgttgaaggaccaggtgaaatctgtcatggagcagaactgggatgagctggccagcagtcctcctgacatggactatgaccctgaggcacgaattctctgtgcgctgtatgttgttgtctctatcctgctggagctggctgaggggcctacctctgtctcttcctaactacaaaagccctttctccccacaagcctctgggttttccctttaccagtctgtcctcactgccatcgccactaccatcctgtcaccagtgggacctctttaaaacaagcagccaaccattctttgatgtatcccattcgctccatgttaacatccaaaaccagcctggatttcatacatggacttctgattaaaagtggcaggttgtgcatgttaa

SEQ ID NO: 440481 - DNA, 2106 bp, Homo sapiens
  misc_feature (617)..(617): n is a, c, g, or t
  misc_feature (632)..(632): n is a, c, g, or t
  misc_feature (695)..(695): n is a, c, g, or t
  misc_feature (1750)..(1750): n is a, c, g, or t
  misc_feature (1933)..(1933): n is a, c, g, or t
ggaagcagtgagtggataagtgcctgtgctgggcagaagggatataggggaaggtggccaaaggtaggatggggaagtggatcccaggaagcttgagtattctatagtgtcacaccacctcattgggaaattgttggtagggaggcacccatccaattgccttgcagaatacagcaaggcagggagcccaagaatcagagccaagggaagaaacgaccagttgaggttagtaatgtgaagtctggcaaccgtgcccgtcattcctccctggttcctctgttcatcaacgttggggctagtctggctggggcatggtgggcctgcctttccatcccttgggccccttggaacaagggggcaactctgctgtgggagatgtagaaaatgggtctcactttctctatttggggcaatagctgctacttttttcctccagatgggtaccatgaggggcagaggagaatctgggatctgtgatgtttagccctctttactgagtcatggctgcctcacgttctagaagtaaggcaggcaaatcattccaggtactgattgtcctggaacctttggctcttccttgacctcatgtcacgtgcgtccatgtgaagagagtccangaaacgggctttatntgagcaacaaggctgggtgcaggcaagctgagtccaaaaaaggggtcagcaaagggtggtggnattatcattagttcttatatgtttgggataggcttacaaagtacattctcaagggtggagaaatattacaaagtaccttcttaagggcaggggagaatattacaaagtaccttcttaagggcgggggggagactatattgtatcagggtggggcaggaacaaatcacaatggtggaatgtcatcagttaaggctattttcatttcttttgtggatcttcagttgcttcaggccatctggatgtatacatgcaggtcacagggaatatgatggcttagcttgggttcagaggcctgacacctcaggctgccaaatgtggaagatttaaatacttgaaccaataccctcctcccaaaaactgaaattggcttctgtttctgagttggtccaggcgcaatgttcagcgtatttgaggaaatcacaagaattgtagttaaggagatggatgctggaggggatatgattgccgttagaagccttgttgatgctgatagattccgctgcttccatctggtgggggagaagagaactttctttggatgccggcactacacaacaggcctcaccctgatggacattctggacacagatggggacaagtggttagatgaactggattctgggctccaaggtcagtataaggtagatgacaggtggccagccaggaggccttgaccgtttgtactccatctccttctcaattccccattgttatcaaccaatcaacaacgaaactgtgggatttgtacacatccacacaccttaatttaagaaatgcacggaagagctgcatggtgggaggagagtgggagaagtggagatttatttccactggaaaccgttcctaaatggtcttccttttccattttttcccttgtaaaataatctgcttttaatttagcgagctcttctcatgtgtttatcatttaaatgaataagtaaatgagggcagtttgcttactggttaagaaaggatgcaggctttagggctggaagcacctggtttcaaagcctggctctgcctcttatcagctgcgtaacctttggacaagttgntttattgctctaagtttcagtttcctcctgtgtcaactctagaggactgttgtaagaatcaagtgagggatgggtgcggtggctcactcctgtaatcccagcactttgggaggccgaggtgggcggatcacgaggtcaggagatcgagaccatcctggctaacacagtgaaaccccgtctctncttaaaaaaaaaaaatacaaaaaattagccaggcgtggtggcatgcgcctgtagtcctggctactcaggaggctgaggcaagagaattgcttgaacccgggaggtgcaggttgccgtgagctgagatcacgccactgcactccagcctgggagacaaagcaagcctctgtctc

SEQ ID NO: 440482 - DNA, 1972 bp, Homo sapiens
aaactcctgaactcaggtgatccacccactgcagcctcccaaagtgctgggattacaggcgtgagccaccatgcccagcctttcctgactttaaactaaaggagtgagactagaaggtccctgtgattctgaattatgtggcttcctctggaatttctaggttttccccttgatcccagcagggttgtactgcctaagagagcttggaaagggatagagaagtctgacccaaatttgcggagcgactgagtgtatgctgccccctttctgggccttggcttcttcctcaatcatctaggcacagtcctatgactgcctgtttttgaggatgtgggaagggtctgcaaatacagtgctttcccattgacacacgctggtgaggatgcaggctccctggcaccagcagtgagggctcagattgcaagagtaaaaacttccatcactgggaagagaagtctgcaggggactggaggtgatctgaagattctgaaataactcttcctctctctgcagagaaggatggtgcttcatcctgtttaggtaagggtgatagccaagtgtgttcagggtggctgcaccaacccaccctgagtccatgtggctcaagactgctgctcaggtggggtcagctgagtgggtaggaagtcgggaggcactgcctagcaggtttcaactttagtctggaggctgcatctgtctcctctaaacacagtggttctcattggttataccccaaaatcacaccaggaaactttaaaactagtgacgactgagtcccgtctccagaaactctgacttaattgtggggggtgtggcctggacatcaggatttgtaataactcctcaggtgattctcatgtagtcaaggttgagaaccactgctttaactttctccaaatcctaattacttctagtgtggcctgaggactgcactttgaatggcaagggccaaataaccaagtttttgtttttttccaggaagtggagaagaatttggggttgggactagactgggggttagctggggagatggaagatggaagtggggtcagtgggaggcaatgatggtaggtatcttgagaagaaggatgcttaattttaacacggaaagactggaagaagggaagatacaaagaggtggtctccagaagacagtcagacaaataacagagccttagaaataaaaccttttgggctgggtggcccaggttctcaattgctgcctctacaggaaagtctttgggttcggaggattccagaaacatgaaggagaagttggaggacatggagagtgtcctcaaggacctgacagaggagaagagaaaagatgtgctaaactccctcgctaagtgcctcggcaaggaggatattcggcaggatctagagcaaagagtatctgaggtcctgatttccggggagctacacatggaggacccagacaagcctctcctaagcagcctttttaatgctgctggggtcttggtagaagcgcgtgcaaaagccattctggacttcctggatgccctgctagagctgtctgaagagcagcagtttgtggctgaggccctggagaaggggacccttcctctgttgaaggaccaggtgaaatctgtcatggagcagaactgggatgagctggccagcagtcctcctgacatggactatgaccctgaggcacgaattctctgtgcgctgtatgttgttgtctctatcctgctggagctggctgaggggcctacctctgtctcttcctaactacaaaagccctttctccccacaagcctctgggttttccctttaccagtctgtcctcactgccatcgccactaccatcctgtcaccagtgggacctctttaaaacaagcagccaaccattctttgatgtatcccattcgctccatgttaacatccaaaaccagcctggatttcatacatggacttctgattaaaagtggcaggttgtgcatgttaa

SEQ ID NO: 440483 - DNA, 2407 bp, Homo sapiens
  misc_feature (617)..(617): n is a, c, g, or t
  misc_feature (632)..(632): n is a, c, g, or t
  misc_feature (695)..(695): n is a, c, g, or t
ggaagcagtgagtggataagtgcctgtgctgggcagaagggatataggggaaggtggccaaaggtaggatggggaagtggatcccaggaagcttgagtattctatagtgtcacaccacctcattgggaaattgttggtagggaggcacccatccaattgccttgcagaatacagcaaggcagggagcccaagaatcagagccaagggaagaaacgaccagttgaggttagtaatgtgaagtctggcaaccgtgcccgtcattcctccctggttcctctgttcatcaacgttggggctagtctggctggggcatggtgggcctgcctttccatcccttgggccccttggaacaagggggcaactctgctgtgggagatgtagaaaatgggtctcactttctctatttggggcaatagctgctacttttttcctccagatgggtaccatgaggggcagaggagaatctgggatctgtgatgtttagccctctttactgagtcatggctgcctcacgttctagaagtaaggcaggcaaatcattccaggtactgattgtcctggaacctttggctcttccttgacctcatgtcacgtgcgtccatgtgaagagagtccangaaacgggctttatntgagcaacaaggctgggtgcaggcaagctgagtccaaaaaaggggtcagcaaagggtggtggnattatcattagttcttatatgtttgggataggcttacaaagtacattctcaagggtggagaaatattacaaagtaccttcttaagggcaggggagaatattacaaagtaccttcttaagggcgggggggagactatattgtatcagggtggggcaggaacaaatcacaatggtggaatgtcatcagttaaggctattttcatttcttttgtggatcttcagttgcttcaggccatctggatgtatacatgcaggtcacagggaatatgatggcttagcttgggttcagaggcctgacacctcaggctgccaaatgtggaagatttaaatacttgaaccaataccctcctcccaaaaactgaaattggcttctgtttctgagttggtccaggcgcaatgttcagcgtatttgaggaaatcacaagaattgtagttaaggagatggatgctggaggggatatgattgccgttagaagccttgttgatgctgatagattccgctgcttccatctggtgggggagaagagaactttctttggatgccggcactacacaacaggcctcaccctgatggacattctggacacagatggggacaagtggttagatgaactggattctgggctccaaggtcaaaaggctgagtttcaaattctggataatgtagactcaacgggagagttgatagtgagattacccaaagaaataacaatttcaggcagtttccagggcttccaccatcagaaaatcaagatatcggagaaccggatatcccagcagtatctggctacccttgaaaacaggaagctgaagagggaactacccttttcattccgatcaattaatacgagagaaaacctgtatctggtgacagaaactctggagacggtaaaggaggaaaccctgaaaagcgaccggcaatataaattttggagccagatctctcagggccatctcagctataaacacaaggaaagtctttgggttcggaggattccagaaacatgaaggagaagttggaggacatggagagtgtcctcaaggacctgacagaggagaagagaaaagatgtgctaaactccctcgctaagtgcctcggcaaggaggatattcggcaggatctagagcaaagagtatctgaggtcctgatttccggggagctacacatggaggacccagacaagcctctcctaagcagcctttttaatgctgctggggtcttggtagaagcgcgtgcaaaagccattctggacttcctggatgccctgctagagctgtctgaagagcagcagtttgtggctgaggccctggagaaggggacccttcctctgttgaaggaccaggtgaaatctgtcatggagcagaactgggatgagctggccagcagtcctcctgacatggactatgaccctgaggcacgaattctctgtgcgctgtatgttgttgtctctatcctgctggagctggctgaggggcctacctctgtctcttcctaactacaaaagccctttctccccacaagcctctgggttttccctttaccagtctgtcctcactgccatcgccactaccatcctgtcaccagtgggacctctttaaaacaagcagccaaccattctttgatgtatcccattcgctccatgttaacatccaaaaccagcctggatttcatacatggacttctgattaaaagtggcaggttgtgcatgttaa

SEQ ID NO: 440484 - DNA, 1852 bp, Homo sapiens
aaactcctgaactcaggtgatccacccactgcagcctcccaaagtgctgggattacaggcgtgagccaccatgcccagcctttcctgactttaaactaaaggagtgagactagaaggtccctgtgattctgaattatgtggcttcctctggaatttctaggttttccccttgatcccagcagggttgtactgcctaagagagcttggaaagggatagagaagtctgacccaaatttgcggagcgactgagtgtatgctgccccctttctgggccttggcttcttcctcaatcatctaggcacagtcctatgactgcctgtttttgaggatgtgggaagggtctgcaaatacagtgctttcccattgacacacgctggtgaggatgcaggctccctggcaccagcagtgagggctcagattgcaagagtaaaaacttccatcactgggaagagaagtctgcaggggactggaggtgatctgaagattctgaaataactcttcctctctctgcagagaaggatggtgcttcatcctgtttaggtaagggtgatagccaagtgtgttcagggtggctgcaccaacccaccctgagtccatgtggctcaagactgctgctcaggtggggtcagctgagtgggtaggaagtcgggaggcactgcctagcaggtttcaactttagtctggaggctgcatctgtctcctctaaacacagtggttctcattggttataccccaaaatcacaccaggaaactttaaaactagtgacgactgagtcccgtctccagaaactctgacttaattgtggggggtgtggcctggacatcaggatttgtaataactcctcaggtgattctcatgtagtcaaggttgagaaccactgctttaactttctccaaatcctaattacttctagtgtggcctgaggactgcactttgaatggcaagggccaaataaccaagtttttgtttttttccaggaagtggagaagaatttggggttgggactagactgggggttagctggggagatggaagatggaagtggggtcagtgggaggcaatgatggtaggtatcttgagaagaaggatgcttaattttaacacggaaagactggaagaagggaagatacaaagaggtggtctccagaagacagtcagacaaataacagagccttagaaataaaaccttttgggctgggtggcccaggttctcaattgctgcctctacaggaaagtctttgggttcggaggattccagaaacatgaaggagaagttggaggacatggagagtgtcctcaaggacctgacagaggagaagagaaaagatgtgctaaactccctcgctaagtgcctcggcaaggaggatattcggcaggatctagagcaaagagtatctgaggtcctgatttccggggagctacacatggaggacccagacaagcctctcctaagcagcctttttaatgctgctggggtcttggtagaagcgcgtgcaaaagccattctggacttcctggatgccctgctagagctgtctgaagagcagcagtttgtggctgaggccctggagaaggggacccttcctctgttgaaggaccagctggctgaggggcctacctctgtctcttcctaactacaaaagccctttctccccacaagcctctgggttttccctttaccagtctgtcctcactgccatcgccactaccatcctgtcaccagtgggacctctttaaaacaagcagccaaccattctttgatgtatcccattcgctccatgttaacatccaaaaccagcctggatttcatacatggacttctgattaaaagtggcaggttgtgcatgttaa

SEQ ID NO: 440485 - DNA, 1757 bp, Homo sapiens
aaactcctgaactcaggtgatccacccactgcagcctcccaaagtgctgggattacaggcgtgagccaccatgcccagcctttcctgactttaaactaaaggagtgagactagaaggtccctgtgattctgaattatgtggcttcctctggaatttctaggttttccccttgatcccagcagggttgtactgcctaagagagcttggaaagggatagagaagtctgacccaaatttgcggagcgactgagtgtatgctgccccctttctgggccttggcttcttcctcaatcatctaggcacagtcctatgactgcctgtttttgaggatgtgggaagggtctgcaaatacagtgctttcccattgacacacgctggtgaggatgcaggctccctggcaccagcagtgagggctcagattgcaagagtaaaaacttccatcactgggaagagaagtctgcaggggactggaggtgatctgaagattctgaaataactcttcctctctctgcagagaaggatggtgcttcatcctgtttaggtaagggtgatagccaagtgtgttcagggtggctgcaccaacccaccctgagtccatgtggctcaagactgctgctcaggtggggtcagctgagtgggtaggaagtcgggaggcactgcctagcaggtttcaactttagtctggaggctgcatctgtctcctctaaacacagtggttctcattggttataccccaaaatcacaccaggaaactttaaaactagtgacgactgagtcccgtctccagaaactctgacttaattgtggggggtgtggcctggacatcaggatttgtaataactcctcaggtgattctcatgtagtcaaggttgagaaccactgctttaactttctccaaatcctaattacttctagtgtggcctgaggactgcactttgaatggcaagggccaaataaccaagtttttgtttttttccaggaagtggagaagaatttggggttgggactagactgggggttagctggggagatggaagatggaagtggggtcagtgggaggcaatgatggtaggtatcttgagaagaaggatgcttaattttaacacggaaagactggaagaagggaagatacaaagaggtggtctccagaagacagtcagacaaataacagagccttagaaataaaaccttttgggctgggtggcccaggttctcaattgctgcctctacaggaaagtctttgggttcggaggattccagaaacatgaaggagaagttggaggacatggagagtgtcctcaaggacctgacagaggagaagagaaaagatgtgctaaactccctcgctaagtgcctcggcaaggaggatattcggcaggatctagagcaaagagtatctgaggtcctgatttccggggagctacacatggaggacccagacaagcctctcctaagcagcctttttaatgctgctggggtcttggtagaagcgcgtgcaaaagccattctggacttcctggatgccctgctagagctgtctgaagagcagcagtttgtggctgaggccctggagaaggggacccttcctctgttgaaggaccaggacagcctgggctgagggccatggtcatagtggaagggaatgcccatattctcaagggacccagaagtcccagggtacagccccttcttattccatagttttctgccggctcacatccatgcagctggtttgtgacaattccctggacagagagt

SEQ ID NO: 440486 - DNA, 2492 bp, Homo sapiens
  misc_feature (617)..(617): n is a, c, g, or t
  misc_feature (632)..(632): n is a, c, g, or t
  misc_feature (695)..(695): n is a, c, g, or t
ggaagcagtgagtggataagtgcctgtgctgggcagaagggatataggggaaggtggccaaaggtaggatggggaagtggatcccaggaagcttgagtattctatagtgtcacaccacctcattgggaaattgttggtagggaggcacccatccaattgccttgcagaatacagcaaggcagggagcccaagaatcagagccaagggaagaaacgaccagttgaggttagtaatgtgaagtctggcaaccgtgcccgtcattcctccctggttcctctgttcatcaacgttggggctagtctggctggggcatggtgggcctgcctttccatcccttgggccccttggaacaagggggcaactctgctgtgggagatgtagaaaatgggtctcactttctctatttggggcaatagctgctacttttttcctccagatgggtaccatgaggggcagaggagaatctgggatctgtgatgtttagccctctttactgagtcatggctgcctcacgttctagaagtaaggcaggcaaatcattccaggtactgattgtcctggaacctttggctcttccttgacctcatgtcacgtgcgtccatgtgaagagagtccangaaacgggctttatntgagcaacaaggctgggtgcaggcaagctgagtccaaaaaaggggtcagcaaagggtggtggnattatcattagttcttatatgtttgggataggcttacaaagtacattctcaagggtggagaaatattacaaagtaccttcttaagggcaggggagaatattacaaagtaccttcttaagggcgggggggagactatattgtatcagggtggggcaggaacaaatcacaatggtggaatgtcatcagttaaggctattttcatttcttttgtggatcttcagttgcttcaggccatctggatgtatacatgcaggtcacagggaatatgatggcttagcttgggttcagaggcctgacacctcaggctgccaaatgtggaagatttaaatacttgaaccaataccctcctcccaaaaactgaaattggcttctgtttctgagttggtccaggcgcaatgttcagcgtatttgaggaaatcacaagaattgtagttaaggagatggatgctggaggggatatgattgccgttagaagccttgttgatgctgatagattccgctgcttccatctggtgggggagaagagaactttctttggatgccggcactacacaacaggcctcaccctgatggacattctggacacagatggggacaagtggttagatgaactggattctgggctccaaggtcaaaaggctgagtttcaaattctggataatgtagactcaacgggagagttgatagtgagattacccaaagaaataacaatttcaggcagtttccagggcttccaccatcagaaaatcaagatatcggagaaccggatatcccagcagtatctggctacccttgaaaacaggaagctgaagagggaactacccttttcattccgatcaattaatacgagagaaaacctgtatctggtgacagaaactctggagacggtaaaggaggaaaccctgaaaagcgaccggcaatataaattttggagccagatctctcagggccatctcagctataaacacaagggccaaagggaagtgaccatccccccaaatcgggtcctgagctatcgagtaaagcagcttgtcttccccaacaaggagacgatgagaaagtctttgggttcggaggattccagaaacatgaaggagaagttggaggacatggagagtgtcctcaaggacctgacagaggagaagagaaaagatgtgctaaactccctcgctaagtgcctcggcaaggaggatattcggcaggatctagagcaaagagtatctgaggtcctgatttccggggagctacacatggaggacccagacaagcctctcctaagcagcctttttaatgctgctggggtcttggtagaagcgcgtgcaaaagccattctggacttcctggatgccctgctagagctgtctgaagagcagcagtttgtggctgaggccctggagaaggggacccttcctctgttgaaggaccaggtgaaatctgtcatggagcagaactgggatgagctggccagcagtcctcctgacatggactatgaccctgaggcacgaattctctgtgcgctgtatgttgttgtctctatcctgctggagctggctgaggggcctacctctgtctcttcctaactacaaaagccctttctccccacaagcctctgggttttccctttaccagtctgtcctcactgccatcgccactaccatcctgtcaccagtgggacctctttaaaacaagcagccaaccattctttgatgtatcccattcgctccatgttaacatccaaaaccagcctggatttcatacatggacttctgattaaaagtggcaggttgtgcatgttaa

SEQ ID NO: 440487 - DNA, 1933 bp, Homo sapiens
taaccctcaccctaaccacgcaacccccaccatgcccagcctttcctgactttaaactaaaggagtgagactagaaggtccctgtgattctgaattatgtggcttcctctggaatttctaggttttccccttgatcccagcagggttgtactgcctaagagagcttggaaagggatagagaagtctgacccaaatttgcggagcgactgagtgtatgctgccccctttctgggccttggcttcttcctcaatcatctaggcacagtcctatgactgcctgtttttgaggatgtgggaagggtctgcaaatacagtgctttcccattgacacacgctggtgaggatgcaggctccctggcaccagcagtgagggctcagattgcaagagtaaaaacttccatcactgggaagagaagtctgcaggggactggaggtgatctgaagattctgaaataactcttcctctctctgcagagaaggatggtgcttcatcctgtttaggtaagggtgatagccaagtgtgttcagggtggctgcaccaacccaccctgagtccatgtggctcaagactgctgctcaggtggggtcagctgagtgggtaggaagtcgggaggcactgcctagcaggtttcaactttagtctggaggctgcatctgtctcctctaaacacagtggttctcattggttataccccaaaatcacaccaggaaactttaaaactagtgacgactgagtcccgtctccagaaactctgacttaattgtggggggtgtggcctggacatcaggatttgtaataactcctcaggtgattctcatgtagtcaaggttgagaaccactgctttaactttctccaaatcctaattacttctagtgtggcctgaggactgcactttgaatggcaagggccaaataaccaagtttttgtttttttccaggaagtggagaagaatttggggttgggactagactgggggttagctggggagatggaagatggaagtggggtcagtgggaggcaatgatggtaggtatcttgagaagaaggatgcttaattttaacacggaaagactggaagaagggaagatacaaagaggtggtctccagaagacagtcagacaaataacagagccttagaaataaaaccttttgggctgggtggcccaggttctcaattgctgcctctacaggaaagtctttgggttcggaggattccagaaacatgaaggagaagttggaggacatggagagtgtcctcaaggacctgacagaggagaagagaaaagatgtgctaaactccctcgctaagtgcctcggcaaggaggatattcggcaggatctagagcaaagagtatctgaggtcctgatttccggggagctacacatggaggacccagacaagcctctcctaagcagcctttttaatgctgctggggtcttggtagaagcgcgtgcaaaagccattctggacttcctggatgccctgctagagctgtctgaagagcagcagtttgtggctgaggccctggagaaggggacccttcctctgttgaaggaccaggtgaaatctgtcatggagcagaactgggatgagctggccagcagtcctcctgacatggactatgaccctgaggcacgaattctctgtgcgctgtatgttgttgtctctatcctgctggagctggctgaggggcctacctctgtctcttcctaactacaaaagccctttctccccacaagcctctgggttttccctttaccagtctgtcctcactgccatcgccactaccatcctgtcaccagtgggacctctttaaaacaagcagccaaccattctttgatgtatcccattcgctccatgttaacatccaaaaccagcctggatttcatacatggacttctgattaaaagtggcaggttgtgcatgttaa

SEQ ID NO: 440488 - DNA, 1281 bp, Homo sapiens
aaactcctgaactcaggtgatccacccactgcagcctcccaaagtgctgggattacaggcgtgagccaccatgcccagcctttcctgactttaaactaaaggagtgagactagaaggtccctgtgattctgaattatgtggcttcctctggaatttctaggttttccccttgatcccagcagggttgtactgcctaagagagcttggaaagggatagagaagtctgacccaaatttgcggagcgactgagtgtatgctgccccctttctgggccttggcttcttcctcaatcatctaggcacagtcctatgactgcctgtttttgaggatgtgggaagggtctgcaaatacagtgctttcccattgacacacgctggtgaggatgcaggctccctggcaccagcagtgagggctcagattgcaagagtaaaaacttccatcactgggaagagaagtctgcaggggactggaggtgatctgaagattctgaaataactcttcctctctctgcagagaaggatggtgcttcatcctgtttaggaaagtctttgggttcggaggattccagaaacatgaaggagaagttggaggacatggagagtgtcctcaaggacctgacagaggagaagagaaaagatgtgctaaactccctcgctaagtgcctcggcaaggaggatattcggcaggatctagagcaaagagtatctgaggtcctgatttccggggagctacacatggaggacccagacaagcctctcctaagcagcctttttaatgctgctggggtcttggtagaagcgcgtgcaaaagccattctggacttcctggatgccctgctagagctgtctgaagagcagcagtttgtggctgaggccctggagaaggggacccttcctctgttgaaggaccaggtgaaatctgtcatggagcagaactgggatgagctggccagcagtcctcctgacatggactatgaccctgaggcacgaattctctgtgcgctgtatgttgttgtctctatcctgctggagctggctgaggggcctacctctgtctcttcctaactacaaaagccctttctccccacaagcctctgggttttccctttaccagtctgtcctcactgccatcgccactaccatcctgtcaccagtgggacctctttaaaacaagcagccaaccattctttgatgtatcccattcgctccatgttaacatccaaaaccagcctggatttcatacatggacttctgattaaaagtggcaggttgtgcatgttaa

SEQ ID NO: 440489 - DNA, 2152 bp, Homo sapiens
  misc_feature (617)..(617): n is a, c, g, or t
  misc_feature (632)..(632): n is a, c, g, or t
  misc_feature (695)..(695): n is a, c, g, or t
ggaagcagtgagtggataagtgcctgtgctgggcagaagggatataggggaaggtggccaaaggtaggatggggaagtggatcccaggaagcttgagtattctatagtgtcacaccacctcattgggaaattgttggtagggaggcacccatccaattgccttgcagaatacagcaaggcagggagcccaagaatcagagccaagggaagaaacgaccagttgaggttagtaatgtgaagtctggcaaccgtgcccgtcattcctccctggttcctctgttcatcaacgttggggctagtctggctggggcatggtgggcctgcctttccatcccttgggccccttggaacaagggggcaactctgctgtgggagatgtagaaaatgggtctcactttctctatttggggcaatagctgctacttttttcctccagatgggtaccatgaggggcagaggagaatctgggatctgtgatgtttagccctctttactgagtcatggctgcctcacgttctagaagtaaggcaggcaaatcattccaggtactgattgtcctggaacctttggctcttccttgacctcatgtcacgtgcgtccatgtgaagagagtccangaaacgggctttatntgagcaacaaggctgggtgcaggcaagctgagtccaaaaaaggggtcagcaaagggtggtggnattatcattagttcttatatgtttgggataggcttacaaagtacattctcaagggtggagaaatattacaaagtaccttcttaagggcaggggagaatattacaaagtaccttcttaagggcgggggggagactatattgtatcagggtggggcaggaacaaatcacaatggtggaatgtcatcagttaaggctattttcatttcttttgtggatcttcagttgcttcaggccatctggatgtatacatgcaggtcacagggaatatgatggcttagcttgggttcagaggcctgacacctcaggctgccaaatgtggaagatttaaatacttgaaccaataccctcctcccaaaaactgaaattggcttctgtttctgagttggtccaggcgcaatgttcagcgtatttgaggaaatcacaagaattgtagttaaggagatggatgctggaggggatatgattgccgttagaagccttgttgatgctgatagattccgctgcttccatctggtgggggagaagagaactttctttggatgccggcactacacaacaggcctcaccctgatggacattctggacacagatggggacaagtggttagatgaactggattctgggctccaaggtcaaaaggctgagtttcaaattctggataatgtagactcaacgggagagttgatagtgagattacccaaagaaataacaatttcaggcagtttccagggcttccaccatcagaaaatcaagatatcggagaaccggatatcccagcagtatctggctacccttgaaaacaggaagctgaagagggaactacccttttcattccgatcaattaatacgagagaaaacctgtatctggtgacagaaactctggagacggtaaaggaggaaaccctgaaaagcgaccggcaatataaattttggagccagatctctcagggccatctcagctataaacacaagggccaaagggaagtgaccatccccccaaatcgggtcctgagctatcgagtaaagcagcttgtcttccccaacaaggagacgatgaagaaggatggtgcttcatcctgtttaggtaagggtgatagccaagtgtgttcagggtggctgcaccaacccaccctgagtccatgtggctcaagactgctgctcaggtggggtcagctgagtgggtaggaagtcgggaggcactgcctagcaggtttcaactttagtctggaggctgcatctgtctcctctaaacacagtggttctcattggttataccccaaaatcacaccaggaaactttaaaactagtgacgactgagtcccgtctccagaaactctgacttaattgtggggggtgtggcctggacatcaggatttgtaataactcctcaggtgattctcattggttataccccaaaatcacaccaggaaactttaaaactagcgactcgtggaaatg

SEQ ID NO: 440490 - DNA, 3354 bp, Homo sapiens
  misc_feature (1172)..(1172): n is a, c, g, or t
  misc_feature (1424)..(1424): n is a, c, g, or t
  misc_feature (1835)..(1835): n is a, c, g, or t
  misc_feature (2623)..(2623): n is a, c, g, or t
agggtatagggaggcggctgaacaaggttgtgggggtaggaagctagggttagaggcaacccgtgaggctagaaccccgaacgtggtcggttggagaaaatatgtccctccggaggcacattgggaaccctgagtatctgatgaaaaggataccacagaacccaagataccagcatatcaaatcaagactggacactggtgcctgtgtgtatcttaccagctccccagcactgccagactgtgccatgaatggattatgcttctgatgaaatccctggctgcgttttgttcagtcaccaccgcagggttcttgtatattctcaagcaccctctctgggtttctgttttgcagcactgcaggctgattaagggacactttccaaaccacagggctctccctttattagtccccacagtctttcattggctgcattgtcctcccatttctatctatattcaatctaatttccaatttctttagctttctgaaattctgtaggctttctccactcagtcttttctagccttatttttgtctttttaaaaattcaccttccttttattatctctagacaaactattcattccctcttttcttctttaggctttacttttcctgaatatttgctaatagccttgactgtaagcatcaaactcattatagactaggtactcttcatttttatttgttgtttaattctgtttcttccgtcaaaggaagaaatatatgtgaaaggcttttataaaccagaaagcactatacacacatatcacttattgaggttaacaaaggaccactgtgcctcttttcatgctttctgctcttccaagccaagagaacttctccatagaggagggaaatattgaagaaaaataaagccatggagttgtctcttagcaactgagttcgtgccttataaatctcatctactttagattactgctgcacaaaatcacttgcttttcttattggctcagtataaataatgttattaaattataggaaaacaatggaaaaaatctaatgaatgactcattcactgaatcagttgcactctgtgtttgcacagcactgttgctatagtcgggttgtttcttcctcttgattctaattgtaaagttttgttatatatcttttatcacaactttagttgtaagtaaacaaagtagangctaaatgctaccttatacatttataggttgcttaagtcgtgaagcaatatgagtcatatatgtagcacataacatatactgtatataagtcaagttgtacatagtttaaagaaaatcaggtgtgcagaaactcagaccaaattgggaagtatttgcattataaaataactcattataaggatttttcagttagtagatctccatagtaaatttcattcagcaaatgtgtatttttcctatttatttatttntttatttattgagatgaagtctcgctctgttgcccaagctggagtgcagtggcgtgatcttggctcactgcaacctctgcctcccaggttcaagcgattcttctgcctcagcctcctgagtagctgggactacaggtgcgcaccaccatgcctggctaatttttatatttttagtagagacggggttttactatgttggtcaggctggtctcgaactcctgaccttgtgatcctcccgcctcggcctcccaaagtgctgggattacaggcgtgagccactgtgccaggtctagttatttatttatttattgtagagatgggctctcactgtgttggccagggtggtcttgaactcctggcctcgagcaatccttccacctcagtctcccaaagtgctgggattacaggtgngagctatcacacctggccatttttttttttttttttttttgagatagagtctcactctgtcacccgcattgtagtgcagtggcgcattcttgctcactgcaacctccccttcctgggctcaggggatcctcctacctcagcctctcaagtagctgggactacagggatgtgccaccatgcctggctagtttttgtgtatgtgtgtgttttgtagagacgaggtctcactattttgcccaggctggtccggaactcctgggctcaagcaatcctgcctcctcagcctcccaacgtgctgggattgcaggcatgatccagtgcacctgaccatcattcagcaagtatttttgagtgtctcctatgctagacaatggaagggataaagattattcatacgtgtgtgtgtgtgtgtgtgtgtacgtgcccataaatagtcccttggctttctgtctagtaaggtaggtaagacaatacagtgataaatgccttgtgagttgtaagccgagtgctatagaggctcagaggagggaaaggtcacttcctgctgagtgagctcttacgagtatgtggcaaggtgatacgttagagaatgcaagactaagagtttgtcaagttaagtaattaaggcaacattaagaggtagtgagttggtgtccagtgctagagcaaggagtttcagctttagttaggaagcaatggggagccactgactttttttttctttttgatcaaaaagtcttatctgggaaaatgtatctggcagtaatgtgtaatttcaattttttttnaaaaaaattggttcttggatagtcttttaggcttcttttgtatgaaacaaagccatgtttataaataagtgaattatgaaatggattcatttccaatctttttaaaaggtagtcagaaactatcttcagatgcaattagatacagtaagataggctgcatagttaagatgtaagcagtttacacagtgggataaaaatgctacttttcatactttctcaaaccatttttaggggtatttttgtgtcagccatcctgctatctcatttgtccaattaaagcaaggaagaaatcctccattctccttttttccccattcttggatagaatgaatgtctatagtgaaaagaactcatcagtagtcctctcagatttggtctgaatttcaccaaatatttgtataattgcaaaaaacttgtttctcagccttctcctttagggggaaaacaaatagagggcatgatggcctacctccctgcattgtggtgagggtcagctgatacaaaataaagtgttaagtgtaattaccctgaaatgtttgtaattaatggagaaatgaagtgtagacactttgttagtagaaaccactgtggtttggaaatgcagtgtttcaataataaagactggataaataaggttgtggtttggaaatgcagtgtttcaataataaagactggataaataaggttgtggtttggaaatgcagtgtttcaataataaagactggataaat

SEQ ID NO: 440491 - DNA, 758 bp, Homo sapiens
agggtatagggaggcggctgaacaaggttgtgggggtaggaagctagggttagaggcaacccgtgaggctagaaccccgaacgtggtcggttggagaaaatatgtccctccggaggcacattgggaaccctgaggtgagggccaggtctcggccggagagccggagggggcgggcgcaccggaaaaggctcatgtgggcagggaagagcagccagcgacttccgccgcccggaaggcgggaaggggccggcgtgaggaggggtcgggatgcaggggcggggcgggccgggcttgggggccgcggggcagcgttcaggaccccgttttgaggagcgatctctccccgcgtacgcacgccagtacttgtgactgcgaggagcgaagtacccaaagacacagcccttgccctcaaatggcttacagtctcggagtgacagttacaaaacagaaaagacaaaggaagcgctgcacactaatggcacgtgttgaaagccagccagcatctctgattgtggggatacaggaagagcaggagtaagctgaccaaacctttggaaaacgggcaaaataggacattaggcttacccctctctccataggacccttcagtttcttcatctgtttcaccgctagtcccctgctgcatttgtggcagtttcaacaaacgttattggaaacttccacggtgcagtaggtgctagacgtacaaagaagacaaggcctctgccctttaataaattgcgtatagtggaccaggc

SEQ ID NO: 440492 - DNA, 3468 bp, Homo sapiens
  misc_feature (1286)..(1286): n is a, c, g, or t
  misc_feature (1538)..(1538): n is a, c, g, or t
  misc_feature (1949)..(1949): n is a, c, g, or t
  misc_feature (2737)..(2737): n is a, c, g, or t
agggtatagggaggcggctgaacaaggttgtgggggtaggaagctagggttagaggcaacccgtgaggctagaaccccgaacgtggtcggttggagaaaatatgtccctccggaggcacattgggaaccctgagtatctgatgaaaaggataccacagaacccaagataccagcatatcaaatcaagactggacactggccgtactgttcctgtatttcccccaagccttgtttcttctgccacaaaaaccctcagctctttcatctctacccatctaacccctaattgcaactgtgatccacccttctgaagtgcctgtgtgtatcttaccagctccccagcactgccagactgtgccatgaatggattatgcttctgatgaaatccctggctgcgttttgttcagtcaccaccgcagggttcttgtatattctcaagcaccctctctgggtttctgttttgcagcactgcaggctgattaagggacactttccaaaccacagggctctccctttattagtccccacagtctttcattggctgcattgtcctcccatttctatctatattcaatctaatttccaatttctttagctttctgaaattctgtaggctttctccactcagtcttttctagccttatttttgtctttttaaaaattcaccttccttttattatctctagacaaactattcattccctcttttcttctttaggctttacttttcctgaatatttgctaatagccttgactgtaagcatcaaactcattatagactaggtactcttcatttttatttgttgtttaattctgtttcttccgtcaaaggaagaaatatatgtgaaaggcttttataaaccagaaagcactatacacacatatcacttattgaggttaacaaaggaccactgtgcctcttttcatgctttctgctcttccaagccaagagaacttctccatagaggagggaaatattgaagaaaaataaagccatggagttgtctcttagcaactgagttcgtgccttataaatctcatctactttagattactgctgcacaaaatcacttgcttttcttattggctcagtataaataatgttattaaattataggaaaacaatggaaaaaatctaatgaatgactcattcactgaatcagttgcactctgtgtttgcacagcactgttgctatagtcgggttgtttcttcctcttgattctaattgtaaagttttgttatatatcttttatcacaactttagttgtaagtaaacaaagtagangctaaatgctaccttatacatttataggttgcttaagtcgtgaagcaatatgagtcatatatgtagcacataacatatactgtatataagtcaagttgtacatagtttaaagaaaatcaggtgtgcagaaactcagaccaaattgggaagtatttgcattataaaataactcattataaggatttttcagttagtagatctccatagtaaatttcattcagcaaatgtgtatttttcctatttatttatttntttatttattgagatgaagtctcgctctgttgcccaagctggagtgcagtggcgtgatcttggctcactgcaacctctgcctcccaggttcaagcgattcttctgcctcagcctcctgagtagctgggactacaggtgcgcaccaccatgcctggctaatttttatatttttagtagagacggggttttactatgttggtcaggctggtctcgaactcctgaccttgtgatcctcccgcctcggcctcccaaagtgctgggattacaggcgtgagccactgtgccaggtctagttatttatttatttattgtagagatgggctctcactgtgttggccagggtggtcttgaactcctggcctcgagcaatccttccacctcagtctcccaaagtgctgggattacaggtgngagctatcacacctggccatttttttttttttttttttttgagatagagtctcactctgtcacccgcattgtagtgcagtggcgcattcttgctcactgcaacctccccttcctgggctcaggggatcctcctacctcagcctctcaagtagctgggactacagggatgtgccaccatgcctggctagtttttgtgtatgtgtgtgttttgtagagacgaggtctcactattttgcccaggctggtccggaactcctgggctcaagcaatcctgcctcctcagcctcccaacgtgctgggattgcaggcatgatccagtgcacctgaccatcattcagcaagtatttttgagtgtctcctatgctagacaatggaagggataaagattattcatacgtgtgtgtgtgtgtgtgtgtgtacgtgcccataaatagtcccttggctttctgtctagtaaggtaggtaagacaatacagtgataaatgccttgtgagttgtaagccgagtgctatagaggctcagaggagggaaaggtcacttcctgctgagtgagctcttacgagtatgtggcaaggtgatacgttagagaatgcaagactaagagtttgtcaagttaagtaattaaggcaacattaagaggtagtgagttggtgtccagtgctagagcaaggagtttcagctttagttaggaagcaatggggagccactgactttttttttctttttgatcaaaaagtcttatctgggaaaatgtatctggcagtaatgtgtaatttcaattttttttnaaaaaaattggttcttggatagtcttttaggcttcttttgtatgaaacaaagccatgtttataaataagtgaattatgaaatggattcatttccaatctttttaaaaggtagtcagaaactatcttcagatgcaattagatacagtaagataggctgcatagttaagatgtaagcagtttacacagtgggataaaaatgctacttttcatactttctcaaaccatttttaggggtatttttgtgtcagccatcctgctatctcatttgtccaattaaagcaaggaagaaatcctccattctccttttttccccattcttggatagaatgaatgtctatagtgaaaagaactcatcagtagtcctctcagatttggtctgaatttcaccaaatatttgtataattgcaaaaaacttgtttctcagccttctcctttagggggaaaacaaatagagggcatgatggcctacctccctgcattgtggtgagggtcagctgatacaaaataaagtgttaagtgtaattaccctgaaatgtttgtaattaatggagaaatgaagtgtagacactttgttagtagaaaccactgtggtttggaaatgcagtgtttcaataataaagactggataaataaggttgtggtttggaaatgcagtgtttcaataataaagactggataaataaggttgtggtttggaaatgcagtgtttcaataataaagactggataaat

SEQ ID NO: 440493 - DNA, 6351 bp, Homo sapiens
agggtatagggaggcggctgaacaaggttgtgggggtaggaagctagggttagaggcaacccgtgaggctagaaccccgaacgtggtcggttggagaaaatatgtccctccggaggcacattgggaaccctgagtatctgatgaaaaggataccacagaacccaagataccagcatatcaaatcaagactggacactggtaacagtatgactaaatatactgagaagctcgaagagattaagaaaaattatagatacaaaaaagatgagcttttcaagagactaaaagttacaacttttgcccagctgatcatccaagttgcttccctctctgatcaaacactggaagtgacagctgaggagattcaaaggctggaagacaatgattctgcagcttcagaccctgatgctgaaaccactgccaggaccaatgggaaaggaaatccaggtgagcagtcgccgagccctgagcagttcataaacaacgcaggagcaggggactccagccgctcaactcttcagagtgtcatcagtggtgttggggaactggatctagacaaagggccagtgaagaaagcagagccccataccaaagacaaaccttatcctgactgccccttcctgctgctagatgtgcgtgatagagattcttaccagcagtgccacattgttggagcttacagttacccaattgcaactctgtctagaacaatgaacccttattcaaatgatattcttgaatataaaaatgcccatggcaagatcatcattctgtatgacgatgatgaaaggctggccagtcaggcggccaccaccatgtgcgagcgtggatttgaaaacctcttcatgctttccggaggtctaaaagtcttagctcagaaattcccggaaggactgattactggttccctgccagcatcttgccagcaggcccttcctcctgggtctgcccggaaacgatccagccccaaagggccacccctaccagctgagaataaatggagatttaccccagaagacttaaaaaagatagaatattatctggaagaggagcaagggcctgcagatcatcctagccgactgaaccaagctaactcctccggaagagagtccaaggtgcctggtgcccgaagcgctcagaatctgccaggtggcggccccgccagccactcaaacccccgctccctcagcagtggtcacctgcaaggcaaaccctggaagtaaagactttgtctcacttaggcaaataaatgttcttcctcttttcagaacccctgagcatttcccaagttgggtcatttccagaaacttctgcagaggaaagaccatgacatatgtatgggataggcctcttccctgtccctgtctccagttcctctcccctcaggaggccacctcaggaaggattttgacaggtgaccataaaaaccagaggtgtgacaggctctagtctcctccctgttgtttacagcatatttaagtcttgtgaaactgtataggaaaaaagtatctacgtttttagtttttttgttttgtttttttttaataaggtccagcttgttgggtctctctgtgttgttttgtaaatacttcagtcacatctgcccgtgtgcctgtccctgccaccttttcattcactgttcttgacttcatgaaggcttctccgggcagtcttggtgtgagaagctgtttccaagggtgcagatgagccttaggttccagccgcctgcagaccccaccccagcaggctcactcagcaaggagctctctgcccagcatattgcaggccctgttttgagtatggaagccagtgcctgtgtactcactgaaattgaagatgaggaaagtagctgtacactcactgaatgctcccccttactagatatttcctggagccagaaaggtatgcatgtgggtgtcttcacaccggggaggagggcctctcatgggaaagccctggccaccacaccggcctgtgccccttgaagcccaccaaagcggccctcacttgtggtcagtatatcagttatgacgcccattgcccagcttcagtccatccatgttagatggacagaaattatggccagttgaaaataccagctttggttggacaactgtggacacacaaggtgaagaggactccgaagtcctttgtcagggctgacaacctcgtaagcccttgcttagaaatacagtattagtctaattgagtaattagtgcaatttcctgcttacttttcattctcatgactgaactgtgattaggaagttgtgattatagattctggttttggccggaattttgaatcagcattaattgaattgctaaatgactgacattcattccatttaattgggggaacaaaaggcctcaggtaaggatgaggaactctgaaatcagatggaaaagagcggtgttaatttttatggtctgtgatcgtagctgtgataagggactgaggaataaattgtgctctttgtcatggcaaccagcttctgaaaagcccactgaaaattgcctgtcctgctggtaactgctacggggtaagatttgccttaacagtactattttctcgccaccaaaaaaaaaaaaaaaaaaaaaaaaaaatgcaccacagtatttctagcatgggggctgtgtttgtatgagaaataaacgtaataaatatctcatagagacatatggaaaaataactttcagattcagcccagttctgttttagagtgtgtttattcttctctacttgatttccaaagtgcaacattttccgatgctttagaaatcaaacaaaccagggacattgttcagatgtcaagccatgcccaattttccacaagattcaagaatcttgtataaaattcagccaacgtacacatagctttaatgaggagcctgtcatgtttccccataaatttattgcctgagaacttagttcagcctttgctaatgccaaaatgctctggctttgtattttctttacagcatagatagaaaaatgcacatttttccacactcagctttcccctagcatggacaagattttcagccatttttgccacatatacatttttaaggaaaaaagatttttctctgtaagaaagttctggttatgctgttttaaaggtgacttgtcaggagttgagacttccctgccggattctattttgaaagtaaatggtcttccctccttgttccgattctgcgttcccatcgtcagacaactttggagtattagaaaccactgtatatatgtggaaagccaggtcagccagacctgttagaattggtgtgcactcacctgagagatctggcaggttggatatatttatgtgtatttctccacagtgcttgctttgccctgttggtaaggattttaaataaccatgctcaaaagagctgttctaatctgcgttttgcatgttaagtgttaatatcaaacattctttacgtgctcgaggtattgcttttaacattctactttgccagtttcttcattagattaattgacatgtattatttaaatgaccagtgatgctttgtgcaattatgaatgttgaagattaaagtacatagttactaatttgtcgtttgctattaatatgctgaaaactgccaacttctctcttcttttctgtcgagatgatttgggggagccacaggagactggtgtgatttttgctgcatctcctaggaaagcattttttaaaaaaaataaatgaatcaggaaatcagtccaattagggcagggggcctcagctctccagtcagaaagcctggatttcttttcctgctcaggctgggactgaagccaccttcaacaactggatcatggcttcctaccagcgtctcaggggttgactagctgcccttgtctggggcttgtgaaccctgagacagaaggtgcttcatcgatgtacaactacagcaccctgaacagcagtgatggccaaagtttaaataataccttaaatgctttaaaggggtttgtgtttaaggaagggagaaaagaaaaaaagaaaggaagggagaaagaagcaaggaaatgggaagaagggagggcagagagaagaaaagaagcagaaagcgagagagaaaggagaaagctacattacttatttgaaaacaaaaggaacaccctgggctgtaataatgtcaggctcaatctcttgaaaaagtatggaatgatttaaatggcctgcattcattttatcttttatctttttttttttttttaacctttagtggttagccaggaccagcacgatcatattgggcttggtataaatccgaatgaaaagagaccaaataacattcattagttgctcagggatttttcctgtggtgctatttaaattatacaaaaattcttaagactttaggctactcgaccaagaaaacagaacaaaacaaaaaatcgtgttttctctaattcccttgtggaatgtaagtgaaatcagagtcctaggctaggaagaaatacgtaggtaatttttcttgtgttggttttggtttctgtcatgttgtttattggctatagattctgtcttttatgttatctgacttttttagagcgaataattagtttctgtccacctggatttaaatccatgaccaccttcttgctctactctgaagataatcagtaagaacctttctttctccagttctaaaacgttctcagtgtctttaatgtgtgtttattttcttcccaattctttcaaagatttaactcccacgatacttttttttccccaggaaacaccgcaaatgtgtggaatataattcaccagtttaattatgtgagcatgttgagtacttacatgcaggtccattaatttttcactaacaattattttttcatgcaaaagcaataaataacattgtgcttccaaaatgttcagaatacatttgggtagtaatactttcctagatttacaataattattgaaattattattatgacatctttaaatggatacacaggtcagttacaacataaaaaatgtaatggtggaaatttgtcagccttgaattcaggcagaacaggattcggtgcatgattttatgtgttttcgaaacggtgtctgtcacattgtgatcccctgatggctcccctctctgttgctgatcctctttgttctgtacagaagcaaattctcacctgtgtaacatcctgaagcacctggtaaaatgtgaggcaaagagaggccacttctcaaatgctgtggacggatgggctgcatcttttaaaggatatcaatatgtcttcctgttgcaattattttgactataagctcccagagagtgaaaatcaccaaccctgtgacagtggcccttaataagtgttcatgaataaatgaattgaacctgtcaagattgaagtttggatgtgatgcccactgtggtggccactcagtgctagtctgtcattctggagacccagaaagctcgttatcttctgtcccccttgtgtatcctgcctttgtgggcgaggcattcaaaaccctgaggtttttagatctccctctacaggaagtacccagagagctgctgggggtgttattaccctgtctctgccaggcttaaagtatcctcccaaattcagcacgcaaaggtcacacaccacccccatcttaagagtaggttttctcttttgtttcaaatcttgaagatttccagaaaataataatactagccaatgtttgtggagagcttactttgctcctagattcttcattatatgttttgacccatttaatttccacaacagtctgatgaggcaggcacccccattttcagatgaggagactgaggttcgggtagaaattaagtgactcaggtttgccttcagtctctgaccaagggtttgaaaagccaggagccagcctgagaactgtggctccagagggtgttctttcagccactccgctctatgcttctcactctgggtgggcacaaccatgttctcctttggtgatgcctctaacttaccgtgaaaatgtacctttcccttcgctattggcttcccttccctcctagtcagccgagattcttttgaaaactttcctccgcttgcctgcacaaaaggcgatggaaattcaggaactgaaacatctgctctggggaatgcgtatttccacatttccaccgcctgtgtctgctgtcttatcttgaagacaggtgctccagggcttccgaggttattttgtctgttaatggacaccttgcaaagtaccacttaaggaatgagaattacaaacttttaattatattgtagggggaaaaaagtaggctgttttcctgataggtctagccattcattcaataaaccatattgatatgaaatgtgcc

SEQ ID NO: 440494 - DNA, 3579 bp, Homo sapiens
agggtatagggaggcggctgaacaaggttgtgggggtaggaagctagggttagaggcaacccgtgaggctagaaccccgaacgtggtcggttggagaaaatatgtccctccggaggcacattgggaaccctgagtatctgatgaaaaggataccacagaacccaagataccagcatatcaaatcaagactggacactggtaacagtatgactaaatatactgagaagctcgaagagattaagaaaaattatagatacaaaaaagatgagcttttcaagagactaaaagttacaacttttgcccagctgatcatccaagttgcttccctctctgatcaaacactggaagtgacagctgaggagattcaaaggctggaagacaatgattctgcagcttcagaccctgatgctgaaaccactgccaggaccaatgggaaaggaaatccaggtgagcagtcgccgagccctgagcagttcataaacaacgcaggagcaggggactccagccgctcaactcttcagagtgtcatcagtggtgttggggaactggatctagacaaagggccagtgaagaaagcagagccccataccaaagacaaaccttatcctgactgccccttcctgctgctagatgtgcgtgatagagattcttaccagcagtgccacattgttggagcttacagttacccaattgcaactctgtctagaacaatgaacccttattcaaatgatattcttgaatataaaaatgcccatggcaagatcatcattctgtatgacgatgatgaaaggctggccagtcaggcggccaccaccatgtgcgagcgtggatttgaaaacctcttcatgctttccggaggtctaaaagtcttagctcagaaattcccggaaggactgattactggttccctgccagcatcttgccagcaggcccttcctcctgggtctgcccggaaacgatccagccccaaagggccacccctaccagctgagaataaatggagatttaccccagaagacttaaaaaagatagaatattatctggaagaggagcaagggcctgcagatcatcctagccgactgaaccaagctaactcctccggaagagagtccaaggtgcctggtgcccgaagcgctcagaatctgccaggtggcggccccgccagccactcaaacccccgctccctcagcagtggtcacctgcaaggcaaaccctggaagtaaagactttgtctcacttaggcaaataaatgttcttcctcttttcagaacccctgagcatttcccaagttgggtcatttccagaaacttctgcagaggaaagaccatgacatatgtatgggataggcctcttccctgtccctgtctccagttcctctcccctcaggaggccacctcaggaaggattttgacaggtgaccataaaaaccagaggtgtgacaggctctagtctcctccctgttgtttacagcatatttaagtcttgtgaaactgtataggaaaaaagtatctacgtttttagtttttttgttttgtttttttttaataaggtccagcttgttgggtctctctgtgttgttttgtaaatacttcagtcacatctgcccgtgtgcctgtccctgccaccttttcattcactgttcttgacttcatgaaggcttctccgggcagtcttggtgtgagaagctgtttccaagggtgcagatgagccttaggttccagccgcctgcagaccccaccccagcaggctcactcagcaaggagctctctgcccagcatattgcaggccctgttttgagtatggaagccagtgcctgtgtactcactgaaattgaagatgaggaaagtagctgtacactcactgaatgctcccccttactagatatttcctggagccagaaaggtatgcatgtgggtgtcttcacaccggggaggagggcctctcatgggaaagccctggccaccacaccggcctgtgccccttgaagcccaccaaagcggccctcacttgtggtcagtatatcagttatgacgcccattgcccagcttcagtccatccatgttagatggacagaaattatggccagttgaaaataccagctttggttggacaactgtggacacacaaggtgaagaggactccgaagtcctttgtcagggctgacaacctcgtaagcccttgcttagaaatacagtattagtctaattgagtaattagtgcaatttcctgcttacttttcattctcatgactgaactgtgattaggaagttgtgattatagattctggttttggccggaattttgaatcagcattaattgaattgctaaatgactgacattcattccatttaattgggggaacaaaaggcctcaggtaaggatgaggaactctgaaatcagatggaaaagagcggtgttaatttttatggtctgtgatcgtagctgtgataagggactgaggaataaattgtgctctttgtcatggcaaccagcttctgaaaagcccactgaaaattgcctgtcctgctggtaactgctacggggtaagatttgccttaacagtactattttctcgccaccaaaaaaaaaaaaaaaaaaaaaaaaaaatgcaccacagtatttctagcatgggggctgtgtttgtatgagaaataaacgtaataaatatctcatagagacatatggaaaaataactttcagattcagcccagttctgttttagagtgtgtttattcttctctacttgatttccaaagtgcaacattttccgatgctttagaaatcaaacaaaccagggacattgttcagatgtcaagccatgcccaattttccacaagattcaagaatcttgtataaaattcagccaacgtacacatagctttaatgaggagcctgtcatgtttccccataaatttattgcctgagaacttagttcagcctttgctaatgccaaaatgctctggctttgtattttctttacagcatagatagaaaaatgcacatttttccacactcagctttcccctagcatggacaagattttcagccatttttgccacatatacatttttaaggaaaaaagatttttctctgtaagaaagttctggttatgctgttttaaaggtgacttgtcaggagttgagacttccctgccggattctattttgaaagtaaatggtcttccctccttgttccgattctgcgttcccatcgtcagacaactttggagtattagaaaccactgtatatatgtggaaagccaggtcagccagacctgttagaattggtgtgcactcacctgagagatctggcaggttggatatatttatgtgtatttctccacagtgcttgctttgccctgttggtaaggattttaaataaccatgctcaaaagagctgttctaatctgcgttttgcatgttaagtgttaatatcaaacattctttacgtgctcgaggtattgcttttaacattctactttgccagtttcttcattagattaattgacatgtattatttaaatgaccagtgatgctttgtgcaattatgaatgttgaagattaaagtacatagttacta

SEQ ID NO: 440495 - DNA, 6275 bp, Homo sapiens
agggtatagggaggcggctgaacaaggttgtgggggtaggaagctagggttagaggcaacccgtgaggctagaaccccgaacgtggtcggttggagaaaatatgtccctccggaggcacattgggaaccctgagtatctgatgaaaaggataccacagaacccaagataccagcatatcaaatcaagactggacactggtaacagtatgactaaatatactgagaagctcgaagagattaagaaaaattatagatacaaaaaagatgagcttttcaagagactaaaagttacaacttttgcccagctgatcatccaagttgcttccctctctgatcaaacactggaagtgacagctgaggagattcaaaggctggaagacaatgattctgcagcttcagaccctgatgctgaaaccactgccaggaccaatgggaaaggaaatccagtgtcatcagtggtgttggggaactggatctagacaaagggccagtgaagaaagcagagccccataccaaagacaaaccttatcctgactgccccttcctgctgctagatgtgcgtgatagagattcttaccagcagtgccacattgttggagcttacagttacccaattgcaactctgtctagaacaatgaacccttattcaaatgatattcttgaatataaaaatgcccatggcaagatcatcattctgtatgacgatgatgaaaggctggccagtcaggcggccaccaccatgtgcgagcgtggatttgaaaacctcttcatgctttccggaggtctaaaagtcttagctcagaaattcccggaaggactgattactggttccctgccagcatcttgccagcaggcccttcctcctgggtctgcccggaaacgatccagccccaaagggccacccctaccagctgagaataaatggagatttaccccagaagacttaaaaaagatagaatattatctggaagaggagcaagggcctgcagatcatcctagccgactgaaccaagctaactcctccggaagagagtccaaggtgcctggtgcccgaagcgctcagaatctgccaggtggcggccccgccagccactcaaacccccgctccctcagcagtggtcacctgcaaggcaaaccctggaagtaaagactttgtctcacttaggcaaataaatgttcttcctcttttcagaacccctgagcatttcccaagttgggtcatttccagaaacttctgcagaggaaagaccatgacatatgtatgggataggcctcttccctgtccctgtctccagttcctctcccctcaggaggccacctcaggaaggattttgacaggtgaccataaaaaccagaggtgtgacaggctctagtctcctccctgttgtttacagcatatttaagtcttgtgaaactgtataggaaaaaagtatctacgtttttagtttttttgttttgtttttttttaataaggtccagcttgttgggtctctctgtgttgttttgtaaatacttcagtcacatctgcccgtgtgcctgtccctgccaccttttcattcactgttcttgacttcatgaaggcttctccgggcagtcttggtgtgagaagctgtttccaagggtgcagatgagccttaggttccagccgcctgcagaccccaccccagcaggctcactcagcaaggagctctctgcccagcatattgcaggccctgttttgagtatggaagccagtgcctgtgtactcactgaaattgaagatgaggaaagtagctgtacactcactgaatgctcccccttactagatatttcctggagccagaaaggtatgcatgtgggtgtcttcacaccggggaggagggcctctcatgggaaagccctggccaccacaccggcctgtgccccttgaagcccaccaaagcggccctcacttgtggtcagtatatcagttatgacgcccattgcccagcttcagtccatccatgttagatggacagaaattatggccagttgaaaataccagctttggttggacaactgtggacacacaaggtgaagaggactccgaagtcctttgtcagggctgacaacctcgtaagcccttgcttagaaatacagtattagtctaattgagtaattagtgcaatttcctgcttacttttcattctcatgactgaactgtgattaggaagttgtgattatagattctggttttggccggaattttgaatcagcattaattgaattgctaaatgactgacattcattccatttaattgggggaacaaaaggcctcaggtaaggatgaggaactctgaaatcagatggaaaagagcggtgttaatttttatggtctgtgatcgtagctgtgataagggactgaggaataaattgtgctctttgtcatggcaaccagcttctgaaaagcccactgaaaattgcctgtcctgctggtaactgctacggggtaagatttgccttaacagtactattttctcgccaccaaaaaaaaaaaaaaaaaaaaaaaaaaatgcaccacagtatttctagcatgggggctgtgtttgtatgagaaataaacgtaataaatatctcatagagacatatggaaaaataactttcagattcagcccagttctgttttagagtgtgtttattcttctctacttgatttccaaagtgcaacattttccgatgctttagaaatcaaacaaaccagggacattgttcagatgtcaagccatgcccaattttccacaagattcaagaatcttgtataaaattcagccaacgtacacatagctttaatgaggagcctgtcatgtttccccataaatttattgcctgagaacttagttcagcctttgctaatgccaaaatgctctggctttgtattttctttacagcatagatagaaaaatgcacatttttccacactcagctttcccctagcatggacaagattttcagccatttttgccacatatacatttttaaggaaaaaagatttttctctgtaagaaagttctggttatgctgttttaaaggtgacttgtcaggagttgagacttccctgccggattctattttgaaagtaaatggtcttccctccttgttccgattctgcgttcccatcgtcagacaactttggagtattagaaaccactgtatatatgtggaaagccaggtcagccagacctgttagaattggtgtgcactcacctgagagatctggcaggttggatatatttatgtgtatttctccacagtgcttgctttgccctgttggtaaggattttaaataaccatgctcaaaagagctgttctaatctgcgttttgcatgttaagtgttaatatcaaacattctttacgtgctcgaggtattgcttttaacattctactttgccagtttcttcattagattaattgacatgtattatttaaatgaccagtgatgctttgtgcaattatgaatgttgaagattaaagtacatagttactaatttgtcgtttgctattaatatgctgaaaactgccaacttctctcttcttttctgtcgagatgatttgggggagccacaggagactggtgtgatttttgctgcatctcctaggaaagcattttttaaaaaaaataaatgaatcaggaaatcagtccaattagggcagggggcctcagctctccagtcagaaagcctggatttcttttcctgctcaggctgggactgaagccaccttcaacaactggatcatggcttcctaccagcgtctcaggggttgactagctgcccttgtctggggcttgtgaaccctgagacagaaggtgcttcatcgatgtacaactacagcaccctgaacagcagtgatggccaaagtttaaataataccttaaatgctttaaaggggtttgtgtttaaggaagggagaaaagaaaaaaagaaaggaagggagaaagaagcaaggaaatgggaagaagggagggcagagagaagaaaagaagcagaaagcgagagagaaaggagaaagctacattacttatttgaaaacaaaaggaacaccctgggctgtaataatgtcaggctcaatctcttgaaaaagtatggaatgatttaaatggcctgcattcattttatcttttatctttttttttttttttaacctttagtggttagccaggaccagcacgatcatattgggcttggtataaatccgaatgaaaagagaccaaataacattcattagttgctcagggatttttcctgtggtgctatttaaattatacaaaaattcttaagactttaggctactcgaccaagaaaacagaacaaaacaaaaaatcgtgttttctctaattcccttgtggaatgtaagtgaaatcagagtcctaggctaggaagaaatacgtaggtaatttttcttgtgttggttttggtttctgtcatgttgtttattggctatagattctgtcttttatgttatctgacttttttagagcgaataattagtttctgtccacctggatttaaatccatgaccaccttcttgctctactctgaagataatcagtaagaacctttctttctccagttctaaaacgttctcagtgtctttaatgtgtgtttattttcttcccaattctttcaaagatttaactcccacgatacttttttttccccaggaaacaccgcaaatgtgtggaatataattcaccagtttaattatgtgagcatgttgagtacttacatgcaggtccattaatttttcactaacaattattttttcatgcaaaagcaataaataacattgtgcttccaaaatgttcagaatacatttgggtagtaatactttcctagatttacaataattattgaaattattattatgacatctttaaatggatacacaggtcagttacaacataaaaaatgtaatggtggaaatttgtcagccttgaattcaggcagaacaggattcggtgcatgattttatgtgttttcgaaacggtgtctgtcacattgtgatcccctgatggctcccctctctgttgctgatcctctttgttctgtacagaagcaaattctcacctgtgtaacatcctgaagcacctggtaaaatgtgaggcaaagagaggccacttctcaaatgctgtggacggatgggctgcatcttttaaaggatatcaatatgtcttcctgttgcaattattttgactataagctcccagagagtgaaaatcaccaaccctgtgacagtggcccttaataagtgttcatgaataaatgaattgaacctgtcaagattgaagtttggatgtgatgcccactgtggtggccactcagtgctagtctgtcattctggagacccagaaagctcgttatcttctgtcccccttgtgtatcctgcctttgtgggcgaggcattcaaaaccctgaggtttttagatctccctctacaggaagtacccagagagctgctgggggtgttattaccctgtctctgccaggcttaaagtatcctcccaaattcagcacgcaaaggtcacacaccacccccatcttaagagtaggttttctcttttgtttcaaatcttgaagatttccagaaaataataatactagccaatgtttgtggagagcttactttgctcctagattcttcattatatgttttgacccatttaatttccacaacagtctgatgaggcaggcacccccattttcagatgaggagactgaggttcgggtagaaattaagtgactcaggtttgccttcagtctctgaccaagggtttgaaaagccaggagccagcctgagaactgtggctccagagggtgttctttcagccactccgctctatgcttctcactctgggtgggcacaaccatgttctcctttggtgatgcctctaacttaccgtgaaaatgtacctttcccttcgctattggcttcccttccctcctagtcagccgagattcttttgaaaactttcctccgcttgcctgcacaaaaggcgatggaaattcaggaactgaaacatctgctctggggaatgcgtatttccacatttccaccgcctgtgtctgctgtcttatcttgaagacaggtgctccagggcttccgaggttattttgtctgttaatggacaccttgcaaagtaccacttaaggaatgagaattacaaacttttaattatattgtagggggaaaaaagtaggctgttttcctgataggtctagccattcattcaataaaccatattgatatgaaatgtgcc

SEQ ID NO: 440496 - DNA, 1269 bp, Homo sapiens
agggtatagggaggcggctgaacaaggttgtgggggtaggaagctagggttagaggcaacccgtgaggctagaaccccgaacgtggtcggttggagaaaatatgtccctccggaggcacattgggaaccctgagtatctgatgaaaaggataccacagaacccaagataccagcatatcaaatcaagactggacactggtaacagtatgactaaatatactgagaagctcgaagagattaagaaaaattatagatacaaaaaagatgagcttttcaagagactaaaagttacaacttttgcccagctgatcatccaagttgcttccctctctgatcaaacactggaagtgacagctgaggagattcaaaggctggaagacaatgattctgcagcttcagaccctgatgctgaaaccactgccaggaccaatgggaaaggaaatccaggtgagcagtcgccgagccctgagcagttcataaacaacgcaggagcaggggactccagccgctcaactcttcagagtgtcatcagtggtgttggggaactggatctagacaaagggccagtgaagaaagcagagccccataccaaagacaaaccttatcctgactgccccttcctgctgctagatgtgcgtgatagagattcttaccagcagtgccacattgttggagcttacagttacccaattgcaactctgtctagaacaatgaacccttattcaaatgatattcttgaatataaaaatgcccatggcaagatcatcattctgtatgacgatgatgaaaggctggccagtcaggcggccaccaccatgtgcgagcgtggatttgaaaacctcttcatgctttccggaggtctaaaagtcttagctcagaaattcccggaaggactgattactggttccctgccagcatcttgccagcaggcccttcctcctgggtctgcccggaaacgatccagccccaaagggccacccctaccagctgagaataaatggagatttaccccagaagacttaaaaaagatagaatattatctggaagaggagcaagggcctgcagatcatcctagccgactgaaccaagctaactcctccggaagagagtccaaggtgcctggtgcccgaagcgctcagaatctgccaggtggcggccccgccagccactcaaacccccgctccctcagcagtggtcacctgcaaggcaaaccctggaagtaaagactttgtctcacttaggcaaataaatgttcttcctcttttcaga

SEQ ID NO: 440497 - DNA, 394 bp, Homo sapiens
tagagatgaggcctcaccatgttgcccgggctggtctcaaactcctggactcaagcggtccacccaccttggcctcccaaagtgctgggattataggtgttagccaccatgcccagcagctcatggattttgaagatgtatttaactcttagattttaaaccagctgggaattgaggccaagttgtattaagagaacaacagacttcctaaactttttcttctctttgcagcttacagttacccaattgcaactctgtctagaacaatgaacccttattcaaatgatattcttgaatatgtatcctttgttgcattttaaggaattgggtggtatgaggattgtaagaatcaaagttatcatgaaccacgctcctggtaagaatgctgtgaagg

SEQ ID NO: 440498 - DNA, 6219 bp, Homo sapiens
agggtatagggaggcggctgaacaaggttgtgggggtaggaagctagggttagaggcaacccgtgaggctagaaccccgaacgtggtcggttggagaaaatatgtccctccggaggcacattgggaaccctgagtatctgatgaaaaggataccacagaacccaagataccagcatatcaaatcaagactggacactggtaacagtatgactaaatatactgagaagctcgaagagattaagaaaaacaatgattctgcagcttcagaccctgatgctgaaaccactgccaggaccaatgggaaaggaaatccaggtgagcagtcgccgagccctgagcagttcataaacaacgcaggagcaggggactccagccgctcaactcttcagagtgtcatcagtggtgttggggaactggatctagacaaagggccagtgaagaaagcagagccccataccaaagacaaaccttatcctgactgccccttcctgctgctagatgtgcgtgatagagattcttaccagcagtgccacattgttggagcttacagttacccaattgcaactctgtctagaacaatgaacccttattcaaatgatattcttgaatataaaaatgcccatggcaagatcatcattctgtatgacgatgatgaaaggctggccagtcaggcggccaccaccatgtgcgagcgtggatttgaaaacctcttcatgctttccggaggtctaaaagtcttagctcagaaattcccggaaggactgattactggttccctgccagcatcttgccagcaggcccttcctcctgggtctgcccggaaacgatccagccccaaagggccacccctaccagctgagaataaatggagatttaccccagaagacttaaaaaagatagaatattatctggaagaggagcaagggcctgcagatcatcctagccgactgaaccaagctaactcctccggaagagagtccaaggtgcctggtgcccgaagcgctcagaatctgccaggtggcggccccgccagccactcaaacccccgctccctcagcagtggtcacctgcaaggcaaaccctggaagtaaagactttgtctcacttaggcaaataaatgttcttcctcttttcagaacccctgagcatttcccaagttgggtcatttccagaaacttctgcagaggaaagaccatgacatatgtatgggataggcctcttccctgtccctgtctccagttcctctcccctcaggaggccacctcaggaaggattttgacaggtgaccataaaaaccagaggtgtgacaggctctagtctcctccctgttgtttacagcatatttaagtcttgtgaaactgtataggaaaaaagtatctacgtttttagtttttttgttttgtttttttttaataaggtccagcttgttgggtctctctgtgttgttttgtaaatacttcagtcacatctgcccgtgtgcctgtccctgccaccttttcattcactgttcttgacttcatgaaggcttctccgggcagtcttggtgtgagaagctgtttccaagggtgcagatgagccttaggttccagccgcctgcagaccccaccccagcaggctcactcagcaaggagctctctgcccagcatattgcaggccctgttttgagtatggaagccagtgcctgtgtactcactgaaattgaagatgaggaaagtagctgtacactcactgaatgctcccccttactagatatttcctggagccagaaaggtatgcatgtgggtgtcttcacaccggggaggagggcctctcatgggaaagccctggccaccacaccggcctgtgccccttgaagcccaccaaagcggccctcacttgtggtcagtatatcagttatgacgcccattgcccagcttcagtccatccatgttagatggacagaaattatggccagttgaaaataccagctttggttggacaactgtggacacacaaggtgaagaggactccgaagtcctttgtcagggctgacaacctcgtaagcccttgcttagaaatacagtattagtctaattgagtaattagtgcaatttcctgcttacttttcattctcatgactgaactgtgattaggaagttgtgattatagattctggttttggccggaattttgaatcagcattaattgaattgctaaatgactgacattcattccatttaattgggggaacaaaaggcctcaggtaaggatgaggaactctgaaatcagatggaaaagagcggtgttaatttttatggtctgtgatcgtagctgtgataagggactgaggaataaattgtgctctttgtcatggcaaccagcttctgaaaagcccactgaaaattgcctgtcctgctggtaactgctacggggtaagatttgccttaacagtactattttctcgccaccaaaaaaaaaaaaaaaaaaaaaaaaaaatgcaccacagtatttctagcatgggggctgtgtttgtatgagaaataaacgtaataaatatctcatagagacatatggaaaaataactttcagattcagcccagttctgttttagagtgtgtttattcttctctacttgatttccaaagtgcaacattttccgatgctttagaaatcaaacaaaccagggacattgttcagatgtcaagccatgcccaattttccacaagattcaagaatcttgtataaaattcagccaacgtacacatagctttaatgaggagcctgtcatgtttccccataaatttattgcctgagaacttagttcagcctttgctaatgccaaaatgctctggctttgtattttctttacagcatagatagaaaaatgcacatttttccacactcagctttcccctagcatggacaagattttcagccatttttgccacatatacatttttaaggaaaaaagatttttctctgtaagaaagttctggttatgctgttttaaaggtgacttgtcaggagttgagacttccctgccggattctattttgaaagtaaatggtcttccctccttgttccgattctgcgttcccatcgtcagacaactttggagtattagaaaccactgtatatatgtggaaagccaggtcagccagacctgttagaattggtgtgcactcacctgagagatctggcaggttggatatatttatgtgtatttctccacagtgcttgctttgccctgttggtaaggattttaaataaccatgctcaaaagagctgttctaatctgcgttttgcatgttaagtgttaatatcaaacattctttacgtgctcgaggtattgcttttaacattctactttgccagtttcttcattagattaattgacatgtattatttaaatgaccagtgatgctttgtgcaattatgaatgttgaagattaaagtacatagttactaatttgtcgtttgctattaatatgctgaaaactgccaacttctctcttcttttctgtcgagatgatttgggggagccacaggagactggtgtgatttttgctgcatctcctaggaaagcattttttaaaaaaaataaatgaatcaggaaatcagtccaattagggcagggggcctcagctctccagtcagaaagcctggatttcttttcctgctcaggctgggactgaagccaccttcaacaactggatcatggcttcctaccagcgtctcaggggttgactagctgcccttgtctggggcttgtgaaccctgagacagaaggtgcttcatcgatgtacaactacagcaccctgaacagcagtgatggccaaagtttaaataataccttaaatgctttaaaggggtttgtgtttaaggaagggagaaaagaaaaaaagaaaggaagggagaaagaagcaaggaaatgggaagaagggagggcagagagaagaaaagaagcagaaagcgagagagaaaggagaaagctacattacttatttgaaaacaaaaggaacaccctgggctgtaataatgtcaggctcaatctcttgaaaaagtatggaatgatttaaatggcctgcattcattttatcttttatctttttttttttttttaacctttagtggttagccaggaccagcacgatcatattgggcttggtataaatccgaatgaaaagagaccaaataacattcattagttgctcagggatttttcctgtggtgctatttaaattatacaaaaattcttaagactttaggctactcgaccaagaaaacagaacaaaacaaaaaatcgtgttttctctaattcccttgtggaatgtaagtgaaatcagagtcctaggctaggaagaaatacgtaggtaatttttcttgtgttggttttggtttctgtcatgttgtttattggctatagattctgtcttttatgttatctgacttttttagagcgaataattagtttctgtccacctggatttaaatccatgaccaccttcttgctctactctgaagataatcagtaagaacctttctttctccagttctaaaacgttctcagtgtctttaatgtgtgtttattttcttcccaattctttcaaagatttaactcccacgatacttttttttccccaggaaacaccgcaaatgtgtggaatataattcaccagtttaattatgtgagcatgttgagtacttacatgcaggtccattaatttttcactaacaattattttttcatgcaaaagcaataaataacattgtgcttccaaaatgttcagaatacatttgggtagtaatactttcctagatttacaataattattgaaattattattatgacatctttaaatggatacacaggtcagttacaacataaaaaatgtaatggtggaaatttgtcagccttgaattcaggcagaacaggattcggtgcatgattttatgtgttttcgaaacggtgtctgtcacattgtgatcccctgatggctcccctctctgttgctgatcctctttgttctgtacagaagcaaattctcacctgtgtaacatcctgaagcacctggtaaaatgtgaggcaaagagaggccacttctcaaatgctgtggacggatgggctgcatcttttaaaggatatcaatatgtcttcctgttgcaattattttgactataagctcccagagagtgaaaatcaccaaccctgtgacagtggcccttaataagtgttcatgaataaatgaattgaacctgtcaagattgaagtttggatgtgatgcccactgtggtggccactcagtgctagtctgtcattctggagacccagaaagctcgttatcttctgtcccccttgtgtatcctgcctttgtgggcgaggcattcaaaaccctgaggtttttagatctccctctacaggaagtacccagagagctgctgggggtgttattaccctgtctctgccaggcttaaagtatcctcccaaattcagcacgcaaaggtcacacaccacccccatcttaagagtaggttttctcttttgtttcaaatcttgaagatttccagaaaataataatactagccaatgtttgtggagagcttactttgctcctagattcttcattatatgttttgacccatttaatttccacaacagtctgatgaggcaggcacccccattttcagatgaggagactgaggttcgggtagaaattaagtgactcaggtttgccttcagtctctgaccaagggtttgaaaagccaggagccagcctgagaactgtggctccagagggtgttctttcagccactccgctctatgcttctcactctgggtgggcacaaccatgttctcctttggtgatgcctctaacttaccgtgaaaatgtacctttcccttcgctattggcttcccttccctcctagtcagccgagattcttttgaaaactttcctccgcttgcctgcacaaaaggcgatggaaattcaggaactgaaacatctgctctggggaatgcgtatttccacatttccaccgcctgtgtctgctgtcttatcttgaagacaggtgctccagggcttccgaggttattttgtctgttaatggacaccttgcaaagtaccacttaaggaatgagaattacaaacttttaattatattgtagggggaaaaaagtaggctgttttcctgataggtctagccattcattcaataaaccatattgatatgaaatgtgcc

SEQ ID NO: 440499 - DNA, 6135 bp, Homo sapiens
agggtatagggaggcggctgaacaaggttgtgggggtaggaagctagggttagaggcaacccgtgaggctagaaccccgaacgtggtcggttggagaaaatatgtccctccggaggcacattgggaaccctgagtatctgatgaaaaggataccacagaacccaagataccagcatatcaaatcaagactggacactggtaacagtatgactaaatatactgagaagctcgaagagattaagaaaaattatagatacaaaaaagatgagcttttcaagagactaaaagttacaacttttgcccagctgatcatccaagttgcttccctctctgatcaaacactggaagtgacagctgaggagattcaaaggctggaagacaatgattctgcagcttcagaccctgatgctgaaaccactgccaggaccaatgggaaaggaaatccaggtgagcagtcgccgagccctgagcagttcataaacaacgcaggagcaggggactccagccgctcaactcttcagagtgtcatcagtggtgttggggaactggatctagacaaagggccagtgaagaaagcagagccccataccaaagacaaaccttatcctgactgccccttcctgctgctagatgtgcgtgatagagattcttaccagcagtgccacattgttggagcttacagttacccaattgcaactctgtctagaacaatgaacccttattcaaatgatattcttgaatataaaaatgcccatggcaagatcatcattctgtatgacgatgatgaaaggctggccagtcaggcggccaccaccatgtgcgagcgtggatttgaaaacctcttcatgctttccggaggccgactgaaccaagctaactcctccggaagagagtccaaggtgcctggtgcccgaagcgctcagaatctgccaggtggcggccccgccagccactcaaacccccgctccctcagcagtggtcacctgcaaggcaaaccctggaagtaaagactttgtctcacttaggcaaataaatgttcttcctcttttcagaacccctgagcatttcccaagttgggtcatttccagaaacttctgcagaggaaagaccatgacatatgtatgggataggcctcttccctgtccctgtctccagttcctctcccctcaggaggccacctcaggaaggattttgacaggtgaccataaaaaccagaggtgtgacaggctctagtctcctccctgttgtttacagcatatttaagtcttgtgaaactgtataggaaaaaagtatctacgtttttagtttttttgttttgtttttttttaataaggtccagcttgttgggtctctctgtgttgttttgtaaatacttcagtcacatctgcccgtgtgcctgtccctgccaccttttcattcactgttcttgacttcatgaaggcttctccgggcagtcttggtgtgagaagctgtttccaagggtgcagatgagccttaggttccagccgcctgcagaccccaccccagcaggctcactcagcaaggagctctctgcccagcatattgcaggccctgttttgagtatggaagccagtgcctgtgtactcactgaaattgaagatgaggaaagtagctgtacactcactgaatgctcccccttactagatatttcctggagccagaaaggtatgcatgtgggtgtcttcacaccggggaggagggcctctcatgggaaagccctggccaccacaccggcctgtgccccttgaagcccaccaaagcggccctcacttgtggtcagtatatcagttatgacgcccattgcccagcttcagtccatccatgttagatggacagaaattatggccagttgaaaataccagctttggttggacaactgtggacacacaaggtgaagaggactccgaagtcctttgtcagggctgacaacctcgtaagcccttgcttagaaatacagtattagtctaattgagtaattagtgcaatttcctgcttacttttcattctcatgactgaactgtgattaggaagttgtgattatagattctggttttggccggaattttgaatcagcattaattgaattgctaaatgactgacattcattccatttaattgggggaacaaaaggcctcaggtaaggatgaggaactctgaaatcagatggaaaagagcggtgttaatttttatggtctgtgatcgtagctgtgataagggactgaggaataaattgtgctctttgtcatggcaaccagcttctgaaaagcccactgaaaattgcctgtcctgctggtaactgctacggggtaagatttgccttaacagtactattttctcgccaccaaaaaaaaaaaaaaaaaaaaaaaaaaatgcaccacagtatttctagcatgggggctgtgtttgtatgagaaataaacgtaataaatatctcatagagacatatggaaaaataactttcagattcagcccagttctgttttagagtgtgtttattcttctctacttgatttccaaagtgcaacattttccgatgctttagaaatcaaacaaaccagggacattgttcagatgtcaagccatgcccaattttccacaagattcaagaatcttgtataaaattcagccaacgtacacatagctttaatgaggagcctgtcatgtttccccataaatttattgcctgagaacttagttcagcctttgctaatgccaaaatgctctggctttgtattttctttacagcatagatagaaaaatgcacatttttccacactcagctttcccctagcatggacaagattttcagccatttttgccacatatacatttttaaggaaaaaagatttttctctgtaagaaagttctggttatgctgttttaaaggtgacttgtcaggagttgagacttccctgccggattctattttgaaagtaaatggtcttccctccttgttccgattctgcgttcccatcgtcagacaactttggagtattagaaaccactgtatatatgtggaaagccaggtcagccagacctgttagaattggtgtgcactcacctgagagatctggcaggttggatatatttatgtgtatttctccacagtgcttgctttgccctgttggtaaggattttaaataaccatgctcaaaagagctgttctaatctgcgttttgcatgttaagtgttaatatcaaacattctttacgtgctcgaggtattgcttttaacattctactttgccagtttcttcattagattaattgacatgtattatttaaatgaccagtgatgctttgtgcaattatgaatgttgaagattaaagtacatagttactaatttgtcgtttgctattaatatgctgaaaactgccaacttctctcttcttttctgtcgagatgatttgggggagccacaggagactggtgtgatttttgctgcatctcctaggaaagcattttttaaaaaaaataaatgaatcaggaaatcagtccaattagggcagggggcctcagctctccagtcagaaagcctggatttcttttcctgctcaggctgggactgaagccaccttcaacaactggatcatggcttcctaccagcgtctcaggggttgactagctgcccttgtctggggcttgtgaaccctgagacagaaggtgcttcatcgatgtacaactacagcaccctgaacagcagtgatggccaaagtttaaataataccttaaatgctttaaaggggtttgtgtttaaggaagggagaaaagaaaaaaagaaaggaagggagaaagaagcaaggaaatgggaagaagggagggcagagagaagaaaagaagcagaaagcgagagagaaaggagaaagctacattacttatttgaaaacaaaaggaacaccctgggctgtaataatgtcaggctcaatctcttgaaaaagtatggaatgatttaaatggcctgcattcattttatcttttatctttttttttttttttaacctttagtggttagccaggaccagcacgatcatattgggcttggtataaatccgaatgaaaagagaccaaataacattcattagttgctcagggatttttcctgtggtgctatttaaattatacaaaaattcttaagactttaggctactcgaccaagaaaacagaacaaaacaaaaaatcgtgttttctctaattcccttgtggaatgtaagtgaaatcagagtcctaggctaggaagaaatacgtaggtaatttttcttgtgttggttttggtttctgtcatgttgtttattggctatagattctgtcttttatgttatctgacttttttagagcgaataattagtttctgtccacctggatttaaatccatgaccaccttcttgctctactctgaagataatcagtaagaacctttctttctccagttctaaaacgttctcagtgtctttaatgtgtgtttattttcttcccaattctttcaaagatttaactcccacgatacttttttttccccaggaaacaccgcaaatgtgtggaatataattcaccagtttaattatgtgagcatgttgagtacttacatgcaggtccattaatttttcactaacaattattttttcatgcaaaagcaataaataacattgtgcttccaaaatgttcagaatacatttgggtagtaatactttcctagatttacaataattattgaaattattattatgacatctttaaatggatacacaggtcagttacaacataaaaaatgtaatggtggaaatttgtcagccttgaattcaggcagaacaggattcggtgcatgattttatgtgttttcgaaacggtgtctgtcacattgtgatcccctgatggctcccctctctgttgctgatcctctttgttctgtacagaagcaaattctcacctgtgtaacatcctgaagcacctggtaaaatgtgaggcaaagagaggccacttctcaaatgctgtggacggatgggctgcatcttttaaaggatatcaatatgtcttcctgttgcaattattttgactataagctcccagagagtgaaaatcaccaaccctgtgacagtggcccttaataagtgttcatgaataaatgaattgaacctgtcaagattgaagtttggatgtgatgcccactgtggtggccactcagtgctagtctgtcattctggagacccagaaagctcgttatcttctgtcccccttgtgtatcctgcctttgtgggcgaggcattcaaaaccctgaggtttttagatctccctctacaggaagtacccagagagctgctgggggtgttattaccctgtctctgccaggcttaaagtatcctcccaaattcagcacgcaaaggtcacacaccacccccatcttaagagtaggttttctcttttgtttcaaatcttgaagatttccagaaaataataatactagccaatgtttgtggagagcttactttgctcctagattcttcattatatgttttgacccatttaatttccacaacagtctgatgaggcaggcacccccattttcagatgaggagactgaggttcgggtagaaattaagtgactcaggtttgccttcagtctctgaccaagggtttgaaaagccaggagccagcctgagaactgtggctccagagggtgttctttcagccactccgctctatgcttctcactctgggtgggcacaaccatgttctcctttggtgatgcctctaacttaccgtgaaaatgtacctttcccttcgctattggcttcccttccctcctagtcagccgagattcttttgaaaactttcctccgcttgcctgcacaaaaggcgatggaaattcaggaactgaaacatctgctctggggaatgcgtatttccacatttccaccgcctgtgtctgctgtcttatcttgaagacaggtgctccagggcttccgaggttattttgtctgttaatggacaccttgcaaagtaccacttaaggaatgagaattacaaacttttaattatattgtagggggaaaaaagtaggctgttttcctgataggtctagccattcattcaataaaccatattgatatgaaatgtgcc

SEQ ID NO: 440500 - DNA, 8149 bp, Homo sapiens
agagatgggtctcgccatcaccatgttgcccagtctggtctccaactcctgggctcaagcgatcctcctgccttggtctcccaaagtgctgggattacaggtgtgagcccccacacccggcctgagtgagtgggttctgaatggtgactgttgttgtccatagccttccccctgcttctgagagtggagtccctcccctcatgttggagacctcccaaggtccatgtggtcctataggggctgttcagcctccctagccccttaacgtgtcaggtaatactgtatatattccatgaaatgtgaataattagttatataattcctaagcacttattttaaaaaacagcaatgtgatgcttaactcttcccacctctgttcctgtcccccttagaaaaccactgataactctttttttttttgagacggagtcttgccctgtcgcccaggctggagtgtagtggcctgatctcggctcggctcattgtaacctccgcctcgggtttgagcgattctcctgcctcagcctcctgagtagctgggattataggcgtgcaccaccacgcctggctaattttttgtatctttagtagggacgggtttcaccatgttggccagagtggtcttgaactcctgaccttgtgatccgctcgcctcagcctcccaaagtgctgggattacaggcatgagccaccgtgcctgtcctagaaccactggtaactcttaactgtgttctaagaacggaagcatctgggctggatggaatttagcatcaagcagagtcccctttctgttcagagtgttgtaaagtgcataaagatgaagcaggcaccagaaatcctcggcagtgccaacgggaagactccgagctgcgaggtgaaccgcgagtgttctgtgttcctcagcaaagcccagctctccagtagcctgcaggagggggtcatgcagaagtttaacggccacgacgccctgccctttattccagccgacaagctgaaagatcttacttcccgggtgtttaatggagaacccggcgcacacgatgccaaactgcgttttgagtcccaggaaatgaaagggattgggacaccccctaacactacccctatcaaaaatggctctccagaaattaagctgaaaatcaccaaaacatacatgaatgggaagcctctctttgaatcttccatttgtggtgacagtgctgctgatgtgtctcagtcagaagaaaatggacaaaaaccagaaaacaaggcgagaaggaacaggaagaggagcataaaatatgactccttgctggagcagggccttgtcgaagcagctcttgtgtctaagatctcaagtccttcagataaaaagattccagctaagaaagagtcttgtccaaacactggaagagacaaagaccacctgttgaaatacaacgttggtgatttggtgtggtccaaagtgtcgggttacccttggtggccttgcatggtttctgcagatccactccttcacagctataccaaacttaaaggtcagaaaaagagtgcacgccagtatcacgtacagttctttggtgacgccccagaaagagcttggatatttgagaagagcctcgtagcttttgaaggagaaggacagtttgaaaaattatgccaggaaagtgccaagcaggcacccacgaaagctgagaaaattaagctattgaaaccaatttcagggaaattgagggcccagtgggaaatgggcattgttcaagcagaagaagctgcaagcatgtcagtggaggagcggaaagccaagttcacctttctctatgtgggggaccagcttcatctcaaccctcaagtagccaaggaggctggcattgctgcagagtctttgggagaaatggcagaatcctcaggagtcagtgaagaagctgctgaaaaccccaagtctgtgagagaagagtgcattcccatgaagagaaggcggagggccaaactgtgtagctctgcagagaccctggagagtcaccccgacatagggaagagtactcctcaaaagacggcagaggctgaccccagaagaggagtagggtctcctcctgggaggaagaagaccacagtctccatgccacgaagcaggaagggagatgcagcatcccagtttttggtcttctgtcaaaaacacagggatgaggtggtagctgagcacccagatgcttcaggtgaggagattgaagagctgctcaggtcacagtggagtctgctgagtgagaagcagagagcacgctacaacaccaagtttgccctggtggcccctgtccaggctgaagaagactctggtaatgtaaatgggaaaaaaagaaaccacacaaagaggatacaggaccctacagaagatgctgaagctgaggacacacccaggaaaagactcaggacggacaagcacagtcttcggaagagagacacaatcactgacaaaacggccagaacaagctcttacaaggccatggaggcagcctcctcgctcaagagccaggcagcaacgaaaaatctgtctgatgcatgtaaaccactgaagaagcgaaatcgggcttccacggcagcatcttcagctcttgggtttagcaaaagttcatctccttctgcatccttaactgagaatgaggtctcggacagcccgggagacgagccctcggagtccccatacgaaagtgcagacgaaacacaaactgaagtatctgtctcatccaaaaagtctgagcgaggagtgactgccaaaaaggagtatgtgtgccagctgtgtgagaagccgggcagcctcctgctctgtgaaggaccctgctgcggagctttccacctcgcctgccttgggctttcccggaggccagaagggaggttcacctgcagcgagtgtgcctcagggattcactcatgtttcgtgtgtaaagagagcaagacagatgttaagcgctgtgtggtaactcagtgtggaaaattttaccatgaggcttgtgtgaaaaaataccctctgactgtatttgagagccgaggtttccgctgccccctccacagctgtgtgagctgccatgcttccaacccttcaaacccaaggccgtcaaaaggtaaaatgatgcggtgtgtccgctgccccgttgcctatcacagcggggatgcttgtctggcagcaggatgctcagtgatcgcctccaacagcatcatctgcactgcccacttcactgctcggaaggggaagcgacaccacgcccacgtcaacgtgagctggtgcttcgtgtgctccaaaggggggagccttctgtgctgtgagtcctgcccagcggccttccaccctgactgcctgaacatcgagatgcctgacggcagctggttctgcaatgactgcagggctgggaagaagctgcacttccaggatatcatttgggtgaaacttgggaactacagatggtggccggcagaagtttgccatcccaaaaatgttcccccaaatattcagaaaatgaagcacgagattggagaattccctgtgtttttctttgggtctaaagattattactggacgcatcaggcgcgagtgttcccgtacatggagggggaccggggcagccgctaccagggggtcagagggatcggaagagtcttcaaaaacgcactgcaagaagctgaagctcgttttcgtgaaattaagcttcagagggaagcccgagaaacacaggagagcgagcgcaagcccccaccatacaagcacatcaaggtgaataagccttacgggaaagtccagatctacacagcggatatttcagaaatccctaagtgcaactgcaagcccacagatgagaatccttgtggctttgattcggagtgtctgaacaggatgctgatgtttgagtgccacccgcaggtgtgtcccgcgggcgagttctgccagaaccagtgcttcaccaagcgccagtacccagagaccaagatcatcaagacagatggcaaagggtggggcctggtcgccaagagggacatcagaaagggagaatttgttaacgagtacgttggggagctgatcgacgaggaggagtgcatggcgagaatcaagcacgcacacgagaacgacatcacccacttctacatgctcactatagacaaggaccgtataatagacgctggccccaaaggaaactactctcgatttatgaatcacagctgccagcccaactgtgagaccctcaagtggacagtgaatggggacactcgtgtgggcctgtttgccgtctgtgacattcctgcagggacggagctgacttttaactacaacctcgattgtctgggcaatgaaaaaacggtctgccggtgtggagcctccaattgcagtggattcctcggggatagaccaaagacctcgacgaccctttcatcagaggaaaagggcaaaaagaccaagaagaaaacgaggcggcgcagagcaaaaggggaagggaagaggcagtcagaggacgagtgcttccgctgcggtgatggcgggcagctggtgctgtgtgaccgcaagttctgcaccaaggcctaccacctgtcctgcctgggccttggcaagcggcccttcgggaagtgggaatgtccttggcatcattgtgacgtgtgtggcaaaccttcgacttcattttgccacctctgccccaattcgttctgtaaggagcaccaggacgggacagccttcagctgcaccccggacgggcggtcctactgctgtgagcatgacttaggggcggcatcggtcagaagcaccaagactgagaagccccccccagagccagggaagccgaaggggaagaggcggcggcggaggggctggcggagagtcacagagggcaaatagcgccaggcggccgcttggccggatccaggggcggtgcagggcggccggccctgcctgcgggagagggcgagcatgaactggcccggaggacccagctcgagccgccaggacacagacgtacaggcctcctcgggagggagcgcctccccaccactgagccatcctcagcagcgtccgctgcgtctgcactgatgaccgtctgagcccagctcagcgttcctggacaaacagcctcactcctcagcgttaccgccacacttgaatttctccgaatgtcaaggttccctcccactctatttttttaggttaaagttaattggcatatggaatgttttaatctcctctgaaatgtgtagcgtaggcttttcccaagggtcgctagaaactcgtcttcgcgttgccccctttctggctctcagcgccgtcgccactcgggagaggctgggtgaggcccgtgtgaggactgaccctggattcctcgaaactgccattgtgatcattactctgctctttggaaatggctgtatcatttttttgtactaatgtgaattgttcctcagaaacgcttcttttccatcctagtgagaagctggccctgcaggtggtggcagcaatggtgttgtaagatttcctcccgtagttttttctcctcatggatttgaatgaaatgccaataacacgtccactttcaacgtgtagtttacgcggagcactttcgaggcctggccgggttgggcctacttctcacctgggcctatcttctgaactcgctaggttcttatcaacatttgggggataactttgtatatttttttcatttggcttttctttaccagtttctgatttttattctcaatatatttttgctaaacctatttcacaaatcaccaccgactgaagtgtgtgtttactgatgcggccctgagctccatggcgaaaggagtgactttgcagggcgtgagaccgcagtctgcttagagcacaggaagtgacaacttagggagccccgtagggcgctgcaggccccggggaccccagcacgtgggtctaaagagagacggagtctagctctcctgccacccagagtggcttccatctcagcactctgtgggtctggtgatggaagatgcagtctctgctgatcacatgtgccctctgccagggcacctactgagaggtgcggtcctgggggtggaggcctgcctggcaggtgtgcgtgcctcgtacgtgtgttatgggcactggtctaggccaggtatgacacccactctcctgtgagatttcactttagtttttaaaaggtccagttctacagagtgagacctatctatctgagtactacatatgttttaagacttggttctttttttgagggatccttgaccctgggaagtctggagcaccctgagaagggggcaccatgtgtgcctttgcccacgtgtcctgaggggctgcttgtctgggagggagggagagaacattcagcagcaggtgcttttttatggccttttcttaaaataacctaagggggacacatccatcttgcagagaagtttacagaactccccttgaaaactgctgctgaggctcctgttaaattttctgtggcatcttttatgccttggtaaaaactgcagtgtctttggacctgagagtggctactccgtggttttgtgacctgtaagcgtggggttcaggggtgtgtggccctgcagggtcccacgcctccctgagcactgactggaagtttcactggctggtggctgtcccttctcccatcagggtccccagcaaagttaactacacagaggacccaggggaaacgagctgtgtagccactgacttgctcgcgcggccgtggcctctgaggggcactcgccggttaagacagggtgggagtagtgctttccagttcagactctaacttctcccaaagtgtcctaagaaaatactggatcggctcatagatttatgctccttatgatgccctaacttggaaggttgttctagggacaggccgggcagtgtccccacacacaccttagagtcgaaggccccagggccccgctgtcacttgcccaaaagatcccttccggcaggtaagggactaccaatgcttacgtcaaaacagcagaatcggctttgcagtgcactttggggagcagatattaacttatttttgtgttggacagtagtgaaatcttgtgatttttaatcgctttgataatacttccaaattttatgatttttctgaaggaaataatgcaaacattttaaatatgtttctccccctttccaaaaactgttaaactaatgagcaagtaacactaactttgaatgtctctacaatacccgttgataactcagtggagccaggctttggggtagcggccctgagcttgcagggtttctcgccactggggctgaccacgcccccagctgtgaccgtgggtgtggctggctctcggccctgcccagctttgttctgaggacgtggtgacttcctgaacatcagcttcaatcctccatcattaatgtgaagcaaaacacaaaaaccgccccaatccctcaggattccttggcatccgaaaccagcatctgcacctaaacccatacccacccgtgtgcgcccacagggggatgtgtccgaatgggcagcttaaaatgtggtcacctgtgggggaaactcttcaggcacctgaagtgagaacccagctgtccgtcctcaggccggcctttcttccggcgacacccgtccatggctggctgggtccccttcgcagtgtttgtctgtcttgacatctaaaccccggcgtgtgcagtgcccatcttccaggactaccttattttccagaattaaacctgttttataattcaagttaatgcaaatgactgtcagttgccaaatatcttgatcctatgagtgtagttgatgactgtttgttagtcagtagagtaaaatgctgtgtccacggggtgtcacagcctcaccataccctgttgaggtgtgaaatgccccgtcagaaattaaatacaaacttaaatgtgcctattggtgtctaaacttcatacaatgtaaggtcagattccttttaggaatactgggtgctgtcaccaggtttgatagttagacttaaaaacttgaaattcactttttggggggagggatatactgaaatagagagttgagacttgccagttgggggaaaatagcatttaaaatggaaagctgtgtttggaaaattgtgtatgagtatttttgtattaaaaacattttaaaggcttttttcttaa

SEQ ID NO: 440501 - DNA, 8324 bp, Homo sapiens
agagatgggtctcgccatcaccatgttgcccagtctggtctccaactcctgggctcaagcgatcctcctgccttggtctcccaaagtgctgggattacaggtgtgagcccccacacccggcctgagtgagtgggttctgaatggtgactgttgttgtccatagccttccccctgcttctgagagtggagtccctcccctcatgttggagacctcccaaggtccatgtggtcctataggggctgttcagcctccctagccccttaacgtgtcaggtaatactgtatatattccatgaaatgtgaataattagttatataattcctaagcacttattttaaaaaacagcaatgtgatgcttaactcttcccacctctgttcctgtcccccttagaaaaccactgataactctttttttttttgagacggagtcttgccctgtcgcccaggctggagtgtagtggcctgatctcggctcggctcattgtaacctccgcctcgggtttgagcgattctcctgcctcagcctcctgagtagctgggattataggcgtgcaccaccacgcctggctaattttttgtatctttagtagggacgggtttcaccatgttggccagagtggtcttgaactcctgaccttgtgatccgctcgcctcagcctcccaaagtgctgggattacaggcatgagccaccgtgcctgtcctagaaccactggtaactcttaactgctgtctgcttttctgtggagactgcgggttgcagacaccagcagccccctattgctgcacgtcaggtgtcctccacctcagtactgtggacatctcgggccgcatagccctgttgcgcgggcatcctgtgcgttgcaggagatgcagcagcatccatgaccgcaacccatcagagtgttctaagaacggaagcatctgggctggatggaatttagcatcaagcagagtcccctttctgttcagagtgttgtaaagtgcataaagatgaagcaggcaccagaaatcctcggcagtgccaacgggaagactccgagctgcgaggtgaaccgcgagtgttctgtgttcctcagcaaagcccagctctccagtagcctgcaggagggggtcatgcagaagtttaacggccacgacgccctgccctttattccagccgacaagctgaaagatcttacttcccgggtgtttaatggagaacccggcgcacacgatgccaaactgcgttttgagtcccaggaaatgaaagggattgggacaccccctaacactacccctatcaaaaatggctctccagaaattaagctgaaaatcaccaaaacatacatgaatgggaagcctctctttgaatcttccatttgtggtgacagtgctgctgatgtgtctcagtcagaagaaaatggacaaaaaccagaaaacaaggcgagaaggaacaggaagaggagcataaaatatgactccttgctggagcagggccttgtcgaagcagctcttgtgtctaagatctcaagtccttcagataaaaagattccagctaagaaagagtcttgtccaaacactggaagagacaaagaccacctgttgaaatacaacgttggtgatttggtgtggtccaaagtgtcgggttacccttggtggccttgcatggtttctgcagatccactccttcacagctataccaaacttaaaggtcagaaaaagagtgcacgccagtatcacgtacagttctttggtgacgccccagaaagagcttggatatttgagaagagcctcgtagcttttgaaggagaaggacagtttgaaaaattatgccaggaaagtgccaagcaggcacccacgaaagctgagaaaattaagctattgaaaccaatttcagggaaattgagggcccagtgggaaatgggcattgttcaagcagaagaagctgcaagcatgtcagtggaggagcggaaagccaagttcacctttctctatgtgggggaccagcttcatctcaaccctcaagtagccaaggaggctggcattgctgcagagtctttgggagaaatggcagaatcctcaggagtcagtgaagaagctgctgaaaaccccaagtctgtgagagaagagtgcattcccatgaagagaaggcggagggccaaactgtgtagctctgcagagaccctggagagtcaccccgacatagggaagagtactcctcaaaagacggcagaggctgaccccagaagaggagtagggtctcctcctgggaggaagaagaccacagtctccatgccacgaagcaggaagggagatgcagcatcccagtttttggtcttctgtcaaaaacacagggatgaggtggtagctgagcacccagatgcttcaggtgaggagattgaagagctgctcaggtcacagtggagtctgctgagtgagaagcagagagcacgctacaacaccaagtttgccctggtggcccctgtccaggctgaagaagactctggtaatgtaaatgggaaaaaaagaaaccacacaaagaggatacaggaccctacagaagatgctgaagctgaggacacacccaggaaaagactcaggacggacaagcacagtcttcggaagagagacacaatcactgacaaaacggccagaacaagctcttacaaggccatggaggcagcctcctcgctcaagagccaggcagcaacgaaaaatctgtctgatgcatgtaaaccactgaagaagcgaaatcgggcttccacggcagcatcttcagctcttgggtttagcaaaagttcatctccttctgcatccttaactgagaatgaggtctcggacagcccgggagacgagccctcggagtccccatacgaaagtgcagacgaaacacaaactgaagtatctgtctcatccaaaaagtctgagcgaggagtgactgccaaaaaggagtatgtgtgccagctgtgtgagaagccgggcagcctcctgctctgtgaaggaccctgctgcggagctttccacctcgcctgccttgggctttcccggaggccagaagggaggttcacctgcagcgagtgtgcctcagggattcactcatgtttcgtgtgtaaagagagcaagacagatgttaagcgctgtgtggtaactcagtgtggaaaattttaccatgaggcttgtgtgaaaaaataccctctgactgtatttgagagccgaggtttccgctgccccctccacagctgtgtgagctgccatgcttccaacccttcaaacccaaggccgtcaaaaggtaaaatgatgcggtgtgtccgctgccccgttgcctatcacagcggggatgcttgtctggcagcaggatgctcagtgatcgcctccaacagcatcatctgcactgcccacttcactgctcggaaggggaagcgacaccacgcccacgtcaacgtgagctggtgcttcgtgtgctccaaaggggggagccttctgtgctgtgagtcctgcccagcggccttccaccctgactgcctgaacatcgagatgcctgacggcagctggttctgcaatgactgcagggctgggaagaagctgcacttccaggatatcatttgggtgaaacttgggaactacagatggtggccggcagaagtttgccatcccaaaaatgttcccccaaatattcagaaaatgaagcacgagattggagaattccctgtgtttttctttgggtctaaagattattactggacgcatcaggcgcgagtgttcccgtacatggagggggaccggggcagccgctaccagggggtcagagggatcggaagagtcttcaaaaacgcactgcaagaagctgaagctcgttttcgtgaaattaagcttcagagggaagcccgagaaacacaggagagcgagcgcaagcccccaccatacaagcacatcaaggtgaataagccttacgggaaagtccagatctacacagcggatatttcagaaatccctaagtgcaactgcaagcccacagatgagaatccttgtggctttgattcggagtgtctgaacaggatgctgatgtttgagtgccacccgcaggtgtgtcccgcgggcgagttctgccagaaccagtgcttcaccaagcgccagtacccagagaccaagatcatcaagacagatggcaaagggtggggcctggtcgccaagagggacatcagaaagggagaatttgttaacgagtacgttggggagctgatcgacgaggaggagtgcatggcgagaatcaagcacgcacacgagaacgacatcacccacttctacatgctcactatagacaaggaccgtataatagacgctggccccaaaggaaactactctcgatttatgaatcacagctgccagcccaactgtgagaccctcaagtggacagtgaatggggacactcgtgtgggcctgtttgccgtctgtgacattcctgcagggacggagctgacttttaactacaacctcgattgtctgggcaatgaaaaaacggtctgccggtgtggagcctccaattgcagtggattcctcggggatagaccaaagacctcgacgaccctttcatcagaggaaaagggcaaaaagaccaagaagaaaacgaggcggcgcagagcaaaaggggaagggaagaggcagtcagaggacgagtgcttccgctgcggtgatggcgggcagctggtgctgtgtgaccgcaagttctgcaccaaggcctaccacctgtcctgcctgggccttggcaagcggcccttcgggaagtgggaatgtccttggcatcattgtgacgtgtgtggcaaaccttcgacttcattttgccacctctgccccaattcgttctgtaaggagcaccaggacgggacagccttcagctgcaccccggacgggcggtcctactgctgtgagcatgacttaggggcggcatcggtcagaagcaccaagactgagaagccccccccagagccagggaagccgaaggggaagaggcggcggcggaggggctggcggagagtcacagagggcaaatagcgccaggcggccgcttggccggatccaggggcggtgcagggcggccggccctgcctgcgggagagggcgagcatgaactggcccggaggacccagctcgagccgccaggacacagacgtacaggcctcctcgggagggagcgcctccccaccactgagccatcctcagcagcgtccgctgcgtctgcactgatgaccgtctgagcccagctcagcgttcctggacaaacagcctcactcctcagcgttaccgccacacttgaatttctccgaatgtcaaggttccctcccactctatttttttaggttaaagttaattggcatatggaatgttttaatctcctctgaaatgtgtagcgtaggcttttcccaagggtcgctagaaactcgtcttcgcgttgccccctttctggctctcagcgccgtcgccactcgggagaggctgggtgaggcccgtgtgaggactgaccctggattcctcgaaactgccattgtgatcattactctgctctttggaaatggctgtatcatttttttgtactaatgtgaattgttcctcagaaacgcttcttttccatcctagtgagaagctggccctgcaggtggtggcagcaatggtgttgtaagatttcctcccgtagttttttctcctcatggatttgaatgaaatgccaataacacgtccactttcaacgtgtagtttacgcggagcactttcgaggcctggccgggttgggcctacttctcacctgggcctatcttctgaactcgctaggttcttatcaacatttgggggataactttgtatatttttttcatttggcttttctttaccagtttctgatttttattctcaatatatttttgctaaacctatttcacaaatcaccaccgactgaagtgtgtgtttactgatgcggccctgagctccatggcgaaaggagtgactttgcagggcgtgagaccgcagtctgcttagagcacaggaagtgacaacttagggagccccgtagggcgctgcaggccccggggaccccagcacgtgggtctaaagagagacggagtctagctctcctgccacccagagtggcttccatctcagcactctgtgggtctggtgatggaagatgcagtctctgctgatcacatgtgccctctgccagggcacctactgagaggtgcggtcctgggggtggaggcctgcctggcaggtgtgcgtgcctcgtacgtgtgttatgggcactggtctaggccaggtatgacacccactctcctgtgagatttcactttagtttttaaaaggtccagttctacagagtgagacctatctatctgagtactacatatgttttaagacttggttctttttttgagggatccttgaccctgggaagtctggagcaccctgagaagggggcaccatgtgtgcctttgcccacgtgtcctgaggggctgcttgtctgggagggagggagagaacattcagcagcaggtgcttttttatggccttttcttaaaataacctaagggggacacatccatcttgcagagaagtttacagaactccccttgaaaactgctgctgaggctcctgttaaattttctgtggcatcttttatgccttggtaaaaactgcagtgtctttggacctgagagtggctactccgtggttttgtgacctgtaagcgtggggttcaggggtgtgtggccctgcagggtcccacgcctccctgagcactgactggaagtttcactggctggtggctgtcccttctcccatcagggtccccagcaaagttaactacacagaggacccaggggaaacgagctgtgtagccactgacttgctcgcgcggccgtggcctctgaggggcactcgccggttaagacagggtgggagtagtgctttccagttcagactctaacttctcccaaagtgtcctaagaaaatactggatcggctcatagatttatgctccttatgatgccctaacttggaaggttgttctagggacaggccgggcagtgtccccacacacaccttagagtcgaaggccccagggccccgctgtcacttgcccaaaagatcccttccggcaggtaagggactaccaatgcttacgtcaaaacagcagaatcggctttgcagtgcactttggggagcagatattaacttatttttgtgttggacagtagtgaaatcttgtgatttttaatcgctttgataatacttccaaattttatgatttttctgaaggaaataatgcaaacattttaaatatgtttctccccctttccaaaaactgttaaactaatgagcaagtaacactaactttgaatgtctctacaatacccgttgataactcagtggagccaggctttggggtagcggccctgagcttgcagggtttctcgccactggggctgaccacgcccccagctgtgaccgtgggtgtggctggctctcggccctgcccagctttgttctgaggacgtggtgacttcctgaacatcagcttcaatcctccatcattaatgtgaagcaaaacacaaaaaccgccccaatccctcaggattccttggcatccgaaaccagcatctgcacctaaacccatacccacccgtgtgcgcccacagggggatgtgtccgaatgggcagcttaaaatgtggtcacctgtgggggaaactcttcaggcacctgaagtgagaacccagctgtccgtcctcaggccggcctttcttccggcgacacccgtccatggctggctgggtccccttcgcagtgtttgtctgtcttgacatctaaaccccggcgtgtgcagtgcccatcttccaggactaccttattttccagaattaaacctgttttataattcaagttaatgcaaatgactgtcagttgccaaatatcttgatcctatgagtgtagttgatgactgtttgttagtcagtagagtaaaatgctgtgtccacggggtgtcacagcctcaccataccctgttgaggtgtgaaatgccccgtcagaaattaaatacaaacttaaatgtgcctattggtgtctaaacttcatacaatgtaaggtcagattccttttaggaatactgggtgctgtcaccaggtttgatagttagacttaaaaacttgaaattcactttttggggggagggatatactgaaatagagagttgagacttgccagttgggggaaaatagcatttaaaatggaaagctgtgtttggaaaattgtgtatgagtatttttgtattaaaaacattttaaaggcttttttcttaa

SEQ ID NO: 440502 - DNA, 8598 bp, Homo sapiens
agagatgggtctcgccatcaccatgttgcccagtctggtctccaactcctgggctcaagcgatcctcctgccttggtctcccaaagtgctgggattacaggtgtgagcccccacacccggcctgagtgagtgggttctgaatggtgactgttgttgtccatagccttccccctgcttctgagagtggagtccctcccctcatgttggagacctcccaaggtccatgtggtcctataggggctgttcagcctccctagccccttaacgtgtcaggtaatactgtatatattccatgaaatgtgaataattagttatataattcctaagcacttattttaaaaaacagcaatgtgatgcttaactcttcccacctctgttcctgtcccccttagaaaaccactgataactctttttttttttgagacggagtcttgccctgtcgcccaggctggagtgtagtggcctgatctcggctcggctcattgtaacctccgcctcgggtttgagcgattctcctgcctcagcctcctgagtagctgggattataggcgtgcaccaccacgcctggctaattttttgtatctttagtagggacgggtttcaccatgttggccagagtggtcttgaactcctgaccttgtgatccgctcgcctcagcctcccaaagtgctgggattacaggcatgagccaccgtgcctgtcctagaaccactggtaactcttaactgagacaagatttcgccatgttgcccaggctggtctcgaacttctgagctcaagcgatctacctgcctcgtcctcccaaagtgttggaattgcaggtgtgagccactgcacccggcccttgcctcatgtttgaatgataatttacctgggcataaaattctggacacttgtggtggcacgagctgtctgcttttctgtggagactgcgggttgcagacaccagcagccccctattgctgcacgtcaggtgtcctccacctcagtactgtggacatctcgggccgcatagccctgttgcgcgggcatcctgtgcgttgcaggagatgcagcagcatccatgaccgcaacccatcagagtgttctaagaacggaagcatctgggctggatggaatttagcatcaagcagagtcccctttctgttcagagtgttgtaaagtgcataaagatgaagcaggcaccagaaatcctcggcagtgccaacgggaagactccgagctgcgaggtgaaccgcgagtgttctgtgttcctcagcaaagcccagctctccagtagcctgcaggagggggtcatgcagaagtttaacggccacgacgccctgccctttattccagccgacaagctgaaagatcttacttcccgggtgtttaatggagaacccggcgcacacgatgccaaactgcgttttgagtcccaggaaatgaaagggattgggacaccccctaacactacccctatcaaaaatggctctccagaaattaagctgaaaatcaccaaaacatacatgaatgggaagcctctctttgaatcttccatttgtggtgacagtgctgctgatgtgtctcagtcagaagaaaatggacaaaaaccagaaaacaaggcgagaaggaacaggaagaggagcataaaatatgactccttgctggagcagggccttgtcgaagcagctcttgtgtctaagatctcaagtccttcagataaaaagattccagctaagaaagagtcttgtccaaacactggaagagacaaagaccacctgttgaaatacaacgttggtgatttggtgtggtccaaagtgtcgggttacccttggtggccttgcatggtttctgcagatccactccttcacagctataccaaacttaaaggtcagaaaaagagtgcacgccagtatcacgtacagttctttggtgacgccccagaaagagcttggatatttgagaagagcctcgtagcttttgaaggagaaggacagtttgaaaaattatgccaggaaagtgccaagcaggcacccacgaaagctgagaaaattaagctattgaaaccaatttcagggaaattgagggcccagtgggaaatgggcattgttcaagcagaagaagctgcaagcatgtcagtggaggagcggaaagccaagttcacctttctctatgtgggggaccagcttcatctcaaccctcaagtagccaaggaggctggcattgctgcagagtctttgggagaaatggcagaatcctcaggagtcagtgaagaagctgctgaaaaccccaagtctgtgagagaagagtgcattcccatgaagagaaggcggagggccaaactgtgtagctctgcagagaccctggagagtcaccccgacatagggaagagtactcctcaaaagacggcagaggctgaccccagaagaggagtagggtctcctcctgggaggaagaagaccacagtctccatgccacgaagcaggaagggagatgcagcatcccagtttttggtcttctgtcaaaaacacagggatgaggtggtagctgagcacccagatgcttcaggtgaggagattgaagagctgctcaggtcacagtggagtctgctgagtgagaagcagagagcacgctacaacaccaagtttgccctggtggcccctgtccaggctgaagaagactctggtaatgtaaatgggaaaaaaagaaaccacacaaagaggatacaggaccctacagaagatgctgaagctgaggacacacccaggaaaagactcaggacggacaagcacagtcttcggaagagagacacaatcactgacaaaacggccagaacaagctcttacaaggccatggaggcagcctcctcgctcaagagccaggcagcaacgaaaaatctgtctgatgcatgtaaaccactgaagaagcgaaatcgggcttccacggcagcatcttcagctcttgggtttagcaaaagttcatctccttctgcatccttaactgagaatgagcttttgtgggagcccacaccagtcaagttggatttgaacccagctgctctgtactgcacttagaatgatgtaatattccaggatgctgctgcaggtctcggacagcccgggagacgagccctcggagtccccatacgaaagtgcagacgaaacacaaactgaagtatctgtctcatccaaaaagtctgagcgaggagtgactgccaaaaaggagtatgtgtgccagctgtgtgagaagccgggcagcctcctgctctgtgaaggaccctgctgcggagctttccacctcgcctgccttgggctttcccggaggccagaagggaggttcacctgcagcgagtgtgcctcagggattcactcatgtttcgtgtgtaaagagagcaagacagatgttaagcgctgtgtggtaactcagtgtggaaaattttaccatgaggcttgtgtgaaaaaataccctctgactgtatttgagagccgaggtttccgctgccccctccacagctgtgtgagctgccatgcttccaacccttcaaacccaaggccgtcaaaaggtaaaatgatgcggtgtgtccgctgccccgttgcctatcacagcggggatgcttgtctggcagcaggatgctcagtgatcgcctccaacagcatcatctgcactgcccacttcactgctcggaaggggaagcgacaccacgcccacgtcaacgtgagctggtgcttcgtgtgctccaaaggggggagccttctgtgctgtgagtcctgcccagcggccttccaccctgactgcctgaacatcgagatgcctgacggcagctggttctgcaatgactgcagggctgggaagaagctgcacttccaggatatcatttgggtgaaacttgggaactacagatggtggccggcagaagtttgccatcccaaaaatgttcccccaaatattcagaaaatgaagcacgagattggagaattccctgtgtttttctttgggtctaaagattattactggacgcatcaggcgcgagtgttcccgtacatggagggggaccggggcagccgctaccagggggtcagagggatcggaagagtcttcaaaaacgcactgcaagaagctgaagctcgttttcgtgaaattaagcttcagagggaagcccgagaaacacaggagagcgagcgcaagcccccaccatacaagcacatcaaggtgaataagccttacgggaaagtccagatctacacagcggatatttcagaaatccctaagtgcaactgcaagcccacagatgagaatccttgtggctttgattcggagtgtctgaacaggatgctgatgtttgagtgccacccgcaggtgtgtcccgcgggcgagttctgccagaaccagtgcttcaccaagcgccagtacccagagaccaagatcatcaagacagatggcaaagggtggggcctggtcgccaagagggacatcagaaagggagaatttgttaacgagtacgttggggagctgatcgacgaggaggagtgcatggcgagaatcaagcacgcacacgagaacgacatcacccacttctacatgctcactatagacaaggaccgtataatagacgctggccccaaaggaaactactctcgatttatgaatcacagctgccagcccaactgtgagaccctcaagtggacagtgaatggggacactcgtgtgggcctgtttgccgtctgtgacattcctgcagggacggagctgacttttaactacaacctcgattgtctgggcaatgaaaaaacggtctgccggtgtggagcctccaattgcagtggattcctcggggatagaccaaagacctcgacgaccctttcatcagaggaaaagggcaaaaagaccaagaagaaaacgaggcggcgcagagcaaaaggggaagggaagaggcagtcagaggacgagtgcttccgctgcggtgatggcgggcagctggtgctgtgtgaccgcaagttctgcaccaaggcctaccacctgtcctgcctgggccttggcaagcggcccttcgggaagtgggaatgtccttggcatcattgtgacgtgtgtggcaaaccttcgacttcattttgccacctctgccccaattcgttctgtaaggagcaccaggacgggacagccttcagctgcaccccggacgggcggtcctactgctgtgagcatgacttaggggcggcatcggtcagaagcaccaagactgagaagccccccccagagccagggaagccgaaggggaagaggcggcggcggaggggctggcggagagtcacagagggcaaatagcgccaggcggccgcttggccggatccaggggcggtgcagggcggccggccctgcctgcgggagagggcgagcatgaactggcccggaggacccagctcgagccgccaggacacagacgtacaggcctcctcgggagggagcgcctccccaccactgagccatcctcagcagcgtccgctgcgtctgcactgatgaccgtctgagcccagctcagcgttcctggacaaacagcctcactcctcagcgttaccgccacacttgaatttctccgaatgtcaaggttccctcccactctatttttttaggttaaagttaattggcatatggaatgttttaatctcctctgaaatgtgtagcgtaggcttttcccaagggtcgctagaaactcgtcttcgcgttgccccctttctggctctcagcgccgtcgccactcgggagaggctgggtgaggcccgtgtgaggactgaccctggattcctcgaaactgccattgtgatcattactctgctctttggaaatggctgtatcatttttttgtactaatgtgaattgttcctcagaaacgcttcttttccatcctagtgagaagctggccctgcaggtggtggcagcaatggtgttgtaagatttcctcccgtagttttttctcctcatggatttgaatgaaatgccaataacacgtccactttcaacgtgtagtttacgcggagcactttcgaggcctggccgggttgggcctacttctcacctgggcctatcttctgaactcgctaggttcttatcaacatttgggggataactttgtatatttttttcatttggcttttctttaccagtttctgatttttattctcaatatatttttgctaaacctatttcacaaatcaccaccgactgaagtgtgtgtttactgatgcggccctgagctccatggcgaaaggagtgactttgcagggcgtgagaccgcagtctgcttagagcacaggaagtgacaacttagggagccccgtagggcgctgcaggccccggggaccccagcacgtgggtctaaagagagacggagtctagctctcctgccacccagagtggcttccatctcagcactctgtgggtctggtgatggaagatgcagtctctgctgatcacatgtgccctctgccagggcacctactgagaggtgcggtcctgggggtggaggcctgcctggcaggtgtgcgtgcctcgtacgtgtgttatgggcactggtctaggccaggtatgacacccactctcctgtgagatttcactttagtttttaaaaggtccagttctacagagtgagacctatctatctgagtactacatatgttttaagacttggttctttttttgagggatccttgaccctgggaagtctggagcaccctgagaagggggcaccatgtgtgcctttgcccacgtgtcctgaggggctgcttgtctgggagggagggagagaacattcagcagcaggtgcttttttatggccttttcttaaaataacctaagggggacacatccatcttgcagagaagtttacagaactccccttgaaaactgctgctgaggctcctgttaaattttctgtggcatcttttatgccttggtaaaaactgcagtgtctttggacctgagagtggctactccgtggttttgtgacctgtaagcgtggggttcaggggtgtgtggccctgcagggtcccacgcctccctgagcactgactggaagtttcactggctggtggctgtcccttctcccatcagggtccccagcaaagttaactacacagaggacccaggggaaacgagctgtgtagccactgacttgctcgcgcggccgtggcctctgaggggcactcgccggttaagacagggtgggagtagtgctttccagttcagactctaacttctcccaaagtgtcctaagaaaatactggatcggctcatagatttatgctccttatgatgccctaacttggaaggttgttctagggacaggccgggcagtgtccccacacacaccttagagtcgaaggccccagggccccgctgtcacttgcccaaaagatcccttccggcaggtaagggactaccaatgcttacgtcaaaacagcagaatcggctttgcagtgcactttggggagcagatattaacttatttttgtgttggacagtagtgaaatcttgtgatttttaatcgctttgataatacttccaaattttatgatttttctgaaggaaataatgcaaacattttaaatatgtttctccccctttccaaaaactgttaaactaatgagcaagtaacactaactttgaatgtctctacaatacccgttgataactcagtggagccaggctttggggtagcggccctgagcttgcagggtttctcgccactggggctgaccacgcccccagctgtgaccgtgggtgtggctggctctcggccctgcccagctttgttctgaggacgtggtgacttcctgaacatcagcttcaatcctccatcattaatgtgaagcaaaacacaaaaaccgccccaatccctcaggattccttggcatccgaaaccagcatctgcacctaaacccatacccacccgtgtgcgcccacagggggatgtgtccgaatgggcagcttaaaatgtggtcacctgtgggggaaactcttcaggcacctgaagtgagaacccagctgtccgtcctcaggccggcctttcttccggcgacacccgtccatggctggctgggtccccttcgcagtgtttgtctgtcttgacatctaaaccccggcgtgtgcagtgcccatcttccaggactaccttattttccagaattaaacctgttttataattcaagttaatgcaaatgactgtcagttgccaaatatcttgatcctatgagtgtagttgatgactgtttgttagtcagtagagtaaaatgctgtgtccacggggtgtcacagcctcaccataccctgttgaggtgtgaaatgccccgtcagaaattaaatacaaacttaaatgtgcctattggtgtctaaacttcatacaatgtaaggtcagattccttttaggaatactgggtgctgtcaccaggtttgatagttagacttaaaaacttgaaattcactttttggggggagggatatactgaaatagagagttgagacttgccagttgggggaaaatagcatttaaaatggaaagctgtgtttggaaaattgtgtatgagtatttttgtattaaaaacattttaaaggcttttttcttaa

SEQ ID NO: 440503 - DNA, 754 bp, Homo sapiens
gctcggtcctctccacgtggtcctgacctgtcctctgtgagcaagagaaacaggactggtttgggggtgtcctgtctcagtggacacaggacaccacggttttcagtacaacaaggaacacaacttgttcaatgtgctttatgatggtgaaaattccctttaaaaataacatgcgattgctaacacttgaccgaatatatcacttgaccttacagggaccgtataatagacgctggccccaaaggaaactactctcgatttatgaatcacagctgccagcccaactgtgagaccctcaagtggacagtgaatggggacactcgtgtgggcctgtttgccgtctgtgacattcctgcagggacggagctgacttttaactacaacctcgattgtctgggcaatgaaaaaacggtctgccggtgtggagcctccaattgcagtggattcctcggggatagaccaaagacctcgacgaccctttcatcagaggaaaagggcaaaaagaccaagaagaaaacgaggcggcgcagagcaaaaggggaagggaagaggcagtcagaggacgagtgcttccgctgcggtgatggcgggcagctggtgctgtgtgaccgcaagttctgcaccaaggcctaccacctgtcctgcctgggccttggcaagcggcccttcgggagtgggatgtcttaatcatgtgactgttggaacctcgatcattgcacttgccaatcgctgaggacagaggcactataccggg

SEQ ID NO: 440504 - DNA, 559 bp, Homo sapiens
  misc_feature (103)..(103): n is a, c, g, or t
aggcgatcactgagcatcctgctggcagacaagcatccccgctgtgataggcacgggggcagcggacacaccgcatcattttaccttttgacggccttgggtntgaagggttggaagcatggccctgctccagcaaggagtcatattttatgctcctcttcctgttccttctcgccttgttttctggtttttgtccattttcttctgactgagacacatcagcagcatgtcagtggaggagcggaaagccaagttcacctttctctatgtgggggaccagcttcatctcaaccctcaagtagccaaggaggctggcattgctgcagagtctttgggagaaatggcagaatcctcaggagtcagtgaagaagctgctgaaaaccccaagtctgtgagagaagagtgcattcccatgaagagaaggcggagggccaaactgtgtagctctgcagagaccctggagagtcaccccgacatagggaagagtactcctcaaaagacggcagaggctgaccccagaagaggagtagtaaatcgtcggccaagtgaatttttaatc

SEQ ID NO: 440505 - DNA, 7592 bp, Homo sapiens
  misc_feature (12)..(12): n is a, c, g, or t
  misc_feature (86)..(86): n is a, c, g, or t
gggaggcgcggnggcggggtcggcgccgcgcgcgagagcctcggcctggccgcgctgcgcccgccgccgccgccgccccctccccncctgggccctaccgccgcacggccccggccccctcccagcctgccgctccggagagccgcccgccgaggatgcgacgcaccgcagtgttctaagaacggaagcatctgggctggatggaatttagcatcaagcagagtcccctttctgttcagagtgttgtaaagtgcataaagatgaagcaggcaccagaaatcctcggcagtgccaacgggaagactccgagctgcgaggtgaaccgcgagtgttctgtgttcctcagcaaagcccagctctccagtagcctgcaggagggggtcatgcagaagtttaacggccacgacgccctgccctttattccagccgacaagctgaaagatcttacttcccgggtgtttaatggagaacccggcgcacacgatgccaaactgcgttttgagtcccaggaaatgaaagggattgggacaccccctaacactacccctatcaaaaatggctctccagaaattaagctgaaaatcaccaaaacatacatgaatgggaagcctctctttgaatcttccatttgtggtgacagtgctgctgatgtgtctcagtcagaagaaaatggacaaaaaccagaaaacaaggcgagaaggaacaggaagaggagcataaaatatgactccttgctggagcagggccttgtcgaagcagctcttgtgtctaagatctcaagtccttcagataaaaagattccagctaagaaagagtcttgtccaaacactggaagagacaaagaccacctgttgaaatacaacgttggtgatttggtgtggtccaaagtgtcgggttacccttggtggccttgcatggtttctgcagatccactccttcacagctataccaaacttaaaggtcagaaaaagagtgcacgccagtatcacgtacagttctttggtgacgccccagaaagagcttggatatttgagaagagcctcgtagcttttgaaggagaaggacagtttgaaaaattatgccaggaaagtgccaagcaggcacccacgaaagctgagaaaattaagctattgaaaccaatttcagggaaattgagggcccagtgggaaatgggcattgttcaagcagaagaagctgcaagcatgtcagtggaggagcggaaagccaagttcacctttctctatgtgggggaccagcttcatctcaaccctcaagtagccaaggaggctggcattgctgcagagtctttgggagaaatggcagaatcctcaggagtcagtgaagaagctgctgaaaaccccaagtctgtgagagaagagtgcattcccatgaagagaaggcggagggccaaactgtgtagctctgcagagaccctggagagtcaccccgacatagggaagagtactcctcaaaagacggcagaggctgaccccagaagaggagtagggtctcctcctgggaggaagaagaccacagtctccatgccacgaagcaggaagggagatgcagcatcccagtttttggtcttctgtcaaaaacacagggatgaggtggtagctgagcacccagatgcttcaggtgaggagattgaagagctgctcaggtcacagtggagtctgctgagtgagaagcagagagcacgctacaacaccaagtttgccctggtggcccctgtccaggctgaagaagactctggtaatgtaaatgggaaaaaaagaaaccacacaaagaggatacaggaccctacagaagatgctgaagctgaggacacacccaggaaaagactcaggacggacaagcacagtcttcggaagagagacacaatcactgacaaaacggccagaacaagctcttacaaggccatggaggcagcctcctcgctcaagagccaggcagcaacgaaaaatctgtctgatgcatgtaaaccactgaagaagcgaaatcgggcttccacggcagcatcttcagctcttgggtttagcaaaagttcatctccttctgcatccttaactgagaatgaggtctcggacagcccgggagacgagccctcggagtccccatacgaaagtgcagacgaaacacaaactgaagtatctgtctcatccaaaaagtctgagcgaggagtgactgccaaaaaggagtatgtgtgccagctgtgtgagaagccgggcagcctcctgctctgtgaaggaccctgctgcggagctttccacctcgcctgccttgggctttcccggaggccagaagggaggttcacctgcagcgagtgtgcctcagggattcactcatgtttcgtgtgtaaagagagcaagacagatgttaagcgctgtgtggtaactcagtgtggaaaattttaccatgaggcttgtgtgaaaaaataccctctgactgtatttgagagccgaggtttccgctgccccctccacagctgtgtgagctgccatgcttccaacccttcaaacccaaggccgtcaaaaggtaaaatgatgcggtgtgtccgctgccccgttgcctatcacagcggggatgcttgtctggcagcaggatgctcagtgatcgcctccaacagcatcatctgcactgcccacttcactgctcggaaggggaagcgacaccacgcccacgtcaacgtgagctggtgcttcgtgtgctccaaaggggggagccttctgtgctgtgagtcctgcccagcggccttccaccctgactgcctgaacatcgagatgcctgacggcagctggttctgcaatgactgcagggctgggaagaagctgcacttccaggatatcatttgggtgaaacttgggaactacagatggtggccggcagaagtttgccatcccaaaaatgttcccccaaatattcagaaaatgaagcacgagattggagaattccctgtgtttttctttgggtctaaagattattactggacgcatcaggcgcgagtgttcccgtacatggagggggaccggggcagccgctaccagggggtcagagggatcggaagagtcttcaaaaacgcactgcaagaagctgaagctcgttttcgtgaaattaagcttcagagggaagcccgagaaacacaggagagcgagcgcaagcccccaccatacaagcacatcaaggtgaataagccttacgggaaagtccagatctacacagcggatatttcagaaatccctaagtgcaactgcaagcccacagatgagaatccttgtggctttgattcggagtgtctgaacaggatgctgatgtttgagtgccacccgcaggtgtgtcccgcgggcgagttctgccagaaccagtgcttcaccaagcgccagtacccagagaccaagatcatcaagacagatggcaaagggtggggcctggtcgccaagagggacatcagaaagggagaatttgttaacgagtacgttggggagctgatcgacgaggaggagtgcatggcgagaatcaagcacgcacacgagaacgacatcacccacttctacatgctcactatagacaaggaccgtataatagacgctggccccaaaggaaactactctcgatttatgaatcacagctgccagcccaactgtgagaccctcaagtggacagtgaatggggacactcgtgtgggcctgtttgccgtctgtgacattcctgcagggacggagctgacttttaactacaacctcgattgtctgggcaatgaaaaaacggtctgccggtgtggagcctccaattgcagtggattcctcggggatagaccaaagacctcgacgaccctttcatcagaggaaaagggcaaaaagaccaagaagaaaacgaggcggcgcagagcaaaaggggaagggaagaggcagtcagaggacgagtgcttccgctgcggtgatggcgggcagctggtgctgtgtgaccgcaagttctgcaccaaggcctaccacctgtcctgcctgggccttggcaagcggcccttcgggaagtgggaatgtccttggcatcattgtgacgtgtgtggcaaaccttcgacttcattttgccacctctgccccaattcgttctgtaaggagcaccaggacgggacagccttcagctgcaccccggacgggcggtcctactgctgtgagcatgacttaggggcggcatcggtcagaagcaccaagactgagaagccccccccagagccagggaagccgaaggggaagaggcggcggcggaggggctggcggagagtcacagagggcaaatagcgccaggcggccgcttggccggatccaggggcggtgcagggcggccggccctgcctgcgggagagggcgagcatgaactggcccggaggacccagctcgagccgccaggacacagacgtacaggcctcctcgggagggagcgcctccccaccactgagccatcctcagcagcgtccgctgcgtctgcactgatgaccgtctgagcccagctcagcgttcctggacaaacagcctcactcctcagcgttaccgccacacttgaatttctccgaatgtcaaggttccctcccactctatttttttaggttaaagttaattggcatatggaatgttttaatctcctctgaaatgtgtagcgtaggcttttcccaagggtcgctagaaactcgtcttcgcgttgccccctttctggctctcagcgccgtcgccactcgggagaggctgggtgaggcccgtgtgaggactgaccctggattcctcgaaactgccattgtgatcattactctgctctttggaaatggctgtatcatttttttgtactaatgtgaattgttcctcagaaacgcttcttttccatcctagtgagaagctggccctgcaggtggtggcagcaatggtgttgtaagatttcctcccgtagttttttctcctcatggatttgaatgaaatgccaataacacgtccactttcaacgtgtagtttacgcggagcactttcgaggcctggccgggttgggcctacttctcacctgggcctatcttctgaactcgctaggttcttatcaacatttgggggataactttgtatatttttttcatttggcttttctttaccagtttctgatttttattctcaatatatttttgctaaacctatttcacaaatcaccaccgactgaagtgtgtgtttactgatgcggccctgagctccatggcgaaaggagtgactttgcagggcgtgagaccgcagtctgcttagagcacaggaagtgacaacttagggagccccgtagggcgctgcaggccccggggaccccagcacgtgggtctaaagagagacggagtctagctctcctgccacccagagtggcttccatctcagcactctgtgggtctggtgatggaagatgcagtctctgctgatcacatgtgccctctgccagggcacctactgagaggtgcggtcctgggggtggaggcctgcctggcaggtgtgcgtgcctcgtacgtgtgttatgggcactggtctaggccaggtatgacacccactctcctgtgagatttcactttagtttttaaaaggtccagttctacagagtgagacctatctatctgagtactacatatgttttaagacttggttctttttttgagggatccttgaccctgggaagtctggagcaccctgagaagggggcaccatgtgtgcctttgcccacgtgtcctgaggggctgcttgtctgggagggagggagagaacattcagcagcaggtgcttttttatggccttttcttaaaataacctaagggggacacatccatcttgcagagaagtttacagaactccccttgaaaactgctgctgaggctcctgttaaattttctgtggcatcttttatgccttggtaaaaactgcagtgtctttggacctgagagtggctactccgtggttttgtgacctgtaagcgtggggttcaggggtgtgtggccctgcagggtcccacgcctccctgagcactgactggaagtttcactggctggtggctgtcccttctcccatcagggtccccagcaaagttaactacacagaggacccaggggaaacgagctgtgtagccactgacttgctcgcgcggccgtggcctctgaggggcactcgccggttaagacagggtgggagtagtgctttccagttcagactctaacttctcccaaagtgtcctaagaaaatactggatcggctcatagatttatgctccttatgatgccctaacttggaaggttgttctagggacaggccgggcagtgtccccacacacaccttagagtcgaaggccccagggccccgctgtcacttgcccaaaagatcccttccggcaggtaagggactaccaatgcttacgtcaaaacagcagaatcggctttgcagtgcactttggggagcagatattaacttatttttgtgttggacagtagtgaaatcttgtgatttttaatcgctttgataatacttccaaattttatgatttttctgaaggaaataatgcaaacattttaaatatgtttctccccctttccaaaaactgttaaactaatgagcaagtaacactaactttgaatgtctctacaatacccgttgataactcagtggagccaggctttggggtagcggccctgagcttgcagggtttctcgccactggggctgaccacgcccccagctgtgaccgtgggtgtggctggctctcggccctgcccagctttgttctgaggacgtggtgacttcctgaacatcagcttcaatcctccatcattaatgtgaagcaaaacacaaaaaccgccccaatccctcaggattccttggcatccgaaaccagcatctgcacctaaacccatacccacccgtgtgcgcccacagggggatgtgtccgaatgggcagcttaaaatgtggtcacctgtgggggaaactcttcaggcacctgaagtgagaacccagctgtccgtcctcaggccggcctttcttccggcgacacccgtccatggctggctgggtccccttcgcagtgtttgtctgtcttgacatctaaaccccggcgtgtgcagtgcccatcttccaggactaccttattttccagaattaaacctgttttataattcaagttaatgcaaatgactgtcagttgccaaatatcttgatcctatgagtgtagttgatgactgtttgttagtcagtagagtaaaatgctgtgtccacggggtgtcacagcctcaccataccctgttgaggtgtgaaatgccccgtcagaaattaaatacaaacttaaatgtgcctattggtgtctaaacttcatacaatgtaaggtcagattccttttaggaatactgggtgctgtcaccaggtttgatagttagacttaaaaacttgaaattcactttttggggggagggatatactgaaatagagagttgagacttgccagttgggggaaaatagcatttaaaatggaaagctgtgtttggaaaattgtgtatgagtatttttgtattaaaaacattttaaaggcttttttcttaa

SEQ ID NO: 440506 - DNA, 10870 bp, Homo sapiens
  misc_feature (12)..(12): n is a, c, g, or t
  misc_feature (86)..(86): n is a, c, g, or t
gggaggcgcggnggcggggtcggcgccgcgcgcgagagcctcggcctggccgcgctgcgcccgccgccgccgccgccccctccccncctgggccctaccgccgcacggccccggccccctcccagcctgccgctccggagagccgcccgccgaggatgcgacgcaccgcagtgttctaagaacggaagcatctgggctggatggaatttagcatcaagcagagtcccctttctgttcagagtgttgtaaagtgcataaagatgaagcaggcaccagaaatcctcggcagtgccaacgggaagactccgagctgcgaggtgaaccgcgagtgttctgtgttcctcagcaaagcccagctctccagtagcctgcaggagggggtcatgcagaagtttaacggccacgacgccctgccctttattccagccgacaagctgaaagatcttacttcccgggtgtttaatggagaacccggcgcacacgatgccaaactgcgttttgagtcccaggaaatgaaagggattgggacaccccctaacactacccctatcaaaaatggctctccagaaattaagctgaaaatcaccaaaacatacatgaatgggaagcctctctttgaatcttccatttgtggtgacagtgctgctgatgtgtctcagtcagaagaaaatggacaaaaaccagaaaacaaggcgagaaggaacaggaagaggagcataaaatatgactccttgctggagcagggccttgtcgaagcagctcttgtgtctaagatctcaagtccttcagataaaaagattccagctaagaaagagtcttgtccaaacactggaagagacaaagaccacctgttgaaatacaacgttggtgatttggtgtggtccaaagtgtcgggttacccttggtggccttgcatggtttctgcagatccactccttcacagctataccaaacttaaaggtcagaaaaagagtgcacgccagtatcacgtacagttctttggtgacgccccagaaagagcttggatatttgagaagagcctcgtagcttttgaaggagaaggacagtttgaaaaattatgccaggaaagtgccaagcaggcacccacgaaagctgagaaaattaagctattgaaaccaatttcagggaaattgagggcccagtgggaaatgggcattgttcaagcagaagaagctgcaagcatgtcagtggaggagcggaaagccaagttcacctttctctatgtgggggaccagcttcatctcaaccctcaagtagccaaggaggctggcattgctgcagagtctttgggagaaatggcagaatcctcaggagtcagtgaagaagctgctgaaaaccccaagtctgtgagagaagagtgcattcccatgaagagaaggcggagggccaaactgtgtagctctgcagagaccctggagagtcaccccgacatagggaagagtactcctcaaaagacggcagaggctgaccccagaagaggagtagggtctcctcctgggaggaagaagaccacagtctccatgccacgaagcaggaagggagatgcagcatcccagtttttggtcttctgtcaaaaacacagggatgaggtggtagctgagcacccagatgcttcaggtgaggagattgaagagctgctcaggtcacagtggagtctgctgagtgagaagcagagagcacgctacaacaccaagtttgccctggtggcccctgtccaggctgaagaagactctggtaatgtaaatgggaaaaaaagaaaccacacaaagaggatacaggaccctacagaagatgctgaagctgaggacacacccaggaaaagactcaggacggacaagcacagtcttcggaagcaacgaaaaatctgtctgatgcatgtaaaccactgaagaagcgaaatcgggcttccacggcagcatcttcagctcttgggtttagcaaaagttcatctccttctgcatccttaactgagaatgagggtaaaataataataataacgataaccatggcattggtatgaaggccatttagctgcccacgctgcagtgtgagtaatgctcagacttcataagcgcagcattggtgctcactgccagtgcagatgttttagggcctcttggctaactcagattcatgaaatggacaaacagtgcactatgttagtttatttgagcactttttatacacacgcacacagtgtctgtgtacatgtacagatatacttcagtcttgatgcagtttcatagttcttaaaatctgtctgaagaatgttgtgttctgtgtagccctcacactgtaagagttcacatggaagtaagtctgcgttggttctgaaagggcacagtgtcagttgagctgacatatactgggtggggtggaaggcgactcacacaccacacctgattcctgttgcttccagacctaggctcatggaggaagccaaagatttctttgttctcatgcatttcatggctttggtcctttaaattctggcacatttttagttacttgagtgttgaggtgagtcagaactaccattgtaatatgactcctgtgttctggacttgcagagtacatgatagcaaaataaagccatttggggctgctgcctgccatcattgtaacatgacacttagactttattatcaaacctaaattttttgccgttgccaaaaacaacaaatagccacagaacgtaggtgtgacacttttttgttcggaggtagttttggtttcctgatttttagggattaccttcatagagctttggagttttaatttcttgttatttggttctccgtgatgctgtttttctcattgtagacatgggtcctgtttttgtcatgtttatgaggagatgataactgggggcccttttggaacagggtagtgaggcaagggttggacaggccccttactcttgctgagtcagaaggcggcacttctggccaggtctctgccatggtccccaggaaggatggggtgtgcctcagttgtttccactcattagaggagtgtaggccttccagtgcaggaaggtcagggacctaggcaacctgggcggggctcatagagctctgcggcttgccactctgaatcctcagcgaccactcctccgagtgggattttctgcagggactcaaaccaactcagtggtggtcgagacctgttcacggatggtgggactggggctgctttacagtttgatacgtgtagataattaagcattttgtgatgtttggacacactggagaaaaggcagtaagaattatttactgaaacatctaggagcttactgaaatatgaaaaggcaaattttatacaaattatttttcctttttcctttctttcttgtccaagttcaggttaaaatcttagaaaattaaatgaaaggtcatttacagttccaaagaagaatattaaacatttttcacttaagttgagatttttgctttaaagagcttttaatgagtttttctgttatcataattttggtccggttattcacttgagttgttgcttatactgttgtcaggtacagtagagagaacatggagcctgctgagatcttctctgttattcctgatcctaagtcatgtatatcgaaggctttgatttagagtaatgcatgaggccagtgtagcggggtcgaggcctgcccatgagtcaggggagctcagtctccctggcctaggcagttgtcctgaccttgagaagacatagatgaagcattttatcatcattagacttaaattttaattcttcagaatgtcagaagttgataggttgttaaatacatttatataatacattaaatatgtgaaattaatacaccttcctacattttgaaggtgatgcatagatcccatagtgtgcatcatgttccttatatgaaaacgtttaaattactgggtcttttccattaaactacttttgtatggcttagataaatcttccattagtgttcatttttatagaattatgctgttaaaactactttaggtgaacaaataaacttgtctattatatattaacgcgactgaactacagtaaatgtttgtgatgtttccaatgctgaatgcctgttagcatatgaggcaaagtgtagtgttataaaaaacagcctgttgactgctgggcccgattctgatatgagttaggtgaccatgagaattgctgtttgaggtccacactgacacacacccattgggtcacaccccctttgcatgtttgtatttcctccctttcatcacatttgtttgaaataaggtacttttatagggttggtatttcagaacactttaggtcatgttgtagtttaaattcttcttgaaaaaggtatatgtgataaataaaaatttttattggaataattattacatggtactacatcaccctgaggaagagaataaattaaaattacacacttgcatgacaaaggcctgtgaaggaattaatgtgatttaagtgttttgtaacttcattttttattcctttagtagagcaaattcttatttttttcgccttcactggtaacagcttttgtgggagcccacaccagtcaagttggatttgaacccagctgctctgtactgcacttagaatgatgtaatattccaggatgctgctgcaggtggcgtatcatcgtacacactcagtgacatttctatcacaatcattttatggaagatgtgtgataatctgtttttactggtattaataaacacatacaatgaagaaaacagataacaaattttaagaccaaggtctcggacagcccgggagacgagccctcggagtccccatacgaaagtgcagacgaaacacaaactgaagtatctgtctcatccaaaaagtctgagcgaggagtgactgccaaaaaggagtatgtgtgccagctgtgtgagaagccgggcagcctcctgctctgtgaaggaccctgctgcggagctttccacctcgcctgccttgggctttcccggaggccagaagggaggttcacctgcagcgagtgtgcctcaggtgtcgcccggcacagtctggggtctgtgaggatgatgagaggacacctgcacagccgtggcccttcctgcctactcaccgggcccaaggagtctcctatctcacgtcagaacacttcctgggtcaggaagacacctggagagtctcccaggccatggcagccccacagcagcacctcacttatgggagtgtctgtctgcctgcccagaatgataagtgactgctccaccactggccagctgctctcaaggaggaaaggcctcttttcataggagccccttctttcaagcttcttgccagttagactgggcctccccagccaggctgcctagtaagattctcctgtatttcaggtgaagctggagctcagatcgcagcaaggtaatccttgatggctggatctttttgctggagaatgcttggactagtgagcaaggttggaaacagggccaggtgctttagcagcgtggctgcctctgaagaggagttgcttgattttagtggctcagaactgcaatttaattcttgttctttgcacctctctctccaccccttctttaactttttgttagggattcactcatgtttcgtgtgtaaagagagcaagacagatgttaagcgctgtgtggtaactcagtgtggaaaattttaccatgaggcttgtgtgaaaaaataccctctgactgtatttgagagccgaggtttccgctgccccctccacagctgtgtgagctgccatgcttccaacccttcaaacccaaggccgtcaaaaggtaaaatgatgcggtgtgtccgctgccccgttgcctatcacagcggggatgcttgtctggcagcaggatgctcagtgatcgcctccaacagcatcatctgcactgcccacttcactgctcggaaggggaagcgacaccacgcccacgtcaacgtgagctggtgcttcgtgtgctccaaaggggggagccttctgtgctgtgagtcctgcccagcggccttccaccctgactgcctgaacatcgagatgcctgacggcagctggttctgcaatgactgcagggctgggaagaagctgcacttccaggatatcatttgggtgaaacttgggaactacagatggtggccggcagaagtttgccatcccaaaaatgttcccccaaatattcagaaaatgaagcacgagattggagaattccctgtgtttttctttgggtctaaagattattactggacgcatcaggcgcgagtgttcccgtacatggagggggaccggggcagccgctaccagggggtcagagggatcggaagagtcttcaaaaacgcactgcaagaagctgaagctcgttttcgtgaaattaagcttcagagggaagcccgagaaacacaggagagcgagcgcaagcccccaccatacaagcacatcaaggtgaataagccttacgggaaagtccagatctacacagcggatatttcagaaatccctaagtgcaactgcaagcccacagatgagaatccttgtggctttgattcggagtgtctgaacaggatgctgatgtttgagtgccacccgcaggtgtgtcccgcgggcgagttctgccagaaccagtgcttcaccaagcgccagtacccagagaccaagatcatcaagacagatggcaaagggtggggcctggtcgccaagagggacatcagaaagggagaatttgttaacgagtacgttggggagctgatcgacgaggaggagtgcatggcgagaatcaagcacgcacacgagaacgacatcacccacttctacatgctcactatagacaaggaccgtataatagacgctggccccaaaggaaactactctcgatttatgaatcacagctgccagcccaactgtgagaccctcaagtggacagtgaatggggacactcgtgtgggcctgtttgccgtctgtgacattcctgcagggacggagctgacttttaactacaacctcgattgtctgggcaatgaaaaaacggtctgccggtgtggagcctccaattgcagtggattcctcggggatagaccaaagacctcgacgaccctttcatcagaggaaaagggcaaaaagaccaagaagaaaacgaggcggcgcagagcaaaaggggaagggaagaggcagtcagaggacgagtgcttccgctgcggtgatggcgggcagctggtgctgtgtgaccgcaagttctgcaccaaggcctaccacctgtcctgcctgggccttggcaagcggcccttcgggaagtgggaatgtccttggcatcattgtgacgtgtgtggcaaaccttcgacttcattttgccacctctgccccaattcgttctgtaaggagcaccaggacgggacagccttcagctgcaccccggacgggcggtcctactgctgtgagcatgacttaggggcggcatcggtcagaagcaccaagactgagaagccccccccagagccagggaagccgaaggggaagaggcggcggcggaggggctggcggagagtcacagagggcaaatagcgccaggcggccgcttggccggatccaggggcggtgcagggcggccggccctgcctgcgggagagggcgagcatgaactggcccggaggacccagctcgagccgccaggacacagacgtacaggcctcctcgggagggagcgcctccccaccactgagccatcctcagcagcgtccgctgcgtctgcactgatgaccgtctgagcccagctcagcgttcctggacaaacagcctcactcctcagcgttaccgccacacttgaatttctccgaatgtcaaggttccctcccactctatttttttaggttaaagttaattggcatatggaatgttttaatctcctctgaaatgtgtagcgtaggcttttcccaagggtcgctagaaactcgtcttcgcgttgccccctttctggctctcagcgccgtcgccactcgggagaggctgggtgaggcccgtgtgaggactgaccctggattcctcgaaactgccattgtgatcattactctgctctttggaaatggctgtatcatttttttgtactaatgtgaattgttcctcagaaacgcttcttttccatcctagtgagaagctggccctgcaggtggtggcagcaatggtgttgtaagatttcctcccgtagttttttctcctcatggatttgaatgaaatgccaataacacgtccactttcaacgtgtagtttacgcggagcactttcgaggcctggccgggttgggcctacttctcacctgggcctatcttctgaactcgctaggttcttatcaacatttgggggataactttgtatatttttttcatttggcttttctttaccagtttctgatttttattctcaatatatttttgctaaacctatttcacaaatcaccaccgactgaagtgtgtgtttactgatgcggccctgagctccatggcgaaaggagtgactttgcagggcgtgagaccgcagtctgcttagagcacaggaagtgacaacttagggagccccgtagggcgctgcaggccccggggaccccagcacgtgggtctaaagagagacggagtctagctctcctgccacccagagtggcttccatctcagcactctgtgggtctggtgatggaagatgcagtctctgctgatcacatgtgccctctgccagggcacctactgagaggtgcggtcctgggggtggaggcctgcctggcaggtgtgcgtgcctcgtacgtgtgttatgggcactggtctaggccaggtatgacacccactctcctgtgagatttcactttagtttttaaaaggtccagttctacagagtgagacctatctatctgagtactacatatgttttaagacttggttctttttttgagggatccttgaccctgggaagtctggagcaccctgagaagggggcaccatgtgtgcctttgcccacgtgtcctgaggggctgcttgtctgggagggagggagagaacattcagcagcaggtgcttttttatggccttttcttaaaataacctaagggggacacatccatcttgcagagaagtttacagaactccccttgaaaactgctgctgaggctcctgttaaattttctgtggcatcttttatgccttggtaaaaactgcagtgtctttggacctgagagtggctactccgtggttttgtgacctgtaagcgtggggttcaggggtgtgtggccctgcagggtcccacgcctccctgagcactgactggaagtttcactggctggtggctgtcccttctcccatcagggtccccagcaaagttaactacacagaggacccaggggaaacgagctgtgtagccactgacttgctcgcgcggccgtggcctctgaggggcactcgccggttaagacagggtgggagtagtgctttccagttcagactctaacttctcccaaagtgtcctaagaaaatactggatcggctcatagatttatgctccttatgatgccctaacttggaaggttgttctagggacaggccgggcagtgtccccacacacaccttagagtcgaaggccccagggccccgctgtcacttgcccaaaagatcccttccggcaggtaagggactaccaatgcttacgtcaaaacagcagaatcggctttgcagtgcactttggggagcagatattaacttatttttgtgttggacagtagtgaaatcttgtgatttttaatcgctttgataatacttccaaattttatgatttttctgaaggaaataatgcaaacattttaaatatgtttctccccctttccaaaaactgttaaactaatgagcaagtaacactaactttgaatgtctctacaatacccgttgataactcagtggagccaggctttggggtagcggccctgagcttgcagggtttctcgccactggggctgaccacgcccccagctgtgaccgtgggtgtggctggctctcggccctgcccagctttgttctgaggacgtggtgacttcctgaacatcagcttcaatcctccatcattaatgtgaagcaaaacacaaaaaccgccccaatccctcaggattccttggcatccgaaaccagcatctgcacctaaacccatacccacccgtgtgcgcccacagggggatgtgtccgaatgggcagcttaaaatgtggtcacctgtgggggaaactcttcaggcacctgaagtgagaacccagctgtccgtcctcaggccggcctttcttccggcgacacccgtccatggctggctgggtccccttcgcagtgtttgtctgtcttgacatctaaaccccggcgtgtgcagtgcccatcttccaggactaccttattttccagaattaaacctgttttataattcaagttaatgcaaatgactgtcagttgccaaatatcttgatcctatgagtgtagttgatgactgtttgttagtcagtagagtaaaatgctgtgtccacggggtgtcacagcctcaccataccctgttgaggtgtgaaatgccccgtcagaaattaaatacaaacttaaatgtgcctattggtgtctaaacttcatacaatgtaaggtcagattccttttaggaatactgggtgctgtcaccaggtttgatagttagacttaaaaacttgaaattcactttttggggggagggatatactgaaatagagagttgagacttgccagttgggggaaaatagcatttaaaatggaaagctgtgtttggaaaattgtgtatgagtatttttgtattaaaaacattttaaaggcttttttcttaa

SEQ ID NO: 440507 - DNA, 11056 bp, Homo sapiens
  misc_feature (12)..(12): n is a, c, g, or t
  misc_feature (86)..(86): n is a, c, g, or t
gggaggcgcggnggcggggtcggcgccgcgcgcgagagcctcggcctggccgcgctgcgcccgccgccgccgccgccccctccccncctgggccctaccgccgcacggccccggccccctcccagcctgccgctccggagagccgcccgccgaggatgcgacgcaccgcagtgttctaagaacggaagcatctgggctggatggaatttagcatcaagcagagtcccctttctgttcagagtgttgtaaagtgcataaagatgaagcaggcaccagaaatcctcggcagtgccaacgggaagactccgagctgcgaggtgaaccgcgagtgttctgtgttcctcagcaaagcccagctctccagtagcctgcaggagggggtcatgcagaagtttaacggccacgacgccctgccctttattccagccgacaagctgaaagatcttacttcccgggtgtttaatggagaacccggcgcacacgatgccaaactgcgttttgagtcccaggaaatgaaagggattgggacaccccctaacactacccctatcaaaaatggctctccagaaattaagctgaaaatcaccaaaacatacatgaatgggaagcctctctttgaatcttccatttgtggtgacagtgctgctgatgtgtctcagtcagaagaaaatggacaaaaaccagaaaacaaggcgagaaggaacaggaagaggagcataaaatatgactccttgctggagcagggccttgtcgaagcagctcttgtgtctaagatctcaagtccttcagataaaaagattccagctaagaaagagtcttgtccaaacactggaagagacaaagaccacctgttgaaatacaacgttggtgatttggtgtggtccaaagtgtcgggttacccttggtggccttgcatggtttctgcagatccactccttcacagctataccaaacttaaaggtattttcaaatcaaagaagtttgaacacttaaaaacaagtcaaattgtactgaaagattaatagtgaaaaatcatcccctgccttcctctctcctccccagaggtcagaaaaagagtgcacgccagtatcacgtacagttctttggtgacgccccagaaagagcttggatatttgagaagagcctcgtagcttttgaaggagaaggacagtttgaaaaattatgccaggaaagtgccaagcaggcacccacgaaagctgagaaaattaagctattgaaaccaatttcagggaaattgagggcccagtgggaaatgggcattgttcaagcagaagaagctgcaagcatgtcagtggaggagcggaaagccaagttcacctttctctatgtgggggaccagcttcatctcaaccctcaagtagccaaggaggctggcattgctgcagagtctttgggagaaatggcagaatcctcaggagtcagtgaagaagctgctgaaaaccccaagtctgtgagagaagagtgcattcccatgaagagaaggcggagggccaaactgtgtagctctgcagagaccctggagagtcaccccgacatagggaagagtactcctcaaaagacggcagaggctgaccccagaagaggagtagggtctcctcctgggaggaagaagaccacagtctccatgccacgaagcaggaagggagatgcagcatcccagtttttggtcttctgtcaaaaacacagggatgaggtggtagctgagcacccagatgcttcaggtgaggagattgaagagctgctcaggtcacagtggagtctgctgagtgagaagcagagagcacgctacaacaccaagtttgccctggtggcccctgtccaggctgaagaagactctggtaatgtaaatgggaaaaaaagaaaccacacaaagaggatacaggaccctacagaagatgctgaagctgaggacacacccaggaaaagactcaggacggacaagcacagtcttcggaagagagacacaatcactgacaaaacggccagaacaagctcttacaaggccatggaggcagcctcctcgctcaagagccaggcagcaacgaaaaatctgtctgatgcatgtaaaccactgaagaagcgaaatcgggcttccacggcagcatcttcagctcttgggtttagcaaaagttcatctccttctgcatccttaactgagaatgagggtaaaataataataataacgataaccatggcattggtatgaaggccatttagctgcccacgctgcagtgtgagtaatgctcagacttcataagcgcagcattggtgctcactgccagtgcagatgttttagggcctcttggctaactcagattcatgaaatggacaaacagtgcactatgttagtttatttgagcactttttatacacacgcacacagtgtctgtgtacatgtacagatatacttcagtcttgatgcagtttcatagttcttaaaatctgtctgaagaatgttgtgttctgtgtagccctcacactgtaagagttcacatggaagtaagtctgcgttggttctgaaagggcacagtgtcagttgagctgacatatactgggtggggtggaaggcgactcacacaccacacctgattcctgttgcttccagacctaggctcatggaggaagccaaagatttctttgttctcatgcatttcatggctttggtcctttaaattctggcacatttttagttacttgagtgttgaggtgagtcagaactaccattgtaatatgactcctgtgttctggacttgcagagtacatgatagcaaaataaagccatttggggctgctgcctgccatcattgtaacatgacacttagactttattatcaaacctaaattttttgccgttgccaaaaacaacaaatagccacagaacgtaggtgtgacacttttttgttcggaggtagttttggtttcctgatttttagggattaccttcatagagctttggagttttaatttcttgttatttggttctccgtgatgctgtttttctcattgtagacatgggtcctgtttttgtcatgtttatgaggagatgataactgggggcccttttggaacagggtagtgaggcaagggttggacaggccccttactcttgctgagtcagaaggcggcacttctggccaggtctctgccatggtccccaggaaggatggggtgtgcctcagttgtttccactcattagaggagtgtaggccttccagtgcaggaaggtcagggacctaggcaacctgggcggggctcatagagctctgcggcttgccactctgaatcctcagcgaccactcctccgagtgggattttctgcagggactcaaaccaactcagtggtggtcgagacctgttcacggatggtgggactggggctgctttacagtttgatacgtgtagataattaagcattttgtgatgtttggacacactggagaaaaggcagtaagaattatttactgaaacatctaggagcttactgaaatatgaaaaggcaaattttatacaaattatttttcctttttcctttctttcttgtccaagttcaggttaaaatcttagaaaattaaatgaaaggtcatttacagttccaaagaagaatattaaacatttttcacttaagttgagatttttgctttaaagagcttttaatgagtttttctgttatcataattttggtccggttattcacttgagttgttgcttatactgttgtcaggtacagtagagagaacatggagcctgctgagatcttctctgttattcctgatcctaagtcatgtatatcgaaggctttgatttagagtaatgcatgaggccagtgtagcggggtcgaggcctgcccatgagtcaggggagctcagtctccctggcctaggcagttgtcctgaccttgagaagacatagatgaagcattttatcatcattagacttaaattttaattcttcagaatgtcagaagttgataggttgttaaatacatttatataatacattaaatatgtgaaattaatacaccttcctacattttgaaggtgatgcatagatcccatagtgtgcatcatgttccttatatgaaaacgtttaaattactgggtcttttccattaaactacttttgtatggcttagataaatcttccattagtgttcatttttatagaattatgctgttaaaactactttaggtgaacaaataaacttgtctattatatattaacgcgactgaactacagtaaatgtttgtgatgtttccaatgctgaatgcctgttagcatatgaggcaaagtgtagtgttataaaaaacagcctgttgactgctgggcccgattctgatatgagttaggtgaccatgagaattgctgtttgaggtccacactgacacacacccattgggtcacaccccctttgcatgtttgtatttcctccctttcatcacatttgtttgaaataaggtacttttatagggttggtatttcagaacactttaggtcatgttgtagtttaaattcttcttgaaaaaggtatatgtgataaataaaaatttttattggaataattattacatggtactacatcaccctgaggaagagaataaattaaaattacacacttgcatgacaaaggcctgtgaaggaattaatgtgatttaagtgttttgtaacttcattttttattcctttagtagagcaaattcttatttttttcgccttcactggtaacagcttttgtgggagcccacaccagtcaagttggatttgaacccagctgctctgtactgcacttagaatgatgtaatattccaggatgctgctgcaggtggcgtatcatcgtacacactcagtgacatttctatcacaatcattttatggaagatgtgtgataatctgtttttactggtattaataaacacatacaatgaagaaaacagataacaaattttaagaccaaggtctcggacagcccgggagacgagccctcggagtccccatacgaaagtgcagacgaaacacaaactgaagtatctgtctcatccaaaaagtctgagcgaggagtgactgccaaaaaggagtatgtgtgccagctgtgtgagaagccgggcagcctcctgctctgtgaaggaccctgctgcggagctttccacctcgcctgccttgggctttcccggaggccagaagggaggttcacctgcagcgagtgtgcctcaggtgtcgcccggcacagtctggggtctgtgaggatgatgagaggacacctgcacagccgtggcccttcctgcctactcaccgggcccaaggagtctcctatctcacgtcagaacacttcctgggtcaggaagacacctggagagtctcccaggccatggcagccccacagcagcacctcacttatgggagtgtctgtctgcctgcccagaatgataagtgactgctccaccactggccagctgctctcaaggaggaaaggcctcttttcataggagccccttctttcaagcttcttgccagttagactgggcctccccagccaggctgcctagtaagattctcctgtatttcaggtgaagctggagctcagatcgcagcaaggtaatccttgatggctggatctttttgctggagaatgcttggactagtgagcaaggttggaaacagggccaggtgctttagcagcgtggctgcctctgaagaggagttgcttgattttagtggctcagaactgcaatttaattcttgttctttgcacctctctctccaccccttctttaactttttgttagggattcactcatgtttcgtgtgtaaagagagcaagacagatgttaagcgctgtgtggtaactcagtgtggaaaattttaccatgaggcttgtgtgaaaaaataccctctgactgtatttgagagccgaggtttccgctgccccctccacagctgtgtgagctgccatgcttccaacccttcaaacccaaggccgtcaaaaggtaaaatgatgcggtgtgtccgctgccccgttgcctatcacagcggggatgcttgtctggcagcaggatgctcagtgatcgcctccaacagcatcatctgcactgcccacttcactgctcggaaggggaagcgacaccacgcccacgtcaacgtgagctggtgcttcgtgtgctccaaaggggggagccttctgtgctgtgagtcctgcccagcggccttccaccctgactgcctgaacatcgagatgcctgacggcagctggttctgcaatgactgcagggctgggaagaagctgcacttccaggatatcatttgggtgaaacttgggaactacagatggtggccggcagaagtttgccatcccaaaaatgttcccccaaatattcagaaaatgaagcacgagattggagaattccctgtgtttttctttgggtctaaagattattactggacgcatcaggcgcgagtgttcccgtacatggagggggaccggggcagccgctaccagggggtcagagggatcggaagagtcttcaaaaacgcactgcaagaagctgaagctcgttttcgtgaaattaagcttcagagggaagcccgagaaacacaggagagcgagcgcaagcccccaccatacaagcacatcaaggtgaataagccttacgggaaagtccagatctacacagcggatatttcagaaatccctaagtgcaactgcaagcccacagatgagaatccttgtggctttgattcggagtgtctgaacaggatgctgatgtttgagtgccacccgcaggtgtgtcccgcgggcgagttctgccagaaccagtgcttcaccaagcgccagtacccagagaccaagatcatcaagacagatggcaaagggtggggcctggtcgccaagagggacatcagaaagggagaatttgttaacgagtacgttggggagctgatcgacgaggaggagtgcatggcgagaatcaagcacgcacacgagaacgacatcacccacttctacatgctcactatagacaaggaccgtataatagacgctggccccaaaggaaactactctcgatttatgaatcacagctgccagcccaactgtgagaccctcaagtggacagtgaatggggacactcgtgtgggcctgtttgccgtctgtgacattcctgcagggacggagctgacttttaactacaacctcgattgtctgggcaatgaaaaaacggtctgccggtgtggagcctccaattgcagtggattcctcggggatagaccaaagacctcgacgaccctttcatcagaggaaaagggcaaaaagaccaagaagaaaacgaggcggcgcagagcaaaaggggaagggaagaggcagtcagaggacgagtgcttccgctgcggtgatggcgggcagctggtgctgtgtgaccgcaagttctgcaccaaggcctaccacctgtcctgcctgggccttggcaagcggcccttcgggaagtgggaatgtccttggcatcattgtgacgtgtgtggcaaaccttcgacttcattttgccacctctgccccaattcgttctgtaaggagcaccaggacgggacagccttcagctgcaccccggacgggcggtcctactgctgtgagcatgacttaggggcggcatcggtcagaagcaccaagactgagaagccccccccagagccagggaagccgaaggggaagaggcggcggcggaggggctggcggagagtcacagagggcaaatagcgccaggcggccgcttggccggatccaggggcggtgcagggcggccggccctgcctgcgggagagggcgagcatgaactggcccggaggacccagctcgagccgccaggacacagacgtacaggcctcctcgggagggagcgcctccccaccactgagccatcctcagcagcgtccgctgcgtctgcactgatgaccgtctgagcccagctcagcgttcctggacaaacagcctcactcctcagcgttaccgccacacttgaatttctccgaatgtcaaggttccctcccactctatttttttaggttaaagttaattggcatatggaatgttttaatctcctctgaaatgtgtagcgtaggcttttcccaagggtcgctagaaactcgtcttcgcgttgccccctttctggctctcagcgccgtcgccactcgggagaggctgggtgaggcccgtgtgaggactgaccctggattcctcgaaactgccattgtgatcattactctgctctttggaaatggctgtatcatttttttgtactaatgtgaattgttcctcagaaacgcttcttttccatcctagtgagaagctggccctgcaggtggtggcagcaatggtgttgtaagatttcctcccgtagttttttctcctcatggatttgaatgaaatgccaataacacgtccactttcaacgtgtagtttacgcggagcactttcgaggcctggccgggttgggcctacttctcacctgggcctatcttctgaactcgctaggttcttatcaacatttgggggataactttgtatatttttttcatttggcttttctttaccagtttctgatttttattctcaatatatttttgctaaacctatttcacaaatcaccaccgactgaagtgtgtgtttactgatgcggccctgagctccatggcgaaaggagtgactttgcagggcgtgagaccgcagtctgcttagagcacaggaagtgacaacttagggagccccgtagggcgctgcaggccccggggaccccagcacgtgggtctaaagagagacggagtctagctctcctgccacccagagtggcttccatctcagcactctgtgggtctggtgatggaagatgcagtctctgctgatcacatgtgccctctgccagggcacctactgagaggtgcggtcctgggggtggaggcctgcctggcaggtgtgcgtgcctcgtacgtgtgttatgggcactggtctaggccaggtatgacacccactctcctgtgagatttcactttagtttttaaaaggtccagttctacagagtgagacctatctatctgagtactacatatgttttaagacttggttctttttttgagggatccttgaccctgggaagtctggagcaccctgagaagggggcaccatgtgtgcctttgcccacgtgtcctgaggggctgcttgtctgggagggagggagagaacattcagcagcaggtgcttttttatggccttttcttaaaataacctaagggggacacatccatcttgcagagaagtttacagaactccccttgaaaactgctgctgaggctcctgttaaattttctgtggcatcttttatgccttggtaaaaactgcagtgtctttggacctgagagtggctactccgtggttttgtgacctgtaagcgtggggttcaggggtgtgtggccctgcagggtcccacgcctccctgagcactgactggaagtttcactggctggtggctgtcccttctcccatcagggtccccagcaaagttaactacacagaggacccaggggaaacgagctgtgtagccactgacttgctcgcgcggccgtggcctctgaggggcactcgccggttaagacagggtgggagtagtgctttccagttcagactctaacttctcccaaagtgtcctaagaaaatactggatcggctcatagatttatgctccttatgatgccctaacttggaaggttgttctagggacaggccgggcagtgtccccacacacaccttagagtcgaaggccccagggccccgctgtcacttgcccaaaagatcccttccggcaggtaagggactaccaatgcttacgtcaaaacagcagaatcggctttgcagtgcactttggggagcagatattaacttatttttgtgttggacagtagtgaaatcttgtgatttttaatcgctttgataatacttccaaattttatgatttttctgaaggaaataatgcaaacattttaaatatgtttctccccctttccaaaaactgttaaactaatgagcaagtaacactaactttgaatgtctctacaatacccgttgataactcagtggagccaggctttggggtagcggccctgagcttgcagggtttctcgccactggggctgaccacgcccccagctgtgaccgtgggtgtggctggctctcggccctgcccagctttgttctgaggacgtggtgacttcctgaacatcagcttcaatcctccatcattaatgtgaagcaaaacacaaaaaccgccccaatccctcaggattccttggcatccgaaaccagcatctgcacctaaacccatacccacccgtgtgcgcccacagggggatgtgtccgaatgggcagcttaaaatgtggtcacctgtgggggaaactcttcaggcacctgaagtgagaacccagctgtccgtcctcaggccggcctttcttccggcgacacccgtccatggctggctgggtccccttcgcagtgtttgtctgtcttgacatctaaaccccggcgtgtgcagtgcccatcttccaggactaccttattttccagaattaaacctgttttataattcaagttaatgcaaatgactgtcagttgccaaatatcttgatcctatgagtgtagttgatgactgtttgttagtcagtagagtaaaatgctgtgtccacggggtgtcacagcctcaccataccctgttgaggtgtgaaatgccccgtcagaaattaaatacaaacttaaatgtgcctattggtgtctaaacttcatacaatgtaaggtcagattccttttaggaatactgggtgctgtcaccaggtttgatagttagacttaaaaacttgaaattcactttttggggggagggatatactgaaatagagagttgagacttgccagttgggggaaaatagcatttaaaatggaaagctgtgtttggaaaattgtgtatgagtatttttgtattaaaaacattttaaaggcttttttcttaa

SEQ ID NO: 440508 - DNA, 8309 bp, Homo sapiens
  misc_feature (12)..(12): n is a, c, g, or t
  misc_feature (86)..(86): n is a, c, g, or t
gggaggcgcggnggcggggtcggcgccgcgcgcgagagcctcggcctggccgcgctgcgcccgccgccgccgccgccccctccccncctgggccctaccgccgcacggccccggccccctcccagcctgccgctccggagagccgcccgccgaggatgcgacgcaccgcagtgttctaagaacggaagcatctgggctggatggaatttagcatcaagcagagtcccctttctgttcagagtgttgtaaagtgcataaagatgaagcaggcaccagaaatcctcggcagtgccaacgggaagactccgagctgcgaggtgaaccgcgagtgttctgtgttcctcagcaaagcccagctctccagtagcctgcaggagggggtcatgcagaagtttaacggccacgacgccctgccctttattccagccgacaagctgaaagatcttacttcccgggtgtttaatggagaacccggcgcacacgatgccaaactgcgttttgagtcccaggaaatgaaagggattgggacaccccctaacactacccctatcaaaaatggctctccagaaattaagctgaaaatcaccaaaacatacatgaatgggaagcctctctttgaatcttccatttgtggtgacagtgctgctgatgtgtctcagtcagaagaaaatggacaaaaaccagaaaacaaggcgagaaggaacaggaagaggagcataaaatatgactccttgctggagcagggccttgtcgaagcagctcttgtgtctaagatctcaagtccttcagataaaaagattccagctaagaaagagtcttgtccaaacactggaagagacaaagaccacctgttgaaatacaacgttggtgatttggtgtggtccaaagtgtcgggttacccttggtggccttgcatggtttctgcagatccactccttcacagctataccaaacttaaaggtcagaaaaagagtgcacgccagtatcacgtacagttctttggtgacgccccagaaagagcttggatatttgagaagagcctcgtagcttttgaaggagaaggacagtttgaaaaattatgccaggaaagtgccaagcaggcacccacgaaagctgagaaaattaagctattgaaaccaatttcagggaaattgagggcccagtgggaaatgggcattgttcaagcagaagaagctgcaagcatgtcagtggaggagcggaaagccaagttcacctttctctatgtgggggaccagcttcatctcaaccctcaagtagccaaggaggctggcattgctgcagagtctttgggagaaatggcagaatcctcaggagtcagtgaagaagctgctgaaaaccccaagtctgtgagagaagagtgcattcccatgaagagaaggcggagggccaaactgtgtagctctgcagagaccctggagagtcaccccgacatagggaagagtactcctcaaaagacggcagaggctgaccccagaagaggagtagggtctcctcctgggaggaagaagaccacagtctccatgccacgaagcaggaagggagatgcagcatcccagtttttggtcttctgtcaaaaacacagggatgaggtggtagctgagcacccagatgcttcaggtgaggagattgaagagctgctcaggtcacagtggagtctgctgagtgagaagcagagagcacgctacaacaccaagtttgccctggtggcccctgtccaggctgaagaagactctggtaatgtaaatgggaaaaaaagaaaccacacaaagaggatacaggaccctacagaagatgctgaagctgaggacacacccaggaaaagactcaggacggacaagcacagtcttcggaagcaacgaaaaatctgtctgatgcatgtaaaccactgaagaagcgaaatcgggcttccacggcagcatcttcagctcttgggtttagcaaaagttcatctccttctgcatccttaactgagaatgagcttttgtgggagcccacaccagtcaagttggatttgaacccagctgctctgtactgcacttagaatgatgtaatattccaggatgctgctgcaggtggcgtatcatcgtacacactcagtgacatttctatcacaatcattttatggaagatgtgtgataatctgtttttactggtattaataaacacatacaatgaagaaaacagataacaaattttaagaccaaggtctcggacagcccgggagacgagccctcggagtccccatacgaaagtgcagacgaaacacaaactgaagtatctgtctcatccaaaaagtctgagcgaggagtgactgccaaaaaggagtatgtgtgccagctgtgtgagaagccgggcagcctcctgctctgtgaaggaccctgctgcggagctttccacctcgcctgccttgggctttcccggaggccagaagggaggttcacctgcagcgagtgtgcctcaggtgtcgcccggcacagtctggggtctgtgaggatgatgagaggacacctgcacagccgtggcccttcctgcctactcaccgggcccaaggagtctcctatctcacgtcagaacacttcctgggtcaggaagacacctggagagtctcccaggccatggcagccccacagcagcacctcacttatgggagtgtctgtctgcctgcccagaatgataagtgactgctccaccactggccagctgctctcaaggaggaaaggcctcttttcataggagccccttctttcaagcttcttgccagttagactgggcctccccagccaggctgcctagtaagattctcctgtatttcaggtgaagctggagctcagatcgcagcaaggtaatccttgatggctggatctttttgctggagaatgcttggactagtgagcaaggttggaaacagggccaggtgctttagcagcgtggctgcctctgaagaggagttgcttgattttagtggctcagaactgcaatttaattcttgttctttgcacctctctctccaccccttctttaactttttgttagggattcactcatgtttcgtgtgtaaagagagcaagacagatgttaagcgctgtgtggtaactcagtgtggaaaattttaccatgaggcttgtgtgaaaaaataccctctgactgtatttgagagccgaggtttccgctgccccctccacagctgtgtgagctgccatgcttccaacccttcaaacccaaggccgtcaaaaggtaaaatgatgcggtgtgtccgctgccccgttgcctatcacagcggggatgcttgtctggcagcaggatgctcagtgatcgcctccaacagcatcatctgcactgcccacttcactgctcggaaggggaagcgacaccacgcccacgtcaacgtgagctggtgcttcgtgtgctccaaaggggggagccttctgtgctgtgagtcctgcccagcggccttccaccctgactgcctgaacatcgagatgcctgacggcagctggttctgcaatgactgcagggctgggaagaagctgcacttccaggatatcatttgggtgaaacttgggaactacagatggtggccggcagaagtttgccatcccaaaaatgttcccccaaatattcagaaaatgaagcacgagattggagaattccctgtgtttttctttgggtctaaagattattactggacgcatcaggcgcgagtgttcccgtacatggagggggaccggggcagccgctaccagggggtcagagggatcggaagagtcttcaaaaacgcactgcaagaagctgaagctcgttttcgtgaaattaagcttcagagggaagcccgagaaacacaggagagcgagcgcaagcccccaccatacaagcacatcaaggtgaataagccttacgggaaagtccagatctacacagcggatatttcagaaatccctaagtgcaactgcaagcccacagatgagaatccttgtggctttgattcggagtgtctgaacaggatgctgatgtttgagtgccacccgcaggtgtgtcccgcgggcgagttctgccagaaccagtgcttcaccaagcgccagtacccagagaccaagatcatcaagacagatggcaaagggtggggcctggtcgccaagagggacatcagaaagggagaatttgttaacgagtacgttggggagctgatcgacgaggaggagtgcatggcgagaatcaagcacgcacacgagaacgacatcacccacttctacatgctcactatagacaaggaccgtataatagacgctggccccaaaggaaactactctcgatttatgaatcacagctgccagcccaactgtgagaccctcaagtggacagtgaatggggacactcgtgtgggcctgtttgccgtctgtgacattcctgcagggacggagctgacttttaactacaacctcgattgtctgggcaatgaaaaaacggtctgccggtgtggagcctccaattgcagtggattcctcggggatagaccaaagacctcgacgaccctttcatcagaggaaaagggcaaaaagaccaagaagaaaacgaggcggcgcagagcaaaaggggaagggaagaggcagtcagaggacgagtgcttccgctgcggtgatggcgggcagctggtgctgtgtgaccgcaagttctgcaccaaggcctaccacctgtcctgcctgggccttggcaagcggcccttcgggaagtgggaatgtccttggcatcattgtgacgtgtgtggcaaaccttcgacttcattttgccacctctgccccaattcgttctgtaaggagcaccaggacgggacagccttcagctgcaccccggacgggcggtcctactgctgtgagcatgacttaggggcggcatcggtcagaagcaccaagactgagaagccccccccagagccagggaagccgaaggggaagaggcggcggcggaggggctggcggagagtcacagagggcaaatagcgccaggcggccgcttggccggatccaggggcggtgcagggcggccggccctgcctgcgggagagggcgagcatgaactggcccggaggacccagctcgagccgccaggacacagacgtacaggcctcctcgggagggagcgcctccccaccactgagccatcctcagcagcgtccgctgcgtctgcactgatgaccgtctgagcccagctcagcgttcctggacaaacagcctcactcctcagcgttaccgccacacttgaatttctccgaatgtcaaggttccctcccactctatttttttaggttaaagttaattggcatatggaatgttttaatctcctctgaaatgtgtagcgtaggcttttcccaagggtcgctagaaactcgtcttcgcgttgccccctttctggctctcagcgccgtcgccactcgggagaggctgggtgaggcccgtgtgaggactgaccctggattcctcgaaactgccattgtgatcattactctgctctttggaaatggctgtatcatttttttgtactaatgtgaattgttcctcagaaacgcttcttttccatcctagtgagaagctggccctgcaggtggtggcagcaatggtgttgtaagatttcctcccgtagttttttctcctcatggatttgaatgaaatgccaataacacgtccactttcaacgtgtagtttacgcggagcactttcgaggcctggccgggttgggcctacttctcacctgggcctatcttctgaactcgctaggttcttatcaacatttgggggataactttgtatatttttttcatttggcttttctttaccagtttctgatttttattctcaatatatttttgctaaacctatttcacaaatcaccaccgactgaagtgtgtgtttactgatgcggccctgagctccatggcgaaaggagtgactttgcagggcgtgagaccgcagtctgcttagagcacaggaagtgacaacttagggagccccgtagggcgctgcaggccccggggaccccagcacgtgggtctaaagagagacggagtctagctctcctgccacccagagtggcttccatctcagcactctgtgggtctggtgatggaagatgcagtctctgctgatcacatgtgccctctgccagggcacctactgagaggtgcggtcctgggggtggaggcctgcctggcaggtgtgcgtgcctcgtacgtgtgttatgggcactggtctaggccaggtatgacacccactctcctgtgagatttcactttagtttttaaaaggtccagttctacagagtgagacctatctatctgagtactacatatgttttaagacttggttctttttttgagggatccttgaccctgggaagtctggagcaccctgagaagggggcaccatgtgtgcctttgcccacgtgtcctgaggggctgcttgtctgggagggagggagagaacattcagcagcaggtgcttttttatggccttttcttaaaataacctaagggggacacatccatcttgcagagaagtttacagaactccccttgaaaactgctgctgaggctcctgttaaattttctgtggcatcttttatgccttggtaaaaactgcagtgtctttggacctgagagtggctactccgtggttttgtgacctgtaagcgtggggttcaggggtgtgtggccctgcagggtcccacgcctccctgagcactgactggaagtttcactggctggtggctgtcccttctcccatcagggtccccagcaaagttaactacacagaggacccaggggaaacgagctgtgtagccactgacttgctcgcgcggccgtggcctctgaggggcactcgccggttaagacagggtgggagtagtgctttccagttcagactctaacttctcccaaagtgtcctaagaaaatactggatcggctcatagatttatgctccttatgatgccctaacttggaaggttgttctagggacaggccgggcagtgtccccacacacaccttagagtcgaaggccccagggccccgctgtcacttgcccaaaagatcccttccggcaggtaagggactaccaatgcttacgtcaaaacagcagaatcggctttgcagtgcactttggggagcagatattaacttatttttgtgttggacagtagtgaaatcttgtgatttttaatcgctttgataatacttccaaattttatgatttttctgaaggaaataatgcaaacattttaaatatgtttctccccctttccaaaaactgttaaactaatgagcaagtaacactaactttgaatgtctctacaatacccgttgataactcagtggagccaggctttggggtagcggccctgagcttgcagggtttctcgccactggggctgaccacgcccccagctgtgaccgtgggtgtggctggctctcggccctgcccagctttgttctgaggacgtggtgacttcctgaacatcagcttcaatcctccatcattaatgtgaagcaaaacacaaaaaccgccccaatccctcaggattccttggcatccgaaaccagcatctgcacctaaacccatacccacccgtgtgcgcccacagggggatgtgtccgaatgggcagcttaaaatgtggtcacctgtgggggaaactcttcaggcacctgaagtgagaacccagctgtccgtcctcaggccggcctttcttccggcgacacccgtccatggctggctgggtccccttcgcagtgtttgtctgtcttgacatctaaaccccggcgtgtgcagtgcccatcttccaggactaccttattttccagaattaaacctgttttataattcaagttaatgcaaatgactgtcagttgccaaatatcttgatcctatgagtgtagttgatgactgtttgttagtcagtagagtaaaatgctgtgtccacggggtgtcacagcctcaccataccctgttgaggtgtgaaatgccccgtcagaaattaaatacaaacttaaatgtgcctattggtgtctaaacttcatacaatgtaaggtcagattccttttaggaatactgggtgctgtcaccaggtttgatagttagacttaaaaacttgaaattcactttttggggggagggatatactgaaatagagagttgagacttgccagttgggggaaaatagcatttaaaatggaaagctgtgtttggaaaattgtgtatgagtatttttgtattaaaaacattttaaaggcttttttcttaa

SEQ ID NO: 440509 - DNA, 10797 bp, Homo sapiens
agagatgggtctcgccatcaccatgttgcccagtctggtctccaactcctgggctcaagcgatcctcctgccttggtctcccaaagtgctgggattacaggtgtgagcccccacacccggcctgagtgagtgggttctgaatggtgactgttgttgtccatagccttccccctgcttctgagagtggagtccctcccctcatgttggagacctcccaaggtccatgtggtcctataggggctgttcagcctccctagccccttaacgtgtcaggtaatactgtatatattccatgaaatgtgaataattagttatataattcctaagcacttattttaaaaaacagcaatgtgatgcttaactcttcccacctctgttcctgtcccccttagaaaaccactgataactctttttttttttgagacggagtcttgccctgtcgcccaggctggagtgtagtggcctgatctcggctcggctcattgtaacctccgcctcgggtttgagcgattctcctgcctcagcctcctgagtagctgggattataggcgtgcaccaccacgcctggctaattttttgtatctttagtagggacgggtttcaccatgttggccagagtggtcttgaactcctgaccttgtgatccgctcgcctcagcctcccaaagtgctgggattacaggcatgagccaccgtgcctgtcctagaaccactggtaactcttaactgctgtctgcttttctgtggagactgcgggttgcagacaccagcagccccctattgctgcacgtcaggtgtcctccacctcagtactgtggacatctcgggccgcatagccctgttgcgcgggcatcctgtgcgttgcaggagatgcagcagcatccatgaccgcaacccatcagagtgttctaagaacggaagcatctgggctggatggaatttagcatcaagcagagtcccctttctgttcagagtgttgtaaagtgcataaagatgaagcaggcaccagaaatcctcggcagtgccaacgggaagactccgagctgcgaggtgaaccgcgagtgttctgtgttcctcagcaaagcccagctctccagtagcctgcaggagggggtcatgcagaagtttaacggccacgacgccctgccctttattccagccgacaagctgaaagatcttacttcccgggtgtttaatggagaacccggcgcacacgatgccaaactgcgttttgagtcccaggaaatgaaagggattgggacaccccctaacactacccctatcaaaaatggctctccagaaattaagctgaaaatcaccaaaacatacatgaatgggaagcctctctttgaatcttccatttgtggtgacagtgctgctgatgtgtctcagtcgaagcaggaagggagatgcagcatcccagtttttggtcttctgtcaaaaacacagggatgaggtggtagctgagcacccagatgcttcaggtgaggagattgaagagctgctcaggtcacagtggagtctgctgagtgagaagcagagagcacgctacaacaccaagtttgccctggtggcccctgtccaggctgaagaagactctggtaatgtaaatgggaaaaaaagaaaccacacaaagaggatacaggaccctacagaagatgctgaagctgaggacacacccaggaaaagactcaggacggacaagcacagtcttcggaagagagacacaatcactgacaaaacggccagaacaagctcttacaaggccatggaggcagcctcctcgctcaagagccaggcagcaacgaaaaatctgtctgatgcatgtaaaccactgaagaagcgaaatcgggcttccacggcagcatcttcagctcttgggtttagcaaaagttcatctccttctgcatccttaactgagaatgagggtaaaataataataataacgataaccatggcattggtatgaaggccatttagctgcccacgctgcagtgtgagtaatgctcagacttcataagcgcagcattggtgctcactgccagtgcagatgttttagggcctcttggctaactcagattcatgaaatggacaaacagtgcactatgttagtttatttgagcactttttatacacacgcacacagtgtctgtgtacatgtacagatatacttcagtcttgatgcagtttcatagttcttaaaatctgtctgaagaatgttgtgttctgtgtagccctcacactgtaagagttcacatggaagtaagtctgcgttggttctgaaagggcacagtgtcagttgagctgacatatactgggtggggtggaaggcgactcacacaccacacctgattcctgttgcttccagacctaggctcatggaggaagccaaagatttctttgttctcatgcatttcatggctttggtcctttaaattctggcacatttttagttacttgagtgttgaggtgagtcagaactaccattgtaatatgactcctgtgttctggacttgcagagtacatgatagcaaaataaagccatttggggctgctgcctgccatcattgtaacatgacacttagactttattatcaaacctaaattttttgccgttgccaaaaacaacaaatagccacagaacgtaggtgtgacacttttttgttcggaggtagttttggtttcctgatttttagggattaccttcatagagctttggagttttaatttcttgttatttggttctccgtgatgctgtttttctcattgtagacatgggtcctgtttttgtcatgtttatgaggagatgataactgggggcccttttggaacagggtagtgaggcaagggttggacaggccccttactcttgctgagtcagaaggcggcacttctggccaggtctctgccatggtccccaggaaggatggggtgtgcctcagttgtttccactcattagaggagtgtaggccttccagtgcaggaaggtcagggacctaggcaacctgggcggggctcatagagctctgcggcttgccactctgaatcctcagcgaccactcctccgagtgggattttctgcagggactcaaaccaactcagtggtggtcgagacctgttcacggatggtgggactggggctgctttacagtttgatacgtgtagataattaagcattttgtgatgtttggacacactggagaaaaggcagtaagaattatttactgaaacatctaggagcttactgaaatatgaaaaggcaaattttatacaaattatttttcctttttcctttctttcttgtccaagttcaggttaaaatcttagaaaattaaatgaaaggtcatttacagttccaaagaagaatattaaacatttttcacttaagttgagatttttgctttaaagagcttttaatgagtttttctgttatcataattttggtccggttattcacttgagttgttgcttatactgttgtcaggtacagtagagagaacatggagcctgctgagatcttctctgttattcctgatcctaagtcatgtatatcgaaggctttgatttagagtaatgcatgaggccagtgtagcggggtcgaggcctgcccatgagtcaggggagctcagtctccctggcctaggcagttgtcctgaccttgagaagacatagatgaagcattttatcatcattagacttaaattttaattcttcagaatgtcagaagttgataggttgttaaatacatttatataatacattaaatatgtgaaattaatacaccttcctacattttgaaggtgatgcatagatcccatagtgtgcatcatgttccttatatgaaaacgtttaaattactgggtcttttccattaaactacttttgtatggcttagataaatcttccattagtgttcatttttatagaattatgctgttaaaactactttaggtgaacaaataaacttgtctattatatattaacgcgactgaactacagtaaatgtttgtgatgtttccaatgctgaatgcctgttagcatatgaggcaaagtgtagtgttataaaaaacagcctgttgactgctgggcccgattctgatatgagttaggtgaccatgagaattgctgtttgaggtccacactgacacacacccattgggtcacaccccctttgcatgtttgtatttcctccctttcatcacatttgtttgaaataaggtacttttatagggttggtatttcagaacactttaggtcatgttgtagtttaaattcttcttgaaaaaggtatatgtgataaataaaaatttttattggaataattattacatggtactacatcaccctgaggaagagaataaattaaaattacacacttgcatgacaaaggcctgtgaaggaattaatgtgatttaagtgttttgtaacttcattttttattcctttagtagagcaaattcttatttttttcgccttcactggtaacagcttttgtgggagcccacaccagtcaagttggatttgaacccagctgctctgtactgcacttagaatgatgtaatattccaggatgctgctgcaggtggcgtatcatcgtacacactcagtgacatttctatcacaatcattttatggaagatgtgtgataatctgtttttactggtattaataaacacatacaatgaagaaaacagataacaaattttaagaccaaggtctcggacagcccgggagacgagccctcggagtccccatacgaaagtgcagacgaaacacaaactgaagtatctgtctcatccaaaaagtctgagcgaggagtgactgccaaaaaggagtatgtgtgccagctgtgtgagaagccgggcagcctcctgctctgtgaaggaccctgctgcggagctttccacctcgcctgccttgggctttcccggaggccagaagggaggttcacctgcagcgagtgtgcctcaggtgtcgcccggcacagtctggggtctgtgaggatgatgagaggacacctgcacagccgtggcccttcctgcctactcaccgggcccaaggagtctcctatctcacgtcagaacacttcctgggtcaggaagacacctggagagtctcccaggccatggcagccccacagcagcacctcacttatgggagtgtctgtctgcctgcccagaatgataagtgactgctccaccactggccagctgctctcaaggaggaaaggcctcttttcataggagccccttctttcaagcttcttgccagttagactgggcctccccagccaggctgcctagtaagattctcctgtatttcaggtgaagctggagctcagatcgcagcaaggtaatccttgatggctggatctttttgctggagaatgcttggactagtgagcaaggttggaaacagggccaggtgctttagcagcgtggctgcctctgaagaggagttgcttgattttagtggctcagaactgcaatttaattcttgttctttgcacctctctctccaccccttctttaactttttgttagggattcactcatgtttcgtgtgtaaagagagcaagacagatgttaagcgctgtgtggtaactcagtgtggaaaattttaccatgaggcttgtgtgaaaaaataccctctgactgtatttgagagccgaggtttccgctgccccctccacagctgtgtgagctgccatgcttccaacccttcaaacccaaggccgtcaaaaggtaaaatgatgcggtgtgtccgctgccccgttgcctatcacagcggggatgcttgtctggcagcaggatgctcagtgatcgcctccaacagcatcatctgcactgcccacttcactgctcggaaggggaagcgacaccacgcccacgtcaacgtgagctggtgcttcgtgtgctccaaaggggggagccttctgtgctgtgagtcctgcccagcggccttccaccctgactgcctgaacatcgagatgcctgacggcagctggttctgcaatgactgcagggctgggaagaagctgcacttccaggatatcatttgggtgaaacttgggaactacagatggtggccggcagaagtttgccatcccaaaaatgttcccccaaatattcagaaaatgaagcacgagattggagaattccctgtgtttttctttgggtctaaagattattactggacgcatcaggcgcgagtgttcccgtacatggagggggaccggggcagccgctaccagggggtcagagggatcggaagagtcttcaaaaacgcactgcaagaagctgaagctcgttttcgtgaaattaagcttcagagggaagcccgagaaacacaggagagcgagcgcaagcccccaccatacaagcacatcaaggtgaataagccttacgggaaagtccagatctacacagcggatatttcagaaatccctaagtgcaactgcaagcccacagatgagaatccttgtggctttgattcggagtgtctgaacaggatgctgatgtttgagtgccacccgcaggtgtgtcccgcgggcgagttctgccagaaccagtgcttcaccaagcgccagtacccagagaccaagatcatcaagacagatggcaaagggtggggcctggtcgccaagagggacatcagaaagggagaatttgttaacgagtacgttggggagctgatcgacgaggaggagtgcatggcgagaatcaagcacgcacacgagaacgacatcacccacttctacatgctcactatagacaaggaccgtataatagacgctggccccaaaggaaactactctcgatttatgaatcacagctgccagcccaactgtgagaccctcaagtggacagtgaatggggacactcgtgtgggcctgtttgccgtctgtgacattcctgcagggacggagctgacttttaactacaacctcgattgtctgggcaatgaaaaaacggtctgccggtgtggagcctccaattgcagtggattcctcggggatagaccaaagacctcgacgaccctttcatcagaggaaaagggcaaaaagaccaagaagaaaacgaggcggcgcagagcaaaaggggaagggaagaggcagtcagaggacgagtgcttccgctgcggtgatggcgggcagctggtgctgtgtgaccgcaagttctgcaccaaggcctaccacctgtcctgcctgggccttggcaagcggcccttcgggaagtgggaatgtccttggcatcattgtgacgtgtgtggcaaaccttcgacttcattttgccacctctgccccaattcgttctgtaaggagcaccaggacgggacagccttcagctgcaccccggacgggcggtcctactgctgtgagcatgacttaggggcggcatcggtcagaagcaccaagactgagaagccccccccagagccagggaagccgaaggggaagaggcggcggcggaggggctggcggagagtcacagagggcaaatagcgccaggcggccgcttggccggatccaggggcggtgcagggcggccggccctgcctgcgggagagggcgagcatgaactggcccggaggacccagctcgagccgccaggacacagacgtacaggcctcctcgggagggagcgcctccccaccactgagccatcctcagcagcgtccgctgcgtctgcactgatgaccgtctgagcccagctcagcgttcctggacaaacagcctcactcctcagcgttaccgccacacttgaatttctccgaatgtcaaggttccctcccactctatttttttaggttaaagttaattggcatatggaatgttttaatctcctctgaaatgtgtagcgtaggcttttcccaagggtcgctagaaactcgtcttcgcgttgccccctttctggctctcagcgccgtcgccactcgggagaggctgggtgaggcccgtgtgaggactgaccctggattcctcgaaactgccattgtgatcattactctgctctttggaaatggctgtatcatttttttgtactaatgtgaattgttcctcagaaacgcttcttttccatcctagtgagaagctggccctgcaggtggtggcagcaatggtgttgtaagatttcctcccgtagttttttctcctcatggatttgaatgaaatgccaataacacgtccactttcaacgtgtagtttacgcggagcactttcgaggcctggccgggttgggcctacttctcacctgggcctatcttctgaactcgctaggttcttatcaacatttgggggataactttgtatatttttttcatttggcttttctttaccagtttctgatttttattctcaatatatttttgctaaacctatttcacaaatcaccaccgactgaagtgtgtgtttactgatgcggccctgagctccatggcgaaaggagtgactttgcagggcgtgagaccgcagtctgcttagagcacaggaagtgacaacttagggagccccgtagggcgctgcaggccccggggaccccagcacgtgggtctaaagagagacggagtctagctctcctgccacccagagtggcttccatctcagcactctgtgggtctggtgatggaagatgcagtctctgctgatcacatgtgccctctgccagggcacctactgagaggtgcggtcctgggggtggaggcctgcctggcaggtgtgcgtgcctcgtacgtgtgttatgggcactggtctaggccaggtatgacacccactctcctgtgagatttcactttagtttttaaaaggtccagttctacagagtgagacctatctatctgagtactacatatgttttaagacttggttctttttttgagggatccttgaccctgggaagtctggagcaccctgagaagggggcaccatgtgtgcctttgcccacgtgtcctgaggggctgcttgtctgggagggagggagagaacattcagcagcaggtgcttttttatggccttttcttaaaataacctaagggggacacatccatcttgcagagaagtttacagaactccccttgaaaactgctgctgaggctcctgttaaattttctgtggcatcttttatgccttggtaaaaactgcagtgtctttggacctgagagtggctactccgtggttttgtgacctgtaagcgtggggttcaggggtgtgtggccctgcagggtcccacgcctccctgagcactgactggaagtttcactggctggtggctgtcccttctcccatcagggtccccagcaaagttaactacacagaggacccaggggaaacgagctgtgtagccactgacttgctcgcgcggccgtggcctctgaggggcactcgccggttaagacagggtgggagtagtgctttccagttcagactctaacttctcccaaagtgtcctaagaaaatactggatcggctcatagatttatgctccttatgatgccctaacttggaaggttgttctagggacaggccgggcagtgtccccacacacaccttagagtcgaaggccccagggccccgctgtcacttgcccaaaagatcccttccggcaggtaagggactaccaatgcttacgtcaaaacagcagaatcggctttgcagtgcactttggggagcagatattaacttatttttgtgttggacagtagtgaaatcttgtgatttttaatcgctttgataatacttccaaattttatgatttttctgaaggaaataatgcaaacattttaaatatgtttctccccctttccaaaaactgttaaactaatgagcaagtaacactaactttgaatgtctctacaatacccgttgataactcagtggagccaggctttggggtagcggccctgagcttgcagggtttctcgccactggggctgaccacgcccccagctgtgaccgtgggtgtggctggctctcggccctgcccagctttgttctgaggacgtggtgacttcctgaacatcagcttcaatcctccatcattaatgtgaagcaaaacacaaaaaccgccccaatccctcaggattccttggcatccgaaaccagcatctgcacctaaacccatacccacccgtgtgcgcccacagggggatgtgtccgaatgggcagcttaaaatgtggtcacctgtgggggaaactcttcaggcacctgaagtgagaacccagctgtccgtcctcaggccggcctttcttccggcgacacccgtccatggctggctgggtccccttcgcagtgtttgtctgtcttgacatctaaaccccggcgtgtgcagtgcccatcttccaggactaccttattttccagaattaaacctgttttataattcaagttaatgcaaatgactgtcagttgccaaatatcttgatcctatgagtgtagttgatgactgtttgttagtcagtagagtaaaatgctgtgtccacggggtgtcacagcctcaccataccctgttgaggtgtgaaatgccccgtcagaaattaaatacaaacttaaatgtgcctattggtgtctaaacttcatacaatgtaaggtcagattccttttaggaatactgggtgctgtcaccaggtttgatagttagacttaaaaacttgaaattcactttttggggggagggatatactgaaatagagagttgagacttgccagttgggggaaaatagcatttaaaatggaaagctgtgtttggaaaattgtgtatgagtatttttgtattaaaaacattttaaaggcttttttcttaa

SEQ ID NO: 440510 - DNA, 12047 bp, Homo sapiens
agagatgggtctcgccatcaccatgttgcccagtctggtctccaactcctgggctcaagcgatcctcctgccttggtctcccaaagtgctgggattacaggtgtgagcccccacacccggcctgagtgagtgggttctgaatggtgactgttgttgtccatagccttccccctgcttctgagagtggagtccctcccctcatgttggagacctcccaaggtccatgtggtcctataggggctgttcagcctccctagccccttaacgtgtcaggtaatactgtatatattccatgaaatgtgaataattagttatataattcctaagcacttattttaaaaaacagcaatgtgatgcttaactcttcccacctctgttcctgtcccccttagaaaaccactgataactctttttttttttgagacggagtcttgccctgtcgcccaggctggagtgtagtggcctgatctcggctcggctcattgtaacctccgcctcgggtttgagcgattctcctgcctcagcctcctgagtagctgggattataggcgtgcaccaccacgcctggctaattttttgtatctttagtagggacgggtttcaccatgttggccagagtggtcttgaactcctgaccttgtgatccgctcgcctcagcctcccaaagtgctgggattacaggcatgagccaccgtgcctgtcctagaaccactggtaactcttaactgagacaagatttcgccatgttgcccaggctggtctcgaacttctgagctcaagcgatctacctgcctcgtcctcccaaagtgttggaattgcaggtgtgagccactgcacccggcccttgcctcatgtttgaatgataatttacctgggcataaaattctggacacttgtggtggcacgagctgtctgcttttctgtggagactgcgggttgcagacaccagcagccccctattgctgcacgtcaggtgtcctccacctcagtactgtggacatctcgggccgcatagccctgttgcgcgggcatcctgtgcgttgcaggagatgcagcagcatccatgaccgcaacccatcagagtgttctaagaacggaagcatctgggctggatggaatttagcatcaagcagagtcccctttctgttcagagtgttgtaaagtgcataaagatgaagcaggcaccagaaatcctcggcagtgccaacgggaagactccgagctgcgaggtgaaccgcgagtgttctgtgttcctcagcaaagcccagctctccagtagcctgcaggagggggtcatgcagaagtttaacggccacgacgccctgccctttattccagccgacaagctgaaagatcttacttcccgggtgtttaatggagaacccggcgcacacgatgccaaactgcgttttgagtcccaggaaatgaaagggattgggacaccccctaacactacccctatcaaaaatggctctccagaaattaagctgaaaatcaccaaaacatacatgaatgggaagcctctctttgaatcttccatttgtggtgacagtgctgctgatgtgtctcagtcagaagaaaatggacaaaaaccagaaaacaaggcgagaaggaacaggaagaggagcataaaatatgactccttgctggagcagggccttgtcgaagcagctcttgtgtctaagatctcaagtccttcagataaaaagattccagctaagaaagagtcttgtccaaacactggaagagacaaagaccacctgttgaaatacaacgttggtgatttggtgtggtccaaagtgtcgggttacccttggtggccttgcatggtttctgcagatccactccttcacagctataccaaacttaaaggtcagaaaaagagtgcacgccagtatcacgtacagttctttggtgacgccccagaaagagcttggatatttgagaagagcctcgtagcttttgaaggagaaggacagtttgaaaaattatgccaggaaagtgccaagcaggcacccacgaaagctgagaaaattaagctattgaaaccaatttcagggaaattgagggcccagtgggaaatgggcattgttcaagcagaagaagctgcaagcatgtcagtggaggagcggaaagccaagttcacctttctctatgtgggggaccagcttcatctcaaccctcaagtagccaaggaggctggcattgctgcagagtctttgggagaaatggcagaatcctcaggagtcagtgaagaagctgctgaaaaccccaagtctgtgagagaagagtgcattcccatgaagagaaggcggagggccaaactgtgtagctctgcagagaccctggagagtcaccccgacatagggaagagtactcctcaaaagacggcagaggctgaccccagaagaggagtagggtctcctcctgggaggaagaagaccacagtctccatgccacgaagcaggaagggagatgcagcatcccagtttttggtcttctgtcaaaaacacagggatgaggtggtagctgagcacccagatgcttcaggtgaggagattgaagagctgctcaggtcacagtggagtctgctgagtgagaagcagagagcacgctacaacaccaagtttgccctggtggcccctgtccaggctgaagaagactctggtaatgtaaatgggaaaaaaagaaaccacacaaagaggatacaggaccctacagaagatgctgaagctgaggacacacccaggaaaagactcaggacggacaagcacagtcttcggaagagagacacaatcactgacaaaacggccagaacaagctcttacaaggccatggaggcagcctcctcgctcaagagccaggcagcaacgaaaaatctgtctgatgcatgtaaaccactgaagaagcgaaatcgggcttccacggcagcatcttcagctcttgggtttagcaaaagttcatctccttctgcatccttaactgagaatgagggtaaaataataataataacgataaccatggcattggtatgaaggccatttagctgcccacgctgcagtgtgagtaatgctcagacttcataagcgcagcattggtgctcactgccagtgcagatgttttagggcctcttggctaactcagattcatgaaatggacaaacagtgcactatgttagtttatttgagcactttttatacacacgcacacagtgtctgtgtacatgtacagatatacttcagtcttgatgcagtttcatagttcttaaaatctgtctgaagaatgttgtgttctgtgtagccctcacactgtaagagttcacatggaagtaagtctgcgttggttctgaaagggcacagtgtcagttgagctgacatatactgggtggggtggaaggcgactcacacaccacacctgattcctgttgcttccagacctaggctcatggaggaagccaaagatttctttgttctcatgcatttcatggctttggtcctttaaattctggcacatttttagttacttgagtgttgaggtgagtcagaactaccattgtaatatgactcctgtgttctggacttgcagagtacatgatagcaaaataaagccatttggggctgctgcctgccatcattgtaacatgacacttagactttattatcaaacctaaattttttgccgttgccaaaaacaacaaatagccacagaacgtaggtgtgacacttttttgttcggaggtagttttggtttcctgatttttagggattaccttcatagagctttggagttttaatttcttgttatttggttctccgtgatgctgtttttctcattgtagacatgggtcctgtttttgtcatgtttatgaggagatgataactgggggcccttttggaacagggtagtgaggcaagggttggacaggccccttactcttgctgagtcagaaggcggcacttctggccaggtctctgccatggtccccaggaaggatggggtgtgcctcagttgtttccactcattagaggagtgtaggccttccagtgcaggaaggtcagggacctaggcaacctgggcggggctcatagagctctgcggcttgccactctgaatcctcagcgaccactcctccgagtgggattttctgcagggactcaaaccaactcagtggtggtcgagacctgttcacggatggtgggactggggctgctttacagtttgatacgtgtagataattaagcattttgtgatgtttggacacactggagaaaaggcagtaagaattatttactgaaacatctaggagcttactgaaatatgaaaaggcaaattttatacaaattatttttcctttttcctttctttcttgtccaagttcaggttaaaatcttagaaaattaaatgaaaggtcatttacagttccaaagaagaatattaaacatttttcacttaagttgagatttttgctttaaagagcttttaatgagtttttctgttatcataattttggtccggttattcacttgagttgttgcttatactgttgtcaggtacagtagagagaacatggagcctgctgagatcttctctgttattcctgatcctaagtcatgtatatcgaaggctttgatttagagtaatgcatgaggccagtgtagcggggtcgaggcctgcccatgagtcaggggagctcagtctccctggcctaggcagttgtcctgaccttgagaagacatagatgaagcattttatcatcattagacttaaattttaattcttcagaatgtcagaagttgataggttgttaaatacatttatataatacattaaatatgtgaaattaatacaccttcctacattttgaaggtgatgcatagatcccatagtgtgcatcatgttccttatatgaaaacgtttaaattactgggtcttttccattaaactacttttgtatggcttagataaatcttccattagtgttcatttttatagaattatgctgttaaaactactttaggtgaacaaataaacttgtctattatatattaacgcgactgaactacagtaaatgtttgtgatgtttccaatgctgaatgcctgttagcatatgaggcaaagtgtagtgttataaaaaacagcctgttgactgctgggcccgattctgatatgagttaggtgaccatgagaattgctgtttgaggtccacactgacacacacccattgggtcacaccccctttgcatgtttgtatttcctccctttcatcacatttgtttgaaataaggtacttttatagggttggtatttcagaacactttaggtcatgttgtagtttaaattcttcttgaaaaaggtatatgtgataaataaaaatttttattggaataattattacatggtactacatcaccctgaggaagagaataaattaaaattacacacttgcatgacaaaggcctgtgaaggaattaatgtgatttaagtgttttgtaacttcattttttattcctttagtagagcaaattcttatttttttcgccttcactggtaacagcttttgtgggagcccacaccagtcaagttggatttgaacccagctgctctgtactgcacttagaatgatgtaatattccaggatgctgctgcaggtggcgtatcatcgtacacactcagtgacatttctatcacaatcattttatggaagatgtgtgataatctgtttttactggtattaataaacacatacaatgaagaaaacagataacaaattttaagaccaaggtaagataactaatcaaggccatttaatccgtcacattcatctcataatagaaacacgttcatattccagtggtcaatgtagatttcaagttgaaaggcagtccctttagttgggggctgtccagagctgcagcagggctttgcacggaaggggtggccctgttagagttgcttctcctctagtttgtaacttactggacttttgtggaaaatatcagcgtcgctaccctcagaaacaaactaacagcacacgttaggaggagtcctcatcagctgttctcattgccagtgagatatattcagtattgtagatactacactaatttccaacataagaggcaggaagagttttgattctatccttttttactaaacagttttattatgacactagatacagtaaatttttagaaaaaaataccatttacagtattattgtgaaccatttaacccttttgatccaaggccccggaccaaggggatactgtaatcaggttatgtacaccaacctctgcatcagttgcttctatagagcatcagccctcatgtttcattgtcttaatgtcggggagcagcctggtgtcctgccccaggtgtccgcatttttgcatggtaaggaaaaggcttacttgcccttcagctcataaaagcagaaggtgtgctattcacagtaccatgcgagtagcccacagttaattcccggcagattctttggctgtgttttatctttaatgaacgtttctgactaatattttgttgtaaaccattaagtaatgtaacgcatgtaagatgcttagggtgcctggccaggactccgtggtttcctgttgtgacagtaataatggttataataataaaaatgataaaattgccatcattctatttttatccaaaagtataaattttgctttggcatgaaaagtggtcctcttgactgcattatgcatgcgaggatgaaataaacctagaagtggcagaacactggatttgtgtgtgtggcgctttagggtgctggactgtatggctgagggctggttgggttcctctattggctctgctcaaatgttgcaggatacatagccccaaagatggtctaggagcaatctaagctgtgttactccaaaggacatgaaaaagctcaagagtaaaattaaaattctcaaaaaaaaaccccacgaaatttaaagatggggaaaaaaagatggtataaaaatggctctggttcaataagcagtcacccaaagtaaagactctatcttgaaaggcttttggtgaaaatgaagggatttcatttgaaattacagcatgatgaattttgcatgggtggccagccagctagcccataactgatagatgcattagaagtcagccagcgcataggtgctccctctatattatggagaaagcaaaaccctgcaaatgaccaaatggtgtccaaagagcagcatgacattggcatcagctgaataaccaggggcacatgggggaacgtggatgggaatgatagtgtatctcagcggggggtggggtgacatcgttccctggggacattgggaaggtgggcaggggcaagtgaactcagcactctgcagtgagagggacagtcccatgtgtggcagcattgtcccacttcagatgccaggagtgggctcatcctagaggagcggagttttccgagaggaccatctcctggtttcctgaaggaggtgggtggaaacggctcttgtttgaaagaacttagggaggaccattggcttgccaagagtacagaaattcattatgctgctaatttaacgtggaattccttcatttcataagaacctcaaaataatggtgatacattctagccttaagacatttgaattgccggttgttgaggtgaattttgtttgtcatacatggaaccattttagtcccatttgactcacttcagaccatcttccacacactatgtctgtgcttggagaggggaggtggctctccagtgtaaaacttgaggcattcactagaggtgaaaacttgtcagaatatataaaagcttagattgtagctgttctaaaaacgtaagtactccattgtaatagggtggcatcttcaggtagtgcacatattggcaatagaggtcctgaattgtttttctaagactgatctgagagccattgggccatcaagcctttatatatctgcttctaaaattgccccacctgctctagatggatctttgggcctttcctcagtgttcatgcaaaaattaaatgtcttttttcagcatactgactccaggtgtagttacatctcagtgctgtcttgagtatatattttatctcttatacctgtatctcccaactagaaacagctccagtgtttttaagagaatgtttcttaaaaccaataggaaacttaagcgaggtttcatgacacaacctttcatgtcgtgaaaggcagagggtgactgtgtgtgatgtgcagagtccttggacaggagtcgggggctcctctgtcccactgctgcttcttgagtgggtggagtggtgcttagaggatctccgagaggtccccgcagctctagggagatctgattttgtgttttttgtttaagtacttcacacagaagcctaggtagatttaaaatggggtgctcagggactggggaacaagacggggtggggtggggagatgggcatttggagagtctcatgtagctggagacgttaagagctgagcacaccacaggaaaggagggaggatgctgtgtgagagccatgctgtcaggagcaagcttgctgctcctgtgctgccctggccctggccttgcttgcccatggtgtgtgtgtccagaggtgtgtgtgaggctgccagaacaagtgctgggtctgtcacagagaagtttaaaaaagaaaactaagattataaattagcatctagttccaaaaccaaaaaaagtgcctgtggatgtatataaaattaagatgataagaaagtgctcctgagaaggctcttgccagaagcctgatgtgagtgtgtggcacctgtgatggcagggctgtgagctgggcttctgtcctcctctgtgtcccggcatggaagccagtataagcatttccaaatgagggaaaagtccttggctcgtttgatccagttgagttgaaagggttgccttggcagcagaggctcctctgatggctgacatcagtcactgcgtctgggcctgagacgtgcatggagggctgtaaagccacggattcccctcgctggagaggctcctgtctgatagcggtagatgaaaaataaggtcgttatgactttggcaacttgcttcatttctttttcatttgacttacaacacacttctctaacatctagcccttttaaatttttaattaatttcaaagcttcctctggccaggtagacttttgtatacagaccaggtgagagcccttttgccttagtgtgaaaatgtaacattttatgcttttaaaatcaatagattcatcaccttagttttttaaaaaaaatctataaatagggtaattgctgaggtgtgcggtttatctttgagatgataaagctaaattatagtcttttgccagagaaactgaggtaactgtcattagaaaaggtttcttaaaatactcacaaagctgttattggcttcttaacttctaaaatttggggggtcttgcatttatttattatttatttatttatttatttagagacagagtctcaccctgttggccaggctggagtgcagtaagtggcacaatctcggctcactgcaacctccgcctccttggttccagcaattcttctgcctcagcctcccgagtagctgggactacaagcggctgccaccacacctggctatttttttttgtatttttagtagagacagggtttcgccatattggccaggctggtcttgaactcctgacctcgtgatccacccgcctcaccctcccaaaatgctgggattacaggcgtaagccactgcacctggcggggtcttgcttattttaaaagaaatattctgattcatattttaggactttttgtcaacgaaattggttttgatccctttgggtaccatttttattgttttatgtagaatgttagaaattaccactaatttacctggcagtgatgtcaaattgactgtaattagcaggtagaaaattatttgtattatattcatctgattcctatactggatgagcaaggagcatgcttcctttgggacattcttacagcagggtgtctctccaacagcccgacagcctcatctttttggttggatacctttgaactccatggttacgtgttaggtccacatttgtgtttttttctagcctacctatagttgttggcctttttgcatataactctcgggtaatattttgaagcatgctgaccatccaggcatatagtattttcaagaaatgactgaggtaggggtgggggtcctggtccggctgatgggggtttgctcagcactgtgccagtggaagcaggtgtattgtgggcagttttgtcattgtcctcaagtccttcgcagacagtgcacagcctgctgtctgcagtcggccagaccaggctcctccccagcacactccctgtgggatggccgctgctcaggacacagtgggacaaagttgggttgataggatattttagattcattttacctttgacaagggcaggccttgaattgggagcagcagccacctggcctcactctggccacaggtgacacttggtccttgctgccacctgcttggggctatgtggctacggctacacaaaagcctgtgcaggttagaagacgactgtggtgtgcagtggtgctctgggagtggagacttcctctgttctcagagactcacccccagccctgaccctagaatttagggatagccaggaagtttctagtttgtgtaacctagaagggtcactttaataaaaattgttatgaactatagtattttagatgatgagtgacttattttaattccactttaacattttactgtgctgttaacttggaagacctgtttgaaattagtcttgatttcacactcatttaatctgctgagcacagggctgttgtcatttgtaaacgcaaacactgtggaggtacttctcgccatcagcttccttctttacaaaaccatcatttcaacatgaaaattatgtcagtttatagaaatatttattgttcaaggtctgtaattgtatttcaaaaacgatgtcgtattcaagttgtgaagggatttgttttgtcaaaaaattaaaaactcaatgtgtatgacgccactctgaagagtaggtgagcgctttgcagtcacagaaggtggcatctgactgcggctcatacaggtcaccctgaagggccacgtgcttttagcagttggctggaatgtgttcactaggttccgttatgtttggtaatatcatcttgaaaagtccctgtaatagatcaaggagactgcattccctgccctgaaggaatgtatttctaaggcaaataggcaacttggtactatcttattctgagtagagagtggagaaagtattttcagactgaagaaaactttgaaaagtcaggagctaagctgctcggagctcagtgccgcagcatggctgtggtggacgcgggaaacaacgggaaagttcttgacagagtctgtgtccgctcagtccctgcacttttcctttccaaatgcatctcgttggatatggaatagatcgtagatgttgtagactgagatttgggactatgttgggaccgtacaggtgaatgtgccacctccacaaatggcttctccgagtgagtcacgtcacctggtgcgtggaggtggagcctgcggctggagtaaggcttgctgtgggacgccctcgtactttgctctccttgcgggtggttgccgagccgagagcattggatcctccccgactgtggctagttgtctgtccggtggctgggagggggtgtggtgggaaaaagtcggaatctctgcaatctgtgtcatggactgtactattgtaaggtctatattctgtatgtgggtcccagaccctgatcaggaaatgagcctcatgtgtgtcgttaacatttatatatttccattcaaaatatgtattcagtgtttatttcctcaaaacagactttgttaatgtaggaaatctctccaagtggaaacgtgctaactttttctgtaaatctgaaataaaaggtgctgttccttcctctgacccaggactgctt

SEQ ID NO: 440511 - DNA, 10005 bp, Homo sapiens
  misc_feature (12)..(12): n is a, c, g, or t
  misc_feature (86)..(86): n is a, c, g, or t
gggaggcgcggnggcggggtcggcgccgcgcgcgagagcctcggcctggccgcgctgcgcccgccgccgccgccgccccctccccncctgggccctaccgccgcacggccccggccccctcccagcctgccgctccggagagccgcccgccgaggatgcgacgcaccgcagtgttctaagaacggaagcatctgggctggatggaatttagcatcaagcagagtcccctttctgttcagagtgttgtaaagtgcataaagatgaagcaggcaccagaaatcctcggcagtgccaacgggaagactccgagctgcgaggtgaaccgcgagtgttctgtgttcctcagcaaagcccagctctccagtagcctgcaggagggggtcatgcagaagtttaacggccacgacgccctgccctttattccagccgacaagctgaaagatcttacttcccgggtgtttaatggagaacccggcgcacacgatgccaaactgcgttttgagtcccaggaaatgaaagggattgggacaccccctaacactacccctatcaaaaatggctctccagaaattaagctgaaaatcaccaaaacatacatgaatgggaagcctctctttgaatcttccatttgtggtgacagtgctgctgatgtgtctcagtcagaagaaaatggacaaaaaccagaaaacaaggcgagaaggaacaggaagaggagcataaaatatgactccttgctggagcagggccttgtcgaagcagctcttgtgtctaagatctcaagtccttcagataaaaagattccagctaagaaagagtcttgtccaaacactggaagagacaaagaccacctgttgaaatacaacgttggtgatttggtgtggtccaaagtgtcgggttacccttggtggccttgcatggtttctgcagatccactccttcacagctataccaaacttaaaggtcagaaaaagagtgcacgccagtatcacgtacagttctttggtgacgccccagaaagagcttggatatttgagaagagcctcgtagcttttgaaggagaaggacagtttgaaaaattatgccaggaaagtgccaagcaggcacccacgaaagctgagaaaattaagctattgaaaccaatttcagggaaattgagggcccagtgggaaatgggcattgttcaagcagaagaagctgcaagcatgtcagtggaggagcggaaagccaagttcacctttctctatgtgggggaccagcttcatctcaaccctcaagtagccaaggaggctggcattgctgcagagtctttgggagaaatggcagaatcctcaggagtcagtgaagaagctgctgaaaaccccaagtctgtgagagaagagtgcattcccatgaagagaaggcggagggccaaactgtgtagctctgcagagaccctggagagtcaccccgacatagggaagagtactcctcaaaagacggcagaggctgaccccagaagaggagtagggtctcctcctgggaggaagaagaccacagtctccatgccacgaagcaggaagggagatgcagcatcccagtttttggtcttctgtcaaaaacacagggatgaggtggtagctgagcacccagatgcttcaggtgaggagattgaagagctgctcaggtcacagtggagtctgctgagtgagaagcagagagcacgctacaacaccaagtttgccctggtggcccctgtccaggctgaagaagactctggtaatgtaaatgggaaaaaaagaaaccacacaaagaggatacaggaccctacagaagatgctgaagctgaggacacacccaggaaaagactcaggacggacaagcacagtcttcggaagagagacacaatcactgacaaaacggccagaacaagctcttacaaggccatggaggcagcctcctcgctcaagagccaggcagcaacgaaaaatctgtctgatgcatgtaaaccactgaagaagcgaaatcgggcttccacggcagcatcttcagctcttgggtttagcaaaagttcatctccttctgcatccttaactgagaatgagggtaaaataataataataacgataaccatggcattggtatgaaggccatttagctgcccacgctgcagtgtgagtaatgctcagacttcataagcgcagcattggtgctcactgccagtgcagatgttttagggcctcttggctaactcagattcatgaaatggacaaacagtgcactatgttagtttatttgagcactttttatacacacgcacacagtgtctgtgtacatgtacagatatacttcagtcttgatgcagtttcatagttcttaaaatctgtctgaagaatgttgtgttctgtgtagccctcacactgtaagagttcacatggaagtaagtctgcgttggttctgaaagggcacagtgtcagttgagctgacatatactgggtggggtggaaggcgactcacacaccacacctgattcctgttgcttccagacctaggctcatggaggaagccaaagatttctttgttctcatgcatttcatggctttggtcctttaaattctggcacatttttagttacttgagtgttgaggtgagtcagaactaccattgtaatatgactcctgtgttctggacttgcagagtacatgatagcaaaataaagccatttggggctgctgcctgccatcattgtaacatgacacttagactttattatcaaacctaaattttttgccgttgccaaaaacaacaaatagccacagaacgtaggtgtgacacttttttgttcggaggtagttttggtttcctgatttttagggattaccttcatagagctttggagttttaatttcttgttatttggttctccgtgatgctgtttttctcattgtagacatgggtcctgtttttgtcatgtttatgaggagatgataactgggggcccttttggaacagggtagtgaggcaagggttggacaggccccttactcttgctgagtcagaaggcggcacttctggccaggtctctgccatggtccccaggaaggatggggtgtgcctcagttgtttccactcattagaggagtgtaggccttccagtgcaggaaggtcagggacctaggcaacctgggcggggctcatagagctctgcggcttgccactctgaatcctcagcgaccactcctccgagtgggattttctgcagggactcaaaccaactcagtggtggtcgagacctgttcacggatggtgggactggggctgctttacagtttgatacgtgtagataattaagcattttgtgatgtttggacacactggagaaaaggcagtaagaattatttactgaaacatctaggagcttactgaaatatgaaaaggcaaattttatacaaattatttttcctttttcctttctttcttgtccaagttcaggttaaaatcttagaaaattaaatgaaaggtcatttacagttccaaagaagaatattaaacatttttcacttaagttgagatttttgctttaaagagcttttaatgagtttttctgttatcataattttggtccggttattcacttgagttgttgcttatactgttgtcaggtacagtagagagaacatggagcctgctgagatcttctctgttattcctgatcctaagtcatgtatatcgaaggctttgatttagagtaatgcatgaggccagtgtagcggggtcgaggcctgcccatgagtcaggggagctcagtctccctggcctaggcagttgtcctgaccttgagaagacatagatgaagcattttatcatcattagacttaaattttaattcttcagaatgtcagaagttgataggttgttaaatacatttatataatacattaaatatgtgaaattaatacaccttcctacattttgaaggtgatgcatagatcccatagtgtgcatcatgttccttatatgaaaacgtttaaattactgggtcttttccattaaactacttttgtatggcttagataaatcttccattagtgttcatttttatagaattatgctgttaaaactactttaggtgaacaaataaacttgtctattatatattaacgcgactgaactacagtaaatgtttgtgatgtttccaatgctgaatgcctgttagcatatgaggcaaagtgtagtgttataaaaaacagcctgttgactgctgggcccgattctgatatgagttaggtgaccatgagaattgctgtttgaggtccacactgacacacacccattgggtcacaccccctttgcatgtttgtatttcctccctttcatcacatttgtttgaaataaggtacttttatagggttggtatttcagaacactttaggtcatgttgtagtttaaattcttcttgaaaaaggtatatgtgataaataaaaatttttattggaataattattacatggtactacatcaccctgaggaagagaataaattaaaattacacacttgcatgacaaaggcctgtgaaggaattaatgtgatttaagtgttttgtaacttcattttttattcctttagtagagcaaattcttatttttttcgccttcactggtaacagcttttgtgggagcccacaccagtcaagttggatttgaacccagctgctctgtactgcacttagaatgatgtaatattccaggatgctgctgcaggtggcgtatcatcgtacacactcagtgacatttctatcacaatcattttatggaagatgtgtgataatctgtttttactggtattaataaacacatacaatgaagaaaacagataacaaattttaagaccaaggtctcggacagcccgggagacgagccctcggagtccccatacgaaagtgcagacgaaacacaaactgaagtatctgtctcatccaaaaagtctgagcgaggagtgactgccaaaaaggagtatgtgtgccagctgtgtgagaagccgggcagcctcctgctctgtgaaggaccctgctgcggagctttccacctcgcctgccttgggctttcccggaggccagaagggaggttcacctgcagcgagtgtgcctcagggattcactcatgtttcgtgtgtaaagagagcaagacagatgttaagcgctgtgtggtaactcagtgtggaaaattttaccatgaggcttgtgtgaaaaaataccctctgactgtatttgagagccgaggtttccgctgccccctccacagctgtgtgagctgccatgcttccaacccttcaaacccaaggccgtcaaaaggtaaaatgatgcggtgtgtccgctgccccgttgcctatcacagcggggatgcttgtctggcagcaggatgctcagtgatcgcctccaacagcatcatctgcactgcccacttcactgctcggaaggggaagcgacaccacgcccacgtcaacgtgagctggtgcttcgtgtgctccaaaggggggagccttctgtgctgtgagtcctgcccagcggccttccaccctgactgcctgaacatcgagatgcctgacggcagctggttctgcaatgactgcagggctgggaagaagctgcacttccaggatatcatttgggtgaaacttgggaactacagatggtggccggcagaagtttgccatcccaaaaatgttcccccaaatattcagaaaatgaagcacgagattggagaattccctgtgtttttctttgggtctaaagattattactggacgcatcaggcgcgagtgttcccgtacatggagggggaccggggcagccgctaccagggggtcagagggatcggaagagtcttcaaaaacgcactgcaagaagctgaagctcgttttcgtgaaattaagcttcagagggaagcccgagaaacacaggagagcgagcgcaagcccccaccatacaagcacatcaaggtgaataagccttacgggaaagtccagatctacacagcggatatttcagaaatccctaagtgcaactgcaagcccacagatgagaatccttgtggctttgattcggagtgtctgaacaggatgctgatgtttgagtgccacccgcaggtgtgtcccgcgggcgagttctgccagaaccagtgcttcaccaagcgccagtacccagagaccaagatcatcaagacagatggcaaagggtggggcctggtcgccaagagggacatcagaaagggagaatttgttaacgagtacgttggggagctgatcgacgaggaggagtgcatggcgagaatcaagcacgcacacgagaacgacatcacccacttctacatgctcactatagacaagcagctggtgctgtgtgaccgcaagttctgcaccaaggcctaccacctgtcctgcctgggccttggcaagcggcccttcgggaagtgggaatgtccttggcatcattgtgacgtgtgtggcaaaccttcgacttcattttgccacctctgccccaattcgttctgtaaggagcaccaggacgggacagccttcagctgcaccccggacgggcggtcctactgctgtgagcatgacttaggggcggcatcggtcagaagcaccaagactgagaagccccccccagagccagggaagccgaaggggaagaggcggcggcggaggggctggcggagagtcacagagggcaaatagcgccaggcggccgcttggccggatccaggggcggtgcagggcggccggccctgcctgcgggagagggcgagcatgaactggcccggaggacccagctcgagccgccaggacacagacgtacaggcctcctcgggagggagcgcctccccaccactgagccatcctcagcagcgtccgctgcgtctgcactgatgaccgtctgagcccagctcagcgttcctggacaaacagcctcactcctcagcgttaccgccacacttgaatttctccgaatgtcaaggttccctcccactctatttttttaggttaaagttaattggcatatggaatgttttaatctcctctgaaatgtgtagcgtaggcttttcccaagggtcgctagaaactcgtcttcgcgttgccccctttctggctctcagcgccgtcgccactcgggagaggctgggtgaggcccgtgtgaggactgaccctggattcctcgaaactgccattgtgatcattactctgctctttggaaatggctgtatcatttttttgtactaatgtgaattgttcctcagaaacgcttcttttccatcctagtgagaagctggccctgcaggtggtggcagcaatggtgttgtaagatttcctcccgtagttttttctcctcatggatttgaatgaaatgccaataacacgtccactttcaacgtgtagtttacgcggagcactttcgaggcctggccgggttgggcctacttctcacctgggcctatcttctgaactcgctaggttcttatcaacatttgggggataactttgtatatttttttcatttggcttttctttaccagtttctgatttttattctcaatatatttttgctaaacctatttcacaaatcaccaccgactgaagtgtgtgtttactgatgcggccctgagctccatggcgaaaggagtgactttgcagggcgtgagaccgcagtctgcttagagcacaggaagtgacaacttagggagccccgtagggcgctgcaggccccggggaccccagcacgtgggtctaaagagagacggagtctagctctcctgccacccagagtggcttccatctcagcactctgtgggtctggtgatggaagatgcagtctctgctgatcacatgtgccctctgccagggcacctactgagaggtgcggtcctgggggtggaggcctgcctggcaggtgtgcgtgcctcgtacgtgtgttatgggcactggtctaggccaggtatgacacccactctcctgtgagatttcactttagtttttaaaaggtccagttctacagagtgagacctatctatctgagtactacatatgttttaagacttggttctttttttgagggatccttgaccctgggaagtctggagcaccctgagaagggggcaccatgtgtgcctttgcccacgtgtcctgaggggctgcttgtctgggagggagggagagaacattcagcagcaggtgcttttttatggccttttcttaaaataacctaagggggacacatccatcttgcagagaagtttacagaactccccttgaaaactgctgctgaggctcctgttaaattttctgtggcatcttttatgccttggtaaaaactgcagtgtctttggacctgagagtggctactccgtggttttgtgacctgtaagcgtggggttcaggggtgtgtggccctgcagggtcccacgcctccctgagcactgactggaagtttcactggctggtggctgtcccttctcccatcagggtccccagcaaagttaactacacagaggacccaggggaaacgagctgtgtagccactgacttgctcgcgcggccgtggcctctgaggggcactcgccggttaagacagggtgggagtagtgctttccagttcagactctaacttctcccaaagtgtcctaagaaaatactggatcggctcatagatttatgctccttatgatgccctaacttggaaggttgttctagggacaggccgggcagtgtccccacacacaccttagagtcgaaggccccagggccccgctgtcacttgcccaaaagatcccttccggcaggtaagggactaccaatgcttacgtcaaaacagcagaatcggctttgcagtgcactttggggagcagatattaacttatttttgtgttggacagtagtgaaatcttgtgatttttaatcgctttgataatacttccaaattttatgatttttctgaaggaaataatgcaaacattttaaatatgtttctccccctttccaaaaactgttaaactaatgagcaagtaacactaactttgaatgtctctacaatacccgttgataactcagtggagccaggctttggggtagcggccctgagcttgcagggtttctcgccactggggctgaccacgcccccagctgtgaccgtgggtgtggctggctctcggccctgcccagctttgttctgaggacgtggtgacttcctgaacatcagcttcaatcctccatcattaatgtgaagcaaaacacaaaaaccgccccaatccctcaggattccttggcatccgaaaccagcatctgcacctaaacccatacccacccgtgtgcgcccacagggggatgtgtccgaatgggcagcttaaaatgtggtcacctgtgggggaaactcttcaggcacctgaagtgagaacccagctgtccgtcctcaggccggcctttcttccggcgacacccgtccatggctggctgggtccccttcgcagtgtttgtctgtcttgacatctaaaccccggcgtgtgcagtgcccatcttccaggactaccttattttccagaattaaacctgttttataattcaagttaatgcaaatgactgtcagttgccaaatatcttgatcctatgagtgtagttgatgactgtttgttagtcagtagagtaaaatgctgtgtccacggggtgtcacagcctcaccataccctgttgaggtgtgaaatgccccgtcagaaattaaatacaaacttaaatgtgcctattggtgtctaaacttcatacaatgtaaggtcagattccttttaggaatactgggtgctgtcaccaggtttgatagttagacttaaaaacttgaaattcactttttggggggagggatatactgaaatagagagttgagacttgccagttgggggaaaatagcatttaaaatggaaagctgtgtttggaaaattgtgtatgagtatttttgtattaaaaacattttaaaggcttttttcttaa

SEQ ID NO: 440512 - DNA, 9919 bp, Homo sapiens
  misc_feature (12)..(12): n is a, c, g, or t
  misc_feature (86)..(86): n is a, c, g, or t
gggaggcgcggnggcggggtcggcgccgcgcgcgagagcctcggcctggccgcgctgcgcccgccgccgccgccgccccctccccncctgggccctaccgccgcacggccccggccccctcccagcctgccgctccggagagccgcccgccgaggatgcgacgcaccgcagtgttctaagaacggaagcatctgggctggatggaatttagcatcaagcagagtcccctttctgttcagagtgttgtaaagtgcataaagatgaagcaggcaccagaaatcctcggcagtgccaacgggaagactccgagctgcgaggtgaaccgcgagtgttctgtgttcctcagcaaagcccagctctccagtagcctgcaggagggggtcatgcagaagtttaacggccacgacgccctgccctttattccagccgacaagctgaaagatcttacttcccgggtgtttaatggagaacccggcgcacacgatgccaaactgcgttttgagtcccaggaaatgaaagggattgggacaccccctaacactacccctatcaaaaatggctctccagaaattaagctgaaaatcaccaaaacatacatgaatgggaagcctctctttgaatcttccatttgtggtgacagtgctgctgatgtgtctcagtcagaagaaaatggacaaaaaccagaaaacaaggcgagaaggaacaggaagaggagcataaaatatgactccttgctggagcagggccttgtcgaagcagctcttgtgtctaagatctcaagtccttcagataaaaagattccagctaagaaagagtcttgtccaaacactggaagagacaaagaccacctgttgaaatacaacgttggtgatttggtgtggtccaaagtgtcgggttacccttggtggccttgcatggtttctgcagatccactccttcacagctataccaaacttaaaggtcagaaaaagagtgcacgccagtatcacgtacagttctttggtgacgccccagaaagagcttggatatttgagaagagcctcgtagcttttgaaggagaaggacagtttgaaaaattatgccaggaaagtgccaagcaggcacccacgaaagctgagaaaattaagctattgaaaccaatttcagggaaattgagggcccagtgggaaatgggcattgttcaagcagaagaagctgcaagcatgtcagtggaggagcggaaagccaagttcacctttctctatgtgggggaccagcttcatctcaaccctcaagtagccaaggaggctggcattgctgcagagtctttgggagaaatggcagaatcctcaggagtcagtgaagaagctgctgaaaaccccaagtctgtgagagaagagtgcattcccatgaagagaaggcggagggccaaactgtgtagctctgcagagaccctggagagtcaccccgacatagggaagagtactcctcaaaagacggcagaggctgaccccagaagaggagtagggtctcctcctgggaggaagaagaccacagtctccatgccacgaagcaggaagggagatgcagcatcccagtttttggtcttctgtcaaaaacacagggatgaggtggtagctgagcacccagatgcttcaggtgaggagattgaagagctgctcaggtcacagtggagtctgctgagtgagaagcagagagcacgctacaacaccaagtttgccctggtggcccctgtccaggctgaagaagactctggtaatgtaaatgggaaaaaaagaaaccacacaaagaggatacaggaccctacagaagatgctgaagctgaggacacacccaggaaaagactcaggacggacaagcacagtcttcggaagagagacacaatcactgacaaaacggccagaacaagctcttacaaggccatggaggcagcctcctcgctcaagagccaggcagcaacgaaaaatctgtctgatgcatgtaaaccactgaagaagcgaaatcgggcttccacggcagcatcttcagctcttgggtttagcaaaagttcatctccttctgcatccttaactgagaatgagggtaaaataataataataacgataaccatggcattggtatgaaggccatttagctgcccacgctgcagtgtgagtaatgctcagacttcataagcgcagcattggtgctcactgccagtgcagatgttttagggcctcttggctaactcagattcatgaaatggacaaacagtgcactatgttagtttatttgagcactttttatacacacgcacacagtgtctgtgtacatgtacagatatacttcagtcttgatgcagtttcatagttcttaaaatctgtctgaagaatgttgtgttctgtgtagccctcacactgtaagagttcacatggaagtaagtctgcgttggttctgaaagggcacagtgtcagttgagctgacatatactgggtggggtggaaggcgactcacacaccacacctgattcctgttgcttccagacctaggctcatggaggaagccaaagatttctttgttctcatgcatttcatggctttggtcctttaaattctggcacatttttagttacttgagtgttgaggtgagtcagaactaccattgtaatatgactcctgtgttctggacttgcagagtacatgatagcaaaataaagccatttggggctgctgcctgccatcattgtaacatgacacttagactttattatcaaacctaaattttttgccgttgccaaaaacaacaaatagccacagaacgtaggtgtgacacttttttgttcggaggtagttttggtttcctgatttttagggattaccttcatagagctttggagttttaatttcttgttatttggttctccgtgatgctgtttttctcattgtagacatgggtcctgtttttgtcatgtttatgaggagatgataactgggggcccttttggaacagggtagtgaggcaagggttggacaggccccttactcttgctgagtcagaaggcggcacttctggccaggtctctgccatggtccccaggaaggatggggtgtgcctcagttgtttccactcattagaggagtgtaggccttccagtgcaggaaggtcagggacctaggcaacctgggcggggctcatagagctctgcggcttgccactctgaatcctcagcgaccactcctccgagtgggattttctgcagggactcaaaccaactcagtggtggtcgagacctgttcacggatggtgggactggggctgctttacagtttgatacgtgtagataattaagcattttgtgatgtttggacacactggagaaaaggcagtaagaattatttactgaaacatctaggagcttactgaaatatgaaaaggcaaattttatacaaattatttttcctttttcctttctttcttgtccaagttcaggttaaaatcttagaaaattaaatgaaaggtcatttacagttccaaagaagaatattaaacatttttcacttaagttgagatttttgctttaaagagcttttaatgagtttttctgttatcataattttggtccggttattcacttgagttgttgcttatactgttgtcaggtacagtagagagaacatggagcctgctgagatcttctctgttattcctgatcctaagtcatgtatatcgaaggctttgatttagagtaatgcatgaggccagtgtagcggggtcgaggcctgcccatgagtcaggggagctcagtctccctggcctaggcagttgtcctgaccttgagaagacatagatgaagcattttatcatcattagacttaaattttaattcttcagaatgtcagaagttgataggttgttaaatacatttatataatacattaaatatgtgaaattaatacaccttcctacattttgaaggtgatgcatagatcccatagtgtgcatcatgttccttatatgaaaacgtttaaattactgggtcttttccattaaactacttttgtatggcttagataaatcttccattagtgttcatttttatagaattatgctgttaaaactactttaggtgaacaaataaacttgtctattatatattaacgcgactgaactacagtaaatgtttgtgatgtttccaatgctgaatgcctgttagcatatgaggcaaagtgtagtgttataaaaaacagcctgttgactgctgggcccgattctgatatgagttaggtgaccatgagaattgctgtttgaggtccacactgacacacacccattgggtcacaccccctttgcatgtttgtatttcctccctttcatcacatttgtttgaaataaggtacttttatagggttggtatttcagaacactttaggtcatgttgtagtttaaattcttcttgaaaaaggtatatgtgataaataaaaatttttattggaataattattacatggtactacatcaccctgaggaagagaataaattaaaattacacacttgcatgacaaaggcctgtgaaggaattaatgtgatttaagtgttttgtaacttcattttttattcctttagtagagcaaattcttatttttttcgccttcactggtaacagcttttgtgggagcccacaccagtcaagttggatttgaacccagctgctctgtactgcacttagaatgatgtaatattccaggatgctgctgcaggtggcgtatcatcgtacacactcagtgacatttctatcacaatcattttatggaagatgtgtgataatctgtttttactggtattaataaacacatacaatgaagaaaacagataacaaattttaagaccaaggtctcggacagcccgggagacgagccctcggagtccccatacgaaagtgcagacgaaacacaaactgaagtatctgtctcatccaaaaagtctgagcgaggagtgactgccaaaaaggagtatgtgtgccagctgtgtgagaagccgggcagcctcctgctctgtgaaggaccctgctgcggagctttccacctcgcctgccttgggctttcccggaggccagaagggaggttcacctgcagcgagtgtgcctcagggattcactcatgtttcgtgtgtaaagagagcaagacagatgttaagcgctgtgtggtaactcagtgtggaaaattttaccatgaggcttgtgtgaaaaaataccctctgactgtatttgagagccgaggtttccgctgccccctccacagctgtgtgagctgccatgcttccaacccttcaaacccaaggccgtcaaaaggtaaaatgatgcggtgtgtccgctgccccgttgcctatcacagcggggatgcttgtctggcagcaggatgctcagtgatcgcctccaacagcatcatctgcactgcccacttcactgctcggaaggggaagcgacaccacgcccacgtcaacgtgagctggtgcttcgtgtgctccaaaggggggagccttctgtgctgtgagtcctgcccagcggccttccaccctgactgcctgaacatcgagatgcctgacggcagctggttctgcaatgactgcagggctgggaagaagctgcacttccaggatatcatttgggtgaaacttgggaactacagatggtggccggcagaagtttgccatcccaaaaatgttcccccaaatattcagaaaatgaagcacgagattggagaattccctgtgtttttctttgggtctaaagattattactggacgcatcaggcgcgagtgttcccgtacatggagggggaccggggcagccgctaccagggggtcagagggatcggaagagtcttcaaaaacgcactgcaagaagctgaagctcgttttcgtgaaattaagcttcagagggaagcccgagaaacacaggagagcgagcgcaagcccccaccatacaagcacatcaaggtgaataagccttacgggaaagtccagatctacacagcggatatttcagaaatccctaagtgcaactgcaagcccacagatgagaatccttgtggctttgattcggagtgtctgaacaggatgctgatgtttgagtgccacccgcaggtgtgtcccgcgggcgagttctgccagaaccagtgcttcaccaagcgccagtacccagagaccaagatcatcaagacagatggcaaagggtggggcctggtcgccaagagggacatcagaaagggagaatttgttaacgagtacgttggggagctgatcgacgaggaggagtgcatggcgagaatcaagcacgcacacgagaacgacatcacccacttctacatgctcactatagacaaggaccgtataatagacgctggccccaaaggaaactactctcgatttatgaatcacagctgccagcccaactgtgagaccctcaagtggacagtgaatggggacactcgtgtgggcctgtttgccgtctgtgacattcctgcagcatgacttaggggcggcatcggtcagaagcaccaagactgagaagccccccccagagccagggaagccgaaggggaagaggcggcggcggaggggctggcggagagtcacagagggcaaatagcgccaggcggccgcttggccggatccaggggcggtgcagggcggccggccctgcctgcgggagagggcgagcatgaactggcccggaggacccagctcgagccgccaggacacagacgtacaggcctcctcgggagggagcgcctccccaccactgagccatcctcagcagcgtccgctgcgtctgcactgatgaccgtctgagcccagctcagcgttcctggacaaacagcctcactcctcagcgttaccgccacacttgaatttctccgaatgtcaaggttccctcccactctatttttttaggttaaagttaattggcatatggaatgttttaatctcctctgaaatgtgtagcgtaggcttttcccaagggtcgctagaaactcgtcttcgcgttgccccctttctggctctcagcgccgtcgccactcgggagaggctgggtgaggcccgtgtgaggactgaccctggattcctcgaaactgccattgtgatcattactctgctctttggaaatggctgtatcatttttttgtactaatgtgaattgttcctcagaaacgcttcttttccatcctagtgagaagctggccctgcaggtggtggcagcaatggtgttgtaagatttcctcccgtagttttttctcctcatggatttgaatgaaatgccaataacacgtccactttcaacgtgtagtttacgcggagcactttcgaggcctggccgggttgggcctacttctcacctgggcctatcttctgaactcgctaggttcttatcaacatttgggggataactttgtatatttttttcatttggcttttctttaccagtttctgatttttattctcaatatatttttgctaaacctatttcacaaatcaccaccgactgaagtgtgtgtttactgatgcggccctgagctccatggcgaaaggagtgactttgcagggcgtgagaccgcagtctgcttagagcacaggaagtgacaacttagggagccccgtagggcgctgcaggccccggggaccccagcacgtgggtctaaagagagacggagtctagctctcctgccacccagagtggcttccatctcagcactctgtgggtctggtgatggaagatgcagtctctgctgatcacatgtgccctctgccagggcacctactgagaggtgcggtcctgggggtggaggcctgcctggcaggtgtgcgtgcctcgtacgtgtgttatgggcactggtctaggccaggtatgacacccactctcctgtgagatttcactttagtttttaaaaggtccagttctacagagtgagacctatctatctgagtactacatatgttttaagacttggttctttttttgagggatccttgaccctgggaagtctggagcaccctgagaagggggcaccatgtgtgcctttgcccacgtgtcctgaggggctgcttgtctgggagggagggagagaacattcagcagcaggtgcttttttatggccttttcttaaaataacctaagggggacacatccatcttgcagagaagtttacagaactccccttgaaaactgctgctgaggctcctgttaaattttctgtggcatcttttatgccttggtaaaaactgcagtgtctttggacctgagagtggctactccgtggttttgtgacctgtaagcgtggggttcaggggtgtgtggccctgcagggtcccacgcctccctgagcactgactggaagtttcactggctggtggctgtcccttctcccatcagggtccccagcaaagttaactacacagaggacccaggggaaacgagctgtgtagccactgacttgctcgcgcggccgtggcctctgaggggcactcgccggttaagacagggtgggagtagtgctttccagttcagactctaacttctcccaaagtgtcctaagaaaatactggatcggctcatagatttatgctccttatgatgccctaacttggaaggttgttctagggacaggccgggcagtgtccccacacacaccttagagtcgaaggccccagggccccgctgtcacttgcccaaaagatcccttccggcaggtaagggactaccaatgcttacgtcaaaacagcagaatcggctttgcagtgcactttggggagcagatattaacttatttttgtgttggacagtagtgaaatcttgtgatttttaatcgctttgataatacttccaaattttatgatttttctgaaggaaataatgcaaacattttaaatatgtttctccccctttccaaaaactgttaaactaatgagcaagtaacactaactttgaatgtctctacaatacccgttgataactcagtggagccaggctttggggtagcggccctgagcttgcagggtttctcgccactggggctgaccacgcccccagctgtgaccgtgggtgtggctggctctcggccctgcccagctttgttctgaggacgtggtgacttcctgaacatcagcttcaatcctccatcattaatgtgaagcaaaacacaaaaaccgccccaatccctcaggattccttggcatccgaaaccagcatctgcacctaaacccatacccacccgtgtgcgcccacagggggatgtgtccgaatgggcagcttaaaatgtggtcacctgtgggggaaactcttcaggcacctgaagtgagaacccagctgtccgtcctcaggccggcctttcttccggcgacacccgtccatggctggctgggtccccttcgcagtgtttgtctgtcttgacatctaaaccccggcgtgtgcagtgcccatcttccaggactaccttattttccagaattaaacctgttttataattcaagttaatgcaaatgactgtcagttgccaaatatcttgatcctatgagtgtagttgatgactgtttgttagtcagtagagtaaaatgctgtgtccacggggtgtcacagcctcaccataccctgttgaggtgtgaaatgccccgtcagaaattaaatacaaacttaaatgtgcctattggtgtctaaacttcatacaatgtaaggtcagattccttttaggaatactgggtgctgtcaccaggtttgatagttagacttaaaaacttgaaattcactttttggggggagggatatactgaaatagagagttgagacttgccagttgggggaaaatagcatttaaaatggaaagctgtgtttggaaaattgtgtatgagtatttttgtattaaaaacattttaaaggcttttttcttaa

SEQ ID NO: 440513 - DNA, 8574 bp, Homo sapiens
  misc_feature (12)..(12): n is a, c, g, or t
  misc_feature (86)..(86): n is a, c, g, or t
gggaggcgcggnggcggggtcggcgccgcgcgcgagagcctcggcctggccgcgctgcgcccgccgccgccgccgccccctccccncctgggccctaccgccgcacggccccggccccctcccagcctgccgctccggagagccgcccgccgaggatgcgacgcaccgcagtgttctaagaacggaagcatctgggctggatggaatttagcatcaagcagagtcccctttctgttcagagtgttgtaaagtgcataaagatgaagcaggcaccagaaatcctcggcagtgccaacgggaagactccgagctgcgaggtgaaccgcgagtgttctgtgttcctcagcaaagcccagctctccagtagcctgcaggagggggtcatgcagaagtttaacggccacgacgccctgccctttattccagccgacaagctgaaagatcttacttcccgggtgtttaatggagaacccggcgcacacgatgccaaactgcgttttgagtcccaggaaatgaaagggattgggacaccccctaacactacccctatcaaaaatggctctccagaaattaagctgaaaatcaccaaaacatacatgaatgggaagcctctctttgaatcttccatttgtggtgacagtgctgctgatgtgtctcagtcagaagaaaatggacaaaaaccagaaaacaaggcgagaaggaacaggaagaggagcataaaatatgactccttgctggagcagggccttgtcgaagcagctcttgtgtctaagatctcaagtccttcagataaaaagattccagctaagaaagagtcttgtccaaacactggaagagacaaagaccacctgttgaaatacaacgttggtgatttggtgtggtccaaagtgtcgggttacccttggtggccttgcatggtttctgcagatccactccttcacagctataccaaacttaaaggtcagaaaaagagtgcacgccagtatcacgtacagttctttggtgacgccccagaaagagcttggatatttgagaagagcctcgtagcttttgaaggagaaggacagtttgaaaaattatgccaggaaagtgccaagcaggcacccacgaaagctgagaaaattaagctattgaaaccaatttcagggaaattgagggcccagtgggaaatgggcattgttcaagcagaagaagctgcaagcatgtcagtggaggagcggaaagccaagttcacctttctctatgtgggggaccagcttcatctcaaccctcaagtagccaaggaggctggcattgctgcagagtctttgggagaaatggcagaatcctcaggagtcagtgaagaagctgctgaaaaccccaagtctgtgagagaagagtgcattcccatgaagagaaggcggagggccaaactgtgtagctctgcagagaccctggagagtcaccccgacatagggaagagtactcctcaaaagacggcagaggctgaccccagaagaggagtagggtctcctcctgggaggaagaagaccacagtctccatgccacgaagcaggaagggagatgcagcatcccagtttttggtcttctgtcaaaaacacagggatgaggtggtagctgagcacccagatgcttcaggtgaggagattgaagagctgctcaggtcacagtggagtctgctgagtgagaagcagagagcacgctacaacaccaagtttgccctggtggcccctgtccaggctgaagaagactctggtaatgtaaatgggaaaaaaagaaaccacacaaagaggatacaggaccctacagaagatgctgaagctgaggacacacccaggaaaagactcaggacggacaagcacagtcttcggaagagagacacaatcactgacaaaacggccagaacaagctcttacaaggccatggaggcagcctcctcgctcaagagccaggcagcaacgaaaaatctgtctgatgcatgtaaaccactgaagaagcgaaatcgggcttccacggcagcatcttcagctcttgggtttagcaaaagttcatctccttctgcatccttaactgagaatgagcttttgtgggagcccacaccagtcaagttggatttgaacccagctgctctgtactgcacttagaatgatgtaatattccaggatgctgctgcaggtggcgtatcatcgtacacactcagtgacatttctatcacaatcattttatggaagatgtgtgataatctgtttttactggtattaataaacacatacaatgaagaaaacagataacaaattttaagaccaaggtaagataactaatcaaggccatttaatccgtcacattcatctcataatagaaacacgttcatattccagtggtcaatgtagatttcaagttgaaaggcagtccctttagttgggggctgtccagagctgcagcagggctttgcacggaaggggtggccctgttagagttgcttctcctctagtttgtaacttactggacttttgtggaaaatatcagcgtcgctaccctcagaaacaaactaacagcacacgttaggaggagtcctcatcagctgttctcattgccagtgagatatattcagtattgtagatactacactaatttccaacataagaggcaggaagagttttgattctatccttttttactaaacagttttattatgacactagatacagtaaatttttagaaaaaaataccatttacagtattattgtgaaccatttaacccttttgatccaaggccccggaccaaggggatactgtaatcaggttatgtacaccaacctctgcatcagttgcttctatagagcatcagccctcatgtttcattgtcttaatgtcggggagcagcctggtgtcctgccccaggtgtccgcatttttgcatggtaaggaaaaggcttacttgcccttcagctcataaaagcagaaggtgtgctattcacagtaccatgcgagtagcccacagttaattcccggcagattctttggctgtgttttatctttaatgaacgtttctgactaatattttgttgtaaaccattaagtaatgtaacgcatgtaagatgcttagggtgcctggccaggactccgtggtttcctgttgtgacagtaataatggttataataataaaaatgataaaattgccatcattctatttttatccaaaagtataaattttgctttggcatgaaaagtggtcctcttgactgcattatgcatgcgaggatgaaataaacctagaagtggcagaacactggatttgtgtgtgtggcgctttagggtgctggactgtatggctgagggctggttgggttcctctattggctctgctcaaatgttgcaggatacatagccccaaagatggtctaggagcaatctaagctgtgttactccaaaggacatgaaaaagctcaagagtaaaattaaaattctcaaaaaaaaaccccacgaaatttaaagatggggaaaaaaagatggtataaaaatggctctggttcaataagcagtcacccaaagtaaagactctatcttgaaaggcttttggtgaaaatgaagggatttcatttgaaattacagcatgatgaattttgcatgggtggccagccagctagcccataactgatagatgcattagaagtcagccagcgcataggtgctccctctatattatggagaaagcaaaaccctgcaaatgaccaaatggtgtccaaagagcagcatgacattggcatcagctgaataaccaggggcacatgggggaacgtggatgggaatgatagtgtatctcagcggggggtggggtgacatcgttccctggggacattgggaaggtgggcaggggcaagtgaactcagcactctgcagtgagagggacagtcccatgtgtggcagcattgtcccacttcagatgccaggagtgggctcatcctagaggagcggagttttccgagaggaccatctcctggtttcctgaaggaggtgggtggaaacggctcttgtttgaaagaacttagggaggaccattggcttgccaagagtacagaaattcattatgctgctaatttaacgtggaattccttcatttcataagaacctcaaaataatggtgatacattctagccttaagacatttgaattgccggttgttgaggtgaattttgtttgtcatacatggaaccattttagtcccatttgactcacttcagaccatcttccacacactatgtctgtgcttggagaggggaggtggctctccagtgtaaaacttgaggcattcactagaggtgaaaacttgtcagaatatataaaagcttagattgtagctgttctaaaaacgtaagtactccattgtaatagggtggcatcttcaggtagtgcacatattggcaatagaggtcctgaattgtttttctaagactgatctgagagccattgggccatcaagcctttatatatctgcttctaaaattgccccacctgctctagatggatctttgggcctttcctcagtgttcatgcaaaaattaaatgtcttttttcagcatactgactccaggtgtagttacatctcagtgctgtcttgagtatatattttatctcttatacctgtatctcccaactagaaacagctccagtgtttttaagagaatgtttcttaaaaccaataggaaacttaagcgaggtttcatgacacaacctttcatgtcgtgaaaggcagagggtgactgtgtgtgatgtgcagagtccttggacaggagtcgggggctcctctgtcccactgctgcttcttgagtgggtggagtggtgcttagaggatctccgagaggtccccgcagctctagggagatctgattttgtgttttttgtttaagtacttcacacagaagcctaggtagatttaaaatggggtgctcagggactggggaacaagacggggtggggtggggagatgggcatttggagagtctcatgtagctggagacgttaagagctgagcacaccacaggaaaggagggaggatgctgtgtgagagccatgctgtcaggagcaagcttgctgctcctgtgctgccctggccctggccttgcttgcccatggtgtgtgtgtccagaggtgtgtgtgaggctgccagaacaagtgctgggtctgtcacagagaagtttaaaaaagaaaactaagattataaattagcatctagttccaaaaccaaaaaaagtgcctgtggatgtatataaaattaagatgataagaaagtgctcctgagaaggctcttgccagaagcctgatgtgagtgtgtggcacctgtgatggcagggctgtgagctgggcttctgtcctcctctgtgtcccggcatggaagccagtataagcatttccaaatgagggaaaagtccttggctcgtttgatccagttgagttgaaagggttgccttggcagcagaggctcctctgatggctgacatcagtcactgcgtctgggcctgagacgtgcatggagggctgtaaagccacggattcccctcgctggagaggctcctgtctgatagcggtagatgaaaaataaggtcgttatgactttggcaacttgcttcatttctttttcatttgacttacaacacacttctctaacatctagcccttttaaatttttaattaatttcaaagcttcctctggccaggtagacttttgtatacagaccaggtgagagcccttttgccttagtgtgaaaatgtaacattttatgcttttaaaatcaatagattcatcaccttagttttttaaaaaaaatctataaatagggtaattgctgaggtgtgcggtttatctttgagatgataaagctaaattatagtcttttgccagagaaactgaggtaactgtcattagaaaaggtttcttaaaatactcacaaagctgttattggcttcttaacttctaaaatttggggggtcttgcatttatttattatttatttatttatttatttagagacagagtctcaccctgttggccaggctggagtgcagtaagtggcacaatctcggctcactgcaacctccgcctccttggttccagcaattcttctgcctcagcctcccgagtagctgggactacaagcggctgccaccacacctggctatttttttttgtatttttagtagagacagggtttcgccatattggccaggctggtcttgaactcctgacctcgtgatccacccgcctcaccctcccaaaatgctgggattacaggcgtaagccactgcacctggcggggtcttgcttattttaaaagaaatattctgattcatattttaggactttttgtcaacgaaattggttttgatccctttgggtaccatttttattgttttatgtagaatgttagaaattaccactaatttacctggcagtgatgtcaaattgactgtaattagcaggtagaaaattatttgtattatattcatctgattcctatactggatgagcaaggagcatgcttcctttgggacattcttacagcagggtgtctctccaacagcccgacagcctcatctttttggttggatacctttgaactccatggttacgtgttaggtccacatttgtgtttttttctagcctacctatagttgttggcctttttgcatataactctcgggtaatattttgaagcatgctgaccatccaggcatatagtattttcaagaaatgactgaggtaggggtgggggtcctggtccggctgatgggggtttgctcagcactgtgccagtggaagcaggtgtattgtgggcagttttgtcattgtcctcaagtccttcgcagacagtgcacagcctgctgtctgcagtcggccagaccaggctcctccccagcacactccctgtgggatggccgctgctcaggacacagtgggacaaagttgggttgataggatattttagattcattttacctttgacaagggcaggccttgaattgggagcagcagccacctggcctcactctggccacaggtgacacttggtccttgctgccacctgcttggggctatgtggctacggctacacaaaagcctgtgcaggttagaagacgactgtggtgtgcagtggtgctctgggagtggagacttcctctgttctcagagactcacccccagccctgaccctagaatttagggatagccaggaagtttctagtttgtgtaacctagaagggtcactttaataaaaattgttatgaactatagtattttagatgatgagtgacttattttaattccactttaacattttactgtgctgttaacttggaagacctgtttgaaattagtcttgatttcacactcatttaatctgctgagcacagggctgttgtcatttgtaaacgcaaacactgtggaggtacttctcgccatcagcttccttctttacaaaaccatcatttcaacatgaaaattatgtcagtttatagaaatatttattgttcaaggtctgtaattgtatttcaaaaacgatgtcgtattcaagttgtgaagggatttgttttgtcaaaaaattaaaaactcaatgtgtatgacgccactctgaagagtaggtgagcgctttgcagtcacagaaggtggcatctgactgcggctcatacaggtcaccctgaagggccacgtgcttttagcagttggctggaatgtgttcactaggttccgttatgtttggtaatatcatcttgaaaagtccctgtaatagatcaaggagactgcattccctgccctgaaggaatgtatttctaaggcaaataggcaacttggtactatcttattctgagtagagagtggagaaagtattttcagactgaagaaaactttgaaaagtcaggagctaagctgctcggagctcagtgccgcagcatggctgtggtggacgcgggaaacaacgggaaagttcttgacagagtctgtgtccgctcagtccctgcacttttcctttccaaatgcatctcgttggatatggaatagatcgtagatgttgtagactgagatttgggactatgttgggaccgtacaggtgaatgtgccacctccacaaatggcttctccgagtgagtcacgtcacctggtgcgtggaggtggagcctgcggctggagtaaggcttgctgtgggacgccctcgtactttgctctccttgcgggtggttgccgagccgagagcattggatcctccccgactgtggctagttgtctgtccggtggctgggagggggtgtggtgggaaaaagtcggaatctctgcaatctgtgtcatggactgtactattgtaaggtctatattctgtatgtgggtcccagaccctgatcaggaaatgagcctcatgtgtgtcgttaacatttatatatttccattcaaaatatgtattcagtgtttatttcctcaaaacagactttgttaatgtaggaaatctctccaagtggaaacgtgctaactttttctgtaaatctgaaataaaaggtgctgttccttcctctgacccaggactgctt

SEQ ID NO: 440514 - DNA, 7256 bp, Homo sapiens
  misc_feature (6861)..(6861): n is a, c, g, or t
  misc_feature (6865)..(6865): n is a, c, g, or t
  misc_feature (6874)..(6874): n is a, c, g, or t
  misc_feature (6884)..(6884): n is a, c, g, or t
  misc_feature (6890)..(6890): n is a, c, g, or t
  misc_feature (6892)..(6892): n is a, c, g, or t
agagatgggtctcgccatcaccatgttgcccagtctggtctccaactcctgggctcaagcgatcctcctgccttggtctcccaaagtgctgggattacaggtgtgagcccccacacccggcctgagtgagtgggttctgaatggtgactgttgttgtccatagccttccccctgcttctgagagtggagtccctcccctcatgttggagacctcccaaggtccatgtggtcctataggggctgttcagcctccctagccccttaacgtgtcaggtaatactgtatatattccatgaaatgtgaataattagttatataattcctaagcacttattttaaaaaacagcaatgtgatgcttaactcttcccacctctgttcctgtcccccttagaaaaccactgataactctttttttttttgagacggagtcttgccctgtcgcccaggctggagtgtagtggcctgatctcggctcggctcattgtaacctccgcctcgggtttgagcgattctcctgcctcagcctcctgagtagctgggattataggcgtgcaccaccacgcctggctaattttttgtatctttagtagggacgggtttcaccatgttggccagagtggtcttgaactcctgaccttgtgatccgctcgcctcagcctcccaaagtgctgggattacaggcatgagccaccgtgcctgtcctagaaccactggtaactcttaactgagacaagatttcgccatgttgcccaggctggtctcgaacttctgagctcaagcgatctacctgcctcgtcctcccaaagtgttggaattgcaggtgtgagccactgcacccggcccttgcctcatgtttgaatgataatttacctgggcataaaattctggacacttgtggtggcacgagctgtctgcttttctgtggagactgcgggttgcagacaccagcagccccctattgctgcacgtcaggtgtcctccacctcagtactgtggacatctcgggccgcatagccctgttgcgcgggcatcctgtgcgttgcaggagatgcagcagcatccatgaccgcaacccatcagagtgttctaagaacggaagcatctgggctggatggaatttagcatcaagcagagtcccctttctgttcagagtgttgtaaagtgcataaagatgaagcaggcaccagaaatcctcggcagtgccaacgggaagactccgagctgcgaggtgaaccgcgagtgttctgtgttcctcagcaaagcccagctctccagtagcctgcaggagggggtcatgcagaagtttaacggccacgacgccctgccctttattccagccgacaagctgaaagatcttacttcccgggtgtttaatggagaacccggcgcacacgatgccaaactgcgttttgagtcccaggaaatgaaagggattgggacaccccctaacactacccctatcaaaaatggctctccagaaattaagctgaaaatcaccaaaacatacatgaatgggaagcctctctttgaatcttccatttgtggtgacagtgctgctgatgtgtctcagtcagaagaaaatggacaaaaaccagaaaacaaggcgagaaggaacaggaagaggagcataaaatatgactccttgctggagcagggccttgtcgaagcagctcttgtgtctaagatctcaagtccttcagataaaaagattccagctaagaaagagtcttgtccaaacactggaagagacaaagaccacctgttgaaatacaacgttggtgatttggtgtggtccaaagtgtcgggttacccttggtggccttgcatggtttctgcagatccactccttcacagctataccaaacttaaaggtcagaaaaagagtgcacgccagtatcacgtacagttctttggtgacgccccagaaagagcttggatatttgagaagagcctcgtagcttttgaaggagaaggacagtttgaaaaattatgccaggaaagtgccaagcaggcacccacgaaagctgagaaaattaagctattgaaaccaatttcagggaaattgagggcccagtgggaaatgggcattgttcaagcagaagaagctgcaagcatgtcagtggaggagcggaaagccaagttcacctttctctatgtgggggaccagcttcatctcaaccctcaagtagccaaggaggctggcattgctgcagagtctttgggagaaatggcagaatcctcaggagtcagtgaagaagctgctgaaaaccccaagtctgtgagagaagagtgcattcccatgaagagaaggcggagggccaaactgtgtagctctgcagagaccctggagagtcaccccgacatagggaagagtactcctcaaaagacggcagaggctgaccccagaagaggagtagggtctcctcctgggaggaagaagaccacagtctccatgccacgaagcaggaagggagatgcagcatcccagtttttggtcttctgtcaaaaacacagggatgaggtggtagctgagcacccagatgcttcaggtgaggagattgaagagctgctcaggtcacagtggagtctgctgagtgagaagcagagagcacgctacaacaccaagtttgccctggtggcccctgtccaggctgaagaagactctggtaatgtaaatgggaaaaaaagaaaccacacaaagaggatacaggaccctacagaagatgctgaagctgaggacacacccaggaaaagactcaggacggacaagcacagtcttcggaagagagacacaatcactgacaaaacggccagaacaagctcttacaaggccatggaggcagcctcctcgctcaagagccaggcagcaacgaaaaatctgtctgatgcatgtaaaccactgaagaagcgaaatcgggcttccacggcagcatcttcagctcttgggtttagcaaaagttcatctccttctgcatccttaactgagaatgagggtaaaataataataataacgataaccatggcattggtatgaaggccatttagctgcccacgctgcagtgtgagtaatgctcagacttcataagcgcagcattggtgctcactgccagtgcagatgttttagggcctcttggctaactcagattcatgaaatggacaaacagtgcactatgttagtttatttgagcactttttatacacacgcacacagtgtctgtgtacatgtacagatatacttcagtcttgatgcagtttcatagttcttaaaatctgtctgaagaatgttgtgttctgtgtagccctcacactgtaagagttcacatggaagtaagtctgcgttggttctgaaagggcacagtgtcagttgagctgacatatactgggtggggtggaaggcgactcacacaccacacctgattcctgttgcttccagacctaggctcatggaggaagccaaagatttctttgttctcatgcatttcatggctttggtcctttaaattctggcacatttttagttacttgagtgttgaggtgagtcagaactaccattgtaatatgactcctgtgttctggacttgcagagtacatgatagcaaaataaagccatttggggctgctgcctgccatcattgtaacatgacacttagactttattatcaaacctaaattttttgccgttgccaaaaacaacaaatagccacagaacgtaggtgtgacacttttttgttcggaggtagttttggtttcctgatttttagggattaccttcatagagctttggagttttaatttcttgttatttggttctccgtgatgctgtttttctcattgtagacatgggtcctgtttttgtcatgtttatgaggagatgataactgggggcccttttggaacagggtagtgaggcaagggttggacaggccccttactcttgctgagtcagaaggcggcacttctggccaggtctctgccatggtccccaggaaggatggggtgtgcctcagttgtttccactcattagaggagtgtaggccttccagtgcaggaaggtcagggacctaggcaacctgggcggggctcatagagctctgcggcttgccactctgaatcctcagcgaccactcctccgagtgggattttctgcagggactcaaaccaactcagtggtggtcgagacctgttcacggatggtgggactggggctgctttacagtttgatacgtgtagataattaagcattttgtgatgtttggacacactggagaaaaggcagtaagaattatttactgaaacatctaggagcttactgaaatatgaaaaggcaaattttatacaaattatttttcctttttcctttctttcttgtccaagttcaggttaaaatcttagaaaattaaatgaaaggtcatttacagttccaaagaagaatattaaacatttttcacttaagttgagatttttgctttaaagagcttttaatgagtttttctgttatcataattttggtccggttattcacttgagttgttgcttatactgttgtcaggtacagtagagagaacatggagcctgctgagatcttctctgttattcctgatcctaagtcatgtatatcgaaggctttgatttagagtaatgcatgaggccagtgtagcggggtcgaggcctgcccatgagtcaggggagctcagtctccctggcctaggcagttgtcctgaccttgagaagacatagatgaagcattttatcatcattagacttaaattttaattcttcagaatgtcagaagttgataggttgttaaatacatttatataatacattaaatatgtgaaattaatacaccttcctacattttgaaggtgatgcatagatcccatagtgtgcatcatgttccttatatgaaaacgtttaaattactgggtcttttccattaaactacttttgtatggcttagataaatcttccattagtgttcatttttatagaattatgctgttaaaactactttaggtgaacaaataaacttgtctattatatattaacgcgactgaactacagtaaatgtttgtgatgtttccaatgctgaatgcctgttagcatatgaggcaaagtgtagtgttataaaaaacagcctgttgactgctgggcccgattctgatatgagttaggtgaccatgagaattgctgtttgaggtccacactgacacacacccattgggtcacaccccctttgcatgtttgtatttcctccctttcatcacatttgtttgaaataaggtacttttatagggttggtatttcagaacactttaggtcatgttgtagtttaaattcttcttgaaaaaggtatatgtgataaataaaaatttttattggaataattattacatggtactacatcaccctgaggaagagaataaattaaaattacacacttgcatgacaaaggcctgtgaaggaattaatgtgatttaagtgttttgtaacttcattttttattcctttagtagagcaaattcttatttttttcgccttcactggtaacagcttttgtgggagcccacaccagtcaagttggatttgaacccagctgctctgtactgcacttagaatgatgtaatattccaggatgctgctgcaggtggcgtatcatcgtacacactcagtgacatttctatcacaatcattttatggaagatgtgtgataatctgtttttactggtattaataaacacatacaatgaagaaaacagataacaaattttaagaccaaggtaagataactaatcaaggccatttaatccgtcacattcatctcataatagaaacacgttcatattccagtggtcaatgtagatttcaagttgaaaggcagtccctttagttgggggctgtccagagctgcagcagggctttgcacggaaggggtggccctgttagagttgcttctcctctagtttgtaacttactggacttttgtggaaaatatcagcgtcgctaccctcagaaacaaactaacagcacacgttaggaggagtcctcatcagctgttctcattgccagtgagatatattcagtattgtagatactacactaatttccaacataagaggcaggaagagttttgattctatccttttttactaaacagttttattatgacactagatacagtaaatttttagaaaaaaataccatttacagtattattgtgaaccatttaacccttttgatccaaggccccggaccaaggggatactgtaatcaggttatgtacaccaacctctgcatcagttgcttctatagagcatcagccctcatgtttcattgtcttaatgtcggggagcagcctggtgtcctgccccaggtgtccgcatttttgcatggtaaggaaaaggcttacttgcccttcagctcataaaagcagaaggtgtgctattcacagtaccatgcgagtagcccacagttaattcccggcagattctttggctgtgttttatctttaatgaacgtttctgactaatattttgttgtaaaccattaagtaatgtaacgcatgtaagatgcttagggtgcctggccaggactccgtggtttcctgttgtgacagtaataatggttataataataaaaatgataaaattgccatcattctatttttatccaaaagtataaattttgctttggcatgaaaagtggtcctcttgactgcattatgcatgcgaggatgaaataaacctagaagtggcagaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaatnaaanaaaaaaaanaaaaaaaaanaaaaananaaaaaaaaaaaaaaaaaaaaaagagggggggggcggcgcaaccacaaatcactcccccagacgggacagacaagctaggcagcaaccatatagtttctatagagtaagggggaggactaaagaaaaagggtagtatacaaagattagaaaagcggaggcggtgagcaaccactaaaataaacgagaggaggagacgaggacacacaaaaggcggacagcacatacaagaagaaacacacaacaactgtgggggagatgaacaaggaggagaaacacacaagcaacaaagaaaaacggggaggagaagaaaaaaaagagaaggataagggggagaaaacaaaaacaaagatggcgagaagtaaaa

SEQ ID NO: 440515 - DNA, 8965 bp, Homo sapiens
  misc_feature (12)..(12): n is a, c, g, or t
  misc_feature (86)..(86): n is a, c, g, or t
  misc_feature (8615)..(8615): n is a, c, g, or t
  misc_feature (8619)..(8619): n is a, c, g, or t
  misc_feature (8628)..(8628): n is a, c, g, or t
  misc_feature (8638)..(8638): n is a, c, g, or t
  misc_feature (8644)..(8644): n is a, c, g, or t
  misc_feature (8646)..(8646): n is a, c, g, or t
gggaggcgcggnggcggggtcggcgccgcgcgcgagagcctcggcctggccgcgctgcgcccgccgccgccgccgccccctccccncctgggccctaccgccgcacggccccggccccctcccagcctgccgctccggagagccgcccgccgaggatgcgacgcaccgcagtgttctaagaacggaagcatctgggctggatggaatttagcatcaagcagagtcccctttctgttcagagtgttgtaaagtgcataaagatgaagcaggcaccagaaatcctcggcagtgccaacgggaagactccgagctgcgaggtgaaccgcgagtgttctgtgttcctcagcaaagcccagctctccagtagcctgcaggagggggtcatgcagaagtttaacggccacgacgccctgccctttattccagccgacaagctgaaagatcttacttcccgggtgtttaatggagaacccggcgcacacgatgccaaactgcgttttgagtcccaggaaatgaaagggattgggacaccccctaacactacccctatcaaaaatggctctccagaaattaagctgaaaatcaccaaaacatacatgaatgggaagcctctctttgaatcttccatttgtggtgacagtgctgctgatgtgtctcagtcagaagaaaatggacaaaaaccagaaaacaaggcgagaaggaacaggaagaggagcataaaatatgactccttgctggagcagggccttgtcgaagcagctcttgtgtctaagatctcaagtccttcagataaaaagattccagctaagaaagagtcttgtccaaacactggaagagacaaagaccacctgttgaaatacaacgttggtgatttggtgtggtccaaagtgtcgggttacccttggtggccttgcatggtttctgcagatccactccttcacagctataccaaacttaaaggtcagaaaaagagtgcacgccagtatcacgtacagttctttggtgacgccccagaaagagcttggatatttgagaagagcctcgtagcttttgaaggagaaggacagtttgaaaaattatgccaggaaagtgccaagcaggcacccacgaaagctgagaaaattaagctattgaaaccaatttcagggaaattgagggcccagtgggaaatgggcattgttcaagcagaagaagctgcaagcatgtcagtggaggagcggaaagccaagttcacctttctctatgtgggggaccagcttcatctcaaccctcaagtagccaaggaggctggcattgctgcagagtctttgggagaaatggcagaatcctcaggagtcagtgaagaagctgctgaaaaccccaagtctgtgagagaagagtgcattcccatgaagagaaggcggagggccaaactgtgtagctctgcagagaccctggagagtcaccccgacatagggaagagtactcctcaaaagacggcagaggctgaccccagaagaggagtagggtctcctcctgggaggaagaagaccacagtctccatgccacgaagcaggaagggagatgcagcatcccagtttttggtcttctgtcaaaaacacagggatgaggtggtagctgagcacccagatgcttcaggtgaggagattgaagagctgctcaggtcacagtggagtctgctgagtgagaagcagagagcacgctacaacaccaagtttgccctggtggcccctgtccaggctgaagaagactctggtaatgtaaatgggaaaaaaagaaaccacacaaagaggatacaggaccctacagaagatgctgaagctgaggacacacccaggaaaagactcaggacggacaagcacagtcttcggaagagagacacaatcactgacaaaacggccagaacaagctcttacaaggccatggaggcagcctcctcgctcaagagccaggcagcaacgaaaaatctgtctgatgcatgtaaaccactgaagaagcgaaatcgggcttccacggcagcatcttcagctcttgggtttagcaaaagttcatctccttctgcatccttaactgagaatgagggtaaaataataataataacgataaccatggcattggtatgaaggccatttagctgcccacgctgcagtgtgagtaatgctcagacttcataagcgcagcattggtgctcactgccagtgcagatgttttagggcctcttggctaactcagattcatgaaatggacaaacagtgcactatgttagtttatttgagcactttttatacacacgcacacagtgtctgtgtacatgtacagatatacttcagtcttgatgcagtttcatagttcttaaaatctgtctgaagaatgttgtgttctgtgtagccctcacactgtaagagttcacatggaagtaagtctgcgttggttctgaaagggcacagtgtcagttgagctgacatatactgggtggggtggaaggcgactcacacaccacacctgattcctgttgcttccagacctaggctcatggaggaagccaaagatttctttgttctcatgcatttcatggctttggtcctttaaattctggcacatttttagttacttgagtgttgaggtgagtcagaactaccattgtaatatgactcctgtgttctggacttgcagagtacatgatagcaaaataaagccatttggggctgctgcctgccatcattgtaacatgacacttagactttattatcaaacctaaattttttgccgttgccaaaaacaacaaatagccacagaacgtaggtgtgacacttttttgttcggaggtagttttggtttcctgatttttagggattaccttcatagagctttggagttttaatttcttgttatttggttctccgtgatgctgtttttctcattgtagacatgggtcctgtttttgtcatgtttatgaggagatgataactgggggcccttttggaacagggtagtgaggcaagggttggacaggccccttactcttgctgagtcagaaggcggcacttctggccaggtctctgccatggtccccaggaaggatggggtgtgcctcagttgtttccactcattagaggagtgtaggccttccagtgcaggaaggtcagggacctaggcaacctgggcggggctcatagagctctgcggcttgccactctgaatcctcagcgaccactcctccgagtgggattttctgcagggactcaaaccaactcagtggtggtcgagacctgttcacggatggtgggactggggctgctttacagtttgatacgtgtagataattaagcattttgtgatgtttggacacactggagaaaaggcagtaagaattatttactgaaacatctaggagcttactgaaatatgaaaaggcaaattttatacaaattatttttcctttttcctttctttcttgtccaagttcaggttaaaatcttagaaaattaaatgaaaggtcatttacagttccaaagaagaatattaaacatttttcacttaagttgagatttttgctttaaagagcttttaatgagtttttctgttatcataattttggtccggttattcacttgagttgttgcttatactgttgtcaggtacagtagagagaacatggagcctgctgagatcttctctgttattcctgatcctaagtcatgtatatcgaaggctttgatttagagtaatgcatgaggccagtgtagcggggtcgaggcctgcccatgagtcaggggagctcagtctccctggcctaggcagttgtcctgaccttgagaagacatagatgaagcattttatcatcattagacttaaattttaattcttcagaatgtcagaagttgataggttgttaaatacatttatataatacattaaatatgtgaaattaatacaccttcctacattttgaaggtgatgcatagatcccatagtgtgcatcatgttccttatatgaaaacgtttaaattactgggtcttttccattaaactacttttgtatggcttagataaatcttccattagtgttcatttttatagaattatgctgttaaaactactttaggtgaacaaataaacttgtctattatatattaacgcgactgaactacagtaaatgtttgtgatgtttccaatgctgaatgcctgttagcatatgaggcaaagtgtagtgttataaaaaacagcctgttgactgctgggcccgattctgatatgagttaggtgaccatgagaattgctgtttgaggtccacactgacacacacccattgggtcacaccccctttgcatgtttgtatttcctccctttcatcacatttgtttgaaataaggtacttttatagggttggtatttcagaacactttaggtcatgttgtagtttaaattcttcttgaaaaaggtatatgtgataaataaaaatttttattggaataattattacatggtactacatcaccctgaggaagagaataaattaaaattacacacttgcatgacaaaggcctgtgaaggaattaatgtgatttaagtgttttgtaacttcattttttattcctttagtagagcaaattcttatttttttcgccttcactggtaacagcttttgtgggagcccacaccagtcaagttggatttgaacccagctgctctgtactgcacttagaatgatgtaatattccaggatgctgctgcaggtggcgtatcatcgtacacactcagtgacatttctatcacaatcattttatggaagatgtgtgataatctgtttttactggtattaataaacacatacaatgaagaaaacagataacaaattttaagaccaaggtctcggacagcccgggagacgagccctcggagtccccatacgaaagtgcagacgaaacacaaactgaagtatctgtctcatccaaaaagtctgagcgaggagtgactgccaaaaaggagtatgtgtgccagctgtgtgagaagccgggcagcctcctgctctgtgaaggaccctgctgcggagctttccacctcgcctgccttgggctttcccggaggccagaagggaggttcacctgcagcgagtgtgcctcaggtgtcgcccggcacagtctggggtctgtgaggatgatgagaggacacctgcacagccgtggcccttcctgcctactcaccgggcccaaggagtctcctatctcacgtcagaacacttcctgggtcaggaagacacctggagagtctcccaggccatggcagccccacagcagcacctcacttatgggagtgtctgtctgcctgcccagaatgataagtgactgctccaccactggccagctgctctcaaggaggaaaggcctcttttcataggagccccttctttcaagcttcttgccagttagactgggcctccccagccaggctgcctagtaagattctcctgtatttcaggtgaagctggagctcagatcgcagcaaggtaatccttgatggctggatctttttgctggagaatgcttggactagtgagcaaggttggaaacagggccaggtgctttagcagcgtggctgcctctgaagaggagttgcttgattttagtggctcagaactgcaatttaattcttgttctttgcacctctctctccaccccttctttaactttttgttagggattcactcatgtttcgtgtgtaaagagagcaagacagatgttaagcgctgtgtggtaactcagtgtggaaaattttaccatgaggcttgtgtgaaaaaataccctctgactgtatttgagagccgaggtttccgctgccccctccacagctgtgtgagctgccatgcttccaacccttcaaacccaaggccgtcaaaaggtaaaatgatgcggtgtgtccgctgccccgttgcctatcacagcggggatgcttgtctggcagcaggatgctcagtgatcgcctccaacagcatcatctgcactgcccacttcactgctcggaaggggaagcgacaccacgcccacgtcaacgtgagctggtgcttcgtgtgctccaaaggggggagccttctgtgctgtgagtcctgcccagcggccttccaccctgactgcctgaacatcgagatgcctgacggcagctggttctgcaatgactgcagggctgggaagaagctgcacttccaggatatcatttgggtgaaacttgggaactacagatggtggccggcagaagtttgccatcccaaaaatgttcccccaaatattcagaaaatgaagcacgagattggagaattccctgtgtttttctttgggtctaaagattattactggacgcatcaggcgcgagtgttcccgtacatggagggggaccggggcagccgctaccagggggtcagagggatcggaagagtcttcaaaaacgcactgcaagaagctgaagctcgttttcgtgaaattaagcttcagagggaagcccgagaaacacaggagagcgagcgcaagcccccaccatacaagcacatcaaggtgaataagccttacgggaaagtccagatctacacagcggatatttcagaaatccctaagtgcaactgcaagcccacagatgagaatccttgtggctttgattcggagtgtctgaacaggatgctgatgtttgagtgccacccgcaggtgtgtcccgcgggcgagttctgccagaaccagtgcttcaccaagcgccagtacccagagaccaagatcatcaagacagatggcaaagggtggggcctggtcgccaagagggacatcagaaagggagaatttgttaacgagtacgttggggagctgatcgacgaggaggagtgcatggcgagaatcaagcacgcacacgagaacgacatcacccacttctacatgctcactatagacaaggaccgtataatagacgctggccccaaaggaaactactctcgatttatgaatcacagctgccagcccaactgtgagaccctcaagtggacagtgaatggggacactcgtgtgggcctgtttgccgtctgtgacattcctgcagggacggagctgacttttaactacaacctcgattgtctgggcaatgaaaaaacggtctgccggtgtggagcctccaattgcagtggattcctcggggatagaccaaagacctcgacgaccctttcatcagaggaaaagggcaaaaagaccaagaagaaaacgaggcggcgcagagcaaaaggggaagggaagaggcagtcagaggacgagtgcttccgctgcggtgatggcgggcagctggtgctgtgtgaccgcaagttctgcaccaaggcctaccacctgtcctgcctgggccttggcaagcggcccttcgggaagtgggaatgtccttggcatcattgtgacgtgtgtggcaaaccttcgacttcattttgccacctctgccccaattcgttctgtaaggagcaccaggacgggacagccttcagctgcaccccggacgggcggtcctactgctgtgagcatgacttaggggcggcatcggtcagaagcaccaagactgagaagccccccccagagccagggaagccgaaggggaagaggcggcggcggaggggctggcggagagtcacagagggcaaatagcgccaggcggccgcttggccggatccaggggcggtgcagggcggccggccctgcctgcgggagagggcgagcatgaactggcccggaggacccagctcgagccgccaggacacagacgtacaggcctcctcgggagggagcgcctccccaccactgagccatcctcagcagcgtccgctgcgtctgcactgatgaccgtctgagcccagctcagcgttcctggacaaacagcctcactcctcagcgttaccgccacacttgaatttctccgaatgtcaaggttccctcccactctatttttttaggttaaagttaattggcatatggaatgttttaatctcctctgaaatgtgtagcgtaggcttttcccaagggtcgctagaaactcgtcttcgcgttgccccctttctggctctcagcgccgtcgccactcgggagaggctgggtgaggcccgtgtgaggactgaccctggattcctcgaaactgccattgtgatcattactctgctctttggaaatggctgtatcatttttttgtactaatgtgaattgttcctcagaaacgcttcttttccatcctagtgagaagctggccctgcaggtggtggcagcaatggtgttgtaagatttcctcccgtagttttttctcctcatggatttgaatgaaatgccaataacacgtccactttcaacgtgtagtttacgcggagcactttcgaggcctggccgggttgggcctacttctcacctgggcctatcttctgaactcgctaggttcttatcaacatttgggggataactttgtatatttttttcatttggcttttctttaccagtttctgatttttattctcaatatatttttgctaaacctatttcacaaatcaaaaaaaaaaaaaaaaaaaaaaaaaaaaaaaaaaaaaaaaaaaaaaaaaaaaaaaaaaaaaacaaaaaatnaaanaaaaaaaanaaaaaaaaanaaaaananaaaaaaaaaaaaaaaacttggggcccctttggcccaatcacttttaaacttggccaattttttttgacgcgccccaatttgggtctcattgggaaattgccccttatgggggccttcttaacattacctggcgcggtttttaaaagctataaatggggaaaccccggggggtccccaaattaaaagctttgcacaaaatccccctttccccggtgggcaaatcccaaaggccccgtcccgagcggtctttccaaaaggttgccccctctaataggcaaagggatattttacggcgttaaattttggtaaacataccgtt

SEQ ID NO: 440516 - DNA, 4236 bp, Homo sapiens
gctcggtcctctccacgtggtcctgacctgtcctctgtgagcaagagaaacaggactggtttgggggtgtcctgtctcagtggacacaggacaccacggttttcagtacaacaaggaacacaacttgttcaatgtgctttatgatggtgaaaattccctttaaaaataacatgcgattgctaacacttgaccgaatatatcacttgaccttacagggaccgtataatagacgctggccccaaaggaaactactctcgatttatgaatcacagctgccagcccaactgtgagaccctcaagtggacagtgaatggggacactcgtgtgggcctgtttgccgtctgtgacattcctgcagggacggagctgacttttaactacaacctcgattgtctgggcaatgaaaaaacggtctgccggtgtggagcctccaattgcagtggattcctcggggatagaccaaagacctcgacgaccctttcatcagaggaaaagggcaaaaagaccaagaagaaaacgaggcggcgcagagcaaaaggggaagggaagaggcagtcagaggacgagtgcttccgctgcggtgatggcgggcagctggtgctgtgtgaccgcaagttctgcaccaaggcctaccacctgtcctgcctgggccttggcaagcggcccttcgggaagtgggaatgtccttggcatcattgtgacgtgtgtggcaaaccttcgacttcattttgccacctctgccccaattcgttctgtaaggagcaccaggacgggacagccttcagctgcaccccggacgggcggtcctactgctgtgagcatgacttaggggcggcatcggtcagaagcaccaagactgagaagccccccccagagccagggaagccgaaggggaagaggcggcggcggaggggctggcggagagtcacagagggcaaatagcgccaggcggccgcttggccggatccaggggcggtgcagggcggccggccctgcctgcgggagagggcgagcatgaactggcccggaggacccagctcgagccgccaggacacagacgtacaggcctcctcgggagggagcgcctccccaccactgagccatcctcagcagcgtccgctgcgtctgcactgatgaccgtctgagcccagctcagcgttcctggacaaacagcctcactcctcagcgttaccgccacacttgaatttctccgaatgtcaaggttccctcccactctatttttttaggttaaagttaattggcatatggaatgttttaatctcctctgaaatgtgtagcgtaggcttttcccaagggtcgctagaaactcgtcttcgcgttgccccctttctggctctcagcgccgtcgccactcgggagaggctgggtgaggcccgtgtgaggactgaccctggattcctcgaaactgccattgtgatcattactctgctctttggaaatggctgtatcatttttttgtactaatgtgaattgttcctcagaaacgcttcttttccatcctagtgagaagctggccctgcaggtggtggcagcaatggtgttgtaagatttcctcccgtagttttttctcctcatggatttgaatgaaatgccaataacacgtccactttcaacgtgtagtttacgcggagcactttcgaggcctggccgggttgggcctacttctcacctgggcctatcttctgaactcgctaggttcttatcaacatttgggggataactttgtatatttttttcatttggcttttctttaccagtttctgatttttattctcaatatatttttgctaaacctatttcacaaatcaccaccgactgaagtgtgtgtttactgatgcggccctgagctccatggcgaaaggagtgactttgcagggcgtgagaccgcagtctgcttagagcacaggaagtgacaacttagggagccccgtagggcgctgcaggccccggggaccccagcacgtgggtctaaagagagacggagtctagctctcctgccacccagagtggcttccatctcagcactctgtgggtctggtgatggaagatgcagtctctgctgatcacatgtgccctctgccagggcacctactgagaggtgcggtcctgggggtggaggcctgcctggcaggtgtgcgtgcctcgtacgtgtgttatgggcactggtctaggccaggtatgacacccactctcctgtgagatttcactttagtttttaaaaggtccagttctacagagtgagacctatctatctgagtactacatatgttttaagacttggttctttttttgagggatccttgaccctgggaagtctggagcaccctgagaagggggcaccatgtgtgcctttgcccacgtgtcctgaggggctgcttgtctgggagggagggagagaacattcagcagcaggtgcttttttatggccttttcttaaaataacctaagggggacacatccatcttgcagagaagtttacagaactccccttgaaaactgctgctgaggctcctgttaaattttctgtggcatcttttatgccttggtaaaaactgcagtgtctttggacctgagagtggctactccgtggttttgtgacctgtaagcgtggggttcaggggtgtgtggccctgcagggtcccacgcctccctgagcactgactggaagtttcactggctggtggctgtcccttctcccatcagggtccccagcaaagttaactacacagaggacccaggggaaacgagctgtgtagccactgacttgctcgcgcggccgtggcctctgaggggcactcgccggttaagacagggtgggagtagtgctttccagttcagactctaacttctcccaaagtgtcctaagaaaatactggatcggctcatagatttatgctccttatgatgccctaacttggaaggttgttctagggacaggccgggcagtgtccccacacacaccttagagtcgaaggccccagggccccgctgtcacttgcccaaaagatcccttccggcaggtaagggactaccaatgcttacgtcaaaacagcagaatcggctttgcagtgcactttggggagcagatattaacttatttttgtgttggacagtagtgaaatcttgtgatttttaatcgctttgataatacttccaaattttatgatttttctgaaggaaataatgcaaacattttaaatatgtttctccccctttccaaaaactgttaaactaatgagcaagtaacactaactttgaatgtctctacaatacccgttgataactcagtggagccaggctttggggtagcggccctgagcttgcagggtttctcgccactggggctgaccacgcccccagctgtgaccgtgggtgtggctggctctcggccctgcccagctttgttctgaggacgtggtgacttcctgaacatcagcttcaatcctccatcattaatgtgaagcaaaacacaaaaaccgccccaatccctcaggattccttggcatccgaaaccagcatctgcacctaaacccatacccacccgtgtgcgcccacagggggatgtgtccgaatgggcagcttaaaatgtggtcacctgtgggggaaactcttcaggcacctgaagtgagaacccagctgtccgtcctcaggccggcctttcttccggcgacacccgtccatggctggctgggtccccttcgcagtgtttgtctgtcttgacatctaaaccccggcgtgtgcagtgcccatcttccaggactaccttattttccagaattaaacctgttttataattcaagttaatgcaaatgactgtcagttgccaaatatcttgatcctatgagtgtagttgatgactgtttgttagtcagtagagtaaaatgctgtgtccacggggtgtcacagcctcaccataccctgttgaggtgtgaaatgccccgtcagaaattaaatacaaacttaaatgtgcctattggtgtctaaacttcatacaatgtaaggtcagattccttttaggaatactgggtgctgtcaccaggtttgatagttagacttaaaaacttgaaattcactttttggggggagggatatactgaaatagagagttgagacttgccagttgggggaaaatagcatttaaaatggaaagctgtgtttggaaaattgtgtatgagtatttttgtattaaaaacattttaaaggcttttttcttaa

SEQ ID NO: 440517 - DNA, 4039 bp, Homo sapiens
ctacgggtaatgatgacacacgatagagaaaagtgttggccatgggtgcgagagggtggtccctaacgtgacagagcttttacagagtcatgccagagaagatgaatacccgagttgaaaatcagtcccttgggagagggcaggtcacatggaaatcagcacagcagcccctgcctgtccacgccgcgctgggggacactcctgcacccggcacagctcctctcagttgccgaaacataaagagacgctaacaggtggtccttaggggcctggcaggtactgtggagtcaacaggccctgccagggagcccgcccgggctgtggtagacagtttgtctgcccgtcctgttcgctggagccagcactattttgtgttcatttgacctgacagttgtaagtcatcttcaaccacgataatgttgaagtcgtgattccatcacttctgtgtgctcacatcttgtgttctgttgcagggaagtgggaatgtccttggcatcattgtgacgtgtgtggcaaaccttcgacttcattttgccacctctgccccaattcgttctgtaaggagcaccaggacgggacagccttcagctgcaccccggacgggcggtcctactgctgtgagcatgacttaggggcggcatcggtcagaagcaccaagactgagaagccccccccagagccagggaagccgaaggggaagaggcggcggcggaggggctggcggagagtcacagagggcaaatagcgccaggcggccgcttggccggatccaggggcggtgcagggcggccggccctgcctgcgggagagggcgagcatgaactggcccggaggacccagctcgagccgccaggacacagacgtacaggcctcctcgggagggagcgcctccccaccactgagccatcctcagcagcgtccgctgcgtctgcactgatgaccgtctgagcccagctcagcgttcctggacaaacagcctcactcctcagcgttaccgccacacttgaatttctccgaatgtcaaggttccctcccactctatttttttaggttaaagttaattggcatatggaatgttttaatctcctctgaaatgtgtagcgtaggcttttcccaagggtcgctagaaactcgtcttcgcgttgccccctttctggctctcagcgccgtcgccactcgggagaggctgggtgaggcccgtgtgaggactgaccctggattcctcgaaactgccattgtgatcattactctgctctttggaaatggctgtatcatttttttgtactaatgtgaattgttcctcagaaacgcttcttttccatcctagtgagaagctggccctgcaggtggtggcagcaatggtgttgtaagatttcctcccgtagttttttctcctcatggatttgaatgaaatgccaataacacgtccactttcaacgtgtagtttacgcggagcactttcgaggcctggccgggttgggcctacttctcacctgggcctatcttctgaactcgctaggttcttatcaacatttgggggataactttgtatatttttttcatttggcttttctttaccagtttctgatttttattctcaatatatttttgctaaacctatttcacaaatcaccaccgactgaagtgtgtgtttactgatgcggccctgagctccatggcgaaaggagtgactttgcagggcgtgagaccgcagtctgcttagagcacaggaagtgacaacttagggagccccgtagggcgctgcaggccccggggaccccagcacgtgggtctaaagagagacggagtctagctctcctgccacccagagtggcttccatctcagcactctgtgggtctggtgatggaagatgcagtctctgctgatcacatgtgccctctgccagggcacctactgagaggtgcggtcctgggggtggaggcctgcctggcaggtgtgcgtgcctcgtacgtgtgttatgggcactggtctaggccaggtatgacacccactctcctgtgagatttcactttagtttttaaaaggtccagttctacagagtgagacctatctatctgagtactacatatgttttaagacttggttctttttttgagggatccttgaccctgggaagtctggagcaccctgagaagggggcaccatgtgtgcctttgcccacgtgtcctgaggggctgcttgtctgggagggagggagagaacattcagcagcaggtgcttttttatggccttttcttaaaataacctaagggggacacatccatcttgcagagaagtttacagaactccccttgaaaactgctgctgaggctcctgttaaattttctgtggcatcttttatgccttggtaaaaactgcagtgtctttggacctgagagtggctactccgtggttttgtgacctgtaagcgtggggttcaggggtgtgtggccctgcagggtcccacgcctccctgagcactgactggaagtttcactggctggtggctgtcccttctcccatcagggtccccagcaaagttaactacacagaggacccaggggaaacgagctgtgtagccactgacttgctcgcgcggccgtggcctctgaggggcactcgccggttaagacagggtgggagtagtgctttccagttcagactctaacttctcccaaagtgtcctaagaaaatactggatcggctcatagatttatgctccttatgatgccctaacttggaaggttgttctagggacaggccgggcagtgtccccacacacaccttagagtcgaaggccccagggccccgctgtcacttgcccaaaagatcccttccggcaggtaagggactaccaatgcttacgtcaaaacagcagaatcggctttgcagtgcactttggggagcagatattaacttatttttgtgttggacagtagtgaaatcttgtgatttttaatcgctttgataatacttccaaattttatgatttttctgaaggaaataatgcaaacattttaaatatgtttctccccctttccaaaaactgttaaactaatgagcaagtaacactaactttgaatgtctctacaatacccgttgataactcagtggagccaggctttggggtagcggccctgagcttgcagggtttctcgccactggggctgaccacgcccccagctgtgaccgtgggtgtggctggctctcggccctgcccagctttgttctgaggacgtggtgacttcctgaacatcagcttcaatcctccatcattaatgtgaagcaaaacacaaaaaccgccccaatccctcaggattccttggcatccgaaaccagcatctgcacctaaacccatacccacccgtgtgcgcccacagggggatgtgtccgaatgggcagcttaaaatgtggtcacctgtgggggaaactcttcaggcacctgaagtgagaacccagctgtccgtcctcaggccggcctttcttccggcgacacccgtccatggctggctgggtccccttcgcagtgtttgtctgtcttgacatctaaaccccggcgtgtgcagtgcccatcttccaggactaccttattttccagaattaaacctgttttataattcaagttaatgcaaatgactgtcagttgccaaatatcttgatcctatgagtgtagttgatgactgtttgttagtcagtagagtaaaatgctgtgtccacggggtgtcacagcctcaccataccctgttgaggtgtgaaatgccccgtcagaaattaaatacaaacttaaatgtgcctattggtgtctaaacttcatacaatgtaaggtcagattccttttaggaatactgggtgctgtcaccaggtttgatagttagacttaaaaacttgaaattcactttttggggggagggatatactgaaatagagagttgagacttgccagttgggggaaaatagcatttaaaatggaaagctgtgtttggaaaattgtgtatgagtatttttgtattaaaaacattttaaaggcttttttcttaa

SEQ ID NO: 440518 - DNA, 6685 bp, Homo sapiens
  misc_feature (12)..(12): n is a, c, g, or t
  misc_feature (86)..(86): n is a, c, g, or t
gggaggcgcggnggcggggtcggcgccgcgcgcgagagcctcggcctggccgcgctgcgcccgccgccgccgccgccccctccccncctgggccctaccgccgcacggccccggccccctcccagcctgccgctccggagagccgcccgccgaggatgcgacgcaccgcagtgttctaagaacggaagcatctgggctggatggaatttagcatcaagcagagtcccctttctgttcagagtgttgtaaagtgcataaagatgaagcaggcaccagaaatcctcggcagtgccaacgggaagactccgagctgcgaggtgaaccgcgagtgttctgtgttcctcagcaaagcccagctctccagtagcctgcaggagggggtcatgcagaagtttaacggccacgacgccctgccctttattccagccgacaagctgaaagatcttacttcccgggtgtttaatggagaacccggcgcacacgatgccaaactgcgttttgagtcccaggaaatgaaagggattgggacaccccctaacactacccctatcaaaaatggctctccagaaattaagctgaaaatcaccaaaacatacatgaatgggaagcctctctttgaatcttccatttgtggtgacagtgctgctgatgtgtctcagtcagaagaaaatggacaaaaaccagaaaacaaggcgagaaggaacaggaagaggagcataaaatatgactccttgctggagcagggccttgtcgaagcagctcttgtgtctaagatctcaagtccttcagataaaaagattccagctaagaaagagtcttgtccaaacactggaagagacaaagaccacctgttgaaatacaacgttggtgatttggtgtggtccaaagtgtcgggttacccttggtggccttgcatggtttctgcagatccactccttcacagctataccaaacttaaaggtcagaaaaagagtgcacgccagtatcacgtacagttctttggtgacgccccagaaagagcttggatatttgagaagagcctcgtagcttttgaaggagaaggacagtttgaaaaattatgccaggaaagtgccaagcaggcacccacgaaagctgagaaaattaagctattgaaaccaatttcagggaaattgagggcccagtgggaaatgggcattgttcaagcagaagaagctgcaagcatgtcagtggaggagcggaaagccaagttcacctttctctatgtgggggaccagcttcatctcaaccctcaagtagccaaggaggctggcattgctgcagagtctttgggagaaatggcagaatcctcaggagtcagtgaagaagctgctgaaaaccccaagtctgtgagagaagagtgcattcccatgaagagaaggcggagggccaaactgtgtagctctgcagagaccctggagagtcaccccgacatagggaagagtactcctcaaaagacggcagaggctgaccccagaagaggagtagggtctcctcctgggaggaagaagaccacagtctccatgccacgaagcaggaagggagatgcagcatcccagtttttggtcttctgtcaaaaacacagggatgaggtggtagctgagcacccagatgcttcaggtgaggagattgaagagctgctcaggtcacagtggagtctgctgagtgagaagcagagagcacgctacaacaccaagtttgccctggtggcccctgtccaggctgaagaagactctggtaatgtaaatgggaaaaaaagaaaccacacaaagaggatacaggaccctacagaagatgctgaagctgaggacacacccaggaaaagactcaggacggacaagcacagtcttcggaagagagacacaatcactgacaaaacggccagaacaagctcttacaaggccatggaggcagcctcctcgctcaagagccaggcagcaacgaaaaatctgtctgatgcatgtaaaccactgaagaagcgaaatcgggcttccacggcagcatcttcagctcttgggtttagcaaaagttcatctccttctgcatccttaactgagaatgagggtaaaataataataataacgataaccatggcattggtatgaaggccatttagctgcccacgctgcagtgtgagtaatgctcagacttcataagcgcagcattggtgctcactgccagtgcagatgttttagggcctcttggctaactcagattcatgaaatggacaaacagtgcactatgttagtttatttgagcactttttatacacacgcacacagtgtctgtgtacatgtacagatatacttcagtcttgatgcagtttcatagttcttaaaatctgtctgaagaatgttgtgttctgtgtagccctcacactgtaagagttcacatggaagtaagtctgcgttggttctgaaagggcacagtgtcagttgagctgacatatactgggtggggtggaaggcgactcacacaccacacctgattcctgttgcttccagacctaggctcatggaggaagccaaagatttctttgttctcatgcatttcatggctttggtcctttaaattctggcacatttttagttacttgagtgttgaggtgagtcagaactaccattgtaatatgactcctgtgttctggacttgcagagtacatgatagcaaaataaagccatttggggctgctgcctgccatcattgtaacatgacacttagactttattatcaaacctaaattttttgccgttgccaaaaacaacaaatagccacagaacgtaggtgtgacacttttttgttcggaggtagttttggtttcctgatttttagggattaccttcatagagctttggagttttaatttcttgttatttggttctccgtgatgctgtttttctcattgtagacatgggtcctgtttttgtcatgtttatgaggagatgataactgggggcccttttggaacagggtagtgaggcaagggttggacaggccccttactcttgctgagtcagaaggcggcacttctggccaggtctctgccatggtccccaggaaggatggggtgtgcctcagttgtttccactcattagaggagtgtaggccttccagtgcaggaaggtcagggacctaggcaacctgggcggggctcatagagctctgcggcttgccactctgaatcctcagcgaccactcctccgagtgggattttctgcagggactcaaaccaactcagtggtggtcgagacctgttcacggatggtgggactggggctgctttacagtttgatacgtgtagataattaagcattttgtgatgtttggacacactggagaaaaggcagtaagaattatttactgaaacatctaggagcttactgaaatatgaaaaggcaaattttatacaaattatttttcctttttcctttctttcttgtccaagttcaggttaaaatcttagaaaattaaatgaaaggtcatttacagttccaaagaagaatattaaacatttttcacttaagttgagatttttgctttaaagagcttttaatgagtttttctgttatcataattttggtccggttattcacttgagttgttgcttatactgttgtcaggtacagtagagagaacatggagcctgctgagatcttctctgttattcctgatcctaagtcatgtatatcgaaggctttgatttagagtaatgcatgaggccagtgtagcggggtcgaggcctgcccatgagtcaggggagctcagtctccctggcctaggcagttgtcctgaccttgagaagacatagatgaagcattttatcatcattagacttaaattttaattcttcagaatgtcagaagttgataggttgttaaatacatttatataatacattaaatatgtgaaattaatacaccttcctacattttgaaggtgatgcatagatcccatagtgtgcatcatgttccttatatgaaaacgtttaaattactgggtcttttccattaaactacttttgtatggcttagataaatcttccattagtgttcatttttatagaattatgctgttaaaactactttaggtgaacaaataaacttgtctattatatattaacgcgactgaactacagtaaatgtttgtgatgtttccaatgctgaatgcctgttagcatatgaggcaaagtgtagtgttataaaaaacagcctgttgactgctgggcccgattctgatatgagttaggtgaccatgagaattgctgtttgaggtccacactgacacacacccattgggtcacaccccctttgcatgtttgtatttcctccctttcatcacatttgtttgaaataaggtacttttatagggttggtatttcagaacactttaggtcatgttgtagtttaaattcttcttgaaaaaggtatatgtgataaataaaaatttttattggaataattattacatggtactacatcaccctgaggaagagaataaattaaaattacacacttgcatgacaaaggcctgtgaaggaattaatgtgatttaagtgttttgtaacttcattttttattcctttagtagagcaaattcttatttttttcgccttcactggtaacagcttttgtgggagcccacaccagtcaagttggatttgaacccagctgctctgtactgcacttagaatgatgtaatattccaggatgctgctgcaggtggcgtatcatcgtacacactcagtgacatttctatcacaatcattttatggaagatgtgtgataatctgtttttactggtattaataaacacatacaatgaagaaaacagataacaaattttaagaccaaggtctcggacagcccgggagacgagccctcggagtccccatacgaaagtgcagacgaaacacaaactgaagtatctgtctcatccaaaaagtctgagcgaggagtgactgccaaaaaggagtatgtgtgccagctgtgtgagaagccgggcagcctcctgctctgtgaaggaccctgctgcggagctttccacctcgcctgccttgggctttcccggaggccagaagggaggttcacctgcagcgagtgtgcctcagggattcactcatgtttcgtgtgtaaagagagcaagacagatgttaagcgctgtgtggtaactcagtgtggaaaattttaccatgaggcttgtgtgaaaaaataccctctgactgtatttgagagccgaggtttccgctgccccctccacagctgtgtgagctgccatgcttccaacccttcaaacccaaggccgtcaaaaggtaaaatgatgcggtgtgtccgctgccccgttgcctatcacagcggggatgcttgtctggcagcaggatgctcagtgatcgcctccaacagcatcatctgcactgcccacttcactgctcggaaggggaagcgacaccacgcccacgtcaacgtgagctggtgcttcgtgtgctccaaaggggggagccttctgtgctgtgagtcctgcccagcggccttccaccctgactgcctgaacatcgagatgcctgacggcagctggttctgcaatgactgcagggctgggaagaagctgcacttccaggatatcatttgggtgaaacttgggaactacagatggtggccggcagaagtttgccatcccaaaaatgttcccccaaatattcagaaaatgaagcacgagattggagaattccctgtgtttttctttgggtctaaagattattactggacgcatcaggcgcgagtgttcccgtacatggagggggaccggggcagccgctaccagggggtcagagggatcggaagagtcttcaaaaacgcactgcaagaagctgaagctcgttttcgtgaaattaagcttcagagggaagcccgagaaacacaggagagcgagcgcaagcccccaccatacaagcacatcaaggtgaataagccttacgggaaagtccagatctacacagcggatatttcagaaatccctaagtgcaactgcaagcccacagatgagaatccttgtggctttgattcggagtgtctgaacaggatgctgatgtttgagtgccacccgcaggtgtgtcccgcgggcgagttctgccagaaccagtgcttcaccaagcgccagtacccagagaccaagatcatcaagacagatggcaaagggtggggcctggtcgccaagagggacatcagaaagggagaatttgttaacgagtacgttggggagctgatcgacgaggaggagtgcatggcgagaatcaagcacgcacacgagaacgacatcacccacttctacatgctcactatagacaaggaccgtataatagacgctggccccaaaggaaactactctcgatttatgaatcacagctgccagcccaactgtgagaccctcaagtggacagtgaatggggacactcgtgtgggcctgtttgccgtctgtgacattcctgcagggacggagctgacttttaactacaacctcgattgtctgggcaatgaaaaaacggtctgccggtgtggagcctccaattgcagtggattcctcggggatagaccaaagaccttgacgaccctttcatcagaggataagggctaaaagaccgagaagttgtgtcgccggagagctgtggcgcgcg

SEQ ID NO: 440519 - DNA, 4136 bp, Homo sapiens
  misc_feature (12)..(12): n is a, c, g, or t
  misc_feature (86)..(86): n is a, c, g, or t
gggaggcgcggnggcggggtcggcgccgcgcgcgagagcctcggcctggccgcgctgcgcccgccgccgccgccgccccctccccncctgggccctaccgccgcacggccccggccccctcccagcctgccgctccggagagccgcccgccgaggatgcgacgcaccgcagtgttctaagaacggaagcatctgggctggatggaatttagcatcaagcagagtcccctttctgttcagagtgttgtaaagtgcataaagatgaagcaggcaccagaaatcctcggcagtgccaacgggaagactccgagctgcgaggtgaaccgcgagtgttctgtgttcctcagcaaagcccagctctccagtagcctgcaggagggggtcatgcagaagtttaacggccacgacgccctgccctttattccagccgacaagctgaaagatcttacttcccgggtgtttaatggagaacccggcgcacacgatgccaaactgcgttttgagtcccaggaaatgaaagggattgggacaccccctaacactacccctatcaaaaatggctctccagaaattaagctgaaaatcaccaaaacatacatgaatgggaagcctctctttgaatcttccatttgtggtgacagtgctgctgatgtgtctcagtcagaagaaaatggacaaaaaccagaaaacaaggcgagaaggaacaggaagaggagcataaaatatgactccttgctggagcagggccttgtcgaagcagctcttgtgtctaagatctcaagtccttcagataaaaagattccagctaagaaagagtcttgtccaaacactggaagagacaaagaccacctgttgaaatacaacgttggtgatttggtgtggtccaaagtgtcgggttacccttggtggccttgcatggtttctgcagatccactccttcacagctataccaaacttaaaggtcagaaaaagagtgcacgccagtatcacgtacagttctttggtgacgccccagaaagagcttggatatttgagaagagcctcgtagcttttgaaggagaaggacagtttgaaaaattatgccaggaaagtgccaagcaggcacccacgaaagctgagaaaattaagctattgaaaccaatttcagggaaattgagggcccagtgggaaatgggcattgttcaagcagaagaagctgcaagcatgtcagtggaggagcggaaagccaagttcacctttctctatgtgggggaccagcttcatctcaaccctcaagtagccaaggaggctggcattgctgcagagtctttgggagaaatggcagaatcctcaggagtcagtgaagaagctgctgaaaaccccaagtctgtgagagaagagtgcattcccatgaagagaaggcggagggccaaactgtgtagctctgcagagaccctggagagtcaccccgacatagggaagagtactcctcaaaagacggcagaggctgaccccagaagaggagtagggtctcctcctgggaggaagaagaccacagtctccatgccacgaagcaggaagggagatgcagcatcccagtttttggtcttctgtcaaaaacacagggatgaggtggtagctgagcacccagatgcttcaggtgaggagattgaagagctgctcaggtcacagtggagtctgctgagtgagaagcagagagcacgctacaacaccaagtttgccctggtggcccctgtccaggctgaagaagactctggtaatgtaaatgggaaaaaaagaaaccacacaaagaggatacaggaccctacagaagatgctgaagctgaggacacacccaggaaaagactcaggacggacaagcacagtcttcggaagagagacacaatcactgacaaaacggccagaacaagctcttacaaggccatggaggcagcctcctcgctcaagagccaggcagcaacgaaaaatctgtctgatgcatgtaaaccactgaagaagcgaaatcgggcttccacggcagcatcttcagctcttgggtttagcaaaagttcatctccttctgcatccttaactgagaatgagggtaaaataataataataacgataaccatggcattggtatgaaggccatttagctgcccacgctgcagtgtgagtaatgctcagacttcataagcgcagcattggtgctcactgccagtgcagatgttttagggcctcttggctaactcagattcatgaaatggacaaacagtgcactatgttagtttatttgagcactttttatacacacgcacacagtgtctgtgtacatgtacagatatacttcagtcttgatgcagtttcatagttcttaaaatctgtctgaagaatgttgtgttctgtgtagccctcacactgtaagagttcacatggaagtaagtctgcgttggttctgaaagggcacagtgtcagttgagctgacatatactgggtggggtggaaggcgactcacacaccacacctgattcctgttgcttccagacctaggctcatggaggaagccaaagatttctttgttctcatgcatttcatggctttggtcctttaaattctggcacatttttagttacttgagtgttgaggtgagtcagaactaccattgtaatatgactcctgtgttctggacttgcagagtacatgatagcaaaataaagccatttggggctgctgcctgccatcattgtaacatgacacttagactttattatcaaacctaaattttttgccgttgccaaaaacaacaaatagccacagaacgtaggtgtgacacttttttgttcggaggtagttttggtttcctgatttttagggattaccttcatagagctttggagttttaatttcttgttatttggttctccgtgatgctgtttttctcattgtagacatgggtcctgtttttgtcatgtttatgaggagatgataactgggggcccttttggaacagggtagtgaggcaagggttggacaggccccttactcttgctgagtcagaaggcggcacttctggccaggtctctgccatggtccccaggaaggatggggtgtgcctcagttgtttccactcattagaggagtgtaggccttccagtgcaggaaggtcagggacctaggcaacctgggcggggctcatagagctctgcggcttgccactctgaatcctcagcgaccactcctccgagtgggattttctgcagggactcaaaccaactcagtggtggtcgagacctgttcacggatggtgggactggggctgctttacagtttgatacgtgtagataattaagcattttgtgatgtttggacacactggagaaaaggcagtaagaattatttactgaaacatctaggagcttactgaaatatgaaaaggcaaattttatacaaattatttttcctttttcctttctttcttgtccaagttcaggttaaaatcttagaaaattaaatgaaaggtcatttacagttccaaagaagaatattaaacatttttcacttaagttgagatttttgctttaaagagcttttaatgagtttttctgttatcataattttggtccggttattcacttgagttgttgcttatactgttgtcaggtacagtagagagaacatggagcctgctgagatcttctctgttattcctgatcctaagtcatgtatatcgaaggctttgatttagagtaatgcatgaggccagtgtagcggggtcgaggcctgcccatgagtcaggggagctcagtctccctggcctaggcagttgtcctgaccttgagaagacatagatgaagcattttatcatcattagacttaaattttaattcttcagaatgtcagaagttgataggttgttaaatacatttatataatacattaaatatgtgaaattaatacaccttcctacattttgaaggtgatgcatagatcccatagtgtgcatcatgttccttatatgaaaacgtttaaattactgggtcttttccattaaactacttttgtatggcttagataaatcttccattagtgttcatttttatagaattatgctgttaaaactactttaggtgaacaaataaacttgtctattatatatta

SEQ ID NO: 440520 - DNA, 2626 bp, Homo sapiens
  misc_feature (12)..(12): n is a, c, g, or t
  misc_feature (86)..(86): n is a, c, g, or t
gggaggcgcggnggcggggtcggcgccgcgcgcgagagcctcggcctggccgcgctgcgcccgccgccgccgccgccccctccccncctgggccctaccgccgcacggccccggccccctcccagcctgccgctccggagagccgcccgccgaggatgcgacgcaccgcagtgttctaagaacggaagcatctgggctggatggaatttagcatcaagcagagtcccctttctgttcagagtgttgtaaagtgcataaagatgaagcaggcaccagaaatcctcggcagtgccaacgggaagactccgagctgcgaggtgaaccgcgagtgttctgtgttcctcagcaaagcccagctctccagtagcctgcaggagggggtcatgcagaagtttaacggccacgacgccctgccctttattccagccgacaagctgaaagatcttacttcccgggtgtttaatggagaacccggcgcacacgatgccaaactgcgttttgagtcccaggaaatgaaagggattgggacaccccctaacactacccctatcaaaaatggctctccagaaattaagctgaaaatcaccaaaacatacatgaatgggaagcctctctttgaatcttccatttgtggtgacagtgctgctgatgtgtctcagtcagaagaaaatggacaaaaaccagaaaacaaggcgagaaggaacaggaagaggagcataaaatatgactccttgctggagcagggccttgtcgaagcagctcttgtgtctaagatctcaagtccttcagataaaaagattccagctaagaaagagtcttgtccaaacactggaagagacaaagaccacctgttgaaatacaacgttggtgatttggtgtggtccaaagtgtcgggttacccttggtggccttgcatggtttctgcagatccactccttcacagctataccaaacttaaaggtcagaaaaagagtgcacgccagtatcacgtacagttctttggtgacgccccagaaagagcttggatatttgagaagagcctcgtagcttttgaaggagaaggacagtttgaaaaattatgccaggaaagtgccaagcaggcacccacgaaagctgagaaaattaagctattgaaaccaatttcagggaaattgagggcccagtgggaaatgggcattgttcaagcagaagaagctgcaagcatgtcagtggaggagcggaaagccaagttcacctttctctatgtgggggaccagcttcatctcaaccctcaagtagccaaggaggctggcattgctgcagagtctttgggagaaatggcagaatcctcaggagtcagtgaagaagctgctgaaaaccccaagtctgtgagagaagagtgcattcccatgaagagaaggcggagggccaaactgtgtagctctgcagagaccctggagagtcaccccgacatagggaagagtactcctcaaaagacggcagaggctgaccccagaagaggagtagggtctcctcctgggaggaagaagaccacagtctccatgccacgaagcaggaagggagatgcagcatcccagtttttggtcttctgtcaaaaacacagggatgaggtggtagctgagcacccagatgcttcaggtgaggagattgaagagctgctcaggtcacagtggagtctgctgagtgagaagcagagagcacgctacaacaccaagtttgccctggtggcccctgtccaggctgaagaagactctggtaatgtaaatgggaaaaaaagaaaccacacaaagaggatacaggaccctacagaagatgctgaagctgaggacacacccaggaaaagactcaggacggacaagcacagtcttcggaagagagacacaatcactgacaaaacggccagaacaagctcttacaaggccatggaggcagcctcctcgctcaagagccaggcaggtaatgtggtcagcgccctttccttcttggcttctgggtgcccaggctgggctgggtgggtgggctgagagtgtgaaaggggaaggctggggctggtgaaggggaacagggcaggggaggaatccacaattaagctaggagtgaaaaagaaggaaaggaggttctcctgtggttgaaaactaaactgttttaatgtgtatgttattttgaagggtttggctaaattttattgaagttactttttacttggctctattatttgcaatttaaaattttactagaaaagtgatttcaaccagaagttttcaggtttcttacttgatggtgccagttgctactgtaaattctgtcacccttcagtaccctgaccctctgcatgtaagctaacagtaagggctcgttatttatatttcacatgctaaagaaactagcttaaaacctttatgaaaaataattgtcaaaaaaataagaggggaaattacacttccttttaccttttagttatctttttgaaatacctgtttgatcccttattgaagaagtcataccttctccaactcttaattaaaaggaaaacaaaaccctggggaggagagtggcaatggctctgtttttcttgttttgcatgaggtgcttgactggcttttaaaaatcagttaaacagacttta

SEQ ID NO: 440521 - DNA, 2473 bp, Homo sapiens
  misc_feature (12)..(12): n is a, c, g, or t
  misc_feature (86)..(86): n is a, c, g, or t
gggaggcgcggnggcggggtcggcgccgcgcgcgagagcctcggcctggccgcgctgcgcccgccgccgccgccgccccctccccncctgggccctaccgccgcacggccccggccccctcccagcctgccgctccggagagccgcccgccgaggatgcgacgcaccgcagtgttctaagaacggaagcatctgggctggatggaatttagcatcaagcagagtcccctttctgttcagagtgttgtaaagtgcataaagatgaagcaggcaccagaaatcctcggcagtgccaacgggaagactccgagctgcgaggtgaaccgcgagtgttctgtgttcctcagcaaagcccagctctccagtagcctgcaggagggggtcatgcagaagtttaacggccacgacgccctgccctttattccagccgacaagctgaaagatcttacttcccgggtgtttaatggagaacccggcgcacacgatgccaaactgcgttttgagtcccaggaaatgaaagggattgggacaccccctaacactacccctatcaaaaatggctctccagaaattaagctgaaaatcaccaaaacatacatgaatgggaagcctctctttgaatcttccatttgtggtgacagtgctgctgatgtgtctcagtcagaagaaaatggacaaaaaccagaaaacaaggcgagaaggaacaggaagaggagcataaaatatgactccttgctggagcagggccttgtcgaagcagctcttgtgtctaagatctcaagtccttcagataaaaagattccagctaagaaagagtcttgtccaaacactggaagagacaaagaccacctgttgaaatacaacgttggtgatttggtgtggtccaaagtgtcgggttacccttggtggccttgcatggtttctgcagatccactccttcacagctataccaaacttaaaggtcagaaaaagagtgcacgccagtatcacgtacagttctttggtgacgccccagaaagagcttggatatttgagaagagcctcgtagcttttgaaggagaaggacagtttgaaaaattatgccaggaaagtgccaagcaggcacccacgaaagctgagaaaattaagctattgaaaccaatttcagggaaattgagggcccagtgggaaatgggcattgttcaagcagaagaagctgcaagcatgtcagtggaggagcggaaagccaagttcacctttctctatgtgggggaccagcttcatctcaaccctcaagtagccaaggaggctggcattgctgcagagtctttgggagaaatggcagaatcctcaggagtcagtgaagaagctgctgaaaaccccaagtctgtgagagaagagtgcattcccatgaagagaaggcggagggccaaactgtgtagctctgcagagaccctggagagtcaccccgacatagggaagagtactcctcaaaagacggcagaggctgaccccagaagaggagtagggtctcctcctgggaggaagaagaccacagtctccatgccacgaagcaggaagggagatgcagcatcccagtttttggtcttctgtcaaaaacacagggatgaggtcagtactaagttgtgtttcatgctagcaagtttcagaatttgaggaacatcccttcagtgcagaatcatctgtttctcagcattatcaggagactctaacatgagccttgcatagattttagatctaataaataagtattagggaacagccattctgacccttgagggaaaagatactcgacttgcactctggggtcttaaagttagcactttctccagcagtctgttctgaagcttccagtgcaggatatgctcatctgtaaagctcattgtgtccactggcactgagggtgttgatttatttccctgacatttaaaagggtagcaatgtgattaagacatttatataattttcttaattgtttgcataaaatgcacagtctgttagtacataataaaggctgtaaagaactgaaggagttgggttccccacttcccacttttggttatgttacttggagtggatcatattctcatgcttaaaaggctttttttaagtgttcattttaattttacttccataggaattttccattcagtagtctaaatctatgtggtgattaaaggtatcaaaaacaatagtgttggccaggcacagtggctcacacctgtaatcccaacactttgggaagctgaggcgggtggatcatgaggtcaggaatttgagactatcctggccaacatgatgaaaccccgtctctactaaaaatacaaaaaaaaattagctgggcatggtgacgcgtgcttgtaatcccagcttctcaggaggctgaggcaggaaaattgcttgaaccagggagtcggaggttgcagtgagccaagattacaccactgcactccagcctggcgacagaatgagac

SEQ ID NO: 440522 - DNA, 2160 bp, Homo sapiens
  misc_feature (12)..(12): n is a, c, g, or t
  misc_feature (86)..(86): n is a, c, g, or t
gggaggcgcggnggcggggtcggcgccgcgcgcgagagcctcggcctggccgcgctgcgcccgccgccgccgccgccccctccccncctgggccctaccgccgcacggccccggccccctcccagcctgccgctccggagagccgcccgccgaggatgcgacgcaccgcagtgttctaagaacggaagcatctgggctggatggaatttagcatcaagcagagtcccctttctgttcagagtgttgtaaagtgcataaagatgaagcaggcaccagaaatcctcggcagtgccaacgggaagactccgagctgcgaggtgaaccgcgagtgttctgtgttcctcagcaaagcccagctctccagtagcctgcaggagggggtcatgcagaagtttaacggccacgacgccctgccctttattccagccgacaagctgaaagatcttacttcccgggtgtttaatggagaacccggcgcacacgatgccaaactgcgttttgagtcccaggaaatgaaagggattgggacaccccctaacactacccctatcaaaaatggctctccagaaattaagctgaaaatcaccaaaacatacatgaatgggaagcctctctttgaatcttccatttgtggtgacagtgctgctgatgtgtctcagtcagaagaaaatggacaaaaaccagaaaacaaggcgagaaggaacaggaagaggagcataaaatatgactccttgctggagcagggccttgtcgaagcagctcttgtgtctaagatctcaagtccttcagataaaaagattccagctaagaaagagtcttgtccaaacactggaagagacaaagaccacctgttgaaatacaacgttggtgatttggtgtggtccaaagtgtcgggttacccttggtggccttgcatggtttctgcagatccactccttcacagctataccaaacttaaaggtcagaaaaagagtgcacgccagtatcacgtacagttctttggtgacgccccagaaagagcttggatatttgagaagagcctcgtagcttttgaaggagaaggacagtttgaaaaattatgccaggaaagtgccaagcaggcacccacgaaagctgagaaaattaagctattgaaaccaatttcagggaaattgagggcccagtgggaaatgggcattgttcaagcagaagaagctgcaagcatgtcagtggaggagcggaaagccaagttcacctttctctatgtgggggaccagcttcatctcaaccctcaagtagccaaggaggctggcattgctgcagagtctttgggagaaatggcagaatcctcaggagtcagtgaagaagctgctgaaaaccccaagtctgtgagagaagagtgcattcccatgaagagaaggcggagggccaaactgtgtagctctgcagagaccctggagagtcaccccgacatagggaagagtactcctcaaaagacggcagaggctgaccccagaagaggagtagggtctcctcctgggaggaagaagaccacagtctccatgccacgaagcaggaagggagatgcagcatcccagtttttggtcttctgtcaaaaacacagggatgaggtcagtactaagttgtgtttcatgctagcaagtttcagaatttgaggaacatcccttcagtgcagaatcatctgtttctcagcattatcaggagactctaacatgagccttgcatagattttagatctaataaataagtattagggaacagccattctgacccttgagggaaaagatactcgacttgcactctggggtcttaaaatatccttcctaatgtggataagaagataccgagaacaggccaggcacagtggctcatgcctgtaatttcagtactttgggaggccaaggcgggaggattgcttcagctcaggagtttgagaccagcctgggcaacatggtgaaaccccatctctacaaaaattagccgggtgtggtggcacatgcctgtagtcccagctgcttgggagactgagacaggaggatcccttgagtcctggaggcaggaggatcccttgagtcctgaaggtggggtttgcagtgagtcgtgatggcatcactgcaccgtagcctgggtgacagcagagcgagactgtgtctcaaaaaa

SEQ ID NO: 440523 - DNA, 601 bp, Homo sapiens
agggagatgcagcatcccagtttttggtcttctgtcaaaaacacagggatgaggtcagtactaagttgtgtttcatgctagcaagtttcagaatttgaggaacatcccttcagtgcagaatcatctgtttctcagcattatcaggagactctaacatgagccttgcatagattttagatctaataaataagtattagggaacagccattctgacccttgagggaaaagatactcgacttgcactctggggtcttaaaatatccttcctaatgtggataagaagataccgagaacaggccaggcacagtggctcatgcctgtaatttcagtactttgggaggccaaggcgggaggattgcttcagctcaggagtttgagaccagcctgggcaacatggtgaaaccccatctctacaaaaattagccgggtgtggtggcacatgcctgtagtcccagctgcttgggagactgagacaggaggatcccttgagtcctggaggcaggaggatcccttgagtcctgaaggtggggtttgcagtgagtcgtgatggcatcactgcaccgtagcctgggtgacagcagagcgagactgtgtctcaaaa

SEQ ID NO: 440524 - DNA, 451 bp, Homo sapiens
tggagtctgctgagtgagaagcagagagcacgctacaacaccaagtttgccctggtggcccctgtccaggctgaagaagactctggtaaacatagcattatgctgatgtcctctgcttgggttgatgtgtgtagtgtagcaagctgagctctgatcttggaaccgtagggaagtgtgtccactctccctgtttctgacccgtggggtttgggccagcggtccaagtgcgtgtggtcacagtaaaaacagcttctgccatctgcgtttactggcttatgagagctattcaatgtagtgccttctggcctgtggctcccttgctctcctacccaagttgagcagccactgtggtcactgctgctgatggggctgtgtgaagagaggacacaagaaggaaggggagggaaggtcgtctcttggattccaggcttacatgatgtggtagggtcag

SEQ ID NO: 440525 - DNA, 322 bp, Homo sapiens
gagtctcttgtaagttaattagtttccctctttggcatgtggcatggaagggataagaagtatagaatttgttttgaggttaacaggctcagacaacaccaagggaaacaactgcaaaatagcagtagatttgactagtttcatcccagattctaactttcattctctaacattttattttaaaaactaggtcagaaaaagagtgcacgccagtatcacgtacagttctttggtgacgccccagaaagagcttggatatttgagaagagcctcgtagcttttgaaggagaaggacagtttgaaaaattatgccaggaaagtg

SEQ ID NO: 440526 - DNA, 8504 bp, Homo sapiens
agagatgggtctcgccatcaccatgttgcccagtctggtctccaactcctgggctcaagcgatcctcctgccttggtctcccaaagtgctgggattacaggtgtgagcccccacacccggcctgagtgagtgggttctgaatggtgactgttgttgtccatagccttccccctgcttctgagagtggagtccctcccctcatgttggagacctcccaaggtccatgtggtcctataggggctgttcagcctccctagccccttaacgtgtcaggtaatactgtatatattccatgaaatgtgaataattagttatataattcctaagcacttattttaaaaaacagcaatgtgatgcttaactcttcccacctctgttcctgtcccccttagaaaaccactgataactctttttttttttgagacggagtcttgccctgtcgcccaggctggagtgtagtggcctgatctcggctcggctcattgtaacctccgcctcgggtttgagcgattctcctgcctcagcctcctgagtagctgggattataggcgtgcaccaccacgcctggctaattttttgtatctttagtagggacgggtttcaccatgttggccagagtggtcttgaactcctgaccttgtgatccgctcgcctcagcctcccaaagtgctgggattacaggcatgagccaccgtgcctgtcctagaaccactggtaactcttaactgagacaagatttcgccatgttgcccaggctggtctcgaacttctgagctcaagcgatctacctgcctcgtcctcccaaagtgttggaattgcaggtgtgagccactgcacccggcccttgcctcatgtttgaatgataatttacctgggcataaaattctggacacttgtggtggcacgagctgtctgcttttctgtggagactgcgggttgcagacaccagcagccccctattgctgcacgtcaggtgtcctccacctcagtactgtggacatctcgggccgcatagccctgttgcgcgggcatcctgtgcgttgcaggagatgcagcagcatccatgaccgcaacccatcagagtgttctaagaacggaagcatctgggctggatggaatttagcatcaagcagagtcccctttctgttcagagtgttgtaaagtgcataaagatgaagcaggcaccagaaatcctcggcagtgccaacgggaagactccgagctgcgaggtgaaccgcgagtgttctgtgttcctcagcaaagcccagctctccagtagcctgcaggagggggtcatgcagaagtttaacggccacgacgccctgccctttattccagccgacaagctgaaagatcttacttcccgggtgtttaatggagaacccggcgcacacgatgccaaactgcgttttgagtcccaggaaatgaaagggattgggacaccccctaacactacccctatcaaaaatggctctccagaaattaagctgaaaatcaccaaaacatacatgaatgggaagcctctctttgaatcttccatttgtggtgacagtgctgctgatgtgtctcagtcagaagaaaatggacaaaaaccagaaaacaaggcgagaaggaacaggaagaggagcataaaatatgactccttgctggagcagggccttgtcgaagcagctcttgtgtctaagatctcaagtccttcagataaaaagattccagctaagaaagagtcttgtccaaacactggaagagacaaagaccacctgttgaaatacaacgttggtgatttggtgtggtccaaagtgtcgggttacccttggtggccttgcatggtttctgcagatccactccttcacagctataccaaacttaaaggtcagaaaaagagtgcacgccagtatcacgtacagttctttggtgacgccccagaaagagcttggatatttgagaagagcctcgtagcttttgaaggagaaggacagtttgaaaaattatgccaggaaagtgccaagcaggcacccacgaaagctgagaaaattaagctattgaaaccaatttcagggaaattgagggcccagtgggaaatgggcattgttcaagcagaagaagctgcaagcatgtcagtggaggagcggaaagccaagttcacctttctctatgtgggggaccagcttcatctcaaccctcaagtagccaaggaggctggcattgctgcagagtctttgggagaaatggcagaatcctcaggagtcagtgaagaagctgctgaaaaccccaagtctgtgagagaagagtgcattcccatgaagagaaggcggagggccaaactgtgtagctctgcagagaccctggagagtcaccccgacatagggaagagtactcctcaaaagacggcagaggctgaccccagaagaggagtagggtctcctcctgggaggaagaagaccacagtctccatgccacgaagcaggaagggagatgcagcatcccagtttttggtcttctgtcaaaaacacagggatgaggtggtagctgagcacccagatgcttcaggtgaggagattgaagagctgctcaggtcacagtggagtctgctgagtgagaagcagagagcacgctacaacaccaagtttgccctggtggcccctgtccaggctgaagaagactctggtaatgtaaatgggaaaaaaagaaaccacacaaagaggatacaggaccctacagaagatgctgaagctgaggacacacccaggaaaagactcaggacggacaagcacagtcttcggaagagagacacaatcactgacaaaacggccagaacaagctcttacaaggccatggaggcagcctcctcgctcaagagccaggcagcaacgaaaaatctgtctgatgcatgtaaaccactgaagaagcgaaatcgggcttccacggcagcatcttcagctcttgggtttagcaaaagttcatctccttctgcatccttaactgagaatgaggtctcggacagcccgggagacgagccctcggagtccccatacgaaagtgcagacgaaacacaaactgaagtatctgtctcatccaaaaagtctgagcgaggagtgactgccaaaaaggagtatgtgtgccagctgtgtgagaagccgggcagcctcctgctctgtgaaggaccctgctgcggagctttccacctcgcctgccttgggctttcccggaggccagaagggaggttcacctgcagcgagtgtgcctcagggattcactcatgtttcgtgtgtaaagagagcaagacagatgttaagcgctgtgtggtaactcagtgtggaaaattttaccatgaggcttgtgtgaaaaaataccctctgactgtatttgagagccgaggtttccgctgccccctccacagctgtgtgagctgccatgcttccaacccttcaaacccaaggccgtcaaaaggtaaaatgatgcggtgtgtccgctgccccgttgcctatcacagcggggatgcttgtctggcagcaggatgctcagtgatcgcctccaacagcatcatctgcactgcccacttcactgctcggaaggggaagcgacaccacgcccacgtcaacgtgagctggtgcttcgtgtgctccaaaggggggagccttctgtgctgtgagtcctgcccagcggccttccaccctgactgcctgaacatcgagatgcctgacggcagctggttctgcaatgactgcagggctgggaagaagctgcacttccaggatatcatttgggtgaaacttgggaactacagatggtggccggcagaagtttgccatcccaaaaatgttcccccaaatattcagaaaatgaagcacgagattggagaattccctgtgtttttctttgggtctaaagattattactggacgcatcaggcgcgagtgttcccgtacatggagggggaccggggcagccgctaccagggggtcagagggatcggaagagtcttcaaaaacgcactgcaagaagctgaagctcgttttcgtgaaattaagcttcagagggaagcccgagaaacacaggagagcgagcgcaagcccccaccatacaagcacatcaaggtgaataagccttacgggaaagtccagatctacacagcggatatttcagaaatccctaagtgcaactgcaagcccacagatgagaatccttgtggctttgattcggagtgtctgaacaggatgctgatgtttgagtgccacccgcaggtgtgtcccgcgggcgagttctgccagaaccagtgcttcaccaagcgccagtacccagagaccaagatcatcaagacagatggcaaagggtggggcctggtcgccaagagggacatcagaaagggagaatttgttaacgagtacgttggggagctgatcgacgaggaggagtgcatggcgagaatcaagcacgcacacgagaacgacatcacccacttctacatgctcactatagacaaggaccgtataatagacgctggccccaaaggaaactactctcgatttatgaatcacagctgccagcccaactgtgagaccctcaagtggacagtgaatggggacactcgtgtgggcctgtttgccgtctgtgacattcctgcagggacggagctgacttttaactacaacctcgattgtctgggcaatgaaaaaacggtctgccggtgtggagcctccaattgcagtggattcctcggggatagaccaaagacctcgacgaccctttcatcagaggaaaagggcaaaaagaccaagaagaaaacgaggcggcgcagagcaaaaggggaagggaagaggcagtcagaggacgagtgcttccgctgcggtgatggcgggcagctggtgctgtgtgaccgcaagttctgcaccaaggcctaccacctgtcctgcctgggccttggcaagcggcccttcgggaagtgggaatgtccttggcatcattgtgacgtgtgtggcaaaccttcgacttcattttgccacctctgccccaattcgttctgtaaggagcaccaggacgggacagccttcagctgcaccccggacgggcggtcctactgctgtgagcatgacttaggggcggcatcggtcagaagcaccaagactgagaagccccccccagagccagggaagccgaaggggaagaggcggcggcggaggggctggcggagagtcacagagggcaaatagcgccaggcggccgcttggccggatccaggggcggtgcagggcggccggccctgcctgcgggagagggcgagcatgaactggcccggaggacccagctcgagccgccaggacacagacgtacaggcctcctcgggagggagcgcctccccaccactgagccatcctcagcagcgtccgctgcgtctgcactgatgaccgtctgagcccagctcagcgttcctggacaaacagcctcactcctcagcgttaccgccacacttgaatttctccgaatgtcaaggttccctcccactctatttttttaggttaaagttaattggcatatggaatgttttaatctcctctgaaatgtgtagcgtaggcttttcccaagggtcgctagaaactcgtcttcgcgttgccccctttctggctctcagcgccgtcgccactcgggagaggctgggtgaggcccgtgtgaggactgaccctggattcctcgaaactgccattgtgatcattactctgctctttggaaatggctgtatcatttttttgtactaatgtgaattgttcctcagaaacgcttcttttccatcctagtgagaagctggccctgcaggtggtggcagcaatggtgttgtaagatttcctcccgtagttttttctcctcatggatttgaatgaaatgccaataacacgtccactttcaacgtgtagtttacgcggagcactttcgaggcctggccgggttgggcctacttctcacctgggcctatcttctgaactcgctaggttcttatcaacatttgggggataactttgtatatttttttcatttggcttttctttaccagtttctgatttttattctcaatatatttttgctaaacctatttcacaaatcaccaccgactgaagtgtgtgtttactgatgcggccctgagctccatggcgaaaggagtgactttgcagggcgtgagaccgcagtctgcttagagcacaggaagtgacaacttagggagccccgtagggcgctgcaggccccggggaccccagcacgtgggtctaaagagagacggagtctagctctcctgccacccagagtggcttccatctcagcactctgtgggtctggtgatggaagatgcagtctctgctgatcacatgtgccctctgccagggcacctactgagaggtgcggtcctgggggtggaggcctgcctggcaggtgtgcgtgcctcgtacgtgtgttatgggcactggtctaggccaggtatgacacccactctcctgtgagatttcactttagtttttaaaaggtccagttctacagagtgagacctatctatctgagtactacatatgttttaagacttggttctttttttgagggatccttgaccctgggaagtctggagcaccctgagaagggggcaccatgtgtgcctttgcccacgtgtcctgaggggctgcttgtctgggagggagggagagaacattcagcagcaggtgcttttttatggccttttcttaaaataacctaagggggacacatccatcttgcagagaagtttacagaactccccttgaaaactgctgctgaggctcctgttaaattttctgtggcatcttttatgccttggtaaaaactgcagtgtctttggacctgagagtggctactccgtggttttgtgacctgtaagcgtggggttcaggggtgtgtggccctgcagggtcccacgcctccctgagcactgactggaagtttcactggctggtggctgtcccttctcccatcagggtccccagcaaagttaactacacagaggacccaggggaaacgagctgtgtagccactgacttgctcgcgcggccgtggcctctgaggggcactcgccggttaagacagggtgggagtagtgctttccagttcagactctaacttctcccaaagtgtcctaagaaaatactggatcggctcatagatttatgctccttatgatgccctaacttggaaggttgttctagggacaggccgggcagtgtccccacacacaccttagagtcgaaggccccagggccccgctgtcacttgcccaaaagatcccttccggcaggtaagggactaccaatgcttacgtcaaaacagcagaatcggctttgcagtgcactttggggagcagatattaacttatttttgtgttggacagtagtgaaatcttgtgatttttaatcgctttgataatacttccaaattttatgatttttctgaaggaaataatgcaaacattttaaatatgtttctccccctttccaaaaactgttaaactaatgagcaagtaacactaactttgaatgtctctacaatacccgttgataactcagtggagccaggctttggggtagcggccctgagcttgcagggtttctcgccactggggctgaccacgcccccagctgtgaccgtgggtgtggctggctctcggccctgcccagctttgttctgaggacgtggtgacttcctgaacatcagcttcaatcctccatcattaatgtgaagcaaaacacaaaaaccgccccaatccctcaggattccttggcatccgaaaccagcatctgcacctaaacccatacccacccgtgtgcgcccacagggggatgtgtccgaatgggcagcttaaaatgtggtcacctgtgggggaaactcttcaggcacctgaagtgagaacccagctgtccgtcctcaggccggcctttcttccggcgacacccgtccatggctggctgggtccccttcgcagtgtttgtctgtcttgacatctaaaccccggcgtgtgcagtgcccatcttccaggactaccttattttccagaattaaacctgttttataattcaagttaatgcaaatgactgtcagttgccaaatatcttgatcctatgagtgtagttgatgactgtttgttagtcagtagagtaaaatgctgtgtccacggggtgtcacagcctcaccataccctgttgaggtgtgaaatgccccgtcagaaattaaatacaaacttaaatgtgcctattggtgtctaaacttcatacaatgtaaggtcagattccttttaggaatactgggtgctgtcaccaggtttgatagttagacttaaaaacttgaaattcactttttggggggagggatatactgaaatagagagttgagacttgccagttgggggaaaatagcatttaaaatggaaagctgtgtttggaaaattgtgtatgagtatttttgtattaaaaacattttaaaggcttttttcttaa

SEQ ID NO: 440527 - DNA, 3602 bp, Homo sapiens
gagtagcattgtggttatatgtaagactttatgtttagagatttgtgctaaacttcttatggatgaaatgatatgtctgggatttgcttcagaataatctggcagggggacgtggaaccaggtatggatagagccacgctggccccaggttgatgtttttgggggccaagtagcgaggacatggggttcattgtacagtttgtctgcttttgtttatgttcagatttttccatgatagaaagttaagccagaaggacaaaggaattcagaagattcatctttagaacttcacttatttgaggggtaatttttaagcagtaaaaagatcaagggtttatgatttgaaactttacaaaccaaaattattttacagcaacgaaaaatctgtctgatgcatgtaaaccactgaagaagcgaaatcgggcttccacggcagcatcttcagctcttgggtttagcaaaagttcatctccttctgcatccttaactgagaatgaggtctcggacagcccgggagacgagccctcggagtccccatacgaaagtgcagacgaaacacaaactgaagtatctgtctcatccaaaaagtctgagcgaggagtgactgccaaaaaggagtatgtgtgccagctgtgtgagaagccgggcagcctcctgctctgtgaaggaccctgctgcggagctttccacctcgcctgccttgggctttcccggaggccagaagggaggttcacctgcagcgagtgtgcctcagggattcactcatgtttcgtgtgtaaagagagcaagacagatgttaagcgctgtgtggtaactcagtgtggaaaattttaccatgaggcttgtgtgaaaaaataccctctgactgtatttgagagccgaggtttccgctgccccctccacagctgtgtgagctgccatgcttccaacccttcaaacccaaggccgtcaaaaggtaaaatgatgcggtgtgtccgctgccccgttgcctatcacagcggggatgcttgtctggcagcaggatgctcagtgatcgcctccaacagcatcatctgcactgcccacttcactgctcggaaggggaagcgacaccacgcccacgtcaacgtgagctggtgcttcgtgtgctccaaaggggggagccttctgtgctgtgagtcctgcccagcggccttccaccctgactgcctgaacatcgagatgcctgacggcagctggttctgcaatgactgcagggctgggaagaagctgcacttccaggatatcatttgggtgaaacttgggaactacagatggtggccggcagaagtttgccatcccaaaaatgttcccccaaatattcagaaaatgaagcacgagattggagaattccctgtgtttttctttgggtctaaagattattactggacgcatcaggcgcgagtgttcccgtacatggagggggaccggggcagccgctaccagggggtcagagggatcggaagagtcttcaaaaacgcactgcaagaagctgaagctcgttttcgtgaaattaagcttcagagggaagcccgagaaacacaggagagcgagcgcaagcccccaccatacaagcacatcaaggtgaataagccttacgggaaagtccagatctacacagcggatatttcagaaatccctaagtgcaactgcaagcccacagatgagaatccttgtggctttgattcggagtgtctgaacaggatgctgatgtttgagtgccacccgcaggtgtgtcccgcgggcgagttctgccagaaccagtgcttcaccaagcgccagtacccagagaccaagatcatcaagacagatggcaaagggtggggcctggtcgccaagagggacatcagaaagggagaatttgttaacgagtacgttggggagctgatcgacgaggaggagtgcatggcgagaatcaagcacgcacacgagaacgacatcacccacttctacatgctcactatagacaaggaccgtataatagacgctggccccaaaggaaactactctcgatttatgaatcacagctgccagcccaactgtgagaccctcaagtggacagtgaatggggacactcgtgtgggcctgtttgccgtctgtgacattcctgcagggacggagctgacttttaactacaacctcgattgtctgggcaatgaaaaaacggtctgccggtgtggagcctccaattgcagtggattcctcggggatagaccaaagacctcgacgaccctttcatcagaggaaaagggcaaaaagaccaagaagaaaacgaggcggcgcagagcaaaaggggaagggaagaggcagtcagaggacgagtgcttccgctgcggtgatggcgggcagctggtgctgtgtgaccgcaagttctgcaccaaggcctaccacctgtcctgcctgggccttggcaagcggcccttcgggaagtgggaatgtccttggcatcattgtgacgtgtgtggcaaaccttcgacttcattttgccacctctgccccaattcgttctgtaaggagcaccaggacgggacagccttcagctgcaccccggacgggcggtcctactgctgtgagcatgacttaggggcggcatcggtcagaagcaccaagactgagaagccccccccagagccagggaagccgaaggggaagaggcggcggcggaggggctggcggagagtcacagagggcaaatagcgccaggcggccgcttggccggatccaggggcggtgcagggcggccggccctgcctgcgggagagggcgagcatgaactggcccggaggacccagctcgagccgccaggacacagacgtacaggcctcctcgggagggagcgcctccccaccactgagccatcctcagcagcgtccgctgcgtctgcactgatgaccgtctgagcccagctcagcgttcctggacaaacagcctcactcctcagcgttaccgccacacttgaatttctccgaatgtcaaggttccctcccactctatttttttaggttaaagttaattggcatatggaatgttttaatctcctctgaaatgtgtagcgtaggcttttcccaagggtcgctagaaactcgtcttcgcgttgccccctttctggctctcagcgccgtcgccactcgggagaggctgggtgaggcccgtgtgaggactgaccctggattcctcgaaactgccattgtgatcattactctgctctttggaaatggctgtatcatttttttgtactaatgtgaattgttcctcagaaacgcttcttttccatcctagtgagaagctggccctgcaggtggtggcagcaatggtgttgtaagatttcctcccgtagttttttctcctcatggatttgaatgaaatgccaataacacgtccactttcaacgtgtagtttacgcggagcactttcgaggcctggccgggttgggcctacttctcacctgggcctatcttctgaactcgctaggttcttatcaacatttgggggataactttgtatatttttttcatttggcttttctttaccagtttctgatttttattctcaatatatttttgctaaacctatttcacaaatca

SEQ ID NO: 440528 - DNA, 307 bp, Homo sapiens
  misc_feature (6)..(6): n is a, c, g, or t
  misc_feature (108)..(108): n is a, c, g, or t
  misc_feature (289)..(289): n is a, c, g, or t
gccggncccggcatgtgctgtaggccagcgaaggagatctggtctcccacaatgaaggtcttgcttccctggttctgggacagcagggtctcaaaaggcttcagttgnccgggcagtgccttcacatagtcatccttgccgcctcatagttggtgtagatgagggagaatttgttaacgagtacgttggggagctgatcgacgaggaggagtgcatggcgagaatcaagcacgcacacgagaacgacatcacccacttctacatgctcactatagacaaggaccgtatnatagacgctggcctacgg

SEQ ID NO: 440529 - DNA, 8082 bp, Homo sapiens
  misc_feature (12)..(12): n is a, c, g, or t
  misc_feature (86)..(86): n is a, c, g, or t
gggaggcgcggnggcggggtcggcgccgcgcgcgagagcctcggcctggccgcgctgcgcccgccgccgccgccgccccctccccncctgggccctaccgccgcacggccccggccccctcccagcctgccgctccggagagccgcccgccgaggatgcgacgcaccgcagtgttctaagaacggaagcatctgggctggatggaatttagcatcaagcagagtcccctttctgttcagagtgttgtaaagtgcataaagatgaagcaggcaccagaaatcctcggcagtgccaacgggaagactccgagctgcgaggtgaaccgcgagtgttctgtgttcctcagcaaagcccagctctccagtagcctgcaggagggggtcatgcagaagtttaacggccacgacgccctgccctttattccagccgacaagctgaaagatcttacttcccgggtgtttaatggagaacccggcgcacacgatgccaaactgcgttttgagtcccaggaaatgaaagggattgggacaccccctaacactacccctatcaaaaatggctctccagaaattaagctgaaaatcaccaaaacatacatgaatgggaagcctctctttgaatcttccatttgtggtgacagtgctgctgatgtgtctcagtcagaagaaaatggacaaaaaccagaaaacaaggcgagaaggaacaggaagaggagcataaaatatgactccttgctggagcagggccttgtcgaagcagctcttgtgtctaagatctcaagtccttcagataaaaagattccagctaagaaagagtcttgtccaaacactggaagagacaaagaccacctgttgaaatacaacgttggtgatttggtgtggtccaaagtgtcgggttacccttggtggccttgcatggtttctgcagatccactccttcacagctataccaaacttaaaggtcagaaaaagagtgcacgccagtatcacgtacagttctttggtgacgccccagaaagagcttggatatttgagaagagcctcgtagcttttgaaggagaaggacagtttgaaaaattatgccaggaaagtgccaagcaggcacccacgaaagctgagaaaattaagctattgaaaccaatttcagggaaattgagggcccagtgggaaatgggcattgttcaagcagaagaagctgcaagcatgtcagtggaggagcggaaagccaagttcacctttctctatgtgggggaccagcttcatctcaaccctcaagtagccaaggaggctggcattgctgcagagtctttgggagaaatggcagaatcctcaggagtcagtgaagaagctgctgaaaaccccaagtctgtgagagaagagtgcattcccatgaagagaaggcggagggccaaactgtgtagctctgcagagaccctggagagtcaccccgacatagggaagagtactcctcaaaagacggcagaggctgaccccagaagaggagtagggtctcctcctgggaggaagaagaccacagtctccatgccacgaagcaggaagggagatgcagcatcccagtttttggtcttctgtcaaaaacacagggatgaggtggtagctgagcacccagatgcttcaggtgaggagattgaagagctgctcaggtcacagtggagtctgctgagtgagaagcagagagcacgctacaacaccaagtttgccctggtggcccctgtccaggctgaagaagactctggtaatgtaaatgggaaaaaaagaaaccacacaaagaggatacaggaccctacagaagatgctgaagctgaggacacacccaggaaaagactcaggacggacaagcacagtcttcggaagcaacgaaaaatctgtctgatgcatgtaaaccactgaagaagcgaaatcgggcttccacggcagcatcttcagctcttgggtttagcaaaagttcatctccttctgcatccttaactgagaatgaggtctcggacagcccgggagacgagccctcggagtccccatacgaaagtgcagacgaaacacaaactgaagtatctgtctcatccaaaaagtctgagcgaggagtgactgccaaaaaggagtatgtgtgccagctgtgtgagaagccgggcagcctcctgctctgtgaaggaccctgctgcggagctttccacctcgcctgccttgggctttcccggaggccagaagggaggttcacctgcagcgagtgtgcctcaggtgtcgcccggcacagtctggggtctgtgaggatgatgagaggacacctgcacagccgtggcccttcctgcctactcaccgggcccaaggagtctcctatctcacgtcagaacacttcctgggtcaggaagacacctggagagtctcccaggccatggcagccccacagcagcacctcacttatgggagtgtctgtctgcctgcccagaatgataagtgactgctccaccactggccagctgctctcaaggaggaaaggcctcttttcataggagccccttctttcaagcttcttgccagttagactgggcctccccagccaggctgcctagtaagattctcctgtatttcaggtgaagctggagctcagatcgcagcaaggtaatccttgatggctggatctttttgctggagaatgcttggactagtgagcaaggttggaaacagggccaggtgctttagcagcgtggctgcctctgaagaggagttgcttgattttagtggctcagaactgcaatttaattcttgttctttgcacctctctctccaccccttctttaactttttgttagggattcactcatgtttcgtgtgtaaagagagcaagacagatgttaagcgctgtgtggtaactcagtgtggaaaattttaccatgaggcttgtgtgaaaaaataccctctgactgtatttgagagccgaggtttccgctgccccctccacagctgtgtgagctgccatgcttccaacccttcaaacccaaggccgtcaaaaggtaaaatgatgcggtgtgtccgctgccccgttgcctatcacagcggggatgcttgtctggcagcaggatgctcagtgatcgcctccaacagcatcatctgcactgcccacttcactgctcggaaggggaagcgacaccacgcccacgtcaacgtgagctggtgcttcgtgtgctccaaaggggggagccttctgtgctgtgagtcctgcccagcggccttccaccctgactgcctgaacatcgagatgcctgacggcagctggttctgcaatgactgcagggctgggaagaagctgcacttccaggatatcatttgggtgaaacttgggaactacagatggtggccggcagaagtttgccatcccaaaaatgttcccccaaatattcagaaaatgaagcacgagattggagaattccctgtgtttttctttgggtctaaagattattactggacgcatcaggcgcgagtgttcccgtacatggagggggaccggggcagccgctaccagggggtcagagggatcggaagagtcttcaaaaacgcactgcaagaagctgaagctcgttttcgtgaaattaagcttcagagggaagcccgagaaacacaggagagcgagcgcaagcccccaccatacaagcacatcaaggtgaataagccttacgggaaagtccagatctacacagcggatatttcagaaatccctaagtgcaactgcaagcccacagatgagaatccttgtggctttgattcggagtgtctgaacaggatgctgatgtttgagtgccacccgcaggtgtgtcccgcgggcgagttctgccagaaccagtgcttcaccaagcgccagtacccagagaccaagatcatcaagacagatggcaaagggtggggcctggtcgccaagagggacatcagaaagggagaatttgttaacgagtacgttggggagctgatcgacgaggaggagtgcatggcgagaatcaagcacgcacacgagaacgacatcacccacttctacatgctcactatagacaaggaccgtataatagacgctggccccaaaggaaactactctcgatttatgaatcacagctgccagcccaactgtgagaccctcaagtggacagtgaatggggacactcgtgtgggcctgtttgccgtctgtgacattcctgcagggacggagctgacttttaactacaacctcgattgtctgggcaatgaaaaaacggtctgccggtgtggagcctccaattgcagtggattcctcggggatagaccaaagacctcgacgaccctttcatcagaggaaaagggcaaaaagaccaagaagaaaacgaggcggcgcagagcaaaaggggaagggaagaggcagtcagaggacgagtgcttccgctgcggtgatggcgggcagctggtgctgtgtgaccgcaagttctgcaccaaggcctaccacctgtcctgcctgggccttggcaagcggcccttcgggaagtgggaatgtccttggcatcattgtgacgtgtgtggcaaaccttcgacttcattttgccacctctgccccaattcgttctgtaaggagcaccaggacgggacagccttcagctgcaccccggacgggcggtcctactgctgtgagcatgacttaggggcggcatcggtcagaagcaccaagactgagaagccccccccagagccagggaagccgaaggggaagaggcggcggcggaggggctggcggagagtcacagagggcaaatagcgccaggcggccgcttggccggatccaggggcggtgcagggcggccggccctgcctgcgggagagggcgagcatgaactggcccggaggacccagctcgagccgccaggacacagacgtacaggcctcctcgggagggagcgcctccccaccactgagccatcctcagcagcgtccgctgcgtctgcactgatgaccgtctgagcccagctcagcgttcctggacaaacagcctcactcctcagcgttaccgccacacttgaatttctccgaatgtcaaggttccctcccactctatttttttaggttaaagttaattggcatatggaatgttttaatctcctctgaaatgtgtagcgtaggcttttcccaagggtcgctagaaactcgtcttcgcgttgccccctttctggctctcagcgccgtcgccactcgggagaggctgggtgaggcccgtgtgaggactgaccctggattcctcgaaactgccattgtgatcattactctgctctttggaaatggctgtatcatttttttgtactaatgtgaattgttcctcagaaacgcttcttttccatcctagtgagaagctggccctgcaggtggtggcagcaatggtgttgtaagatttcctcccgtagttttttctcctcatggatttgaatgaaatgccaataacacgtccactttcaacgtgtagtttacgcggagcactttcgaggcctggccgggttgggcctacttctcacctgggcctatcttctgaactcgctaggttcttatcaacatttgggggataactttgtatatttttttcatttggcttttctttaccagtttctgatttttattctcaatatatttttgctaaacctatttcacaaatcaccaccgactgaagtgtgtgtttactgatgcggccctgagctccatggcgaaaggagtgactttgcagggcgtgagaccgcagtctgcttagagcacaggaagtgacaacttagggagccccgtagggcgctgcaggccccggggaccccagcacgtgggtctaaagagagacggagtctagctctcctgccacccagagtggcttccatctcagcactctgtgggtctggtgatggaagatgcagtctctgctgatcacatgtgccctctgccagggcacctactgagaggtgcggtcctgggggtggaggcctgcctggcaggtgtgcgtgcctcgtacgtgtgttatgggcactggtctaggccaggtatgacacccactctcctgtgagatttcactttagtttttaaaaggtccagttctacagagtgagacctatctatctgagtactacatatgttttaagacttggttctttttttgagggatccttgaccctgggaagtctggagcaccctgagaagggggcaccatgtgtgcctttgcccacgtgtcctgaggggctgcttgtctgggagggagggagagaacattcagcagcaggtgcttttttatggccttttcttaaaataacctaagggggacacatccatcttgcagagaagtttacagaactccccttgaaaactgctgctgaggctcctgttaaattttctgtggcatcttttatgccttggtaaaaactgcagtgtctttggacctgagagtggctactccgtggttttgtgacctgtaagcgtggggttcaggggtgtgtggccctgcagggtcccacgcctccctgagcactgactggaagtttcactggctggtggctgtcccttctcccatcagggtccccagcaaagttaactacacagaggacccaggggaaacgagctgtgtagccactgacttgctcgcgcggccgtggcctctgaggggcactcgccggttaagacagggtgggagtagtgctttccagttcagactctaacttctcccaaagtgtcctaagaaaatactggatcggctcatagatttatgctccttatgatgccctaacttggaaggttgttctagggacaggccgggcagtgtccccacacacaccttagagtcgaaggccccagggccccgctgtcacttgcccaaaagatcccttccggcaggtaagggactaccaatgcttacgtcaaaacagcagaatcggctttgcagtgcactttggggagcagatattaacttatttttgtgttggacagtagtgaaatcttgtgatttttaatcgctttgataatacttccaaattttatgatttttctgaaggaaataatgcaaacattttaaatatgtttctccccctttccaaaaactgttaaactaatgagcaagtaacactaactttgaatgtctctacaatacccgttgataactcagtggagccaggctttggggtagcggccctgagcttgcagggtttctcgccactggggctgaccacgcccccagctgtgaccgtgggtgtggctggctctcggccctgcccagctttgttctgaggacgtggtgacttcctgaacatcagcttcaatcctccatcattaatgtgaagcaaaacacaaaaaccgccccaatccctcaggattccttggcatccgaaaccagcatctgcacctaaacccatacccacccgtgtgcgcccacagggggatgtgtccgaatgggcagcttaaaatgtggtcacctgtgggggaaactcttcaggcacctgaagtgagaacccagctgtccgtcctcaggccggcctttcttccggcgacacccgtccatggctggctgggtccccttcgcagtgtttgtctgtcttgacatctaaaccccggcgtgtgcagtgcccatcttccaggactaccttattttccagaattaaacctgttttataattcaagttaatgcaaatgactgtcagttgccaaatatcttgatcctatgagtgtagttgatgactgtttgttagtcagtagagtaaaatgctgtgtccacggggtgtcacagcctcaccataccctgttgaggtgtgaaatgccccgtcagaaattaaatacaaacttaaatgtgcctattggtgtctaaacttcatacaatgtaaggtcagattccttttaggaatactgggtgctgtcaccaggtttgatagttagacttaaaaacttgaaattcactttttggggggagggatatactgaaatagagagttgagacttgccagttgggggaaaatagcatttaaaatggaaagctgtgtttggaaaattgtgtatgagtatttttgtattaaaaacattttaaaggcttttttcttaa

SEQ ID NO: 440530 - DNA, 5598 bp, Homo sapiens
ggtggggcgggacgagcctgcctgcaggcatggccacccgctgtgttctgcgactagtgaactgtcatccgcctccttcatctctaggtctcggacagcccgggagacgagccctcggagtccccatacgaaagtgcagacgaaacacaaactgaagtatctgtctcatccaaaaagtctgagcgaggagtgactgccaaaaaggagtatgtgtgccagctgtgtgagaagccgggcagcctcctgctctgtgaaggaccctgctgcggagctttccacctcgcctgccttgggctttcccggaggccagaagggaggttcacctgcagcgagtgtgcctcagggattcactcatgtttcgtgtgtaaagagagcaagacagatgttaagcgctgtgtggtaactcagtgtggaaaattttaccatgaggcttgtgtgaaaaaataccctctgactgtatttgagagccgaggtttccgctgccccctccacagctgtgtgagctgccatgcttccaacccttcaaacccaaggccgtcaaaaggtaaaatgatgcggtgtgtccgctgccccgttgcctatcacagcggggatgcttgtctggcagcaggatgctcagtgatcgcctccaacagcatcatctgcactgcccacttcactgctcggaaggggaagcgacaccacgcccacgtcaacgtgagctggtgcttcgtgtgctccaaaggggggagccttctgtgctgtgagtcctgcccagcggccttccaccctgactgcctgaacatcgagatgcctgacggcagctggttctgcaatgactgcagggctgggaagaagctgcacttccaggatatcatttgggtgaaacttgggaactacagatggtggccggcagaagtttgccatcccaaaaatgttcccccaaatattcagaaaatgaagcacgagattggagaattccctgtgtttttctttgggtctaaagattattactggacgcatcaggcgcgagtgttcccgtacatggagggggaccggggcagccgctaccagggggtcagagggatcggaagagtcttcaaaaacgcactgcaagaagctgaagctcgttttcgtgaaattaagcttcagagggaagcccgagaaacacaggagagcgagcgcaagcccccaccatacaagcacatcaaggtgaataagccttacgggaaagtccagatctacacagcggatatttcagaaatccctaagtgcaactgcaagcccacagatgagaatccttgtggctttgattcggagtgtctgaacaggatgctgatgtttgagtgccacccgcaggtgtgtcccgcgggcgagttctgccagaaccagtgcttcaccaagcgccagtacccagagaccaagatcatcaagacagatggcaaagggtggggcctggtcgccaagagggacatcagaaagggagaatttgttaacgagtacgttggggagctgatcgacgaggaggagtgcatggcgagaatcaagcacgcacacgagaacgacatcacccacttctacatgctcactatagacaaggaccgtataatagacgctggccccaaaggaaactactctcgatttatgaatcacagctgccagcccaactgtgagaccctcaagtggacagtgaatggggacactcgtgtgggcctgtttgccgtctgtgacattcctgcagggacggagctgacttttaactacaacctcgattgtctgggcaatgaaaaaacggtctgccggtgtggagcctccaattgcagtggattcctcggggatagaccaaagacctcgacgaccctttcatcagaggaaaagggcaaaaagaccaagaagaaaacgaggcggcgcagagcaaaaggggaagggaagaggcagtcagaggacgagtgcttccgctgcggtgatggcgggcagctggtgctgtgtgaccgcaagttctgcaccaaggcctaccacctgtcctgcctgggccttggcaagcggcccttcgggaagtgggaatgtccttggcatcattgtgacgtgtgtggcaaaccttcgacttcattttgccacctctgccccaattcgttctgtaaggagcaccaggacgggacagccttcagctgcaccccggacgggcggtcctactgctgtgagcatgacttaggggcggcatcggtcagaagcaccaagactgagaagccccccccagagccagggaagccgaaggggaagaggcggcggcggaggggctggcggagagtcacagagggcaaatagcgccaggcggccgcttggccggatccaggggcggtgcagggcggccggccctgcctgcgggagagggcgagcatgaactggcccggaggacccagctcgagccgccaggacacagacgtacaggcctcctcgggagggagcgcctccccaccactgagccatcctcagcagcgtccgctgcgtctgcactgatgaccgtctgagcccagctcagcgttcctggacaaacagcctcactcctcagcgttaccgccacacttgaatttctccgaatgtcaaggttccctcccactctatttttttaggttaaagttaattggcatatggaatgttttaatctcctctgaaatgtgtagcgtaggcttttcccaagggtcgctagaaactcgtcttcgcgttgccccctttctggctctcagcgccgtcgccactcgggagaggctgggtgaggcccgtgtgaggactgaccctggattcctcgaaactgccattgtgatcattactctgctctttggaaatggctgtatcatttttttgtactaatgtgaattgttcctcagaaacgcttcttttccatcctagtgagaagctggccctgcaggtggtggcagcaatggtgttgtaagatttcctcccgtagttttttctcctcatggatttgaatgaaatgccaataacacgtccactttcaacgtgtagtttacgcggagcactttcgaggcctggccgggttgggcctacttctcacctgggcctatcttctgaactcgctaggttcttatcaacatttgggggataactttgtatatttttttcatttggcttttctttaccagtttctgatttttattctcaatatatttttgctaaacctatttcacaaatcaccaccgactgaagtgtgtgtttactgatgcggccctgagctccatggcgaaaggagtgactttgcagggcgtgagaccgcagtctgcttagagcacaggaagtgacaacttagggagccccgtagggcgctgcaggccccggggaccccagcacgtgggtctaaagagagacggagtctagctctcctgccacccagagtggcttccatctcagcactctgtgggtctggtgatggaagatgcagtctctgctgatcacatgtgccctctgccagggcacctactgagaggtgcggtcctgggggtggaggcctgcctggcaggtgtgcgtgcctcgtacgtgtgttatgggcactggtctaggccaggtatgacacccactctcctgtgagatttcactttagtttttaaaaggtccagttctacagagtgagacctatctatctgagtactacatatgttttaagacttggttctttttttgagggatccttgaccctgggaagtctggagcaccctgagaagggggcaccatgtgtgcctttgcccacgtgtcctgaggggctgcttgtctgggagggagggagagaacattcagcagcaggtgcttttttatggccttttcttaaaataacctaagggggacacatccatcttgcagagaagtttacagaactccccttgaaaactgctgctgaggctcctgttaaattttctgtggcatcttttatgccttggtaaaaactgcagtgtctttggacctgagagtggctactccgtggttttgtgacctgtaagcgtggggttcaggggtgtgtggccctgcagggtcccacgcctccctgagcactgactggaagtttcactggctggtggctgtcccttctcccatcagggtccccagcaaagttaactacacagaggacccaggggaaacgagctgtgtagccactgacttgctcgcgcggccgtggcctctgaggggcactcgccggttaagacagggtgggagtagtgctttccagttcagactctaacttctcccaaagtgtcctaagaaaatactggatcggctcatagatttatgctccttatgatgccctaacttggaaggttgttctagggacaggccgggcagtgtccccacacacaccttagagtcgaaggccccagggccccgctgtcacttgcccaaaagatcccttccggcaggtaagggactaccaatgcttacgtcaaaacagcagaatcggctttgcagtgcactttggggagcagatattaacttatttttgtgttggacagtagtgaaatcttgtgatttttaatcgctttgataatacttccaaattttatgatttttctgaaggaaataatgcaaacattttaaatatgtttctccccctttccaaaaactgttaaactaatgagcaagtaacactaactttgaatgtctctacaatacccgttgataactcagtggagccaggctttggggtagcggccctgagcttgcagggtttctcgccactggggctgaccacgcccccagctgtgaccgtgggtgtggctggctctcggccctgcccagctttgttctgaggacgtggtgacttcctgaacatcagcttcaatcctccatcattaatgtgaagcaaaacacaaaaaccgccccaatccctcaggattccttggcatccgaaaccagcatctgcacctaaacccatacccacccgtgtgcgcccacagggggatgtgtccgaatgggcagcttaaaatgtggtcacctgtgggggaaactcttcaggcacctgaagtgagaacccagctgtccgtcctcaggccggcctttcttccggcgacacccgtccatggctggctgggtccccttcgcagtgtttgtctgtcttgacatctaaaccccggcgtgtgcagtgcccatcttccaggactaccttattttccagaattaaacctgttttataattcaagttaatgcaaatgactgtcagttgccaaatatcttgatcctatgagtgtagttgatgactgtttgttagtcagtagagtaaaatgctgtgtccacggggtgtcacagcctcaccataccctgttgaggtgtgaaatgccccgtcagaaattaaatacaaacttaaatgtgcctattggtgtctaaacttcatacaatgtaaggtcagattccttttaggaatactgggtgctgtcaccaggtttgatagttagacttaaaaacttgaaattcactttttggggggagggatatactgaaatagagagttgagacttgccagttgggggaaaatagcatttaaaatggaaagctgtgtttggaaaattgtgtatgagtatttttgtattaaaaacattttaaaggcttttttcttaa

SEQ ID NO: 440531 - DNA, 5311 bp, Homo sapiens
tgaggatcctgagaagacgacagaagggaggttcactgcatgcgagtgtgctcaggggattcactcatgtttcgtgtgtaaagagagcaagacagatgttaagcgctgtgtggtaactcagtgtggaaaattttaccatgaggcttgtgtgaaaaaataccctctgactgtatttgagagccgaggtttccgctgccccctccacagctgtgtgagctgccatgcttccaacccttcaaacccaaggccgtcaaaaggtaaaatgatgcggtgtgtccgctgccccgttgcctatcacagcggggatgcttgtctggcagcaggatgctcagtgatcgcctccaacagcatcatctgcactgcccacttcactgctcggaaggggaagcgacaccacgcccacgtcaacgtgagctggtgcttcgtgtgctccaaaggggggagccttctgtgctgtgagtcctgcccagcggccttccaccctgactgcctgaacatcgagatgcctgacggcagctggttctgcaatgactgcagggctgggaagaagctgcacttccaggatatcatttgggtgaaacttgggaactacagatggtggccggcagaagtttgccatcccaaaaatgttcccccaaatattcagaaaatgaagcacgagattggagaattccctgtgtttttctttgggtctaaagattattactggacgcatcaggcgcgagtgttcccgtacatggagggggaccggggcagccgctaccagggggtcagagggatcggaagagtcttcaaaaacgcactgcaagaagctgaagctcgttttcgtgaaattaagcttcagagggaagcccgagaaacacaggagagcgagcgcaagcccccaccatacaagcacatcaaggtgaataagccttacgggaaagtccagatctacacagcggatatttcagaaatccctaagtgcaactgcaagcccacagatgagaatccttgtggctttgattcggagtgtctgaacaggatgctgatgtttgagtgccacccgcaggtgtgtcccgcgggcgagttctgccagaaccagtgcttcaccaagcgccagtacccagagaccaagatcatcaagacagatggcaaagggtggggcctggtcgccaagagggacatcagaaagggagaatttgttaacgagtacgttggggagctgatcgacgaggaggagtgcatggcgagaatcaagcacgcacacgagaacgacatcacccacttctacatgctcactatagacaaggaccgtataatagacgctggccccaaaggaaactactctcgatttatgaatcacagctgccagcccaactgtgagaccctcaagtggacagtgaatggggacactcgtgtgggcctgtttgccgtctgtgacattcctgcagggacggagctgacttttaactacaacctcgattgtctgggcaatgaaaaaacggtctgccggtgtggagcctccaattgcagtggattcctcggggatagaccaaagacctcgacgaccctttcatcagaggaaaagggcaaaaagaccaagaagaaaacgaggcggcgcagagcaaaaggggaagggaagaggcagtcagaggacgagtgcttccgctgcggtgatggcgggcagctggtgctgtgtgaccgcaagttctgcaccaaggcctaccacctgtcctgcctgggccttggcaagcggcccttcgggaagtgggaatgtccttggcatcattgtgacgtgtgtggcaaaccttcgacttcattttgccacctctgccccaattcgttctgtaaggagcaccaggacgggacagccttcagctgcaccccggacgggcggtcctactgctgtgagcatgacttaggggcggcatcggtcagaagcaccaagactgagaagccccccccagagccagggaagccgaaggggaagaggcggcggcggaggggctggcggagagtcacagagggcaaatagcgccaggcggccgcttggccggatccaggggcggtgcagggcggccggccctgcctgcgggagagggcgagcatgaactggcccggaggacccagctcgagccgccaggacacagacgtacaggcctcctcgggagggagcgcctccccaccactgagccatcctcagcagcgtccgctgcgtctgcactgatgaccgtctgagcccagctcagcgttcctggacaaacagcctcactcctcagcgttaccgccacacttgaatttctccgaatgtcaaggttccctcccactctatttttttaggttaaagttaattggcatatggaatgttttaatctcctctgaaatgtgtagcgtaggcttttcccaagggtcgctagaaactcgtcttcgcgttgccccctttctggctctcagcgccgtcgccactcgggagaggctgggtgaggcccgtgtgaggactgaccctggattcctcgaaactgccattgtgatcattactctgctctttggaaatggctgtatcatttttttgtactaatgtgaattgttcctcagaaacgcttcttttccatcctagtgagaagctggccctgcaggtggtggcagcaatggtgttgtaagatttcctcccgtagttttttctcctcatggatttgaatgaaatgccaataacacgtccactttcaacgtgtagtttacgcggagcactttcgaggcctggccgggttgggcctacttctcacctgggcctatcttctgaactcgctaggttcttatcaacatttgggggataactttgtatatttttttcatttggcttttctttaccagtttctgatttttattctcaatatatttttgctaaacctatttcacaaatcaccaccgactgaagtgtgtgtttactgatgcggccctgagctccatggcgaaaggagtgactttgcagggcgtgagaccgcagtctgcttagagcacaggaagtgacaacttagggagccccgtagggcgctgcaggccccggggaccccagcacgtgggtctaaagagagacggagtctagctctcctgccacccagagtggcttccatctcagcactctgtgggtctggtgatggaagatgcagtctctgctgatcacatgtgccctctgccagggcacctactgagaggtgcggtcctgggggtggaggcctgcctggcaggtgtgcgtgcctcgtacgtgtgttatgggcactggtctaggccaggtatgacacccactctcctgtgagatttcactttagtttttaaaaggtccagttctacagagtgagacctatctatctgagtactacatatgttttaagacttggttctttttttgagggatccttgaccctgggaagtctggagcaccctgagaagggggcaccatgtgtgcctttgcccacgtgtcctgaggggctgcttgtctgggagggagggagagaacattcagcagcaggtgcttttttatggccttttcttaaaataacctaagggggacacatccatcttgcagagaagtttacagaactccccttgaaaactgctgctgaggctcctgttaaattttctgtggcatcttttatgccttggtaaaaactgcagtgtctttggacctgagagtggctactccgtggttttgtgacctgtaagcgtggggttcaggggtgtgtggccctgcagggtcccacgcctccctgagcactgactggaagtttcactggctggtggctgtcccttctcccatcagggtccccagcaaagttaactacacagaggacccaggggaaacgagctgtgtagccactgacttgctcgcgcggccgtggcctctgaggggcactcgccggttaagacagggtgggagtagtgctttccagttcagactctaacttctcccaaagtgtcctaagaaaatactggatcggctcatagatttatgctccttatgatgccctaacttggaaggttgttctagggacaggccgggcagtgtccccacacacaccttagagtcgaaggccccagggccccgctgtcacttgcccaaaagatcccttccggcaggtaagggactaccaatgcttacgtcaaaacagcagaatcggctttgcagtgcactttggggagcagatattaacttatttttgtgttggacagtagtgaaatcttgtgatttttaatcgctttgataatacttccaaattttatgatttttctgaaggaaataatgcaaacattttaaatatgtttctccccctttccaaaaactgttaaactaatgagcaagtaacactaactttgaatgtctctacaatacccgttgataactcagtggagccaggctttggggtagcggccctgagcttgcagggtttctcgccactggggctgaccacgcccccagctgtgaccgtgggtgtggctggctctcggccctgcccagctttgttctgaggacgtggtgacttcctgaacatcagcttcaatcctccatcattaatgtgaagcaaaacacaaaaaccgccccaatccctcaggattccttggcatccgaaaccagcatctgcacctaaacccatacccacccgtgtgcgcccacagggggatgtgtccgaatgggcagcttaaaatgtggtcacctgtgggggaaactcttcaggcacctgaagtgagaacccagctgtccgtcctcaggccggcctttcttccggcgacacccgtccatggctggctgggtccccttcgcagtgtttgtctgtcttgacatctaaaccccggcgtgtgcagtgcccatcttccaggactaccttattttccagaattaaacctgttttataattcaagttaatgcaaatgactgtcagttgccaaatatcttgatcctatgagtgtagttgatgactgtttgttagtcagtagagtaaaatgctgtgtccacggggtgtcacagcctcaccataccctgttgaggtgtgaaatgccccgtcagaaattaaatacaaacttaaatgtgcctattggtgtctaaacttcatacaatgtaaggtcagattccttttaggaatactgggtgctgtcaccaggtttgatagttagacttaaaaacttgaaattcactttttggggggagggatatactgaaatagagagttgagacttgccagttgggggaaaatagcatttaaaatggaaagctgtgtttggaaaattgtgtatgagtatttttgtattaaaaacattttaaaggcttttttcttaa

SEQ ID NO: 440532 - DNA, 6596 bp, Homo sapiens
  misc_feature (12)..(12): n is a, c, g, or t
  misc_feature (86)..(86): n is a, c, g, or t
gggaggcgcggnggcggggtcggcgccgcgcgcgagagcctcggcctggccgcgctgcgcccgccgccgccgccgccccctccccncctgggccctaccgccgcacggccccggccccctcccagcctgccgctccggagagccgcccgccgaggatgcgacgcaccgcagtgttctaagaacggaagcatctgggctggatggaatttagcatcaagcagagtcccctttctgttcagagtgttgtaaagtgcataaagatgaagcaggcaccagaaatcctcggcagtgccaacgggaagactccgagctgcgaggtgaaccgcgagtgttctgtgttcctcagcaaagcccagctctccagtagcctgcaggagggggtcatgcagaagtttaacggccacgacgccctgccctttattccagccgacaagctgaaagatcttacttcccgggtgtttaatggagaacccggcgcacacgatgccaaactgcgttttgagtcccaggaaatgaaagggattgggacaccccctaacactacccctatcaaaaatggctctccagaaattaagctgaaaatcaccaaaacatacatgaatgggaagcctctctttgaatcttccatttgtggtgacagtgctgctgatgtgtctcagtcagaagaaaatggacaaaaaccagaaaacaaggcgagaaggaacaggaagaggagcataaaatatgactccttgctggagcagggccttgtcgaagcagctcttgtgtctaagatctcaagtccttcagataaaaagattccagctaagaaagagtcttgtccaaacactggaagagacaaagaccacctgttgaaatacaacgttggtgatttggtgtggtccaaagtgtcgggttacccttggtggccttgcatggtttctgcagatccactccttcacagctataccaaacttaaaggtcagaaaaagagtgcacgccagtatcacgtacagttctttggtgacgccccagaaagagcttggatatttgagaagagcctcgtagcttttgaaggagaaggacagtttgaaaaattatgccaggaaagtgccaagcaggcacccacgaaagctgagaaaattaagctattgaaaccaatttcagggaaattgagggcccagtgggaaatgggcattgttcaagcagaagaagctgcaagcatgtcagtggaggagcggaaagccaagttcacctttctctatgtgggggaccagcttcatctcaaccctcaagtagccaaggaggctggcattgctgcagagtctttgggagaaatggcagaatcctcaggagtcagtgaagaagctgctgaaaaccccaagtctgtgagagaagagtgcattcccatgaagagaaggcggagggccaaactgtgtagctctgcagagaccctggagagtcaccccgacatagggaagagtactcctcaaaagacggcagaggctgaccccagaagaggagtagggtctcctcctgggaggaagaagaccacagtctccatgccacgaagcaggaagggagatgcagcatcccagtttttggtcttctgtcaaaaacacagggatgaggtggtagctgagcacccagatgcttcaggtgaggagattgaagagctgctcaggtcacagtggagtctgctgagtgagaagcagagagcacgctacaacaccaagtttgccctggtggcccctgtccaggctgaagaagactctggtaatgtaaatgggaaaaaaagaaaccacacaaagaggatacaggaccctacagaagatgctgaagctgaggacacacccaggaaaagactcaggacggacaagcacagtcttcggaagagagacacaatcactgacaaaacggccagaacaagctcttacaaggccatggaggcagcctcctcgctcaagagccaggcagcaacgaaaaatctgtctgatgcatgtaaaccactgaagaagcgaaatcgggcttccacggcagcatcttcagctcttgggtttagcaaaagttcatctccttctgcatccttaactgagaatgagggtaaaataataataataacgataaccatggcattggtatgaaggccatttagctgcccacgctgcagtgtgagtaatgctcagacttcataagcgcagcattggtgctcactgccagtgcagatgttttagggcctcttggctaactcagattcatgaaatggacaaacagtgcactatgttagtttatttgagcactttttatacacacgcacacagtgtctgtgtacatgtacagatatacttcagtcttgatgcagtttcatagttcttaaaatctgtctgaagaatgttgtgttctgtgtagccctcacactgtaagagttcacatggaagtaagtctgcgttggttctgaaagggcacagtgtcagttgagctgacatatactgggtggggtggaaggcgactcacacaccacacctgattcctgttgcttccagacctaggctcatggaggaagccaaagatttctttgttctcatgcatttcatggctttggtcctttaaattctggcacatttttagttacttgagtgttgaggtgagtcagaactaccattgtaatatgactcctgtgttctggacttgcagagtacatgatagcaaaataaagccatttggggctgctgcctgccatcattgtaacatgacacttagactttattatcaaacctaaattttttgccgttgccaaaaacaacaaatagccacagaacgtaggtgtgacacttttttgttcggaggtagttttggtttcctgatttttagggattaccttcatagagctttggagttttaatttcttgttatttggttctccgtgatgctgtttttctcattgtagacatgggtcctgtttttgtcatgtttatgaggagatgataactgggggcccttttggaacagggtagtgaggcaagggttggacaggccccttactcttgctgagtcagaaggcggcacttctggccaggtctctgccatggtccccaggaaggatggggtgtgcctcagttgtttccactcattagaggagtgtaggccttccagtgcaggaaggtcagggacctaggcaacctgggcggggctcatagagctctgcggcttgccactctgaatcctcagcgaccactcctccgagtgggattttctgcagggactcaaaccaactcagtggtggtcgagacctgttcacggatggtgggactggggctgctttacagtttgatacgtgtagataattaagcattttgtgatgtttggacacactggagaaaaggcagtaagaattatttactgaaacatctaggagcttactgaaatatgaaaaggcaaattttatacaaattatttttcctttttcctttctttcttgtccaagttcaggttaaaatcttagaaaattaaatgaaaggtcatttacagttccaaagaagaatattaaacatttttcacttaagttgagatttttgctttaaagagcttttaatgagtttttctgttatcataattttggtccggttattcacttgagttgttgcttatactgttgtcaggtacagtagagagaacatggagcctgctgagatcttctctgttattcctgatcctaagtcatgtatatcgaaggctttgatttagagtaatgcatgaggccagtgtagcggggtcgaggcctgcccatgagtcaggggagctcagtctccctggcctaggcagttgtcctgaccttgagaagacatagatgaagcattttatcatcattagacttaaattttaattcttcagaatgtcagaagttgataggttgttaaatacatttatataatacattaaatatgtgaaattaatacaccttcctacattttgaaggtgatgcatagatcccatagtgtgcatcatgttccttatatgaaaacgtttaaattactgggtcttttccattaaactacttttgtatggcttagataaatcttccattagtgttcatttttatagaattatgctgttaaaactactttaggtgaacaaataaacttgtctattatatattaacgcgactgaactacagtaaatgtttgtgatgtttccaatgctgaatgcctgttagcatatgaggcaaagtgtagtgttataaaaaacagcctgttgactgctgggcccgattctgatatgagttaggtgaccatgagaattgctgtttgaggtccacactgacacacacccattgggtcacaccccctttgcatgtttgtatttcctccctttcatcacatttgtttgaaataaggtacttttatagggttggtatttcagaacactttaggtcatgttgtagtttaaattcttcttgaaaaaggtatatgtgataaataaaaatttttattggaataattattacatggtactacatcaccctgaggaagagaataaattaaaattacacacttgcatgacaaaggcctgtgaaggaattaatgtgatttaagtgttttgtaacttcattttttattcctttagtagagcaaattcttatttttttcgccttcactggtaacagcttttgtgggagcccacaccagtcaagttggatttgaacccagctgctctgtactgcacttagaatgatgtaatattccaggatgctgctgcaggtggcgtatcatcgtacacactcagtgacatttctatcacaatcattttatggaagatgtgtgataatctgtttttactggtattaataaacacatacaatgaagaaaacagataacaaattttaagaccaaggtctcggacagcccgggagacgagccctcggagtccccatacgaaagtgcagacgaaacacaaactgaagtatctgtctcatccaaaaagtctgagcgaggagtgactgccaaaaaggagtatgtgtgccagctgtgtgagaagccgggcagcctcctgctctgtgaaggaccctgctgcggagctttccacctcgcctgccttgggctttcccggaggccagaagggaggttcacctgcagcgagtgtgcctcaggtgtcgcccggcacagtctggggtctgtgaggatgatgagaggacacctgcacagccgtggcccttcctgcctactcaccgggcccaaggagtctcctatctcacgtcagaacacttcctgggtcaggaagacacctggagagtctcccaggccatggcagccccacagcagcacctcacttatgggagtgtctgtctgcctgcccagaatgataagtgactgctccaccactggccagctgctctcaaggaggaaaggcctcttttcataggagccccttctttcaagcttcttgccagttagactgggcctccccagccaggctgcctagtaagattctcctgtatttcaggtgaagctggagctcagatcgcagcaaggtaatccttgatggctggatctttttgctggagaatgcttggactagtgagcaaggttggaaacagggccaggtgctttagcagcgtggctgcctctgaagaggagttgcttgattttagtggctcagaactgcaatttaattcttgttctttgcacctctctctccaccccttctttaactttttgttagggattcactcatgtttcgtgtgtaaagagagcaagacagatgttaagcgctgtgtggtaactcagtgtggaaaattttaccatgaggcttgtgtgaaaaaataccctctgactgtatttgagagccgaggtttccgctgccccctccacagctgtgtgagctgccatgcttccaacccttcaaacccaaggccgtcaaaaggtacaggtgcacctgcgcagccttgctgtgggttcagatgcaggccagacgcaggcccatgggcgcttgggaaggtgggctgttgggattgtcaccaaagagcattaattatcttgagtgactaactggacatcggctgggttgggttttctttgacaaaggacctgtctcccttttccttctttccatcctaaatatcaccctaaagatgcttaactataggagaggggcaacctttggaccatttgatagattttgtttaccctggctgcactacagtgggaatggaggggccagagcccctgtcctggatgtgcagggcaggctgtccccagagatggtgctgtgcaccaggaggctccgccggttgacgaaggagctgcagctctggctctgtttgagggaaagtagagtgggctccaccttccagcacccgcatttcagagatgacaggcgccagtgggaaaacagtagcgtcttgttccacttggtgatgagacagtctgagaacgggcggagtgccctggggggcgaatcatggcacctagggcgccctcgtacacctccgtttgcgaagctgagggcacccgcacacatggggttcccccgcacgggggcacgaccactgagagagacctcacacacacaggcccccaccagggggcccagggaccggtttgccactccccttcttcgct

SEQ ID NO: 440533 - DNA, 2479 bp, Homo sapiens
  misc_feature (12)..(12): n is a, c, g, or t
  misc_feature (86)..(86): n is a, c, g, or t
gggaggcgcggnggcggggtcggcgccgcgcgcgagagcctcggcctggccgcgctgcgcccgccgccgccgccgccccctccccncctgggccctaccgccgcacggccccggccccctcccagcctgccgctccggagagccgcccgccgaggatgcgacgcaccgcagtgttctaagaacggaagcatctgggctggatggaatttagcatcaagcagagtcccctttctgttcagagtgttgtaaagtgcataaagatgaagcaggcaccagaaatcctcggcagtgccaacgggaagactccgagctgcgaggtgaaccgcgagtgttctgtgttcctcagcaaagcccagctctccagtagcctgcaggagggggtcatgcagaagtttaacggccacgacgccctgccctttattccagccgacaagctgaaagatcttacttcccgggtgtttaatggagaacccggcgcacacgatgccaaactgcgttttgagtcccaggaaatgaaagggattgggacaccccctaacactacccctatcaaaaatggctctccagaaattaagctgaaaatcaccaaaacatacatgaatgggaagcctctctttgaatcttccatttgtggtgacagtgctgctgatgtgtctcagtcagaagaaaatggacaaaaaccagaaaacaaggcgagaaggaacaggaagaggagcataaaatatgactccttgctggagcagggccttgtcgaagcagctcttgtgtctaagatctcaagtccttcagataaaaagattccagctaagaaagagtcttgtccaaacactggaagagacaaagaccacctgttgaaatacaacgttggtgatttggtgtggtccaaagtgtcgggttacccttggtggccttgcatggtttctgcagatccactccttcacagctataccaaacttaaaggtcagaaaaagagtgcacgccagtatcacgtacagttctttggtgacgccccagaaagagcttggatatttgagaagagcctcgtagcttttgaaggagaaggacagtttgaaaaattatgccaggaaagtgccaagcaggcacccacgaaagctgagaaaattaagctattgaaaccaatttcagggaaattgagggcccagtgggaaatgggcattgttcaagcagaagaagctgcaagcatgtcagtggaggagcggaaagccaagttcacctttctctatgtgggggaccagcttcatctcaaccctcaagtagccaaggaggctggcattgctgcagagtctttgggagaaatggcagaatcctcaggagtcagtgaagaagctgctgaaaaccccaagtctgtgagagaagagtgcattcccatgaagagaaggcggagggccaaactgtgtagctctgcagagaccctggagagtcaccccgacatagggaagagtactcctcaaaagacggcagaggctgaccccagaagaggagtagggtctcctcctgggaggaagaagaccacagtctccatgccacgaagcaggaagggagatgcagcatcccagtttttggtcttctgtcaaaaacacagggatgaggtggtagctgagcacccagatgcttcaggtgaggagattgaagagctgctcaggtcacagtggagtctgctgagtgagaagcagagagcacgctacaacaccaagtttgccctggtggcccctgtccaggctgaagaagactctggtaatgtaaatgggaaaaaaagaaaccacacaaagaggatacaggaccctacagaagatgctgaagctgaggacacacccaggaaaagactcaggacggacaagcacagtcttcggaagagagacacaatcactgacaaaacggccagaacaagctcttacaaggccatggaggcagcctcctcgctcaagagccaggcagcaacgaaaaatctgtctgatgcatgtaaaccactgaagaagcgaaatcgggcttccacggcagcatcttcagctcttgggtttagcaaaagttcatctccttctgcatccttaactgagaatgaggtctcggacagcccgggagacgagccctcggagtccccatacgaaagtgcagacgaaacacaaactgaagtatctgtctcatccaaaaagtctgagcgaggagtgactgccaaaaaggagtatgtgtgccagctgtgtgagaagccgggcagcctcctgctctgtgaaggaccctgctgcggagctttccacctcgcctgccttgggctttcccggaggccagaagggaggttcacctgcagcgagtgtgcctcaggcaagttcccacgggcgggcagctctgcagcctggccggccacctgctcctgcaaccccctgcaccaagtcctgccctgagctgcctgcagaggacaagccccctccccacccccaccgcctggccctctctggagcttgta

SEQ ID NO: 440534 - DNA, 2141 bp, Homo sapiens
  misc_feature (12)..(12): n is a, c, g, or t
  misc_feature (86)..(86): n is a, c, g, or t
gggaggcgcggnggcggggtcggcgccgcgcgcgagagcctcggcctggccgcgctgcgcccgccgccgccgccgccccctccccncctgggccctaccgccgcacggccccggccccctcccagcctgccgctccggagagccgcccgccgaggatgcgacgcaccgcagtgttctaagaacggaagcatctgggctggatggaatttagcatcaagcagagtcccctttctgttcagagtgttgtaaagtgcataaagatgaagcaggcaccagaaatcctcggcagtgccaacgggaagactccgagctgcgaggtgaaccgcgagtgttctgtgttcctcagcaaagcccagctctccagtagcctgcaggagggggtcatgcagaagtttaacggccacgacgccctgccctttattccagccgacaagctgaaagatcttacttcccgggtgtttaatggagaacccggcgcacacgatgccaaactgcgttttgagtcccaggaaatgaaagggattgggacaccccctaacactacccctatcaaaaatggctctccagaaattaagctgaaaatcaccaaaacatacatgaatgggaagcctctctttgaatcttccatttgtggtgacagtgctgctgatgtgtctcagtcagaagaaaatggacaaaaaccagaaaacaaggcgagaaggaacaggaagaggagcataaaatatgactccttgctggagcagggccttgtcgaagcagctcttgtgtctaagatctcaagtccttcagataaaaagattccagctaagaaagagtcttgtccaaacactggaagagacaaagaccacctgttgaaatacaacgttggtgatttggtgtggtccaaagtgtcgggttacccttggtggccttgcatggtttctgcagatccactccttcacagctataccaaacttaaaggtcagaaaaagagtgcacgccagtatcacgtacagttctttggtgacgccccagaaagagcttggatatttgagaagagcctcgtagcttttgaaggagaaggacagtttgaaaaattatgccaggaaagtgccaagcaggcacccacgaaagctgagaaaattaagctattgaaaccaatttcagggaaattgagggcccagtgggaaatgggcattgttcaagcagaagaagctgcaagcatgtcagtggaggagcggaaagccaagttcacctttctctatgtgggggaccagcttcatctcaaccctcaagtagccaaggaggctggcattgctgcagagtctttgggagaaatggcagaatcctcaggagtcagtgaagaagctgctgaaaaccccaagtctgtgagagaagagtgcattcccatgaagagaaggcggagggccaaactgtgtagctctgcagagaccctggagagtcaccccgacatagggaagagtactcctcaaaagacggcagaggctgaccccagaagaggagtagggtctcctcctgggaggaagaagaccacagtctccatgccacgaagcaggaagggagatgcagcatcccagtttttggtcttctgtcaaaaacacagggatgaggtggtagctgagcacccagatgcttcaggtgaggagattgaagagctgctcaggtcacagtggagtctgctgagtgagaagcagagagcacgctacaacaccaagtttgccctggtggcccctgtccaggctgaagaagactctggtaatgtaaatgggaaaaaaagaaaccacacaaagaggatacaggaccctacagaagatgctgaagctgaggacacacccaggaaaagactcaggacggacaagcacagtcttcggaagagagacacaatcactgacaaaacggccagaacaagctcttacaaggccatggaggcagcctcctcgctcaagagccaggcagcaacgaaaaatctgtctgatgcatgtaaaccactgaagaagcgaaatcgggcttccacggcagcatcttcagctcttgggtttagcaaaagttcatctccttctgcatccttaactgagaatgagtggaaaatgaaggtctttcggacaagccccggggagaccaagccccctcgggaggtcccc

SEQ ID NO: 440535 - DNA, 1167 bp, Homo sapiens
  misc_feature (12)..(12): n is a, c, g, or t
  misc_feature (86)..(86): n is a, c, g, or t
gggaggcgcggnggcggggtcggcgccgcgcgcgagagcctcggcctggccgcgctgcgcccgccgccgccgccgccccctccccncctgggccctaccgccgcacggccccggccccctcccagcctgccgctccggagagccgcccgccgaggatgcgacgcaccgcagtgttctaagaacggaagcatctgggctggatggaatttagcatcaagcagagtcccctttctgttcagagtgttgtaaagtgcataaagatgaagcaggcaccagaaatcctcggcagtgccaacgggaagactccgagctgcgaggtgaaccgcgagtgttctgtgttcctcagcaaagcccagctctccagtagcctgcaggagggggtcatgcagaagtttaacggccacgacgccctgccctttattccagccgacaagctgaaagatcttacttcccgggtgtttaatggagaacccggcgcacacgatgccaaactgcgttttgagtcccaggaaatgaaagggattgggacaccccctaacactacccctatcaaaaatggctctccagaaattaagctgaaaatcaccaaaacatacatgaatgggaagcctctctttgaatcttccatttgtggtgacagtgctgctgatgtgtctcagtcagaagaaaatggacaaaaaccagaaaacaaggcgagaaggaacaggaagaggagcataaaatatgactccttgctggagcagggccttgtcgaagcagctcttgtgtctaagatctcaagtccttcagataaaaagattccagctaagaaagagtcttgtccaaacactggaagagacaaagaccacctgttgaaatacaacgttggtgatttggtgtggtccaaagtgtcgggttacccttggtggccttgcatggtttctgcagatccactccttcacagctataccaaacttaaaggtcagaaaaagagtgcacgccagtatcacgtacagttctttggtgacgccccagaaagagcttggatatttgagaagagcctcgtagcttttgaaggagaaggacagtttgaaaaattatgccaggaaagtgccaagcaggcacccacgaaagctgagaaaattaaggtgatagatgacccttcagtctacttttagaccagaaatt

SEQ ID NO: 440536 - DNA, 8545 bp, Homo sapiens
  misc_feature (12)..(12): n is a, c, g, or t
  misc_feature (86)..(86): n is a, c, g, or t
gggaggcgcggnggcggggtcggcgccgcgcgcgagagcctcggcctggccgcgctgcgcccgccgccgccgccgccccctccccncctgggccctaccgccgcacggccccggccccctcccagcctgccgctccggagagccgcccgccgaggatgcgacgcaccgcagtgttctaagaacggaagcatctgggctggatggaatttagcatcaagcagagtcccctttctgttcagagtgttgtaaagtgcataaagatgaagcaggcaccagaaatcctcggcagtgccaacgggaagactccgagctgcgaggtgaaccgcgagtgttctgtgttcctcagcaaagcccagctctccagtagcctgcaggagggggtcatgcagaagtttaacggccacgacgccctgccctttattccagccgacaagctgaaagatcttacttcccgggtgtttaatggagaacccggcgcacacgatgccaaactgcgttttgagtcccaggaaatgaaagggattgggacaccccctaacactacccctatcaaaaatggctctccagaaattaagctgaaaatcaccaaaacatacatgaatgggaagcctctctttgaatcttccatttgtggtgacagtgctgctgatgtgtctcagtcagaagaaaatggacaaaaaccagaaaacaaggcgagaaggaacaggaagaggagcataaaatatgactccttgctggagcagggccttgtcgaagcagctcttgtgtctaagatctcaagtccttcagataaaaagattccagctaagaaagagtcttgtccaaacactggaagagacaaagaccacctgttgaaatacaacgttggtgatttggtgtggtccaaagtgtcgggttacccttggtggccttgcatggtttctgcagatccactccttcacagctataccaaacttaaaggtcagaaaaagagtgcacgccagtatcacgtacagttctttggtgacgccccagaaagagcttggatatttgagaagagcctcgtagcttttgaaggagaaggacagtttgaaaaattatgccaggaaagtgccaagcaggcacccacgaaagctgagaaaattaagctattgaaaccaatttcagggaaattgagggcccagtgggaaatgggcattgttcaagcagaagaagctgcaagcatgtcagtggaggagcggaaagccaagttcacctttctctatgtgggggaccagcttcatctcaaccctcaagtagccaaggaggctggcattgctgcagagtctttgggagaaatggcagaatcctcaggagtcagtgaagaagctgctgaaaaccccaagtctgtgagagaagagtgcattcccatgaagagaaggcggagggccaaactgtgtagctctgcagagaccctggagagtcaccccgacatagggaagagtactcctcaaaagacggcagaggctgaccccagaagaggagtagggtctcctcctgggaggaagaagaccacagtctccatgccacgaagcaggaagggagatgcagcatcccagtttttggtcttctgtcaaaaacacagggatgaggtggtagctgagcacccagatgcttcaggtgaggagattgaagagctgctcaggtcacagtggagtctgctgagtgagaagcagagagcacgctacaacaccaagtttgccctggtggcccctgtccaggctgaagaagactctggtaatgtaaatgggaaaaaaagaaaccacacaaagaggatacaggaccctacagaagatgctgaagctgaggacacacccaggaaaagactcaggacggacaagcacagtcttcggaagagagacacaatcactgacaaaacggccagaacaagctcttacaaggccatggaggcagcctcctcgctcaagagccaggcagcaacgaaaaatctgtctgatgcatgtaaaccactgaagaagcgaaatcgggcttccacggcagcatcttcagctcttgggtttagcaaaagttcatctccttctgcatccttaactgagaatgagggtaaaataataataataacgataaccatggcattggtatgaaggccatttagctgcccacgctgcagtgtgagtaatgctcagacttcataagcgcagcattggtgctcactgccagtgcagatgttttagggcctcttggctaactcagattcatgaaatggacaaacagtgcactatgttagtttatttgagcactttttatacacacgcacacagtgtctgtgtacatgtacagatatacttcagtcttgatgcagtttcatagttcttaaaatctgtctgaagaatgttgtgttctgtgtagccctcacactgtaagagttcacatggaagtaagtctgcgttggttctgaaagggcacagtgtcagttgagctgacatatactgggtggggtggaaggcgactcacacaccacacctgattcctgttgcttccagacctaggctcatggaggaagccaaagatttctttgttctcatgcatttcatggctttggtcctttaaattctggcacatttttagttacttgagtgttgaggtgagtcagaactaccattgtaatatgactcctgtgttctggacttgcagagtacatgatagcaaaataaagccatttggggctgctgcctgccatcattgtaacatgacacttagactttattatcaaacctaaattttttgccgttgccaaaaacaacaaatagccacagaacgtaggtgtgacacttttttgttcggaggtagttttggtttcctgatttttagggattaccttcatagagctttggagttttaatttcttgttatttggttctccgtgatgctgtttttctcattgtagacatgggtcctgtttttgtcatgtttatgaggagatgataactgggggcccttttggaacagggtagtgaggcaagggttggacaggccccttactcttgctgagtcagaaggcggcacttctggccaggtctctgccatggtccccaggaaggatggggtgtgcctcagttgtttccactcattagaggagtgtaggccttccagtgcaggaaggtcagggacctaggcaacctgggcggggctcatagagctctgcggcttgccactctgaatcctcagcgaccactcctccgagtgggattttctgcagggactcaaaccaactcagtggtggtcgagacctgttcacggatggtgggactggggctgctttacagtttgatacgtgtagataattaagcattttgtgatgtttggacacactggagaaaaggcagtaagaattatttactgaaacatctaggagcttactgaaatatgaaaaggcaaattttatacaaattatttttcctttttcctttctttcttgtccaagttcaggttaaaatcttagaaaattaaatgaaaggtcatttacagttccaaagaagaatattaaacatttttcacttaagttgagatttttgctttaaagagcttttaatgagtttttctgttatcataattttggtccggttattcacttgagttgttgcttatactgttgtcaggtacagtagagagaacatggagcctgctgagatcttctctgttattcctgatcctaagtcatgtatatcgaaggctttgatttagagtaatgcatgaggccagtgtagcggggtcgaggcctgcccatgagtcaggggagctcagtctccctggcctaggcagttgtcctgaccttgagaagacatagatgaagcattttatcatcattagacttaaattttaattcttcagaatgtcagaagttgataggttgttaaatacatttatataatacattaaatatgtgaaattaatacaccttcctacattttgaaggtgatgcatagatcccatagtgtgcatcatgttccttatatgaaaacgtttaaattactgggtcttttccattaaactacttttgtatggcttagataaatcttccattagtgttcatttttatagaattatgctgttaaaactactttaggtgaacaaataaacttgtctattatatattaacgcgactgaactacagtaaatgtttgtgatgtttccaatgctgaatgcctgttagcatatgaggcaaagtgtagtgttataaaaaacagcctgttgactgctgggcccgattctgatatgagttaggtgaccatgagaattgctgtttgaggtccacactgacacacacccattgggtcacaccccctttgcatgtttgtatttcctccctttcatcacatttgtttgaaataaggtacttttatagggttggtatttcagaacactttaggtcatgttgtagtttaaattcttcttgaaaaaggtatatgtgataaataaaaatttttattggaataattattacatggtactacatcaccctgaggaagagaataaattaaaattacacacttgcatgacaaaggcctgtgaaggaattaatgtgatttaagtgttttgtaacttcattttttattcctttagtagagcaaattcttatttttttcgccttcactggtaacagcttttgtgggagcccacaccagtcaagttggatttgaacccagctgctctgtactgcacttagaatgatgtaatattccaggatgctgctgcaggtggcgtatcatcgtacacactcagtgacatttctatcacaatcattttatggaagatgtgtgataatctgtttttactggtattaataaacacatacaatgaagaaaacagataacaaattttaagaccaaggtctcggacagcccgggagacgagccctcggagtccccatacgaaagtgcagacgaaacacaaactgaagtatctgtctcatccaaaaagtctgagcgaggagtgactgccaaaaaggagtatgtgtgccagctgtgtgagaagccgggcagcctcctgctctgtgaaggaccctgctgcggagctttccacctcgcctgccttgggctttcccggaggccagaagggaggttcacctgcagcgagtgtgcctcaggtgtcgcccggcacagtctggggtctgtgaggatgatgagaggacacctgcacagccgtggcccttcctgcctactcaccgggcccaaggagtctcctatctcacgtcagaacacttcctgggtcaggaagacacctggagagtctcccaggccatggcagccccacagcagcacctcacttatgggagtgtctgtctgcctgcccagaatgataagtgactgctccaccactggccagctgctctcaaggaggaaaggcctcttttcataggagccccttctttcaagcttcttgccagttagactgggcctccccagccaggctgcctagtaagattctcctgtatttcaggtgaagctggagctcagatcgcagcaaggtaatccttgatggctggatctttttgctggagaatgcttggactagtgagcaaggttggaaacagggccaggtgctttagcagcgtggctgcctctgaagaggagttgcttgattttagtggctcagaactgcaatttaattcttgttctttgcacctctctctccaccccttctttaactttttgttagggattcactcatgtttcgtgtgtaaagagagcaagacagatgttaagcgctgtgtggtaactcagtgtggaaaattttaccatgaggcttgtgtgaaaaaataccctctgactgtatttgagagccgaggtttccgctgccccctccacagctgtgtgagctgccatgcttccaacccttcaaacccaaggccgtcaaaaggtaaaatgatgcggtgtgtccgctgccccgttgcctatcacagcggggatgcttgtctggcagcaggatgctcagtgatcgcctccaacagcatcatctgcactgcccacttcactgctcggaaggggaagcgacaccacgcccacgtcaacgtgagctggtgcttcgtgtgctccaaaggggggagccttctgtgctgtgagtcctgcccagcggccttccaccctgactgcctgaacatcgagatgcctgacggcagctggttctgcaatgactgcagggctgggaagaagctgcacttccaggatatcatttgggtgaaacttgggaactacagatggtggccggcagaagtttgccatcccaaaaatgttcccccaaatattcagaaaatgaagcacgagattggagaattccctgtgtttttctttgggtctaaagattattactggacgcatcaggcgcgagtgttcccgtacatggagggggaccggggcagccgctaccagggggtcagagggatcggaagagtcttcaaaaacgcactgcaagaagctgaagctcgttttcgtgaaattaagcttcagagggaagcccgagaaacacaggagagcgagcgcaagcccccaccatacaagcacatcaaggtgaataagccttacgggaaagtccagatctacacagcggatatttcagaaatccctaagtgcaactgcaagcccacagatgagaatccttgtggctttgattcggagtgtctgaacaggatgctgatgtttgagtgccacccgcaggtgtgtcccgcgggcgagttctgccagaaccagtgcttcaccaagcgccagtacccagagaccaagatcatcaagacagatggcaaagggtggggcctggtcgccaagagggacatcagaaagggagaatttgttaacgagtacgttggggagctgatcgacgaggaggagtgcatggcgagaatcaagcacgcacacgagaacgacatcacccacttctacatgctcactatagacaaggaccgtataatagacgctggccccaaaggaaactactctcgatttatgaatcacagctgccagcccaactgtgagaccctcaagtggacagtgaatggggacactcgtgtgggcctgtttgccgtctgtgacattcctgcagggacggagctgacttttaactacaacctcgattgtctgggcaatgaaaaaacggtctgccggtgtggagcctccaattgcagtggattcctcggggatagaccaaagacctcgacgaccctttcatcagaggaaaagggcaaaaagaccaagaagaaaacgaggcggcgcagagcaaaaggggaagggaagaggcagtcagaggacgagtgcttccgctgcggtgatggcgggcagctggtgctgtgtgaccgcaagttctgcaccaaggcctaccacctgtcctgcctgggccttggcaagcggcccttcgggaagtgggaatgtccttggcatcattgtgacgtgtgtggcaaaccttcgacttcattttgccacctctgccccaattcgttctgtaaggagcaccaggacgggacagccttcagctgcaccccggacgggcggtcctactgctgtgagcatgacttaggggcggcatcggtcagaagcaccaagactgagaagccccccccagagccagggaagccgaaggggaagaggcggcggcggaggggctggcggagagtcacagagggcaaatagcgccaggcggccgcttggccggatccaggggcggtgcagggcggccggccctgcctgcgggagagggcgagcatgaactggcccggaggacccagctcgagccgccaggacacagacgtacaggcctcctcgggagggagcgcctccccaccactgagccatcctcagcagcgtccgctgcgtctgcactgatgaccgtctgagcccagctcagcgttcctggacaaacagcctcactcctcagcgttaccgccacacttgaatttctccgaatgtcaaggttccctcccactctatttttttaggttaaagttaattggcatatggaatgttttaatctcctctgaaatgtgtagcgtaggcttttcccaagggtcgctagaaactcgtcttcgcgttgccccctttctggctctcagcgccgtcgccactcgggagaggctgggtgaggcccgtgtgaggactgaccctggattcctcgaaactgccattgtgatcattactctgctctttggaaatggctgtatcatttttttgtactaatgtgaattgttcctcagaaacgcttcttttccatcctagtgagaagctggccctgcaggtggtggcagcaatggtgttgtaagatttcctcccgtagttttttctcctcatggatttgaatgaaatgccaataacacgtccactttcaacgtgtagtttacgcggagcactttcgaggcctggccgggttgggcctacttctcacctgggcctatcttctgaactcgctaggttcttatcaacatttgggggataactttgtatatttttttcatttggcttttctttaccagtttctgatttttattctcaatatatttttgctaaacctatttcacaaatca

SEQ ID NO: 440537 - DNA, 9985 bp, Homo sapiens
tttttattgacgaaaagacagatactatatttggatgtgacaggtgttttttcttttgtacaagagtgcagaactgtttacagtacataaacatcagcgtggaaaatgctagtacatatataaaggtgaacatcagtaccagctgtttccacaaagcccactcttggtaagaatcttctttgtggcaaaaaagcttggcatcaatgtaggctgaaatttatatcattagaaatcaatgtcattaaaggagatatgggagttaccttagaaatattaactccttctctagctaggaaaggccagaagtaaaactgttaaaatcatcatcatgtgcttcagcgccttctcggcttcatctggattctcaaactctacgtacgcatagcctttggacagatggggatgcatcctttccacgggcatgaagagaaggcggagggccaaactgtgtagctctgcagagaccctggagagtcaccccgacatagggaagagtactcctcaaaagacggcagaggctgaccccagaagaggagtagggtctcctcctgggaggaagaagaccacagtctccatgccacgaagcaggaagggagatgcagcatcccagtttttggtcttctgtcaaaaacacagggatgaggtggtagctgagcacccagatgcttcaggtgaggagattgaagagctgctcaggtcacagtggagtctgctgagtgagaagcagagagcacgctacaacaccaagtttgccctggtggcccctgtccaggctgaagaagactctggtaatgtaaatgggaaaaaaagaaaccacacaaagaggatacaggaccctacagaagatgctgaagctgaggacacacccaggaaaagactcaggacggacaagcacagtcttcggaagagagacacaatcactgacaaaacggccagaacaagctcttacaaggccatggaggcagcctcctcgctcaagagccaggcagcaacgaaaaatctgtctgatgcatgtaaaccactgaagaagcgaaatcgggcttccacggcagcatcttcagctcttgggtttagcaaaagttcatctccttctgcatccttaactgagaatgagggtaaaataataataataacgataaccatggcattggtatgaaggccatttagctgcccacgctgcagtgtgagtaatgctcagacttcataagcgcagcattggtgctcactgccagtgcagatgttttagggcctcttggctaactcagattcatgaaatggacaaacagtgcactatgttagtttatttgagcactttttatacacacgcacacagtgtctgtgtacatgtacagatatacttcagtcttgatgcagtttcatagttcttaaaatctgtctgaagaatgttgtgttctgtgtagccctcacactgtaagagttcacatggaagtaagtctgcgttggttctgaaagggcacagtgtcagttgagctgacatatactgggtggggtggaaggcgactcacacaccacacctgattcctgttgcttccagacctaggctcatggaggaagccaaagatttctttgttctcatgcatttcatggctttggtcctttaaattctggcacatttttagttacttgagtgttgaggtgagtcagaactaccattgtaatatgactcctgtgttctggacttgcagagtacatgatagcaaaataaagccatttggggctgctgcctgccatcattgtaacatgacacttagactttattatcaaacctaaattttttgccgttgccaaaaacaacaaatagccacagaacgtaggtgtgacacttttttgttcggaggtagttttggtttcctgatttttagggattaccttcatagagctttggagttttaatttcttgttatttggttctccgtgatgctgtttttctcattgtagacatgggtcctgtttttgtcatgtttatgaggagatgataactgggggcccttttggaacagggtagtgaggcaagggttggacaggccccttactcttgctgagtcagaaggcggcacttctggccaggtctctgccatggtccccaggaaggatggggtgtgcctcagttgtttccactcattagaggagtgtaggccttccagtgcaggaaggtcagggacctaggcaacctgggcggggctcatagagctctgcggcttgccactctgaatcctcagcgaccactcctccgagtgggattttctgcagggactcaaaccaactcagtggtggtcgagacctgttcacggatggtgggactggggctgctttacagtttgatacgtgtagataattaagcattttgtgatgtttggacacactggagaaaaggcagtaagaattatttactgaaacatctaggagcttactgaaatatgaaaaggcaaattttatacaaattatttttcctttttcctttctttcttgtccaagttcaggttaaaatcttagaaaattaaatgaaaggtcatttacagttccaaagaagaatattaaacatttttcacttaagttgagatttttgctttaaagagcttttaatgagtttttctgttatcataattttggtccggttattcacttgagttgttgcttatactgttgtcaggtacagtagagagaacatggagcctgctgagatcttctctgttattcctgatcctaagtcatgtatatcgaaggctttgatttagagtaatgcatgaggccagtgtagcggggtcgaggcctgcccatgagtcaggggagctcagtctccctggcctaggcagttgtcctgaccttgagaagacatagatgaagcattttatcatcattagacttaaattttaattcttcagaatgtcagaagttgataggttgttaaatacatttatataatacattaaatatgtgaaattaatacaccttcctacattttgaaggtgatgcatagatcccatagtgtgcatcatgttccttatatgaaaacgtttaaattactgggtcttttccattaaactacttttgtatggcttagataaatcttccattagtgttcatttttatagaattatgctgttaaaactactttaggtgaacaaataaacttgtctattatatattaacgcgactgaactacagtaaatgtttgtgatgtttccaatgctgaatgcctgttagcatatgaggcaaagtgtagtgttataaaaaacagcctgttgactgctgggcccgattctgatatgagttaggtgaccatgagaattgctgtttgaggtccacactgacacacacccattgggtcacaccccctttgcatgtttgtatttcctccctttcatcacatttgtttgaaataaggtacttttatagggttggtatttcagaacactttaggtcatgttgtagtttaaattcttcttgaaaaaggtatatgtgataaataaaaatttttattggaataattattacatggtactacatcaccctgaggaagagaataaattaaaattacacacttgcatgacaaaggcctgtgaaggaattaatgtgatttaagtgttttgtaacttcattttttattcctttagtagagcaaattcttatttttttcgccttcactggtaacagcttttgtgggagcccacaccagtcaagttggatttgaacccagctgctctgtactgcacttagaatgatgtaatattccaggatgctgctgcaggtggcgtatcatcgtacacactcagtgacatttctatcacaatcattttatggaagatgtgtgataatctgtttttactggtattaataaacacatacaatgaagaaaacagataacaaattttaagaccaaggtctcggacagcccgggagacgagccctcggagtccccatacgaaagtgcagacgaaacacaaactgaagtatctgtctcatccaaaaagtctgagcgaggagtgactgccaaaaaggagtatgtgtgccagctgtgtgagaagccgggcagcctcctgctctgtgaaggaccctgctgcggagctttccacctcgcctgccttgggctttcccggaggccagaagggaggttcacctgcagcgagtgtgcctcaggtgtcgcccggcacagtctggggtctgtgaggatgatgagaggacacctgcacagccgtggcccttcctgcctactcaccgggcccaaggagtctcctatctcacgtcagaacacttcctgggtcaggaagacacctggagagtctcccaggccatggcagccccacagcagcacctcacttatgggagtgtctgtctgcctgcccagaatgataagtgactgctccaccactggccagctgctctcaaggaggaaaggcctcttttcataggagccccttctttcaagcttcttgccagttagactgggcctccccagccaggctgcctagtaagattctcctgtatttcaggtgaagctggagctcagatcgcagcaaggtaatccttgatggctggatctttttgctggagaatgcttggactagtgagcaaggttggaaacagggccaggtgctttagcagcgtggctgcctctgaagaggagttgcttgattttagtggctcagaactgcaatttaattcttgttctttgcacctctctctccaccccttctttaactttttgttagggattcactcatgtttcgtgtgtaaagagagcaagacagatgttaagcgctgtgtggtaactcagtgtggaaaattttaccatgaggcttgtgtgaaaaaataccctctgactgtatttgagagccgaggtttccgctgccccctccacagctgtgtgagctgccatgcttccaacccttcaaacccaaggccgtcaaaaggtaaaatgatgcggtgtgtccgctgccccgttgcctatcacagcggggatgcttgtctggcagcaggatgctcagtgatcgcctccaacagcatcatctgcactgcccacttcactgctcggaaggggaagcgacaccacgcccacgtcaacgtgagctggtgcttcgtgtgctccaaaggggggagccttctgtgctgtgagtcctgcccagcggccttccaccctgactgcctgaacatcgagatgcctgacggcagctggttctgcaatgactgcagggctgggaagaagctgcacttccaggatatcatttgggtgaaacttgggaactacagatggtggccggcagaagtttgccatcccaaaaatgttcccccaaatattcagaaaatgaagcacgagattggagaattccctgtgtttttctttgggtctaaagattattactggacgcatcaggcgcgagtgttcccgtacatggagggggaccggggcagccgctaccagggggtcagagggatcggaagagtcttcaaaaacgcactgcaagaagctgaagctcgttttcgtgaaattaagcttcagagggaagcccgagaaacacaggagagcgagcgcaagcccccaccatacaagcacatcaaggtgaataagccttacgggaaagtccagatctacacagcggatatttcagaaatccctaagtgcaactgcaagcccacagatgagaatccttgtggctttgattcggagtgtctgaacaggatgctgatgtttgagtgccacccgcaggtgtgtcccgcgggcgagttctgccagaaccagtgcttcaccaagcgccagtacccagagaccaagatcatcaagacagatggcaaagggtggggcctggtcgccaagagggacatcagaaagggagaatttgttaacgagtacgttggggagctgatcgacgaggaggagtgcatggcgagaatcaagcacgcacacgagaacgacatcacccacttctacatgctcactatagacaaggaccgtataatagacgctggccccaaaggaaactactctcgatttatgaatcacagctgccagcccaactgtgagaccctcaagtggacagtgaatggggacactcgtgtgggcctgtttgccgtctgtgacattcctgcagggacggagctgacttttaactacaacctcgattgtctgggcaatgaaaaaacggtctgccggtgtggagcctccaattgcagtggattcctcggggatagaccaaagacctcgacgaccctttcatcagaggaaaagggcaaaaagaccaagaagaaaacgaggcggcgcagagcaaaaggggaagggaagaggcagtcagaggacgagtgcttccgctgcggtgatggcgggcagctggtgctgtgtgaccgcaagttctgcaccaaggcctaccacctgtcctgcctgggccttggcaagcggcccttcgggaagtgggaatgtccttggcatcattgtgacgtgtgtggcaaaccttcgacttcattttgccacctctgccccaattcgttctgtaaggagcaccaggacgggacagccttcagctgcaccccggacgggcggtcctactgctgtgagcatgacttaggggcggcatcggtcagaagcaccaagactgagaagccccccccagagccagggaagccgaaggggaagaggcggcggcggaggggctggcggagagtcacagagggcaaatagcgccaggcggccgcttggccggatccaggggcggtgcagggcggccggccctgcctgcgggagagggcgagcatgaactggcccggaggacccagctcgagccgccaggacacagacgtacaggcctcctcgggagggagcgcctccccaccactgagccatcctcagcagcgtccgctgcgtctgcactgatgaccgtctgagcccagctcagcgttcctggacaaacagcctcactcctcagcgttaccgccacacttgaatttctccgaatgtcaaggttccctcccactctatttttttaggttaaagttaattggcatatggaatgttttaatctcctctgaaatgtgtagcgtaggcttttcccaagggtcgctagaaactcgtcttcgcgttgccccctttctggctctcagcgccgtcgccactcgggagaggctgggtgaggcccgtgtgaggactgaccctggattcctcgaaactgccattgtgatcattactctgctctttggaaatggctgtatcatttttttgtactaatgtgaattgttcctcagaaacgcttcttttccatcctagtgagaagctggccctgcaggtggtggcagcaatggtgttgtaagatttcctcccgtagttttttctcctcatggatttgaatgaaatgccaataacacgtccactttcaacgtgtagtttacgcggagcactttcgaggcctggccgggttgggcctacttctcacctgggcctatcttctgaactcgctaggttcttatcaacatttgggggataactttgtatatttttttcatttggcttttctttaccagtttctgatttttattctcaatatatttttgctaaacctatttcacaaatcaccaccgactgaagtgtgtgtttactgatgcggccctgagctccatggcgaaaggagtgactttgcagggcgtgagaccgcagtctgcttagagcacaggaagtgacaacttagggagccccgtagggcgctgcaggccccggggaccccagcacgtgggtctaaagagagacggagtctagctctcctgccacccagagtggcttccatctcagcactctgtgggtctggtgatggaagatgcagtctctgctgatcacatgtgccctctgccagggcacctactgagaggtgcggtcctgggggtggaggcctgcctggcaggtgtgcgtgcctcgtacgtgtgttatgggcactggtctaggccaggtatgacacccactctcctgtgagatttcactttagtttttaaaaggtccagttctacagagtgagacctatctatctgagtactacatatgttttaagacttggttctttttttgagggatccttgaccctgggaagtctggagcaccctgagaagggggcaccatgtgtgcctttgcccacgtgtcctgaggggctgcttgtctgggagggagggagagaacattcagcagcaggtgcttttttatggccttttcttaaaataacctaagggggacacatccatcttgcagagaagtttacagaactccccttgaaaactgctgctgaggctcctgttaaattttctgtggcatcttttatgccttggtaaaaactgcagtgtctttggacctgagagtggctactccgtggttttgtgacctgtaagcgtggggttcaggggtgtgtggccctgcagggtcccacgcctccctgagcactgactggaagtttcactggctggtggctgtcccttctcccatcagggtccccagcaaagttaactacacagaggacccaggggaaacgagctgtgtagccactgacttgctcgcgcggccgtggcctctgaggggcactcgccggttaagacagggtgggagtagtgctttccagttcagactctaacttctcccaaagtgtcctaagaaaatactggatcggctcatagatttatgctccttatgatgccctaacttggaaggttgttctagggacaggccgggcagtgtccccacacacaccttagagtcgaaggccccagggccccgctgtcacttgcccaaaagatcccttccggcaggtaagggactaccaatgcttacgtcaaaacagcagaatcggctttgcagtgcactttggggagcagatattaacttatttttgtgttggacagtagtgaaatcttgtgatttttaatcgctttgataatacttccaaattttatgatttttctgaaggaaataatgcaaacattttaaatatgtttctccccctttccaaaaactgttaaactaatgagcaagtaacactaactttgaatgtctctacaatacccgttgataactcagtggagccaggctttggggtagcggccctgagcttgcagggtttctcgccactggggctgaccacgcccccagctgtgaccgtgggtgtggctggctctcggccctgcccagctttgttctgaggacgtggtgacttcctgaacatcagcttcaatcctccatcattaatgtgaagcaaaacacaaaaaccgccccaatccctcaggattccttggcatccgaaaccagcatctgcacctaaacccatacccacccgtgtgcgcccacagggggatgtgtccgaatgggcagcttaaaatgtggtcacctgtgggggaaactcttcaggcacctgaagtgagaacccagctgtccgtcctcaggccggcctttcttccggcgacacccgtccatggctggctgggtccccttcgcagtgtttgtctgtcttgacatctaaaccccggcgtgtgcagtgcccatcttccaggactaccttattttccagaattaaacctgttttataattcaagttaatgcaaatgactgtcagttgccaaatatcttgatcctatgagtgtagttgatgactgtttgttagtcagtagagtaaaatgctgtgtccacggggtgtcacagcctcaccataccctgttgaggtgtgaaatgccccgtcagaaattaaatacaaacttaaatgtgcctattggtgtctaaacttcatacaatgtaaggtcagattccttttaggaatactgggtgctgtcaccaggtttgatagttagacttaaaaacttgaaattcactttttggggggagggatatactgaaatagagagttgagacttgccagttgggggaaaatagcatttaaaatggaaagctgtgtttggaaaattgtgtatgagtatttttgtattaaaaacattttaaaggcttttttcttaa

SEQ ID NO: 440538 - DNA, 11324 bp, Homo sapiens
  misc_feature (12)..(12): n is a, c, g, or t
  misc_feature (86)..(86): n is a, c, g, or t
  misc_feature (10974)..(10974): n is a, c, g, or t
  misc_feature (10978)..(10978): n is a, c, g, or t
  misc_feature (10987)..(10987): n is a, c, g, or t
  misc_feature (10997)..(10997): n is a, c, g, or t
  misc_feature (11003)..(11003): n is a, c, g, or t
  misc_feature (11005)..(11005): n is a, c, g, or t
gggaggcgcggnggcggggtcggcgccgcgcgcgagagcctcggcctggccgcgctgcgcccgccgccgccgccgccccctccccncctgggccctaccgccgcacggccccggccccctcccagcctgccgctccggagagccgcccgccgaggatgcgacgcaccgcagtgttctaagaacggaagcatctgggctggatggaatttagcatcaagcagagtcccctttctgttcagagtgttgtaaagtgcataaagatgaagcaggcaccagaaatcctcggcagtgccaacgggaagactccgagctgcgaggtgaaccgcgagtgttctgtgttcctcagcaaagcccagctctccagtagcctgcaggagggggtcatgcagaagtttaacggccacgacgccctgccctttattccagccgacaagctgaaagatcttacttcccgggtgtttaatggagaacccggcgcacacgatgccaaactgcgttttgagtcccaggaaatgaaagggattgggacaccccctaacactacccctatcaaaaatggctctccagaaattaagctgaaaatcaccaaaacatacatgaatgggaagcctctctttgaatcttccatttgtggtgacagtgctgctgatgtgtctcagtcagaagaaaatggacaaaaaccagaaaacaaggcgagaaggaacaggaagaggagcataaaatatgactccttgctggagcagggccttgtcgaagcagctcttgtgtctaagatctcaagtccttcagataaaaagattccagctaagaaagagtcttgtccaaacactggaagagacaaagaccacctgttgaaatacaacgttggtgatttggtgtggtccaaagtgtcgggttacccttggtggccttgcatggtttctgcagatccactccttcacagctataccaaacttaaaggtcagaaaaagagtgcacgccagtatcacgtacagttctttggtgacgccccagaaagagcttggatatttgagaagagcctcgtagcttttgaaggagaaggacagtttgaaaaattatgccaggaaagtgccaagcaggcacccacgaaagctgagaaaattaagctattgaaaccaatttcagggaaattgagggcccagtgggaaatgggcattgttcaagcagaagaagctgcaagcatgtcagtggaggagcggaaagccaagttcacctttctctatgtgggggaccagcttcatctcaaccctcaagtagccaaggaggctggcattgctgcagagtctttgggagaaatggcagaatcctcaggagtcagtgaagaagctgctgaaaaccccaagtctgtgagagaagagtgcattcccatgaagagaaggcggagggccaaactgtgtagctctgcagagaccctggagagtcaccccgacatagggaagagtactcctcaaaagacggcagaggctgaccccagaagaggagtagggtctcctcctgggaggaagaagaccacagtctccatgccacgaagcaggaagggagatgcagcatcccagtttttggtcttctgtcaaaaacacagggatgaggtggtagctgagcacccagatgcttcaggtgaggagattgaagagctgctcaggtcacagtggagtctgctgagtgagaagcagagagcacgctacaacaccaagtttgccctggtggcccctgtccaggctgaagaagactctggtaatgtaaatgggaaaaaaagaaaccacacaaagaggatacaggaccctacagaagatgctgaagctgaggacacacccaggaaaagactcaggacggacaagcacagtcttcggaagagagacacaatcactgacaaaacggccagaacaagctcttacaaggccatggaggcagcctcctcgctcaagagccaggcagcaacgaaaaatctgtctgatgcatgtaaaccactgaagaagcgaaatcgggcttccacggcagcatcttcagctcttgggtttagcaaaagttcatctccttctgcatccttaactgagaatgagggtaaaataataataataacgataaccatggcattggtatgaaggccatttagctgcccacgctgcagtgtgagtaatgctcagacttcataagcgcagcattggtgctcactgccagtgcagatgttttagggcctcttggctaactcagattcatgaaatggacaaacagtgcactatgttagtttatttgagcactttttatacacacgcacacagtgtctgtgtacatgtacagatatacttcagtcttgatgcagtttcatagttcttaaaatctgtctgaagaatgttgtgttctgtgtagccctcacactgtaagagttcacatggaagtaagtctgcgttggttctgaaagggcacagtgtcagttgagctgacatatactgggtggggtggaaggcgactcacacaccacacctgattcctgttgcttccagacctaggctcatggaggaagccaaagatttctttgttctcatgcatttcatggctttggtcctttaaattctggcacatttttagttacttgagtgttgaggtgagtcagaactaccattgtaatatgactcctgtgttctggacttgcagagtacatgatagcaaaataaagccatttggggctgctgcctgccatcattgtaacatgacacttagactttattatcaaacctaaattttttgccgttgccaaaaacaacaaatagccacagaacgtaggtgtgacacttttttgttcggaggtagttttggtttcctgatttttagggattaccttcatagagctttggagttttaatttcttgttatttggttctccgtgatgctgtttttctcattgtagacatgggtcctgtttttgtcatgtttatgaggagatgataactgggggcccttttggaacagggtagtgaggcaagggttggacaggccccttactcttgctgagtcagaaggcggcacttctggccaggtctctgccatggtccccaggaaggatggggtgtgcctcagttgtttccactcattagaggagtgtaggccttccagtgcaggaaggtcagggacctaggcaacctgggcggggctcatagagctctgcggcttgccactctgaatcctcagcgaccactcctccgagtgggattttctgcagggactcaaaccaactcagtggtggtcgagacctgttcacggatggtgggactggggctgctttacagtttgatacgtgtagataattaagcattttgtgatgtttggacacactggagaaaaggcagtaagaattatttactgaaacatctaggagcttactgaaatatgaaaaggcaaattttatacaaattatttttcctttttcctttctttcttgtccaagttcaggttaaaatcttagaaaattaaatgaaaggtcatttacagttccaaagaagaatattaaacatttttcacttaagttgagatttttgctttaaagagcttttaatgagtttttctgttatcataattttggtccggttattcacttgagttgttgcttatactgttgtcaggtacagtagagagaacatggagcctgctgagatcttctctgttattcctgatcctaagtcatgtatatcgaaggctttgatttagagtaatgcatgaggccagtgtagcggggtcgaggcctgcccatgagtcaggggagctcagtctccctggcctaggcagttgtcctgaccttgagaagacatagatgaagcattttatcatcattagacttaaattttaattcttcagaatgtcagaagttgataggttgttaaatacatttatataatacattaaatatgtgaaattaatacaccttcctacattttgaaggtgatgcatagatcccatagtgtgcatcatgttccttatatgaaaacgtttaaattactgggtcttttccattaaactacttttgtatggcttagataaatcttccattagtgttcatttttatagaattatgctgttaaaactactttaggtgaacaaataaacttgtctattatatattaacgcgactgaactacagtaaatgtttgtgatgtttccaatgctgaatgcctgttagcatatgaggcaaagtgtagtgttataaaaaacagcctgttgactgctgggcccgattctgatatgagttaggtgaccatgagaattgctgtttgaggtccacactgacacacacccattgggtcacaccccctttgcatgtttgtatttcctccctttcatcacatttgtttgaaataaggtacttttatagggttggtatttcagaacactttaggtcatgttgtagtttaaattcttcttgaaaaaggtatatgtgataaataaaaatttttattggaataattattacatggtactacatcaccctgaggaagagaataaattaaaattacacacttgcatgacaaaggcctgtgaaggaattaatgtgatttaagtgttttgtaacttcattttttattcctttagtagagcaaattcttatttttttcgccttcactggtaacagcttttgtgggagcccacaccagtcaagttggatttgaacccagctgctctgtactgcacttagaatgatgtaatattccaggatgctgctgcaggtggcgtatcatcgtacacactcagtgacatttctatcacaatcattttatggaagatgtgtgataatctgtttttactggtattaataaacacatacaatgaagaaaacagataacaaattttaagaccaaggtctcggacagcccgggagacgagccctcggagtccccatacgaaagtgcagacgaaacacaaactgaagtatctgtctcatccaaaaagtctgagcgaggagtgactgccaaaaaggagtatgtgtgccagctgtgtgagaagccgggcagcctcctgctctgtgaaggaccctgctgcggagctttccacctcgcctgccttgggctttcccggaggccagaagggaggttcacctgcagcgagtgtgcctcaggtgtcgcccggcacagtctggggtctgtgaggatgatgagaggacacctgcacagccgtggcccttcctgcctactcaccgggcccaaggagtctcctatctcacgtcagaacacttcctgggtcaggaagacacctggagagtctcccaggccatggcagccccacagcagcacctcacttatgggagtgtctgtctgcctgcccagaatgataagtgactgctccaccactggccagctgctctcaaggaggaaaggcctcttttcataggagccccttctttcaagcttcttgccagttagactgggcctccccagccaggctgcctagtaagattctcctgtatttcaggtgaagctggagctcagatcgcagcaaggtaatccttgatggctggatctttttgctggagaatgcttggactagtgagcaaggttggaaacagggccaggtgctttagcagcgtggctgcctctgaagaggagttgcttgattttagtggctcagaactgcaatttaattcttgttctttgcacctctctctccaccccttctttaactttttgttagggattcactcatgtttcgtgtgtaaagagagcaagacagatgttaagcgctgtgtggtaactcagtgtggaaaattttaccatgaggcttgtgtgaaaaaataccctctgactgtatttgagagccgaggtttccgctgccccctccacagctgtgtgagctgccatgcttccaacccttcaaacccaaggccgtcaaaaggtaaaatgatgcggtgtgtccgctgccccgttgcctatcacagcggggatgcttgtctggcagcaggatgctcagtgatcgcctccaacagcatcatctgcactgcccacttcactgctcggaaggggaagcgacaccacgcccacgtcaacgtgagctggtgcttcgtgtgctccaaaggggggagccttctgtgctgtgagtcctgcccagcggccttccaccctgactgcctgaacatcgagatgcctgacggcagctggttctgcaatgactgcagggctgggaagaagctgcacttccaggatatcatttgggtgaaacttgggaactacagatggtggccggcagaagtttgccatcccaaaaatgttcccccaaatattcagaaaatgaagcacgagattggagaattccctgtgtttttctttgggtctaaagattattactggacgcatcaggcgcgagtgttcccgtacatggagggggaccggggcagccgctaccagggggtcagagggatcggaagagtcttcaaaaacgcactgcaagaagctgaagctcgttttcgtgaaattaagcttcagagggaagcccgagaaacacaggagagcgagcgcaagcccccaccatacaagcacatcaaggtgaataagccttacgggaaagtccagatctacacagcggatatttcagaaatccctaagtgcaactgcaagcccacagatgagaatccttgtggctttgattcggagtgtctgaacaggatgctgatgtttgagtgccacccgcaggtgtgtcccgcgggcgagttctgccagaaccagtgcttcaccaagcgccagtacccagagaccaagatcatcaagacagatggcaaagggtggggcctggtcgccaagagggacatcagaaagggagaatttgttaacgagtacgttggggagctgatcgacgaggaggagtgcatggcgagaatcaagcacgcacacgagaacgacatcacccacttctacatgctcactatagacaaggaccgtataatagacgctggccccaaaggaaactactctcgatttatgaatcacagctgccagcccaactgtgagaccctcaagtggacagtgaatggggacactcgtgtgggcctgtttgccgtctgtgacattcctgcagggacggagctgacttttaactacaacctcgattgtctgggcaatgaaaaaacggtctgccggtgtggagcctccaattgcagtggattcctcggggatagaccaaagacctcgacgaccctttcatcagaggaaaagggcaaaaagaccaagaagaaaacgaggcggcgcagagcaaaaggggaagggaagaggcagtcagaggacgagtgcttccgctgcggtgatggcgggcagctggtgctgtgtgaccgcaagttctgcaccaaggcctaccacctgtcctgcctgggccttggcaagcggcccttcgggaagtgggaatgtccttggcatcattgtgacgtgtgtggcaaaccttcgacttcattttgccacctctgccccaattcgttctgtaaggagcaccaggacgggacagccttcagctgcaccccggacgggcggtcctactgctgtgagcatgacttaggggcggcatcggtcagaagcaccaagactgagaagccccccccagagccagggaagccgaaggggaagaggcggcggcggaggggctggcggagagtcacagagggcaaatagcgccaggcggccgcttggccggatccaggggcggtgcagggcggccggccctgcctgcgggagagggcgagcatgaactggcccggaggacccagctcgagccgccaggacacagacgtacaggcctcctcgggagggagcgcctccccaccactgagccatcctcagcagcgtccgctgcgtctgcactgatgaccgtctgagcccagctcagcgttcctggacaaacagcctcactcctcagcgttaccgccacacttgaatttctccgaatgtcaaggttccctcccactctatttttttaggttaaagttaattggcatatggaatgttttaatctcctctgaaatgtgtagcgtaggcttttcccaagggtcgctagaaactcgtcttcgcgttgccccctttctggctctcagcgccgtcgccactcgggagaggctgggtgaggcccgtgtgaggactgaccctggattcctcgaaactgccattgtgatcattactctgctctttggaaatggctgtatcatttttttgtactaatgtgaattgttcctcagaaacgcttcttttccatcctagtgagaagctggccctgcaggtggtggcagcaatggtgttgtaagatttcctcccgtagttttttctcctcatggatttgaatgaaatgccaataacacgtccactttcaacgtgtagtttacgcggagcactttcgaggcctggccgggttgggcctacttctcacctgggcctatcttctgaactcgctaggttcttatcaacatttgggggataactttgtatatttttttcatttggcttttctttaccagtttctgatttttattctcaatatatttttgctaaacctatttcacaaatcaccaccgactgaagtgtgtgtttactgatgcggccctgagctccatggcgaaaggagtgactttgcagggcgtgagaccgcagtctgcttagagcacaggaagtgacaacttagggagccccgtagggcgctgcaggccccggggaccccagcacgtgggtctaaagagagacggagtctagctctcctgccacccagagtggcttccatctcagcactctgtgggtctggtgatggaagatgcagtctctgctgatcacatgtgccctctgccagggcacctactgagaggtgcggtcctgggggtggaggcctgcctggcaggtgtgcgtgcctcgtacgtgtgttatgggcactggtctaggccaggtatgacacccactctcctgtgagatttcactttagtttttaaaaggtccagttctacagagtgagacctatctatctgagtactacatatgttttaagacttggttctttttttgagggatccttgaccctgggaagtctggagcaccctgagaagggggcaccatgtgtgcctttgcccacgtgtcctgaggggctgcttgtctgggagggagggagagaacattcagcagcaggtgcttttttatggccttttcttaaaataacctaagggggacacatccatcttgcagagaagtttacagaactccccttgaaaactgctgctgaggctcctgttaaattttctgtggcatcttttatgccttggtaaaaactgcagtgtctttggacctgagagtggctactccgtggttttgtgacctgtaagcgtggggttcaggggtgtgtggccctgcagggtcccacgcctccctgagcactgactggaagtttcactggctggtggctgtcccttctcccatcagggtccccagcaaagttaactacacagaggacccaggggaaacgagctgtgtagccactgacttgctcgcgcggccgtggcctctgaggggcactcgccggttaagacagggtgggagtagtgctttccagttcagactctaacttctcccaaagtgtcctaagaaaatactggatcggctcatagatttatgctccttatgatgccctaacttggaaggttgttctagggacaggccgggcagtgtccccacacacaccttagagtcgaaggccccagggccccgctgtcacttgcccaaaagatcccttccggcaggtaagggactaccaatgcttacgtcaaaacagcagaatcggctttgcagtgcactttggggagcagatattaacttatttttgtgttggacagtagtgaaatcttgtgatttttaatcgctttgataatacttccaaattttatgatttttctgaaggaaataatgcaaacattttaaatatgtttctccccctttccaaaaactgttaaactaatgagcaagtaacactaactttgaatgtctctacaatacccgttgataactcagtggagccaggctttggggtagcggccctgagcttgcagggtttctcgccactggggctgaccacgcccccagctgtgaccgtgggtgtggctggctctcggccctgcccagctttgttctgaggacgtggtgacttcctgaacatcagcttcaatcctccatcattaatgtgaagcaaaacacaaaaaccgccccaatccctcaggattccttggcatccgaaaccagcatctgcacctaaacccatacccacccgtgtgcgcccacagggggatgtgtccgaatgggcagcttaaaatgtggtcacctgtgggggaaactcttcaggcacctgaagtgagaacccagctgtccgtcctcaggccggcctttcttccggcgacacccgtccatggctggctgggtccccttcgcagtgtttgtctgtcttgacatctaaaccccggcgtgtgcagtgcccatcttccaggactaccttattttccagaattaaacctgttttataattcaagttaatgcaaatgactgtcagttgccaaatatcttgatcctatgagtgtagttgatgactgtttgttagtcagtagagtaaaatgctgtgtccacggggtgtcacagcctcaccataccctgttgaggtgtgaaatgccccgtcagaaattaaatacaaacttaaatgtgcctattggtgtctaaacttcatacaatgtaaggtcagattccttttaggaatactgggtgctgtcaccaggtttgatagttagacttaaaaacttgaaattcactttttggggggagggatatactgaaatagagagttgagacttgccagttgggggaaaatagcatttaaaatggaaagctgtgtttggaaaattgtgtatgagtatttttgtattaaaaacattttaaaggcttttttcttaaaaaaaaaaaaaaacaaaaaatnaaanaaaaaaaanaaaaaaaaanaaaaananaaaaaaaaaaaaaaaacttggggcccctttggcccaatcacttttaaacttggccaattttttttgacgcgccccaatttgggtctcattgggaaattgccccttatgggggccttcttaacattacctggcgcggtttttaaaagctataaatggggaaaccccggggggtccccaaattaaaagctttgcacaaaatccccctttccccggtgggcaaatcccaaaggccccgtcccgagcggtctttccaaaaggttgccccctctaataggcaaagggatattttacggcgttaaattttggtaaacataccgtt

SEQ ID NO: 440539 - DNA, 10952 bp, Homo sapiens
  misc_feature (12)..(12): n is a, c, g, or t
  misc_feature (86)..(86): n is a, c, g, or t
gggaggcgcggnggcggggtcggcgccgcgcgcgagagcctcggcctggccgcgctgcgcccgccgccgccgccgccccctccccncctgggccctaccgccgcacggccccggccccctcccagcctgccgctccggagagccgcccgccgaggatgcgacgcaccgcagtgttctaagaacggaagcatctgggctggatggaatttagcatcaagcagagtcccctttctgttcagagtgttgtaaagtgcataaagatgaagcaggcaccagaaatcctcggcagtgccaacgggaagactccgagctgcgaggtgaaccgcgagtgttctgtgttcctcagcaaagcccagctctccagtagcctgcaggagggggtcatgcagaagtttaacggccacgacgccctgccctttattccagccgacaagctgaaagatcttacttcccgggtgtttaatggagaacccggcgcacacgatgccaaactgcgttttgagtcccaggaaatgaaagggattgggacaccccctaacactacccctatcaaaaatggctctccagaaattaagctgaaaatcaccaaaacatacatgaatgggaagcctctctttgaatcttccatttgtggtgacagtgctgctgatgtgtctcagtcagaagaaaatggacaaaaaccagaaaacaaggcgagaaggaacaggaagaggagcataaaatatgactccttgctggagcagggccttgtcgaagcagctcttgtgtctaagatctcaagtccttcagataaaaagattccagctaagaaagagtcttgtccaaacactggaagagacaaagaccacctgttgaaatacaacgttggtgatttggtgtggtccaaagtgtcgggttacccttggtggccttgcatggtttctgcagatccactccttcacagctataccaaacttaaaggtcagaaaaagagtgcacgccagtatcacgtacagttctttggtgacgccccagaaagagcttggatatttgagaagagcctcgtagcttttgaaggagaaggacagtttgaaaaattatgccaggaaagtgccaagcaggcacccacgaaagctgagaaaattaagctattgaaaccaatttcagggaaattgagggcccagtgggaaatgggcattgttcaagcagaagaagctgcaagcatgtcagtggaggagcggaaagccaagttcacctttctctatgtgggggaccagcttcatctcaaccctcaagtagccaaggaggctggcattgctgcagagtctttgggagaaatggcagaatcctcaggagtcagtgaagaagctgctgaaaaccccaagtctgtgagagaagagtgcattcccatgaagagaaggcggagggccaaactgtgtagctctgcagagaccctggagagtcaccccgacatagggaagagtactcctcaaaagacggcagaggctgaccccagaagaggagtagggtctcctcctgggaggaagaagaccacagtctccatgccacgaagcaggaagggagatgcagcatcccagtttttggtcttctgtcaaaaacacagggatgaggtggtagctgagcacccagatgcttcaggtgaggagattgaagagctgctcaggtcacagtggagtctgctgagtgagaagcagagagcacgctacaacaccaagtttgccctggtggcccctgtccaggctgaagaagactctggtaatgtaaatgggaaaaaaagaaaccacacaaagaggatacaggaccctacagaagatgctgaagctgaggacacacccaggaaaagactcaggacggacaagcacagtcttcggaagagagacacaatcactgacaaaacggccagaacaagctcttacaaggccatggaggcagcctcctcgctcaagagccaggcagcaacgaaaaatctgtctgatgcatgtaaaccactgaagaagcgaaatcgggcttccacggcagcatcttcagctcttgggtttagcaaaagttcatctccttctgcatccttaactgagaatgagggtaaaataataataataacgataaccatggcattggtatgaaggccatttagctgcccacgctgcagtgtgagtaatgctcagacttcataagcgcagcattggtgctcactgccagtgcagatgttttagggcctcttggctaactcagattcatgaaatggacaaacagtgcactatgttagtttatttgagcactttttatacacacgcacacagtgtctgtgtacatgtacagatatacttcagtcttgatgcagtttcatagttcttaaaatctgtctgaagaatgttgtgttctgtgtagccctcacactgtaagagttcacatggaagtaagtctgcgttggttctgaaagggcacagtgtcagttgagctgacatatactgggtggggtggaaggcgactcacacaccacacctgattcctgttgcttccagacctaggctcatggaggaagccaaagatttctttgttctcatgcatttcatggctttggtcctttaaattctggcacatttttagttacttgagtgttgaggtgagtcagaactaccattgtaatatgactcctgtgttctggacttgcagagtacatgatagcaaaataaagccatttggggctgctgcctgccatcattgtaacatgacacttagactttattatcaaacctaaattttttgccgttgccaaaaacaacaaatagccacagaacgtaggtgtgacacttttttgttcggaggtagttttggtttcctgatttttagggattaccttcatagagctttggagttttaatttcttgttatttggttctccgtgatgctgtttttctcattgtagacatgggtcctgtttttgtcatgtttatgaggagatgataactgggggcccttttggaacagggtagtgaggcaagggttggacaggccccttactcttgctgagtcagaaggcggcacttctggccaggtctctgccatggtccccaggaaggatggggtgtgcctcagttgtttccactcattagaggagtgtaggccttccagtgcaggaaggtcagggacctaggcaacctgggcggggctcatagagctctgcggcttgccactctgaatcctcagcgaccactcctccgagtgggattttctgcagggactcaaaccaactcagtggtggtcgagacctgttcacggatggtgggactggggctgctttacagtttgatacgtgtagataattaagcattttgtgatgtttggacacactggagaaaaggcagtaagaattatttactgaaacatctaggagcttactgaaatatgaaaaggcaaattttatacaaattatttttcctttttcctttctttcttgtccaagttcaggttaaaatcttagaaaattaaatgaaaggtcatttacagttccaaagaagaatattaaacatttttcacttaagttgagatttttgctttaaagagcttttaatgagtttttctgttatcataattttggtccggttattcacttgagttgttgcttatactgttgtcaggtacagtagagagaacatggagcctgctgagatcttctctgttattcctgatcctaagtcatgtatatcgaaggctttgatttagagtaatgcatgaggccagtgtagcggggtcgaggcctgcccatgagtcaggggagctcagtctccctggcctaggcagttgtcctgaccttgagaagacatagatgaagcattttatcatcattagacttaaattttaattcttcagaatgtcagaagttgataggttgttaaatacatttatataatacattaaatatgtgaaattaatacaccttcctacattttgaaggtgatgcatagatcccatagtgtgcatcatgttccttatatgaaaacgtttaaattactgggtcttttccattaaactacttttgtatggcttagataaatcttccattagtgttcatttttatagaattatgctgttaaaactactttaggtgaacaaataaacttgtctattatatattaacgcgactgaactacagtaaatgtttgtgatgtttccaatgctgaatgcctgttagcatatgaggcaaagtgtagtgttataaaaaacagcctgttgactgctgggcccgattctgatatgagttaggtgaccatgagaattgctgtttgaggtccacactgacacacacccattgggtcacaccccctttgcatgtttgtatttcctccctttcatcacatttgtttgaaataaggtacttttatagggttggtatttcagaacactttaggtcatgttgtagtttaaattcttcttgaaaaaggtatatgtgataaataaaaatttttattggaataattattacatggtactacatcaccctgaggaagagaataaattaaaattacacacttgcatgacaaaggcctgtgaaggaattaatgtgatttaagtgttttgtaacttcattttttattcctttagtagagcaaattcttatttttttcgccttcactggtaacagcttttgtgggagcccacaccagtcaagttggatttgaacccagctgctctgtactgcacttagaatgatgtaatattccaggatgctgctgcaggtggcgtatcatcgtacacactcagtgacatttctatcacaatcattttatggaagatgtgtgataatctgtttttactggtattaataaacacatacaatgaagaaaacagataacaaattttaagaccaaggtctcggacagcccgggagacgagccctcggagtccccatacgaaagtgcagacgaaacacaaactgaagtatctgtctcatccaaaaagtctgagcgaggagtgactgccaaaaaggagtatgtgtgccagctgtgtgagaagccgggcagcctcctgctctgtgaaggaccctgctgcggagctttccacctcgcctgccttgggctttcccggaggccagaagggaggttcacctgcagcgagtgtgcctcaggtgtcgcccggcacagtctggggtctgtgaggatgatgagaggacacctgcacagccgtggcccttcctgcctactcaccgggcccaaggagtctcctatctcacgtcagaacacttcctgggtcaggaagacacctggagagtctcccaggccatggcagccccacagcagcacctcacttatgggagtgtctgtctgcctgcccagaatgataagtgactgctccaccactggccagctgctctcaaggaggaaaggcctcttttcataggagccccttctttcaagcttcttgccagttagactgggcctccccagccaggctgcctagtaagattctcctgtatttcaggtgaagctggagctcagatcgcagcaaggtaatccttgatggctggatctttttgctggagaatgcttggactagtgagcaaggttggaaacagggccaggtgctttagcagcgtggctgcctctgaagaggagttgcttgattttagtggctcagaactgcaatttaattcttgttctttgcacctctctctccaccccttctttaactttttgttagggattcactcatgtttcgtgtgtaaagagagcaagacagatgttaagcgctgtgtggtaactcagtgtggaaaattttaccatgaggcttgtgtgaaaaaataccctctgactgtatttgagagccgaggtttccgctgccccctccacagctgtgtgagctgccatgcttccaacccttcaaacccaaggccgtcaaaaggtaaaatgatgcggtgtgtccgctgccccgttgcctatcacagcggggatgcttgtctggcagcaggatgctcagtgatcgcctccaacagcatcatctgcactgcccacttcactgctcggaaggggaagcgacaccacgcccacgtcaacgtgagctggtgcttcgtgtgctccaaaggggggagccttctgtgctgtgagtcctgcccagcggccttccaccctgactgcctgaacatcgagatgcctgacggcagctggttctgcaatgactgcagggctgggaagaagctgcacttccaggatatcatttgggtgaaacttgggaactacagatggtggccggcagaagtttgccatcccaaaaatgttcccccaaatattcagaaaatgaagcacgagattggagaattccctgtgtttttctttgggtctaaagattattactggacgcatcaggcgcgagtgttcccgtacatggagggggaccggggcagccgctaccagggggtcagagggatcggaagagtcttcaaaaacgcactgcaagaagctgaagctcgttttcgtgaaattaagcttcagagggaagcccgagaaacacaggagagcgagcgcaagcccccaccatacaagcacatcaaggtgaataagccttacgggaaagtccagatctacacagcggatatttcagaaatccctaagtgcaactgcaagcccacagatgagaatccttgtggctttgattcggagtgtctgaacaggatgctgatgtttgagtgccacccgcaggtgtgtcccgcgggcgagttctgccagaaccagtgcttcaccaagcgccagtacccagagaccaagatcatcaagacagatggcaaagggtggggcctggtcgccaagagggacatcagaaagggagaatttgttaacgagtacgttggggagctgatcgacgaggaggagtgcatggcgagaatcaagcacgcacacgagaacgacatcacccacttctacatgctcactatagacaaggaccgtataatagacgctggccccaaaggaaactactctcgatttatgaatcacagctgccagcccaactgtgagaccctcaagtggacagtgaatggggacactcgtgtgggcctgtttgccgtctgtgacattcctgcagggacggagctgacttttaactacaacctcgattgtctgggcaatgaaaaaacggtctgccggtgtggagcctccaattgcagtggattcctcggggatagaccaaagacctcgacgaccctttcatcagaggaaaagggcaaaaagaccaagaagaaaacgaggcggcgcagagcaaaaggggaagggaagaggcagtcagaggacgagtgcttccgctgcggtgatggcgggcagctggtgctgtgtgaccgcaagttctgcaccaaggcctaccacctgtcctgcctgggccttggcaagcggcccttcgggaagtgggaatgtccttggcatcattgtgacgtgtgtggcaaaccttcgacttcattttgccacctctgccccaattcgttctgtaaggagcaccaggacgggacagccttcagctgcaccccggacgggcggtcctactgctgtgagcatgacttaggggcggcatcggtcagaagcaccaagactgagaagccccccccagagccagggaagccgaaggggaagaggcggcggcggaggggctggcggagagtcacagagggcaaatagcgccaggcggccgcttggccggatccaggggcggtgcagggcggccggccctgcctgcgggagagggcgagcatgaactggcccggaggacccagctcgagccgccaggacacagacgtacaggcctcctcgggagggagcgcctccccaccactgagccatcctcagcagcgtccgctgcgtctgcactgatgaccgtctgagcccagctcagcgttcctggacaaacagcctcactcctcagcgttaccgccacacttgaatttctccgaatgtcaaggttccctcccactctatttttttaggttaaagttaattggcatatggaatgttttaatctcctctgaaatgtgtagcgtaggcttttcccaagggtcgctagaaactcgtcttcgcgttgccccctttctggctctcagcgccgtcgccactcgggagaggctgggtgaggcccgtgtgaggactgaccctggattcctcgaaactgccattgtgatcattactctgctctttggaaatggctgtatcatttttttgtactaatgtgaattgttcctcagaaacgcttcttttccatcctagtgagaagctggccctgcaggtggtggcagcaatggtgttgtaagatttcctcccgtagttttttctcctcatggatttgaatgaaatgccaataacacgtccactttcaacgtgtagtttacgcggagcactttcgaggcctggccgggttgggcctacttctcacctgggcctatcttctgaactcgctaggttcttatcaacatttgggggataactttgtatatttttttcatttggcttttctttaccagtttctgatttttattctcaatatatttttgctaaacctatttcacaaatcaccaccgactgaagtgtgtgtttactgatgcggccctgagctccatggcgaaaggagtgactttgcagggcgtgagaccgcagtctgcttagagcacaggaagtgacaacttagggagccccgtagggcgctgcaggccccggggaccccagcacgtgggtctaaagagagacggagtctagctctcctgccacccagagtggcttccatctcagcactctgtgggtctggtgatggaagatgcagtctctgctgatcacatgtgccctctgccagggcacctactgagaggtgcggtcctgggggtggaggcctgcctggcaggtgtgcgtgcctcgtacgtgtgttatgggcactggtctaggccaggtatgacacccactctcctgtgagatttcactttagtttttaaaaggtccagttctacagagtgagacctatctatctgagtactacatatgttttaagacttggttctttttttgagggatccttgaccctgggaagtctggagcaccctgagaagggggcaccatgtgtgcctttgcccacgtgtcctgaggggctgcttgtctgggagggagggagagaacattcagcagcaggtgcttttttatggccttttcttaaaataacctaagggggacacatccatcttgcagagaagtttacagaactccccttgaaaactgctgctgaggctcctgttaaattttctgtggcatcttttatgccttggtaaaaactgcagtgtctttggacctgagagtggctactccgtggttttgtgacctgtaagcgtggggttcaggggtgtgtggccctgcagggtcccacgcctccctgagcactgactggaagtttcactggctggtggctgtcccttctcccatcagggtccccagcaaagttaactacacagaggacccaggggaaacgagctgtgtagccactgacttgctcgcgcggccgtggcctctgaggggcactcgccggttaagacagggtgggagtagtgctttccagttcagactctaacttctcccaaagtgtcctaagaaaatactggatcggctcatagatttatgctccttatgatgccctaacttggaaggttgttctagggacaggccgggcagtgtccccacacacaccttagagtcgaaggccccagggccccgctgtcacttgcccaaaagatcccttccggcaggtaagggactaccaatgcttacgtcaaaacagcagaatcggctttgcagtgcactttggggagcagatattaacttatttttgtgttggacagtagtgaaatcttgtgatttttaatcgctttgataatacttccaaattttatgatttttctgaaggaaataatgcaaacattttaaatatgtttctccccctttccaaaaactgttaaactaatgagcaagtaacactaactttgaatgtctctacaatacccgttgataactcagtggagccaggctttggggtagcggccctgagcttgcagggtttctcgccactggggctgaccacgcccccagctgtgaccgtgggtgtggctggctctcggccctgcccagctttgttctgaggacgtggtgacttcctgaacatcagcttcaatcctccatcattaatgtgaagcaaaacacaaaaaccgccccaatccctcaggattccttggcatccgaaaccagcatctgcacctaaacccatacccacccgtgtgcgcccacagggggatgtgtccgaatgggcagcttaaaatgtggtcacctgtgggggaaactcttcaggcacctgaagtgagaacccagctgtccgtcctcaggccggcctttcttccggcgacacccgtccatggctggctgggtccccttcgcagtgtttgtctgtcttgacatctaaaccccggcgtgtgcagtgcccatcttccaggactaccttattttccagaattaaacctgttttataattcaagttaatgcaaatgactgtcagttgccaaatatcttgatcctatgagtgtagttgatgactgtttgttagtcagtagagtaaaatgctgtgtccacggggtgtcacagcctcaccataccctgttgaggtgtgaaatgccccgtcagaaattaaatacaaacttaaatgtgcctattggtgtctaaacttcatacaatgtaaggtcagattccttttaggaatactgggtgctgtcaccaggtttgatagttagacttaaaaacttgaaattcactttttggggggagggatatactgaaatagagagttgagacttgccagttgggggaaaatagcatttaaaatggaaagctgtgtttggaaaattgtgtatgagtatttttgtattaaaaacattttaaaggcttttttcttaa

SEQ ID NO: 440540 - DNA, 8731 bp, Homo sapiens
agagatgggtctcgccatcaccatgttgcccagtctggtctccaactcctgggctcaagcgatcctcctgccttggtctcccaaagtgctgggattacaggtgtgagcccccacacccggcctgagtgagtgggttctgaatggtgactgttgttgtccatagccttccccctgcttctgagagtggagtccctcccctcatgttggagacctcccaaggtccatgtggtcctataggggctgttcagcctccctagccccttaacgtgtcaggtaatactgtatatattccatgaaatgtgaataattagttatataattcctaagcacttattttaaaaaacagcaatgtgatgcttaactcttcccacctctgttcctgtcccccttagaaaaccactgataactctttttttttttgagacggagtcttgccctgtcgcccaggctggagtgtagtggcctgatctcggctcggctcattgtaacctccgcctcgggtttgagcgattctcctgcctcagcctcctgagtagctgggattataggcgtgcaccaccacgcctggctaattttttgtatctttagtagggacgggtttcaccatgttggccagagtggtcttgaactcctgaccttgtgatccgctcgcctcagcctcccaaagtgctgggattacaggcatgagccaccgtgcctgtcctagaaccactggtaactcttaactgagacaagatttcgccatgttgcccaggctggtctcgaacttctgagctcaagcgatctacctgcctcgtcctcccaaagtgttggaattgcaggtgtgagccactgcacccggcccttgcctcatgtttgaatgataatttacctgggcataaaattctggacacttgtggtggcacgagctgtctgcttttctgtggagactgcgggttgcagacaccagcagccccctattgctgcacgtcaggtgtcctccacctcagtactgtggacatctcgggccgcatagccctgttgcgcgggcatcctgtgcgttgcaggagatgcagcagcatccatgaccgcaacccatcagagtgttctaagaacggaagcatctgggctggatggaatttagcatcaagcagagtcccctttctgttcagagtgttgtaaagtgcataaagatgaagcaggcaccagaaatcctcggcagtgccaacgggaagactccgagctgcgaggtgaaccgcgagtgttctgtgttcctcagcaaagcccagctctccagtagcctgcaggagggggtcatgcagaagtttaacggccacgacgccctgccctttattccagccgacaagctgaaagatcttacttcccgggtgtttaatggagaacccggcgcacacgatgccaaactgcgttttgagtcccaggaaatgaaagggattgggacaccccctaacactacccctatcaaaaatggctctccagaaattaagctgaaaatcaccaaaacatacatgaatgggaagcctctctttgaatcttccatttgtggtgacagtgctgctgatgtgtctcagtcagaagaaaatggacaaaaaccagaaaacaaggcgagaaggaacaggaagaggagcataaaatatgactccttgctggagcagggccttgtcgaagcagctcttgtgtctaagatctcaagtccttcagataaaaagattccagctaagaaagagtcttgtccaaacactggaagagacaaagaccacctgttgaaatacaacgttggtgatttggtgtggtccaaagtgtcgggttacccttggtggccttgcatggtttctgcagatccactccttcacagctataccaaacttaaaggtcagaaaaagagtgcacgccagtatcacgtacagttctttggtgacgccccagaaagagcttggatatttgagaagagcctcgtagcttttgaaggagaaggacagtttgaaaaattatgccaggaaagtgccaagcaggcacccacgaaagctgagaaaattaagctattgaaaccaatttcagggaaattgagggcccagtgggaaatgggcattgttcaagcagaagaagctgcaagcatgtcagtggaggagcggaaagccaagttcacctttctctatgtgggggaccagcttcatctcaaccctcaagtagccaaggaggctggcattgctgcagagtctttgggagaaatggcagaatcctcaggagtcagtgaagaagctgctgaaaaccccaagtctgtgagagaagagtgcattcccatgaagagaaggcggagggccaaactgtgtagctctgcagagaccctggagagtcaccccgacatagggaagagtactcctcaaaagacggcagaggctgaccccagaagaggagtagggtctcctcctgggaggaagaagaccacagtctccatgccacgaagcaggaagggagatgcagcatcccagtttttggtcttctgtcaaaaacacagggatgaggtggtagctgagcacccagatgcttcaggtgaggagattgaagagctgctcaggtcacagtggagtctgctgagtgagaagcagagagcacgctacaacaccaagtttgccctggtggcccctgtccaggctgaagaagactctggtaatgtaaatgggaaaaaaagaaaccacacaaagaggatacaggaccctacagaagatgctgaagctgaggacacacccaggaaaagactcaggacggacaagcacagtcttcggaagagagacacaatcactgacaaaacggccagaacaagctcttacaaggccatggaggcagcctcctcgctcaagagccaggcagcaacgaaaaatctgtctgatgcatgtaaaccactgaagaagcgaaatcgggcttccacggcagcatcttcagctcttgggtttagcaaaagttcatctccttctgcatccttaactgagaatgagcttttgtgggagcccacaccagtcaagttggatttgaacccagctgctctgtactgcacttagaatgatgtaatattccaggatgctgctgcaggtggcgtatcatcgtacacactcagtgacatttctatcacaatcattttatggaagatgtgtgataatctgtttttactggtattaataaacacatacaatgaagaaaacagataacaaattttaagaccaaggtctcggacagcccgggagacgagccctcggagtccccatacgaaagtgcagacgaaacacaaactgaagtatctgtctcatccaaaaagtctgagcgaggagtgactgccaaaaaggagtatgtgtgccagctgtgtgagaagccgggcagcctcctgctctgtgaaggaccctgctgcggagctttccacctcgcctgccttgggctttcccggaggccagaagggaggttcacctgcagcgagtgtgcctcagggattcactcatgtttcgtgtgtaaagagagcaagacagatgttaagcgctgtgtggtaactcagtgtggaaaattttaccatgaggcttgtgtgaaaaaataccctctgactgtatttgagagccgaggtttccgctgccccctccacagctgtgtgagctgccatgcttccaacccttcaaacccaaggccgtcaaaaggtaaaatgatgcggtgtgtccgctgccccgttgcctatcacagcggggatgcttgtctggcagcaggatgctcagtgatcgcctccaacagcatcatctgcactgcccacttcactgctcggaaggggaagcgacaccacgcccacgtcaacgtgagctggtgcttcgtgtgctccaaaggggggagccttctgtgctgtgagtcctgcccagcggccttccaccctgactgcctgaacatcgagatgcctgacggcagctggttctgcaatgactgcagggctgggaagaagctgcacttccaggatatcatttgggtgaaacttgggaactacagatggtggccggcagaagtttgccatcccaaaaatgttcccccaaatattcagaaaatgaagcacgagattggagaattccctgtgtttttctttgggtctaaagattattactggacgcatcaggcgcgagtgttcccgtacatggagggggaccggggcagccgctaccagggggtcagagggatcggaagagtcttcaaaaacgcactgcaagaagctgaagctcgttttcgtgaaattaagcttcagagggaagcccgagaaacacaggagagcgagcgcaagcccccaccatacaagcacatcaaggtgaataagccttacgggaaagtccagatctacacagcggatatttcagaaatccctaagtgcaactgcaagcccacagatgagaatccttgtggctttgattcggagtgtctgaacaggatgctgatgtttgagtgccacccgcaggtgtgtcccgcgggcgagttctgccagaaccagtgcttcaccaagcgccagtacccagagaccaagatcatcaagacagatggcaaagggtggggcctggtcgccaagagggacatcagaaagggagaatttgttaacgagtacgttggggagctgatcgacgaggaggagtgcatggcgagaatcaagcacgcacacgagaacgacatcacccacttctacatgctcactatagacaaggaccgtataatagacgctggccccaaaggaaactactctcgatttatgaatcacagctgccagcccaactgtgagaccctcaagtggacagtgaatggggacactcgtgtgggcctgtttgccgtctgtgacattcctgcagggacggagctgacttttaactacaacctcgattgtctgggcaatgaaaaaacggtctgccggtgtggagcctccaattgcagtggattcctcggggatagaccaaagacctcgacgaccctttcatcagaggaaaagggcaaaaagaccaagaagaaaacgaggcggcgcagagcaaaaggggaagggaagaggcagtcagaggacgagtgcttccgctgcggtgatggcgggcagctggtgctgtgtgaccgcaagttctgcaccaaggcctaccacctgtcctgcctgggccttggcaagcggcccttcgggaagtgggaatgtccttggcatcattgtgacgtgtgtggcaaaccttcgacttcattttgccacctctgccccaattcgttctgtaaggagcaccaggacgggacagccttcagctgcaccccggacgggcggtcctactgctgtgagcatgacttaggggcggcatcggtcagaagcaccaagactgagaagccccccccagagccagggaagccgaaggggaagaggcggcggcggaggggctggcggagagtcacagagggcaaatagcgccaggcggccgcttggccggatccaggggcggtgcagggcggccggccctgcctgcgggagagggcgagcatgaactggcccggaggacccagctcgagccgccaggacacagacgtacaggcctcctcgggagggagcgcctccccaccactgagccatcctcagcagcgtccgctgcgtctgcactgatgaccgtctgagcccagctcagcgttcctggacaaacagcctcactcctcagcgttaccgccacacttgaatttctccgaatgtcaaggttccctcccactctatttttttaggttaaagttaattggcatatggaatgttttaatctcctctgaaatgtgtagcgtaggcttttcccaagggtcgctagaaactcgtcttcgcgttgccccctttctggctctcagcgccgtcgccactcgggagaggctgggtgaggcccgtgtgaggactgaccctggattcctcgaaactgccattgtgatcattactctgctctttggaaatggctgtatcatttttttgtactaatgtgaattgttcctcagaaacgcttcttttccatcctagtgagaagctggccctgcaggtggtggcagcaatggtgttgtaagatttcctcccgtagttttttctcctcatggatttgaatgaaatgccaataacacgtccactttcaacgtgtagtttacgcggagcactttcgaggcctggccgggttgggcctacttctcacctgggcctatcttctgaactcgctaggttcttatcaacatttgggggataactttgtatatttttttcatttggcttttctttaccagtttctgatttttattctcaatatatttttgctaaacctatttcacaaatcaccaccgactgaagtgtgtgtttactgatgcggccctgagctccatggcgaaaggagtgactttgcagggcgtgagaccgcagtctgcttagagcacaggaagtgacaacttagggagccccgtagggcgctgcaggccccggggaccccagcacgtgggtctaaagagagacggagtctagctctcctgccacccagagtggcttccatctcagcactctgtgggtctggtgatggaagatgcagtctctgctgatcacatgtgccctctgccagggcacctactgagaggtgcggtcctgggggtggaggcctgcctggcaggtgtgcgtgcctcgtacgtgtgttatgggcactggtctaggccaggtatgacacccactctcctgtgagatttcactttagtttttaaaaggtccagttctacagagtgagacctatctatctgagtactacatatgttttaagacttggttctttttttgagggatccttgaccctgggaagtctggagcaccctgagaagggggcaccatgtgtgcctttgcccacgtgtcctgaggggctgcttgtctgggagggagggagagaacattcagcagcaggtgcttttttatggccttttcttaaaataacctaagggggacacatccatcttgcagagaagtttacagaactccccttgaaaactgctgctgaggctcctgttaaattttctgtggcatcttttatgccttggtaaaaactgcagtgtctttggacctgagagtggctactccgtggttttgtgacctgtaagcgtggggttcaggggtgtgtggccctgcagggtcccacgcctccctgagcactgactggaagtttcactggctggtggctgtcccttctcccatcagggtccccagcaaagttaactacacagaggacccaggggaaacgagctgtgtagccactgacttgctcgcgcggccgtggcctctgaggggcactcgccggttaagacagggtgggagtagtgctttccagttcagactctaacttctcccaaagtgtcctaagaaaatactggatcggctcatagatttatgctccttatgatgccctaacttggaaggttgttctagggacaggccgggcagtgtccccacacacaccttagagtcgaaggccccagggccccgctgtcacttgcccaaaagatcccttccggcaggtaagggactaccaatgcttacgtcaaaacagcagaatcggctttgcagtgcactttggggagcagatattaacttatttttgtgttggacagtagtgaaatcttgtgatttttaatcgctttgataatacttccaaattttatgatttttctgaaggaaataatgcaaacattttaaatatgtttctccccctttccaaaaactgttaaactaatgagcaagtaacactaactttgaatgtctctacaatacccgttgataactcagtggagccaggctttggggtagcggccctgagcttgcagggtttctcgccactggggctgaccacgcccccagctgtgaccgtgggtgtggctggctctcggccctgcccagctttgttctgaggacgtggtgacttcctgaacatcagcttcaatcctccatcattaatgtgaagcaaaacacaaaaaccgccccaatccctcaggattccttggcatccgaaaccagcatctgcacctaaacccatacccacccgtgtgcgcccacagggggatgtgtccgaatgggcagcttaaaatgtggtcacctgtgggggaaactcttcaggcacctgaagtgagaacccagctgtccgtcctcaggccggcctttcttccggcgacacccgtccatggctggctgggtccccttcgcagtgtttgtctgtcttgacatctaaaccccggcgtgtgcagtgcccatcttccaggactaccttattttccagaattaaacctgttttataattcaagttaatgcaaatgactgtcagttgccaaatatcttgatcctatgagtgtagttgatgactgtttgttagtcagtagagtaaaatgctgtgtccacggggtgtcacagcctcaccataccctgttgaggtgtgaaatgccccgtcagaaattaaatacaaacttaaatgtgcctattggtgtctaaacttcatacaatgtaaggtcagattccttttaggaatactgggtgctgtcaccaggtttgatagttagacttaaaaacttgaaattcactttttggggggagggatatactgaaatagagagttgagacttgccagttgggggaaaatagcatttaaaatggaaagctgtgtttggaaaattgtgtatgagtatttttgtattaaaaacattttaaaggcttttttcttaa

SEQ ID NO: 440541 - DNA, 658 bp, Homo sapiens
agctagagggcgcgcgcggctgaaagcgtgtggaggcgcgggctgcagttcggatgtctgtgtggcggggagggggcggcggccgggagagacgactccgccccctgcgcgcatgctccggccccggcgggttataaggcagcctcgctggcccggccagacaaagtggtgagctgcgacgtgactggctagctgcgtgggtactggaacaagcaaacgaggcagcgagcgaaggacgggagccggaccctgggccccgtggaactccagcctgcgccaccacgtcacgcacacgctcggcgctgcgatccgcgcatataacgatatttggatttgacctgcattttggaatttatctacacttaaaatgccaccagcagttggaggtccagttggatacacccccccagatggaggctggggctgggcagtggtaattggagctttcatttccatcggcttctcttatgcatttcccaaatcaattactgtcttcttcaaagagattgaaggtatattccatgccaccaccagcgaagtgtcatggatatcctccataatgttggctgtcatgtatggtggaggtaagtacccattaaggcctgctcttttaattttcatgaagcagccagagtgtctgtattaggtaactttaaaa

SEQ ID NO: 440542 - DNA, 3398 bp, Homo sapiens
agctagagggcgcgcgcggctgaaagcgtgtggaggcgcgggctgcagttcggatgtctgtgtggcggggagggggcggcggccgggagagacgactccgccccctgcgcgcatgctccggccccggcgggttataaggcagcctcgctggcccggccagacaaagtggtgagctgcgacgtgactggctagctgcgtgggtactggaacaagcaaacgaggcagcgagcgaaggacgggagccggaccctgggccccgtggaactccagcctgcgccaccacgtcacgcacacgctcggcgctgcgatccgcgcatataacgatatttggatttgacctgcattttggaatttatctacacttaaaatgccaccagcagttggaggtccagttggatacacccccccagatggaggctggggctgggcagtggtaattggagctttcatttccatcggcttctcttatgcatttcccaaatcaattactgtcttcttcaaagagattgaaggtatattccatgccaccaccagcgaagtgtcatggatatcctccataatgttggctgtcatgtatggtggaggtcctatcagcagtatcctggtgaataaatatggaagtcgtatagtcatgattgttggtggctgcttgtcaggctgtggcttgattgcagcttctttctgtaacaccgtacagcaactatacgtctgtattggagtcattggaggtcttgggcttgccttcaacttgaatccagctctgaccatgattggcaagtatttctacaagaggcgaccattggccaacggactggccatggcaggcagccctgtgttcctctgtactctggcccccctcaatcaggttttcttcggtatctttggatggagaggaagctttctaattcttgggggcttgctactaaactgctgtgttgctggagccctcatgcgaccaatcgggcccaagccaaccaaggcagggaaagataagtctaaagcatcccttgagaaagctggaaaatctggtgtgaaaaaagatctgcatgatgcaaatacagatcttattggaagacaccctaaacaagagaaacgatcagtcttccaaacaattaatcagttcctggacttaaccctattcacccacagaggctttttgctatacctctctggaaatgtgatcatgttttttggactctttgcacctttggtgtttcttagtagttatgggaagagtcagcattattctagtgagaagtctgccttccttctttccattctggcttttgttgacatggtagcccgaccatctatgggacttgtagccaacacaaagccaataagacctcgaattcagtatttctttgcggcttccgttgttgcaaatggagtgtgtcatatgctagcacctttatccactacctatgttggattctgtgtctatgcgggattctttggatttgccttcgggtggctcagctccgtattgtttgaaacattgatggaccttgttggaccccagaggttctccagcgctgtgggattggtgaccattgtggaatgctgtcctgtcctcctggggccaccacttttaggtcggctcaatgacatgtatggagactacaaatacacatactgggcatgtggcgtcgtcctaattatttcaggtatctatctcttcattggcatgggcatcaattatcgacttttggcaaaagaacagaaagcaaacgagcagaaaaaggaaagtaaagaggaagagaccagtatagatgttgctgggaagccaaatgaagttaccaaagcagcagaatctccggaccagaaagacacagaaggagggcccaaggaggaggaaagtccagtctgaatccatggggctgaagggtaaattgagcagttcatgacccaggatatctgaaaatattctactggcctgtaatctaccagtggtgctcaatgcaaatagtagacatttgtgtggaaatcataccagttgttcattgatgggatttttgtttgactccttaccaatagcctgaatttgaggagggaatgattggtagcaaaggatgggggaaagaagtaggttctgttttgttttgttttaatcttagcttttaatagtgtcataaagattataatatgtgccttaagttttagtctttagaactctagagagccttaacttcttaaaccatttttgctgaattcatctatttcgagtgttgtgttaaaaggaaaaataacaactaacttgtttgaggcaaatctaaaatttaaaattaatcttgcttcattgttacatgtaatatatttcagacattttcactggaagatttatgaacagaaatattggttgaaagttagagattttacaaaatgctgacaaaaatattttcctagcatcagtagatttctggcatatgtttctgctagctatatatttaggaaattcaaagcataaaactttggcaacatcttggctgttctagacacagtgtacttgtcaacccctctcaggtaccttttcttgggatgcttattagaagccaagtaaagtgcttaaggtttgttttcattaaattagctatttctgctcccctgttcaaagatgcattttgagtgtttatagatcactgccctttttgaaatcacctggtattatttttcttactggaaaagttagtattaaaatctacagaactacatatttgtgcctccttggtaaatacaacacatctaattaaatgtagacagatatttcaaacatcagctgaattcacttaagtttttccaaaacctcagttaaactgtgaagctattggaatttttttttcctggaatttttcccctttgattcacagtggtcccatttatatctgcttctagcttagtgctatgtgtgagatatgtgtgtgtttggtgtttttgtttttgtttttttttttaaggtttgcaaattaaaaagggccagaaaaatttggcaccaggcaaacgaataaagataggattgggaaagaagttgctaagtgtgcttagttttaataagtaattccttctcttttttcagagaaggccttacagaaaattgttgtgcttagaattgctggatgcatttttaccctccacacaaacctaaaaattttgtgacccctttcacttacctgaaaagtagagaaatggattcagtataaggataaggagggaaggtggaccagaatgaaaactgtaaatatttttttaacctaatatcacttaaatcgaggcagaaagatatagacattcaatgaattatattcaatgcatttaaaataccactgtaattgacagagtaaaagtatagatacaaaaccttgtgtaagaggctgacttttccaaataaacattttttaaga

SEQ ID NO: 440543 - DNA, 3916 bp, Homo sapiens
agctagagggcgcgcgcggctgaaagcgtgtggaggcgcgggctgcagttcggatgtctgtgtggcggggagggggcggcggccgggagagacgactccgccccctgcgcgcatgctccggccccggcgggttataaggcagcctcgctggcccggccagacaaagtggtgagctgcgacgtgactggctagctgcgtgggtactggaacaagcaaacgaggcagcgagcgaaggacgggagccggaccctgggccccgtggaactccagcctgcgccaccacgtcacgcacacgctcggcgctgcgatccgcgcatataacgatatttggatttgacctgcattttggaatttatctacacttaaaatgccaccagcagttggaggtccagttggatacacccccccagatggaggctggggctgggcagtggtaattggagctttcatttccatcggcttctcttatgcatttcccaaatcaattactgtcttcttcaaagagattgaaggtatattccatgccaccaccagcgaagtgtcatggatatcctccataatgttggctgtcatgtatggtggaggtcctatcagcagtatcctggtgaataaatatggaagtcgtatagtcatgattgttggtggctgcttgtcaggctgtggcttgattgcagcttctttctgtaacaccgtacagcaactatacgtctgtattggagtcattggaggtcttgggcttgccttcaacttgaatccagctctgaccatgattggcaagtatttctacaagaggcgaccattggccaacggactggccatggcaggcagccctgtgttcctctgtactctggcccccctcaatcaggttttcttcggtatctttggatggagaggaagctttctaattcttgggggcttgctactaaactgctgtgttgctggagccctcatgcgaccaatcgggcccaagccaaccaaggcagggaaagataagtctaaagcatcccttgagaaagctggaaaatctggtgtgaaaaaagatctgcatgatgcaaatacagatcttattggaagacaccctaaacaagagaaacgatcagtcttccaaacaattaatcagttcctggacttaaccctattcacccacagaggctttttgctatacctctctggaaatgtgatcatgttttttggactctttgcacctttggtgtttcttagtagttatgggaagagtcagcattattctagtgagaagtctgccttccttctttccattctggcttttgttgacatggtagcccgaccatctatgggacttgtagccaacacaaagccaataagacctcgaattcagtatttctttgcggcttccgttgttgcaaatggagtgtgtcatatgctagcacctttatccactacctatgttggattctgtgtctatgcgggattctttggatttgccttcgggtggctcagctccgtattgtttgaaacattgatggaccttgttggaccccagaggttctccagcgctgtgggattggtgaccattgtggaatgctgtcctgtcctcctggggccaccacttttaggtcggctcaatgacatgtatggagactacaaatacacatactgggcatgtggcgtcgtcctaattatttcaggtatctatctcttcattggcatgggcatcaattatcgacttttggcaaaagaacagaaagcaaacgagcagaaaaaggaaagtaaagaggaagagaccagtatagatgttgctgggaagccaaatgaagttaccaaagcagcagaatctccggaccagaaagacacagaaggagggcccaaggaggaggaaagtccagtctgaatccatggggctgaagggtaaattgagcagttcatgacccaggatatctgaaaatattctactggcctgtaatctaccagtggtgctcaatgcaaatagtagacatttgtgtggaaatcataccagttgttcattgatgggatttttgtttgactccttaccaatagcctgaatttgaggagggaatgattggtagcaaaggatgggggaaagaagtaggttctgttttgttttgttttaatcttagcttttaatagtgtcataaagattataatatgtgccttaagttttagtctttagaactctagagagccttaacttcttaaaccatttttgctgaattcatctatttcgagtgttgtgttaaaaggaaaaataacaactaacttgtttgaggcaaatctaaaatttaaaattaatcttgcttcattgttacatgtaatatatttcagacattttcactggaagatttatgaacagaaatattggttgaaagttagagattttacaaaatgctgacaaaaatattttcctagcatcagtagatttctggcatatgtttctgctagctatatatttaggaaattcaaagcataaaactttggcaacatcttggctgttctagacacagtgtacttgtcaacccctctcaggtaccttttcttgggatgcttattagaagccaagtaaagtgcttaaggtttgttttcattaaattagctatttctgctcccctgttcaaagatgcattttgagtgtttatagatcactgccctttttgaaatcacctggtattatttttcttactggaaaagttagtattaaaatctacagaactacatatttgtgcctccttggtaaatacaacacatctaattaaatgtagacagatatttcaaacatcagctgaattcacttaagtttttccaaaacctcagttaaactgtgaagctattggaatttttttttcctggaatttttcccctttgattcacagtggtcccatttatatctgcttctagcttagtgctatgtgtgagatatgtgtgtgtttggtgtttttgtttttgtttttttttttaaggtttgcaaattaaaaagggccagaaaaatttggcaccaggcaaacgaataaagataggattgggaaagaagttgctaagtgtgcttagttttaataagtaattccttctcttttttcagagaaggccttacagaaaattgttgtgcttagaattgctggatgcatttttaccctccacacaaacctaaaaattttgtgacccctttcacttacctgaaaagtagagaaatggattcagtataaggataaggagggaaggtggaccagaatgaaaactgtaaatatttttttaacctaatatcacttaaatcgaggcagaaagatatagacattcaatgaattatattcaatgcatttaaaataccactgtaattgacagagtaaaagtatagatacaaaaccttgtgtaagaggctgacttttccaaataaacattttttaagaaaacatttcttctcccaaatgtctattttcttgaggaaaatattgctgtgtcttcattttcattaccaggtttcattttgggccttgctaaattgattgaattaaatcctccagcttttgaaccttgatatttgtgtatatgatttattttcatttgaatttctcctttcctcttctttgctgtaaggcaaggaggaggggaattttaaaaccatcttatttgaactgagagcatccagagcagttaaccttaaggaaacaatgaaaaactccctttgtatgcctgggcatcatggcagatagaggaagagtgttagaggagaaaactgctgctgagagtattggcaggcttggcctcagtttggactctgtaattttctttggacccaagtctgtaacctctgcgtacttcttctctcttaccttctataaaaatgaggattactgttggtgagggaataaggaatgtaagtaaaggaaatctgaaaaaataaaagtaaagcaagtataaaaaaaaa

SEQ ID NO: 440544 - DNA, 3050 bp, Homo sapiens
agctagagggcgcgcgcggctgaaagcgtgtggaggcgcgggctgcagttcggatgtctgtgtggcggggagggggcggcggccgggagagacgactccgccccctgcgcgcatgctccggccccggcgggttataaggcagcctcgctggcccggccagacaaagtggtgagctgcgacgtgactggctagctgcgtgggtactggaacaagcaaacgaggcagcgagcgaaggacgggagccggaccctgggccccgtggaactccagcctgcgccaccacgtcacgcacacgctcggcgctgcgatccgcgcatataacgatatttggatttgacctgcattttggaatttatctacacttaaaatgccaccagcagttggaggtccagttggatacacccccccagatggaggctggggctgggcagtggtaattggagctttcatttccatcggcttctcttatgcatttcccaaatcaattactgtcttcttcaaagagattgaaggtatattccatgccaccaccagcgaagtgtcatggatatcctccataatgttggctgtcatgtatggtggaggtcctatcagcagtatcctggtgaataaatatggaagtcgtatagtcatgattgttggtggctgcttgtcaggctgtggcttgattgcagcttctttctgtaacaccgtacagcaactatacgtctgtattggagtcattggaggtcttgggcttgccttcaacttgaatccagctctgaccatgattggcaagtatttctacaagaggcgaccattggccaacggactggccatggcaggcagccctgtgttcctctgtactctggcccccctcaatcaggttttcttcggtatctttggatggagaggaagctttctaattcttgggggcttgctactaaactgctgtgttgctggagccctcatgcgaccaatcgggcccaagccaaccaaggcagggaaagataagtctaaagcatcccttgagaaagctggaaaatctggtgtgaaaaaagatctgcatgatgcaaatacagatcttattggaagacaccctaaacaagagaaacgatcagtcttccaaacaattaatcagttcctggacttaaccctattcacccacagaggctttttgctatacctctctggaaatgtgatcatgttttttggactctttgcacctttggtgtttcttataggttctgttttgttttgttttaatcttagcttttaatagtgtcataaagattataatatgtgccttaagttttagtctttagaactctagagagccttaacttcttaaaccatttttgctgaattcatctatttcgagtgttgtgttaaaaggaaaaataacaactaacttgtttgaggcaaatctaaaatttaaaattaatcttgcttcattgttacatgtaatatatttcagacattttcactggaagatttatgaacagaaatattggttgaaagttagagattttacaaaatgctgacaaaaatattttcctagcatcagtagatttctggcatatgtttctgctagctatatatttaggaaattcaaagcataaaactttggcaacatcttggctgttctagacacagtgtacttgtcaacccctctcaggtaccttttcttgggatgcttattagaagccaagtaaagtgcttaaggtttgttttcattaaattagctatttctgctcccctgttcaaagatgcattttgagtgtttatagatcactgccctttttgaaatcacctggtattatttttcttactggaaaagttagtattaaaatctacagaactacatatttgtgcctccttggtaaatacaacacatctaattaaatgtagacagatatttcaaacatcagctgaattcacttaagtttttccaaaacctcagttaaactgtgaagctattggaatttttttttcctggaatttttcccctttgattcacagtggtcccatttatatctgcttctagcttagtgctatgtgtgagatatgtgtgtgtttggtgtttttgtttttgtttttttttttaaggtttgcaaattaaaaagggccagaaaaatttggcaccaggcaaacgaataaagataggattgggaaagaagttgctaagtgtgcttagttttaataagtaattccttctcttttttcagagaaggccttacagaaaattgttgtgcttagaattgctggatgcatttttaccctccacacaaacctaaaaattttgtgacccctttcacttacctgaaaagtagagaaatggattcagtataaggataaggagggaaggtggaccagaatgaaaactgtaaatatttttttaacctaatatcacttaaatcgaggcagaaagatatagacattcaatgaattatattcaatgcatttaaaataccactgtaattgacagagtaaaagtatagatacaaaaccttgtgtaagaggctgacttttccaaataaacattttttaagaaaacatttcttctcccaaatgtctattttcttgaggaaaatattgctgtgtcttcattttcattaccaggtttcattttgggccttgctaaattgattgaattaaatcctccagcttttgaaccttgatatttgtgtatatgatttattttcatttgaatttctcctttcctcttctttgctgtaaggcaaggaggaggggaattttaaaaccatcttatttgaactgagagcatccagagcagttaaccttaaggaaacaatgaaaaactccctttgtatgcctgggcatcatggcagatagaggaagagtgttagaggagaaaactgctgctgagagtattggcaggcttggcctcagtttggactctgtaattttctttggacccaagtctgtaacctctgcgtacttcttctctcttaccttctataaaaatgaggattactgttggtgagggaataaggaatgtaagtaaaggaaatctgaaaaaataaaagtaaagcaagtataaaaaaaaa

SEQ ID NO: 440545 - DNA, 1082 bp, Homo sapiens
agctagagggcgcgcgcggctgaaagcgtgtggaggcgcgggctgcagttcggatgtctgtgtggcggggagggggcggcggccgggagagacgactccgccccctgcgcgcatgctccggccccggcgggttataaggcagcctcgctggcccggccagacaaagtggtgagctgcgacgtgactggctagctgcgtgggtactggaacaagcaaacgaggcagcgagcgaaggacgggagccggaccctgggccccgtggaactccagcctgcgccaccacgtcacgcacacgctcggcgctgcgatccgcgcatataacggttagttgggtaacagccggcggcacgcggcgcggaccccacggtgccctcgctgccctggtggggtcggaggggacctccggggttgggagactttgtctccggcggagggaggcggcccagcagagggcatcgtggtcacaggcagccgcgtggcctcggactgcagtgctggtgaaggagaccttgaggcgctggggtcagcgcctctcttagccgagccgcgggccccgtgctaagatgccggtcccaggcctggccgaggagttgggtcgtggtgcccggtgacggtggggaagtcccttcccccctaagtcttcaataggctcctcgagagatgctttgatctggaaaagggataacatgaggctgctgcatgtggtacctccagactctcctggccgcttctgccccaagggaagggactcggggcagaagttatttatgattcgtgacattgtccgccccaaccttcttggcccgccgatccttgccccacctggtgacttgcgagagtggtgcggagagccgcattccccacagccaaggcgtgactgcagggttcgagtagactttgcggaggggacggggcagcccgcagactcctgggagtggtgctgacgggggctctttgtcattcaacctgtggctgccagcgtccgccgcagcgcccttctactcatggacttaaggcggccctgttgagagaaatctggaggatagcgttacacttggtccgatgcaagttttttgttccaa

SEQ ID NO: 440546 - DNA, 3525 bp, Homo sapiens
agctagagggcgcgcgcggctgaaagcgtgtggaggcgcgggctgcagttcggatgtctgtgtggcggggagggggcggcggccgggagagacgactccgccccctgcgcgcatgctccggccccggcgggttataaggcagcctcgctggcccggccagacaaagtggtgagctgcgacgtgactggctagctgcgtgggtactggaacaagcaaacgaggcagcgagcgaaggacgggagccggaccctgggccccgtggaactccagcctgcgccaccacgtcacgcacacgctcggcgctgcgatccgcgcatataacgatatttggatttgacctgcattttggaatttatctacacttaaaatgccaccagcagttggaggtccagttggatacacccccccagatggaggctggggctgggcagtggtaattggagctttcatttccatcggcttctcttatgcatttcccaaatcaattactgtcttcttcaaagagattgaaggtatattccatgccaccaccagcgaagtgtcatggatatcctccataatgttggctgtcatgtatggtggaggtcctatcagcagtatcctggtgaataaatatggaagtcgtatagtcatgattgttggtggctgcttgtcaggctgtggcttgattgcagcttctttctgtaacaccgtacagcaactatacgtctgtattggagtcattggaggtcttgggcttgccttcaacttgaatccagctctgaccatgattggcaagtatttctacaagaggcgaccattggccaacggactggccatggcaggcagccctgtgttcctctgtactctggcccccctcaatcaggttttcttcggtatctttggatggagaggaagctttctaattcttgggggcttgctactaaactgctgtgttgctggagccctcatgcgaccaatcgggcccaagccaaccaaggcagggaaagataagtctaaagcatcccttgagaaagctggaaaatctggtgtgaaaaaagatctgcatgatgcaaatacagatcttattggaagacaccctaaacaagagaaacgatcagtcttccaaacaattaatcagttcctggacttaaccctattcacccacagaggctttttgctatacctctctggaaatgtgatcatgttttttggactctttgcacctttggtgtttcttagtagttatgggaagagtcagcattattctagtgagaagtctgccttccttctttccattctggcttttgttgacatggtagcccgaccatctatgggacttgtagccaacacaaagccaataagacctcgaattcagtatttctttgcggcttccgttgttgcaaatggagtgtgtcatatgctagcacctttatccactacctatgttggattctgtgtctatgcgggattctttggatttgccttcgggtggctcagctccgtattgtttgaaacattgatggaccttgttggaccccagaggttctccagcgctgtgggattggtgaccattgtggaatgctgtcctgtcctcctggggccaccacttttaggtcggctcaatgacatgtatggagactacaaatacacatactgggcatgtggcgtcgtcctaattatttcaggtatctatctcttcattggcatgggcatcaattatcgacttttggcaaaagaacagaaagcaaacgagcagaaaaaggaaagtaaagaggaagagaccagtatagatgttgctgggaagccaaatgaagttaccaaagcagcagaatctccggaccagaaagacacagaaggagggcccaaggaggaggaaagtccagtctgaatccatggggctgaagggtaaattgagcagttcatgacccaggatatctgaaaatattctactggcctgtaatctaccagtggtgctcaatgcaaatagtagacatttgtgtggaaatcataccagttgttcattgatgggatttttgtttgactccttaccaatagcctgaatttgaggagggaatgattggtagcaaaggatgggggaaagaagtaggttctgttttgttttgttttaatcttagcttttaatagtgtcataaagattataatatgtgccttaagttttagtctttagaactctagagagccttaacttcttaaaccatttttgctgaattcatctatttcgagtgttgtgttaaaaggaaaaataacaactaacttgtttgaggcaaatctaaaatttaaaattaatcttgcttcattgttacatgtaatatatttcagacattttcactggaagatttatgaacagaaatattggttgaaagttagagattttacaaaatgctgacaaaaatattttcctagcatcagtagatttctggcatatgtttctgctagctatatatttaggaaattcaaagcataaaactttggcaacatcttggctgttctagacacagtgtacttgtcaacccctctcaggtaccttttcttgggatgcttattagaagccaagtaaagtgcttaaggtttgttttcattaaattagctatttctgctcccctgttcaaagatgcattttgagtgtttatagatcactgccctttttgaaatcacctggtattatttttcttactggaaaagttagtattaaaatctacagaactacatatttgtgcctccttggtaaatacaacacatctaattaaatgtagacagatatttcaaacatcagctgaattcacttaagtttttccaaaacctcagttaaactgtgaagctattggaatttttttttcctggaatttttcccctttgattcacagtggtcccatttatatctgcttctagcttagtgctatgtgtgagatatgtgtgtgtttggtgtttttgtttttgtttttttttttaaggtttgcaaattaaaaagggccagaaaaatttggcaccaggcaaacgaataaagataggattgggaaagaagttgctaagtgtgcttagttttaataagtaattccttctcttttttcagagaaggccttacagaaaattgttgtgcttagaattgctggatgcatttttaccctccacacaaacctaaaaattttgtgacccctttcacttacctgaaaagtagagaaatggattcagtataaggataaggagggaaggtggaccagaatgaaaactgtaaatatttttttaacctaatatcacttaaatcgaggcagaaagatatagacattcaatgaattatattcaatgcatttaaaataccactgtaattgacagagtaaaagtatagatacaaaaccttgtgtaagaggctgacttttccaaataaacattttttaagaaaacatttcttctcccaaatgtctattttcttgaggaaaatattgctgtgtcttcattttcattaccaggtttcattttgggccttgctaaattgattgaattaaatcctccagcttttgaaccttg

SEQ ID NO: 440547 - DNA, 3077 bp, Homo sapiens
gaaagattaaggataacttcaggtcttttgtattttagtaaaattccatccagtatttttagatttagaacctgcacaattaattatgttttctaacatctttattttagtacacatgtgactcagaagtaattatagaaaacaatattcttatcattgctgcttgtttattttggaggatttgtcattcattgtcattcatacttgtgtagatgtgagggagcagtttcctttatattactacatttttggttgtcttttaggtcctatcagcagtatcctggtgaataaatatggaagtcgtatagtcatgattgttggtggctgcttgtcaggctgtggcttgattgcagcttctttctgtaacaccgtacagcaactatacgtctgtattggagtcattggaggtcttgggcttgccttcaacttgaatccagctctgaccatgattggcaagtatttctacaagaggcgaccattggccaacggactggccatggcaggcagccctgtgttcctctgtactctggcccccctcaatcaggttttcttcggtatctttggatggagaggaagctttctaattcttgggggcttgctactaaactgctgtgttgctggagccctcatgcgaccaatcgggcccaagccaaccaaggcagggaaagataagtctaaagcatcccttgagaaagctggaaaatctggtgtgaaaaaagatctgcatgatgcaaatacagatcttattggaagacaccctaaacaagagaaacgatcagtcttccaaacaattaatcagttcctggacttaaccctattcacccacagaggctttttgctatacctctctggaaatgtgatcatgttttttggactctttgcacctttggtgtttcttagtagttatgggaagagtcagcattattctagtgagaagtctgccttccttctttccattctggcttttgttgacatggtagcccgaccatctatgggacttgtagccaacacaaagccaataagacctcgaattcagtatttctttgcggcttccgttgttgcaaatggagtgtgtcatatgctagcacctttatccactacctatgttggattctgtgtctatgcgggattctttggatttgccttcgggtggctcagctccgtattgtttgaaacattgatggaccttgttggaccccagaggttctccagcgctgtgggattggtgaccattgtggaatgctgtcctgtcctcctggggccaccacttttaggtcggctcaatgacatgtatggagactacaaatacacatactgggcatgtggcgtcgtcctaattatttcaggtatctatctcttcattggcatgggcatcaattatcgacttttggcaaaagaacagaaagcaaacgagcagaaaaaggaaagtaaagaggaagagaccagtatagatgttgctgggaagccaaatgaagttaccaaagcagcagaatctccggaccagaaagacacagaaggagggcccaaggaggaggaaagtccagtctgaatccatggggctgaagggtaaattgagcagttcatgacccaggatatctgaaaatattctactggcctgtaatctaccagtggtgctcaatgcaaatagtagacatttgtgtggaaatcataccagttgttcattgatgggatttttgtttgactccttaccaatagcctgaatttgaggagggaatgattggtagcaaaggatgggggaaagaagtaggttctgttttgttttgttttaatcttagcttttaatagtgtcataaagattataatatgtgccttaagttttagtctttagaactctagagagccttaacttcttaaaccatttttgctgaattcatctatttcgagtgttgtgttaaaaggaaaaataacaactaacttgtttgaggcaaatctaaaatttaaaattaatcttgcttcattgttacatgtaatatatttcagacattttcactggaagatttatgaacagaaatattggttgaaagttagagattttacaaaatgctgacaaaaatattttcctagcatcagtagatttctggcatatgtttctgctagctatatatttaggaaattcaaagcataaaactttggcaacatcttggctgttctagacacagtgtacttgtcaacccctctcaggtaccttttcttgggatgcttattagaagccaagtaaagtgcttaaggtttgttttcattaaattagctatttctgctcccctgttcaaagatgcattttgagtgtttatagatcactgccctttttgaaatcacctggtattatttttcttactggaaaagttagtattaaaatctacagaactacatatttgtgcctccttggtaaatacaacacatctaattaaatgtagacagatatttcaaacatcagctgaattcacttaagtttttccaaaacctcagttaaactgtgaagctattggaatttttttttcctggaatttttcccctttgattcacagtggtcccatttatatctgcttctagcttagtgctatgtgtgagatatgtgtgtgtttggtgtttttgtttttgtttttttttttaaggtttgcaaattaaaaagggccagaaaaatttggcaccaggcaaacgaataaagataggattgggaaagaagttgctaagtgtgcttagttttaataagtaattccttctcttttttcagagaaggccttacagaaaattgttgtgcttagaattgctggatgcatttttaccctccacacaaacctaaaaattttgtgacccctttcacttacctgaaaagtagagaaatggattcagtataaggataaggagggaaggtggaccagaatgaaaactgtaaatatttttttaacctaatatcacttaaatcgaggcagaaagatatagacattcaatgaattatattcaatgcatttaaaataccactgtaattgacagagtaaaagtatagatacaaaaccttgtgtaagaggctgacttttccaaataaacattttttaaga

SEQ ID NO: 440548 - DNA, 2598 bp, Homo sapiens
agctagagggcgcgcgcggctgaaagcgtgtggaggcgcgggctgcagttcggatgtctgtgtggcggggagggggcggcggccgggagagacgactccgccccctgcgcgcatgctccggccccggcgggttataaggcagcctcgctggcccggccagacaaagtggtgagctgcgacgtgactggctagctgcgtgggtactggaacaagcaaacgaggcagcgagcgaaggacgggagccggaccctgggccccgtggaactccagcctgcgccaccacgtcacgcacacgctcggcgctgcgatccgcgcatataacgatatttggatttgacctgcattttggaatttatctacacttaaaatgccaccagcagttggaggtccagttggatacacccccccagatggaggctggggctgggcagtggtaattggagctttcatttccatcggcttctcttatgcatttcccaaatcaattactgtcttcttcaaagagattgaaggtatattccatgccaccaccagcgaagtgtcatggatatcctccataatgttggctgtcatgtatggtggaggtcctatcagcagtatcctggtgaataaatatggaagtcgtatagtcatgattgttggtggctgcttgtcaggctgtggcttgattgcagcttctttctgtaacaccgtacagcaactatacgtctgtattggagtcattggaggtcttgggcttgccttcaacttgaatccagctctgaccatgattggcaagtatttctacaagaggcgaccattggccaacggactggccatggcaggcagccctgtgttcctctgtactctggcccccctcaatcaggttttcttcggtatctttggatggagaggaagctttctaattcttgggggcttgctactaaactgctgtgttgctggagccctcatgcgaccaatcgggcccaagccaaccaaggcagggaaagataagtctaaagcatcccttgagaaagctggaaaatctggtgtgaaaaaagatctgcatgatgcaaatacagatcttattggaagacaccctaaacaagagaaacgatcagtcttccaaacaattaatcagttcctggacttaaccctattcacccacagaggctttttgctatacctctctggaaatgtgatcatgttttttggactctttgcacctttggtgtttcttagtagttatgggaagagtcagcattattctagtgagaagtctgccttccttctttccattctggcttttgttgacatggtagcccgaccatctatgggacttgtagccaacacaaagccaataagacctcgaattcagtatttctttgcggcttccgttgttgcaaatggagtgtgtcatatgctagcacctttatccactacctatgttggattctgtgtctatgcgggattctttggatttgccttcgggtggctcagctccgtattgtttgaaacattgatggaccttgttggaccccagaggttctccagcgctgtgggattggtgaccattgtggaatgctgtcctgtcctcctggggccaccacttttaggtcggctcaatgacatgtatggagactacaaatacacatactgggcatgtggcgtcgtcctaattatttcaggtatctatctcttcattggcatgggcatcaattatcgacttttggcaaaagaacagaaagcaaacgagcagaaaaaggaaagtaaagaggaagagaccagtatagatgttgctgggaagccaaatgaagttaccaaagcagcagaatctccggaccagaaagacacagaaggagggcccaaggaggaggaaagtccagtctgaatccatggggctgaagggtaaattgagcagttcatgacccaggatatctgaaaatattctactggcctgtaatctaccagtggtgctcaatgcaaatagtagacatttgtgtggaaatcataccagttgttcattgatgggatttttgtttgactccttaccaatagcctgaatttgaggagggaatgattggtagcaaaggatgggggaaagaagtaggttctgttttgttttgttttaatcttagcttttaatagtgtcataaagattataatatgtgccttaagttttagtctttagaactctagagagccttaacttcttaaaccatttttgctgaattcatctatttcgagtgttgtgttaaaaggaaaaataacaactaacttgtttgaggcaaatctaaaatttaaaattaatcttgcttcattgttacatgtaatatatttcagacattttcactggaagatttatgaacagaaatattggttgaaagttagagattttacaaaatgctgacaaaaacagaatctccggaccagaaagacacagaaggagggcccaaggaggaggaaagtccagtctgaatccatggggctgaagggtaaattgagcagttcatgacccaggatatctgaaaatattctactggcctgtaatctaccagtggtgctcaatgcaaatagtagatatttgtgtggaaatcataccagttgttcattgatggg

SEQ ID NO: 440549 - DNA, 3719 bp, Homo sapiens
cttttccgtaaagcggtggagaatctcaagcatgtgcatttaattgaggaatagcagaagggctaaagcaaccaagaaaagaagtgtgggtatttttgttaagtaaaacagcccaagtgcttctggaggtgggtttctaccaagatagaggaaaagggctgaattccctctaagtgggacagccgagctcaggatgtgcttcccagcttcactggttaatttgacctgaacctatttaaagatcccttctgcccctgaagacctatccgcactcaaattctaacatgaagaaatctactcgaatgcatcctttactttgaatgagctctattcggttgcatgttatatgtgatttccttcctcccaactgtttccactgagcgcacccagtctcccctagtcttcctctgtgggtgtgatttttgtgatttttacaaacaaaacccttgaagttcttggcagatgtgtttgtttctgtttgcatgtactgcagataccccaggacaagcgggggattcatttttcagccattcagttgtttcctcaataatccgcagcaaagtgaaaatattcttagcactcagactgtacttagagtgttttctcagtccagtctgtacagtctgtaggcagaaggcctcagaagaaagtcatggccactcagtgcccactgtgggctttgtaagtcctggctctcccgtcaaggttacccagaggtaaaagcttcctgggagtggggccaggtgtgtttggcactccagatagaaggcaaaatgctcagattcgggcctgtgcacttgtatgcaacctgtcggtcgatacctagcatttatttttccctgacaatgaacgacctttccctcacccaccctaagctcaaagagtttagcaaaattctcttttaaataaacagaatgccagtaagaggttgacccctaccatggaacttctgggatgctaaatacttcctcatgaacaaaataagttccttattataagttccttatactagcagcttcacctaaagaattttctctccagcaatattgacttcactggggaaaagccaagagtgtgtggtgagtgatttgttctcactcgacctggctaggactggctaggagctgttttttgtacatgagggaatttgggctttcctcagttatctgaatgttttacccaagtgccttcctgctattgtagcaaagtagctcagcttccttgtccacagggtgaaaaaggactaatgcattttccatcagttttctaactatgttagcaaaaacggcctcctggtagctcaacctcctgtacgcgtgtgtgtgtgtaatacacacacaaataaacccctctgtttttctaagacatcttagctggatattataggaagcactttcataaacaactgtaacaaatcgcaaaggaaagagaaacaaaagcattagatttgagacataaacaggcaagagaaagtgtattaggaactgacagctatcaaggaagttttgtcagttacaaatgctaggaggaaattttgccaagaaggatggctcatgaaatatttccagtacgggaagaggcaataagatcctctaagagaatgagaaagtaggggtgtctaaatggtaaagatgggtgtgttgcacgtgtgttagaaggatctcagttgagtgaaggtttgcactgctacatctaagttaatgtaaatatgtagcactctgacaggtctaccgtgttgctgaatgtagtatatttccaaagtttgcaagtcttcctgtattgtacaaagatgctgctgcttgataatatgtatagcaatccagattagtatgttattaaattttattttcttacctgtatttttatgctttttacctgtcctcaaaatattacacccctgttggaattagatttatatttataaatggtcagaaatctttttaagtgtctctttttacacataggttgattttttttttcttaagagaaatgatgtattcttgaaacatttgttactcattccaggaaacaaaaacccatataataaaacccccactcagagcctgttagtcacctctctagaagatggcatctcaggagaaggaatggctttgtggaagaaggaatcacctttttcttgctcaagaattatgctgacttcagccctgagcctggatctggtcactgagaatcatcaagtgtctagatcctccccccaaaataactaatttagtaggtgattttgattttaaaaaattgacaccaaaaccctgcctgcattgtaatggaattcgaaaagaattcatgttcacagaactcaacgttcaggctaatatttacagaagggaccaaatctaaatcctggtagataactcctgtatgctttatccaaaggacacccacagttttccagcatagatataaccaaggatgaattgattccttcaaagaactgggaggcacggatattgcattttttgtttacatccagtagccaagacgcctcagtgagccagtcttgggcagaggctgtcacatttaggcagattggaagttggtatgttctaattctcactctggactacagtgaggctgaatttatcatgtcaaaaaaaaaaaaaaaaaaagacctttccaagtgctttctattgctcagaattgaaagaatgttttcatttcaagtttacaagaggcatggatggagttgtgacgttcttgacaagctgggctaacctttcccgaacttgtttcccggaggcaaggtgctcggtgacccagcgcatcttaaccttgggtctcctaggctcgaggctagggcattacgtttcgtggaaccaaagcagccaattgcatagcaagtattttcctgcattccaattaaatgcttaagaaaaagcagcatcctataaaattgtgatcataaacatccatttccctcagcttttgtgagtgccttgacttacagccaacatcactgtttaactcagtctgtttaaaaacaaacttttctggtggttgataacagagagttgctccctgagccatcagggtcctgggagctggaagtgaaagggttattaacattctacctttatgcagctgttggctgaccagaataaactccctgctgagttcaagctttgaatggaatggatgcaaatgatgttgtttccattagagcaggtgctcacagcattctgattggcctgagcagaccgaggctatggctgttgggacaagcttagcatcctggacatcttgtcaaagaacctcactcacccctctggcctctacagccctcagaggagagaaaaccaattctccaacaaacaggtctctccaacatggtggtgctggcaggcttaggtttagaaaatcctgactgttaaaggcgtttgaatacatcacattcctatgcaaatgtttttaatctccagtttaatgtagtttatttttcctatatgtaaagtatttttatacggcttgtatcatgatagtttagcaataaaacagttggaagcaaaaaaaaaaaaaaaaaaaaaaaaaaaaaaaaaaaaaaaaaaaaaaaaaaaaaaaacaccccccttttttttttaggggggcccggggcggggagaggagggggggcaccacacaggggacccccggggcccggggaaaagggggggggggggggccccccccccaaagcgccccccccagggggggcgccggataca

SEQ ID NO: 440550 - DNA, 3523 bp, Homo sapiens
cttttccgtaaagcggtggagaatctcaagcatgtgcatttaattgaggaatagcagaagggctaaagcaaccaagaaaagaagtgtgggtatttttgttaagtaaaacagcccaagtgcttctggaggtgggtttctaccaagatagaggaaaagggctgaattccctctaagtgggacagccgagctcaggatgtgcttcccagcttcactggttaatttgacctgaacctatttaaagatcccttctgcccctgaagacctatccgcactcaaattctaacatgaagaaatctactcgaatgcatcctttactttgaatgagctctattcggttgcatgttatatgtgatttccttcctcccaactgtttccactgagcgcacccagtctcccctagtcttcctctgtgggtgtgatttttgtgatttttacaaacaaaacccttgaagttcttggcagatgtgtttgtttctgtttgcatgtactgcagataccccaggacaagcgggggattcatttttcagccattcagttgtttcctcaataatccgcagcaaagtgaaaatattcttagcactcagactgtacttagagtgttttctcagtccagtctgtacagtctgtaggcagaaggcctcagaagaaagtcatggccactcagtgcccactgtgggctttgtaagtcctggctctcccgtcaaggttacccagaggtaaaagcttcctgggagtggggccaggtgtgtttggcactccagatagaaggcaaaatgctcagattcgggcctgtgcacttgtatgcaacctgtcggtcgatacctagcatttatttttccctgacaatgaacgacctttccctcacccaccctaagctcaaagagtttagcaaaattctcttttaaataaacagaatgccagtaagaggttgacccctaccatggaacttctgggatgctaaatacttcctcatgaacaaaataagttccttattataagttccttatactagcagcttcacctaaagaattttctctccagcaatattgacttcactggggaaaagccaagagtgtgtggtgagtgatttgttctcactcgacctggctaggactggctaggagctgttttttgtacatgagggaatttgggctttcctcagttatctgaatgttttacccaagtgccttcctgctattgtagcaaagtagctcagcttccttgtccacagggtgaaaaaggactaatgcattttccatcagttttctaactatgttagcaaaaacggcctcctggtagctcaacctcctgtacgcgtgtgtgtgtgtaatacacacacaaataaacccctctgtttttctaagacatcttagctggatattataggaagcactttcataaacaactgtaacaaatcgcaaaggaaagagaaacaaaagcattagatttgagacataaacaggcaagagaaagtgtattaggaactgacagctatcaaggaagttttgtcagttacaaatgctaggaggaaattttgccaagaaggatggctcatgaaatatttccagtacgggaagaggcaataagatcctctaagagaatgagaaagtaggggtgtctaaatggtaaagatgggtgtgttgcacgtgtgttagaaggatctcagttgagtgaaggtttgcactgctacatctaagttaatgtaaatatgtagcactctgacaggtctaccgtgttgctgaatgtagtatatttccaaagtttgcaagtcttcctgtattgtacaaagatgctgctgcttgataatatgtatagcaatccagattagtatgttattaaattttattttcttacctgtatttttatgctttttacctgtcctcaaaatattacacccctgttggaattagatttatatttataaatggtcagaaatctttttaagtgtctctttttacacataggttgattttttttttcttaagagaaatgatgtattcttgaaacatttgttactcattccaggaaacaaaaacccatataataaaacccccactcagagcctgttagtcacctctctagaagatggcatctcaggagaaggaatggctttgtggaagaaggaatcacctttttcttgctcaagaattatgctgacttcagccctgagcctggatctggtcactgagaatcatcaagtgtctagatcctccccccaaaataactaatttagtaggtgattttgattttaaaaaattgacaccaaaaccctgcctgcattgtaatggaattcgaaaagaattcatgttcacagaactcaacgttcaggctaatatttacagaagggaccaaatctaaatcctggtagataactcctgtatgctttatccaaaggacacccacagttttccagcatagatataaccaaggatgaattgattccttcaaagaactgggaggcacggatattgcattttttgtttacatccagtagccaagacgcctcagtgagccagtcttgggcagaggctgtcacatttaggcagattggaagttggtatgttctaattctcactctggactacagtgaggctgaatttatcatgtcaaaaaaaaaaaaaaaaaaagacctttccaagtgctttctattgctcagaattgaaagaatgttttcatttcaagtttacaagaggcatggatggagttgtgacgttcttgacaagctgggctaacctttcccgaacttgtttcccggaggcaaggtgctcggtgacccagcgcatcttaaccttgggtctcctaggctcgaggctagggcattacgtttcgtggaaccaaagcagccaattgcatagcaagtattttcctgcattccaattaaatgcttaagaaaaagcagcatcctataaaattgtgatcataaacatccatttccctcagcttttgtgagtgccttgacttacagccaacatcactgtttaactcagtctgtttaaaaacaaacttttctggtggttgataacagagagttgctccctgagccatcagggtcctgggagctggaagtgaaagggttattaacattctacctttatgcagctgttggctgaccagaataaactccctgctgagttcaagctttgaatggaatggatgcaaatgatgttgtttccattagagcaggtgctcacagcattctgattggcctgagcagaccgaggctatggctgttgggacaagcttagcatcctggacatcttgtcaaagaacctcactcacccctctggcctctacagccctcagaggagagaaaaccaattctccaacaaacaggtctctccaacatggtggtgctggcaggcttaggtttagaaaatcctgactgttaaaggcgtttgaatacatcacattcctatgcaaatgtttttaatctccagtttaatgtagtttatttttcctatatgtaaagtatttttatacggcttgtatcatgatagtttagcaataaaacagttggaagcaa

SEQ ID NO: 440551 - DNA, 549 bp, Homo sapiens
acaacagagaagctcagtaagagtaaaggatgttggaaagaaaccaatagggaatagattgaagatgtggaaggatgacagatgaagcagaatttcacaggagatgggaggggaagaagtcatcagctcaggtggagattctggtcttgaacaggaggagtaaccattatctcctaaaactggagatggaggaagggagccatgagtcaaggaatgaggcagcttgaaaacctgggaatggccttcagcatacagccaacaagaaaacaagggcctcagttctacagccggaaagaactgaattctgccaacagcctgcatgaatcacttgaaaaactgactgttgatgggaatgaactgagttttttcccccatggaattttgaagcttaacctgacaaaaattcagtttgagaataatttcactcatccttgtttttggagagataattatttgaataatccacaacaacttactcaaattatttctttgttcattgtccaaaataaactacataaattttatgataagaacagtagaagttcagaa

SEQ ID NO: 440552 - DNA, 641 bp, Homo sapiens
tgaactttgagttgatgctgtaaaggttaacctttcgggaaattgagataagtgaatgtattttgcatgtgggatagatgtgaatctttagggatgaactgtgatagggcgaataatggtccccaaagatgttcatattctaccagaacatgtgaatatgttatattacatggcaaagggaaattaagtttggagatgaaattaagggttctaatcagctgatcttaaagtagggagattattctggattagttgagtggtcccaatcaaatcacatgagctcttaaaaatggaagggggatgcagaagcatttgtcagagagataccacctgaggacttgacttgcttttgttggttttgaagatggaggaagggagccatgagtcaaggaatgaggcagcttgaaaacctgggaatggccttcagcatacagccaacaagaaaacaagggcctcagttctacagccggaaagaactgaattctgccaacagcctgcatgagtaagaaaacagattctccctagagcctccagatagcaatgcagtcctgctgatgccttaattttagtagagtgagacctttgcagacttctgacctatataactataattaataaatctgagttgttgtacgccactg

SEQ ID NO: 440553 - DNA, 387 bp, Homo sapiens
taggtctcaccaaaactgaaaaaatagaatcagagatacacgttgtacgtggtgaaggttttaagactgttgcagcaacacgatatgaaacaataacagccatgaccaacctggccatagtaaactgtcaagtatatgggagaaatgcacttaatctgaagatcacttgaaaaactgactgttgatgggaatgaactgagttttttcccccatggaattttgaagcttaacctgacaaaaattcagtttgagaataatttcactcatccttgtttttggagagataattatttgaataatccacaacaacttactcaaattatttctttgttcattgtccaaaataaactacataaattttatgataagaacagtagaagttcagaa

SEQ ID NO: 440554 - DNA, 812 bp, Homo sapiens
tgaactttgagttgatgctgtaaaggttaacctttcgggaaattgagataagtgaatgtattttgcatgtgggatagatgtgaatctttagggatgaactgtgatagggcgaataatggtccccaaagatgttcatattctaccagaacatgtgaatatgttatattacatggcaaagggaaattaagtttggagatgaaattaagggttctaatcagctgatcttaaagtagggagattattctggattagttgagtggtcccaatcaaatcacatgagctcttaaaaatggaagggggatgcagaagcatttgtcagagagataccacctgaggacttgacttgcttttgttggttttgaagatggaggaagggagccatgagtcaaggaatgaggcagcttgaaaacctgggaatggccttcagcatacagccaacaagaaaacaagggcctcagttctacagccggaaagaactgaattctgccaacagcctgcatgagttattttccttgtcttatcttgaagaacttgatgtttcctataatgaacttacttttattccaaatgaaattcagaaactcagatcacttgaaaaactgactgttgatgggaatgaactgagttttttcccccatggaattttgaagcttaacctgacaaaaattcagtttgagaataatttcactcatccttgtttttggagagataattatttgaataatccacaacaacttactcaaattatttctttgttcattgtccaaaataaactacataaattttatgataagaacagtagaagttcagaa

SEQ ID NO: 440555 - DNA, 462 bp, Homo sapiens
acaacagagaagctcagtaagagtaaaggatgttggaaagaaaccaatagggaatagattgaagatgtggaaggatgacagatgaagcagaatttcacaggagatgggaggggaagaagtcatcagctcaggtggagattctggtcttgaacaggaggagtaaccattatctcctaaaactggagatggaggaagggagccatgagtcaaggaatgaggcagcttgaaaacctgggaatggccttcagcatacagccaacaagaaaacaagggcctcagttctacagccggaaagaactgaattctgccaacagcctgcatgagtaagaaaacagattctccctagagcctccagatagcaatgcagtcctgctgatgccttaattttagtagagtgagacctttgcagacttctgacctatataactataattaataaatctgagttgttgtacgccactg

SEQ ID NO: 440556 - DNA, 3549 bp, Homo sapiens
  misc_feature (3288)..(3288): n is a, c, g, or t
  misc_feature (3302)..(3304): n is a, c, g, or t
  misc_feature (3306)..(3306): n is a, c, g, or t
  misc_feature (3324)..(3325): n is a, c, g, or t
  misc_feature (3332)..(3333): n is a, c, g, or t
  misc_feature (3347)..(3347): n is a, c, g, or t
  misc_feature (3352)..(3353): n is a, c, g, or t
  misc_feature (3358)..(3358): n is a, c, g, or t
  misc_feature (3361)..(3361): n is a, c, g, or t
  misc_feature (3365)..(3368): n is a, c, g, or t
  misc_feature (3377)..(3377): n is a, c, g, or t
  misc_feature (3379)..(3379): n is a, c, g, or t
  misc_feature (3382)..(3382): n is a, c, g, or t
  misc_feature (3386)..(3387): n is a, c, g, or t
  misc_feature (3394)..(3395): n is a, c, g, or t
  misc_feature (3403)..(3403): n is a, c, g, or t
  misc_feature (3414)..(3414): n is a, c, g, or t
  misc_feature (3420)..(3422): n is a, c, g, or t
  misc_feature (3424)..(3424): n is a, c, g, or t
  misc_feature (3429)..(3430): n is a, c, g, or t
  misc_feature (3433)..(3433): n is a, c, g, or t
  misc_feature (3436)..(3436): n is a, c, g, or t
  misc_feature (3439)..(3439): n is a, c, g, or t
  misc_feature (3441)..(3441): n is a, c, g, or t
  misc_feature (3461)..(3461): n is a, c, g, or t
  misc_feature (3464)..(3465): n is a, c, g, or t
  misc_feature (3474)..(3475): n is a, c, g, or t
  misc_feature (3481)..(3482): n is a, c, g, or t
  misc_feature (3487)..(3487): n is a, c, g, or t
  misc_feature (3491)..(3491): n is a, c, g, or t
  misc_feature (3498)..(3498): n is a, c, g, or t
  misc_feature (3500)..(3500): n is a, c, g, or t
  misc_feature (3502)..(3502): n is a, c, g, or t
  misc_feature (3504)..(3504): n is a, c, g, or t
  misc_feature (3516)..(3516): n is a, c, g, or t
  misc_feature (3521)..(3521): n is a, c, g, or t
  misc_feature (3528)..(3529): n is a, c, g, or t
  misc_feature (3535)..(3537): n is a, c, g, or t
  misc_feature (3540)..(3540): n is a, c, g, or t
  misc_feature (3542)..(3542): n is a, c, g, or t
agcgggtttgtttttgaatctgcggaggcggcggcggtggcagcggcggcgcggcgactgaagcgcgcgaaaagctgaggcggcaacgtcggggacggctgcgcgggacggctctgtaggaaggaacttggttccccctccctcagcttccgccccaaaagattcagaatggacagtttagaagaacctcagaaaaaagtctttaaggctcgaaaaacgatgagagtgagtgatcgtcagcaacttgaagcagtgtacaaggtcaaagaagaactgttgaaaactgatgtcaagctgttaaatggcaaccatgaaaatggagatttggacccaacctcacctttggaaaacatggattacattaaagacaaggaagaggtgaatggcattgaagagatttgttttgatcctgaaggaagtaaagcagaatggaaggaaacaccctgtatcctaagtgttaatgtaaaaaacaagcaggatgatgatttaaattgtgaacctttgtctccccataatataactccagaaccagtctctaaactgcctgctgaaccagtttctggtgatccagcccctggtgatctggatgccggagatccagcctccggagtactggcctctggtgattccacctctggtgatcccacctctagcgagccctcctctagtgatgctgcctctggtgatgcaacctctggtgatgccccttctggtgatgtgtcccctggtgatgccacctctggtgatgccactgctgatgatctctcctctggtgatcccacctctagtgatcccatcccaggtgaaccggtccctgttgaacccatttctggtgattgtgccgctgatgatatagcctctagtgaaataacttctgttgatctggcttctggagcaccagcttccactgatccagcctctgatgatctggcctctggtgatctatcctctagtgaactggcctctgatgatctggccactggtgaactggcctctgatgagctgacttctgaatcaacctttgatcgtacctttgaaccaaagtctgtaccagtttgtgaaccagttcctgaaattgacaatatagaaccaagtagcaataaagatgatgattttcttgaaaaaaatggagctgatgaaaaattagagcaaattcagagtaaagactcattggatgagaaaaataaagctgataataatattgatgctaatgaagaaactctagaaacagatgatacaactatttgttcagatcgacctcctgaaaatgaaaagaaggtagaggaagatattatcacagagcttgctcttggagaagatgctatatctagcagtatggaaattgaccaaggtgaaaagaatgaagatgaaacttctgcagatcttgtagaaacgattaatgaaaatgttattgaagataacaaaagtgagaatatcttagaaaatacagactctatggagacagatgaaatcattcctattttggaaaagcttgcaccttctgaggatgaacttacttgcttttctaaaacatctctccttccaatcgatgagacaaatccagatttggaagagaaaatggaaagttcttttggttcaccatctaaacaagaaagtagtgagagtttgccaaaagaagcctttctggtcctctctgatgaagaggatatttcgggtgaaaaagatgagtctgaagttatatcgcaaaatgaaacgtgctctccagcagaagtagaaagtaatgaaaaggacaacagacctgaggaagaagagcaagtaatacatgaagatgatgaaagaccttctgagaaaaatgaattttctagacgaaaacgttctaaatcagaagacatggacaatgtacagtctaaacgtcgtcgatatatggaagaagaatatgaggcagaatttcaagtaaagattacagccaaaggagacattaaccagaaacttcaaaaggttatacagtggttgctggaagaaaaattgtgtgcgctgcagtgtgctgtatttgataagactttggcagaattgaaaacacgagtggaaaagattgaatgtaacaagaggcataaaacagttctcactgaactacaggccaagatagccaggttaaccaaacgctttgaagcagccaaagaagatcttaagaaaagacatgaacatccacccaacccaccagtatcaccaggaaaaactgtaaatgatgtcaacagcaataataacatgtcttacagaaatgcaggcacagtgagacagatgctggagtccaaaagaaatgtaagcgagagtgcaccaccatcctttcaaactcctgtgaatacagtatcttcaaccaatcttgtcactcctccagcagttgtcagtagtcaacctaaattgcagactccagtgacttcgggttccctcacagcaacgtcagttcttcctgcacccaatacagctactgtagttgctactactcaggtgcctagtggaaatccccagcctacaatctctttacagcctttgccagtgattttgcatgtacctgttgcagtatcctcccagcctcagcttctacagagccatccagggactttggtgactaatcaaccatctggcaatgttgaattcatttctgtgcaaagcccacctacagtgagtggtcttaccaaaaatccagtatccttgccatccttgccaaatcccactaaaccaaacaacgttccttctgtgcccagtcctagtattcaaaggaaccctactgccagtgctgcaccattgggaacaacacttgctgtgcaggctgttccaacagcacactctattgtacaagccacaaggacttctttacccacagtgggcccatcaggactctatagtccatcaactaatcgaggtcctatacagatgaaaattccaatttctgcatttagtacttcgtctgctgcagaacagaacagcaataccaccccaagaattgaaaaccagacaaacaaaacaatagatgcttctgtcagtaagaaagcagctgatagcacatcacagtgtggaaaagccactggcagtgattcaagtggtgtcattgatctcacaatggatgatgaagagagtggagcttcacaaggtacttcaatagtaattgtactaagcaacgttttgataccattttttttgtcttaatacggtacagtattctacaaagacagatgtttatggcattatgcttggtttatttgtgttctttttggaatggaagttttttagattagaattttaaaatttggccaggtgcagtgtctcacncctgtaatcccagnnntntgggaggccaaggcaggnngatcacnngaggtcaggagttngagannagccnggncaannnngtgaaaccncntcnctannaaaaatnnaaaaattngctgggtgtgntggcannngnctgtnntcncanctncntgggaggctgaggcaggagnatnncttgagccnnggaggnngaggntgcngtgagcngngntnatgccactgcantccancctgggnnacagannnagncnctgtctc

SEQ ID NO: 440557 - DNA, 7965 bp, Homo sapiens
agcgggtttgtttttgaatctgcggaggcggcggcggtggcagcggcggcgcggcgactgaagcgcgcgaaaagctgaggcggcaacgtcggggacggctgcgcgggacggctctgtaggaaggaacttggttccccctccctcagcttccgccccaaaagattcagaatggacagtttagaagaacctcagaaaaaagtctttaaggctcgaaaaacgatgagagtgagtgatcgtcagcaacttgaagcagtgtacaaggtcaaagaagaactgttgaaaactgatgtcaagctgttaaatggcaaccatgaaaatggagatttggacccaacctcacctttggaaaacatggattacattaaagacaaggaagaggtgaatggcattgaagagatttgttttgatcctgaaggaagtaaagcagaatggaaggaaacaccctgtatcctaagtgttaatgtaaaaaacaagcaggatgatgatttaaattgtgaacctttgtctccccataatataactccagaaccagtctctaaactgcctgctgaaccagtttctggtgatccagcccctggtgatctggatgccggagatccagcctccggagtactggcctctggtgattccacctctggtgatcccacctctagcgagccctcctctagtgatgctgcctctggtgatgcaacctctggtgatgccccttctggtgatgtgtcccctggtgatgccacctctggtgatgccactgctgatgatctctcctctggtgatcccacctctagtgatcccatcccaggtgaaccggtccctgttgaacccatttctggtgattgtgccgctgatgatatagcctctagtgaaataacttctgttgatctggcttctggagcaccagcttccactgatccagcctctgatgatctggcctctggtgatctatcctctagtgaactggcctctgatgatctggccactggtgaactggcctctgatgagctgacttctgaatcaacctttgatcgtacctttgaaccaaagtctgtaccagtttgtgaaccagttcctgaaattgacaatatagaaccaagtagcaataaagatgatgattttcttgaaaaaaatggagctgatgaaaaattagagcaaattcagagtaaagactcattggatgagaaaaataaagctgataataatattgatgctaatgaagaaactctagaaacagatgatacaactatttgttcagatcgacctcctgaaaatgaaaagaaggtagaggaagatattatcacagagcttgctcttggagaagatgctatatctagcagtatggaaattgaccaaggtgaaaagaatgaagatgaaacttctgcagatcttgtagaaacgattaatgaaaatgttattgaagataacaaaagtgagaatatcttagaaaatacagactctatggagacagatgaaatcattcctattttggaaaagcttgcaccttctgaggatgaacttacttgcttttctaaaacatctctccttccaatcgatgagacaaatccagatttggaagagaaaatggaaagttcttttggttcaccatctaaacaagaaagtagtgagagtttgccaaaagaagcctttctggtcctctctgatgaagaggatatttcgggtgaaaaagatgagtctgaagttatatcgcaaaatgaaacgtgctctccagcagaagtagaaagtaatgaaaaggacaacagacctgaggaagaagagcaagtaatacatgaagatgatgaaagaccttctgagaaaaatgaattttctagacgaaaacgttctaaatcagaagacatggacaatgtacagtctaaacgtcgtcgatatatggaagaagaatatgaggcagaatttcaagtaaagattacagccaaaggagacattaaccagaaacttcaaaaggttatacagtggttgctggaagaaaaattgtgtgcgctgcagtgtgctgtatttgataagactttggcagaattgaaaacacgagtggaaaagattgaatgtaacaagaggcataaaacagttctcactgaactacaggccaagatagccaggttaaccaaacgctttgaagcagccaaagaagatcttaagaaaagacatgaacatccacccaacccaccagtatcaccaggaaaaactgtaaatgatgtcaacagcaataataacatgtcttacagaaatgcaggcacagtgagacagatgctggagtccaaaagaaatgtaagcgagagtgcaccaccatcctttcaaactcctgtgaatacagtatcttcaaccaatcttgtcactcctccagcagttgtcagtagtcaacctaaattgcagactccagtgacttcgggttccctcacagcaacgtcagttcttcctgcacccaatacagctactgtagttgctactactcaggtgcctagtggaaatccccagcctacaatctctttacagcctttgccagtgattttgcatgtacctgttgcagtatcctcccagcctcagcttctacagagccatccagggactttggtgactaatcaaccatctggcaatgttgaattcatttctgtgcaaagcccacctacagtgagtggtcttaccaaaaatccagtatccttgccatccttgccaaatcccactaaaccaaacaacgttccttctgtgcccagtcctagtattcaaaggaaccctactgccagtgctgcaccattgggaacaacacttgctgtgcaggctgttccaacagcacactctattgtacaagccacaaggacttctttacccacagtgggcccatcaggactctatagtccatcaactaatcgaggtcctatacagatgaaaattccaatttctgcatttagtacttcgtctgctgcagaacagaacagcaataccaccccaagaattgaaaaccagacaaacaaaacaatagatgcttctgtcagtaagaaagcagctgatagcacatcacagtgtggaaaagccactggcagtgattcaagtggtgtcattgatctcacaatggatgatgaagagagtggagcttcacaagaccccaaaaaactaaatcacactcctgtatcaaccatgagttcttctcagcctgtgtcacgaccattgcaacccatacaaccagcaccgcctcttcaaccatctggggtgccaacaagtggaccatctcagaccaccatacacttactacctacagctccaactaccgtgaatgtaacacatcgtccagtaactcaggtgaccacaagactccctgtaccaagagctcctgcaaaccaccaggtggtttatacaactcttcctgcaccaccagctcaggctcccttgcgaggaactgttatgcaggctcctgctgttcggcaggtcaatccccaaaatagtgttacagttcgagtgcctcaaacaaccacatatgttgtaaacaatggactaaccctgggatcaacaggacctcagctcacagtgcatcaccgaccaccacaagtgcatactgagcccccacgccccgtgcacccagcacccttaccagaagctccacaaccacagcgtctgcccccagaagctgccagcacatctctgcctcagaagccacacttgaagttagcacgcgttcagagtcaaaatggcatagtactgtcatggagtgtcctggaggtggatcgaagctgtgccactgttgatagctaccatctctatgcttaccatgaggaacccagtgccactgtgccctcacaatggaaaaagattggggaagtcaaggcacttcccttgcccatggcatgtactctcacccagtttgtatctggtagcaaatactactttgcagtacgagccaaggatatttatggacgttttgggcctttctgtgatcctcagtcaacagatgtgatctcttctacccagagcagttaaaccttggagcctttatattttcctcttttaaaatttccaccttttggtcttgtttttaatcttgtgcatgataccccatgtaaaatccaccttgtgcaagatttcttggacagatgtgtgtatacactacatttgtttataaccagaagcaaaataaactcagcccacaaagctagaatcttttcctggacagtttaggctttggggtttggaaatgtaaatgtgtaccttgctttagttttgaggctggggaatatgtgtgggtgtttatgtgtgtttttccttatgtaggtgttattgcattggagtctcccattttcattctcaaatttacctcttaaagtacgaagtaagtagatcaaaggatttgagatgtgtaactggcatgattctgcttttgaaggatctatagtatcattttagttaagtgggtcaaacagaatcaaaacaaaacccaaagaaataaataaaaaacaaaatggctaaatagtttaaaataggttaattcgaacacaggaaaggatctatttgttgtttcttttgtctggtctcctgagttgttaattaggtgaaaaaagatctgcaatggccccctccctttcctaatctggcttttacatttattttgtgccttaaagattaactacaaagataaacatggccaaaaataaataaataaatatggccatatgtccgttgttgcttagtcttcccttgcagccttttacccttgatttctccttcatctctaccaaatatagcacaactcctcaagtaattttttttttttaagatggagttttgctcttgttgcagtgagctgagattgcgccattgcactccatcctgggagacaagagcgaaactctgcctcaaaaaaaaaaagaatttaaagtatatcctttgaggtcattttatgtaacaattagatataacctcctgtgtatctctctgttcctcttcaaagttattaaaattcagcttaggtcatggatttttaatatgagggccagctgtactggtgtcaggtaggtgttttggggtgtagataatttaggactggagggctgagttaagttttaggaggagaatgtggttgagaatattttgaaaggaatttatggagtttgtgaaataacttcgaagtcctcttcctttacaatatttgaattcatatttgtaccttctcaaaatagtgattcatttttcctagaattacaggagggagctcttttactaatgttgttttgtttgcaactttgatggcttataataggaagtattctagttgtaaagaaaactctttagagacttttgactggtcagtatactgaggtgtgagatttgattcatgatgaagaaagcctatagattgccaaaaaattaattctccaaaccacctttcactctcagaaaatgagaccacaaaggagtatgctataaatcaaatttgccaaccaattatgtagatattactcattctaggactaatgatgatggtaaagaagttgccagtgttatggcaatgaaaatttcagaaaggaggagttgatgatcttctagatgtatatgaacacctgtctatatctgcatgtatatgttttgacctgcagtggttgcaatgttgatatgtgttcaagattattcctgtctacaaaactgaaggcccatgttcaaattgttctttattgggtgtttttatggtcacgtggtaacaattttcttacctaacctacaaaaggttctcttgatgaacatttttatttatatttactaatcttttttaaaaaaagctttcatagcattatataatcagatgaagaaagcccagtagaataaaaaaaaaattcattagcctagcctatattatgttttctgtcaaaggaaaacaaattctcaaataggaattctaaaaatatttactaaagtaaaataactacttaaaatgttttattccagttgggaaggaagggtacagggagaaatcgcaattatttaggggagaagtatatttattataagatggtgtcctcaaattagcctaccatggcacgtaggggcagcagctatattagatttactagaggtgctaagttagaacactaggcttttattgaggcaggttttaatattgatagatgctttttgtttggtttgtttcttctgggagagaatggaggacttaagtagaagtagctactgataacagactttctagtagcagtttccactccacggttacctttttagtttcatagtatcttttcacaaagtattacaaataagctagattctcccagtttgggaatgcaagtttgctacatttttagcctggcaatatttgtgtaggtattgccttattggaaattctggaaacctgatactgcaacctgcaatgtaggatgtttgtatggcatttaaaggtaatggtgatgtttattattctatactttgcattctgtgagagtaattttcactctgtcttaagtgtgagtaagcctcttctaaaaatcttgttcttgccaagaaatttataaatcacatacgaagacgtctgttgctaacagttaactttatgaggtaactatatccttctatttctctggactcatttttaaaaaatatgccgaatactgcatactgtttaaggtagtatataagtttatgagagaagtggagagctttcttccttgaaaagtcggtatttgttgagataccatttgcctcacagagaggtgttccccactcccatccccattgccagataataaatattttgagaaaagtgacctaaaacagctgaaatcttaggtgcatctgtctgcagacctccttaagcaggctgtatcttacaattcccttactgcactgggtaagtgttaacttagtttttgttgtttgctcttttgctttaaatattctccaaattaccatttatgcaacatggttagggttaatactgcatggtattcatttatcttgtttcatgaactttccagtactgtacaaggtcaacaaagtaatgcctgtggtatcctcatctctcacttttttactctgtgattttagcacagtaaggtactgcaaagaccttccttccaaatgttctccttgactttatttcttgggccaattcagtatcctcaacatcctaagattttgttgttttatcactgacctgtggttggcctgttttattctaatttccagaaaagtcaagtcccagtatttgcaatatcaaataactctaaaaccgatgtgtgattctaccttccttactatttttactgggcaaatgccctatttttttaattattattatttttaacttttgggacacacaaaaatcagcaattctcatgaagcgtttgttagtgtggcagacttgtctaattcctgaaactcattcatccccttgagccagccaatggggaggaataggataatgcaaacacatgttttgttttctcattttcaaataatttaccatgttaaaataaacttttctttgttttttatttgtagagtcagctaagtacccatatttaaatgccgtctttattatttttttgaggtctttgtttttgtctgtttttgttttgttttgttttgtaaataaggtaactgggcaatcaaacaccttttggggattctggctttagtattttatcagccattttaaaattaaatataaaaatcctttgtaagaaacttgcatcctaatttttctttattgcaattgaaagtgtaaataataagacaatgtaagtaagaccttcctaatgtctaatacaaactgggctccagcaagtggccctatttttattagggttttgaaggtttgtgtgtgtgtgtgcgtgcgtgtgtgtgtttttcttttttaaatgtatagtagagtggtgtctgtataagtgttacctgtagtggggttttgtccagcaagcctgaaatttatactttgaaataaaactactgggtttttaa

SEQ ID NO: 440558 - DNA, 7978 bp, Homo sapiens
aagcaggctgttactggcccggagaggcgttatgcgtggcgggggcaagcggatggtgggcggttcgtacatgaagcgcgcgaaaagctgaggcggcaacgtcggggacggctgcgcgggacggctctgtaggaaggaacttggttccccctccctcagcttccgccccaaaagattcagaatggacagtttagaagaacctcagaaaaaagtctttaaggctcgaaaaacgatgagagtgagtgatcgtcagcaacttgaagcagtgtacaaggtcaaagaagaactgttgaaaactgatgtcaagctgttaaatggcaaccatgaaaatggagatttggacccaacctcacctttggaaaacatggattacattaaagacaaggaagaggtgaatggcattgaagagatttgttttgatcctgaaggaagtaaagcagaatggaaggaaacaccctgtatcctaagtgttaatgtaaaaaacaagcaggatgatgatttaaattgtgaacctttgtctccccataatataactccagaaccagtctctaaactgcctgctgaaccagtttctggtgatccagcccctggtgatctggatgccggagatccagcctccggagtactggcctctggtgattccacctctggtgatcccacctctagcgagccctcctctagtgatgctgcctctggtgatgcaacctctggtgatgccccttctggtgatgtgtcccctggtgatgccacctctggtgatgccactgctgatgatctctcctctggtgatcccacctctagtgatcccatcccaggtgaaccggtccctgttgaacccatttctggtgattgtgccgctgatgatatagcctctagtgaaataacttctgttgatctggcttctggagcaccagcttccactgatccagcctctgatgatctggcctctggtgatctatcctctagtgaactggcctctgatgatctggccactggtgaactggcctctgatgagctgacttctgaatcaacctttgatcgtacctttgaaccaaagtctgtaccagtttgtgaaccagttcctgaaattgacaatatagaaccaagtagcaataaagatgatgattttcttgaaaaaaatggagctgatgaaaaattagagcaaattcagagtaaagactcattggatgagaaaaataaagctgataataatattgatgctaatgaagaaactctagaaacagatgatacaactatttgttcagatcgacctcctgaaaatgaaaagaaggtagaggaagatattatcacagagcttgctcttggagaagatgctatatctagcagtatggaaattgaccaaggtgaaaagaatgaagatgaaacttctgcagatcttgtagaaacgattaatgaaaatgttattgaagataacaaaagtgagaatatcttagaaaatacagactctatggagacagatgaaatcattcctattttggaaaagcttgcaccttctgaggatgaacttacttgcttttctaaaacatctctccttccaatcgatgagacaaatccagatttggaagagaaaatggaaagttcttttggttcaccatctaaacaagaaagtagtgagagtttgccaaaagaagcctttctggtcctctctgatgaagaggatatttcgggtgaaaaagatgagtctgaagttatatcgcaaaatgaaacgtgctctccagcagaagtagaaagtaatgaaaaggacaacagacctgaggaagaagagcaagtaatacatgaagatgatgaaagaccttctgagaaaaatgaattttctagacgaaaacgttctaaatcagaagacatggacaatgtacagtctaaacgtcgtcgatatatggaagaagaatatgaggcagaatttcaagtaaagattacagccaaaggagacattaaccagaaacttcaaaaggttatacagtggttgctggaagaaaaattgtgtgcgctgcagtgtgctgtatttgataagactttggcagaattgaaaacacgagtggaaaagattgaatgtaacaagaggcataaaacagttctcactgaactacaggccaagatagccaggttaaccaaacgctttgaagcagccaaagaagatcttaagaaaagacatgaacatccacccaacccaccagtatcaccaggaaaaactgtaaatgatgtcaacagcaataataacatgtcttacagaaatgcaggcacagtgagacagatgctggagtccaaaagaaatgtaagcgagagtgcaccaccatcctttcaaactcctgtgaatacagtatcttcaaccaatcttgtcactcctccagcagttgtcagtagtcaacctaaattgcagactccagtgacttcgggttccctcacagcaacgtcagttcttcctgcacccaatacagctactgtagttgctactactcaggtgcctagtggaaatccccagcctacaatctctttacagcctttgccagtgattttgcatgtacctgttgcagtatcctcccagcctcagcttctacagagccatccagggactttggtgactaatcaaccatctggcaatgttgaattcatttctgtgcaaagcccacctacagtgagtggtcttaccaaaaatccagtatccttgccatccttgccaaatcccactaaaccaaacaacgttccttctgtgcccagtcctagtattcaaaggaaccctactgccagtgctgcaccattgggaacaacacttgctgtgcaggctgttccaacagcacactctattgtacaagccacaaggacttctttacccacagtgggcccatcaggactctatagtccatcaactaatcgaggtcctatacagatgaaaattccaatttctgcatttagtacttcgtctgctgcagaacagaacagcaataccaccccaagaattgaaaaccagacaaacaaaacaatagatgcttctgtcagtaagaaagcagctgatagcacatcacagtgtggaaaagccactggcagtgattcaagtggtgtcattgatctcacaatggatgatgaagagagtggagcttcacaagaccccaaaaaactaaatcacactcctgtatcaaccatgagttcttctcagcctgtgtcacgaccattgcaacccatacaaccagcaccgcctcttcaaccatctggggtgccaacaagtggaccatctcagaccaccatacacttactacctacagctccaactaccgtgaatgtaacacatcgtccagtaactcaggtgaccacaagactccctgtaccaagagctcctgcaaaccaccaggtggtttatacaactcttcctgcaccaccagctcaggctcccttgcgaggaactgttatgcaggctcctgctgttcggcaggtcaatccccaaaatagtgttacagttcgagtgcctcaaacaaccacatatgttgtaaacaatggactaaccctgggatcaacaggacctcagctcacagtgcatcaccgaccaccacaagtgcatactgagcccccacgccccgtgcacccagcacccttaccagaagctccacaaccacagcgtctgcccccagaagctgccagcacatctctgcctcagaagccacacttgaagttagcacgcgttcagagtcaaaatggcatagtactgtcatggagtgtcctggaggtggatcgaagctgtgccactgttgatagctaccatctctatgcttaccatgaggaacccagtgccactgtgccctcacaatggaaaaagattggggaagtcaaggcacttcccttgcccatggcatgtactctcacccagtttgtatctggtagcaaatactactttgcagtacgagccaaggatatttatggacgttttgggcctttctgtgatcctcagtcaacagatgtgatctcttctacccagagcagttaaaccttggagcctttatattttcctcttttaaaatttccaccttttggtcttgtttttaatcttgtgcatgataccccatgtaaaatccaccttgtgcaagatttcttggacagatgtgtgtatacactacatttgtttataaccagaagcaaaataaactcagcccacaaagctagaatcttttcctggacagtttaggctttggggtttggaaatgtaaatgtgtaccttgctttagttttgaggctggggaatatgtgtgggtgtttatgtgtgtttttccttatgtaggtgttattgcattggagtctcccattttcattctcaaatttacctcttaaagtacgaagtaagtagatcaaaggatttgagatgtgtaactggcatgattctgcttttgaaggatctatagtatcattttagttaagtgggtcaaacagaatcaaaacaaaacccaaagaaataaataaaaaacaaaatggctaaatagtttaaaataggttaattcgaacacaggaaaggatctatttgttgtttcttttgtctggtctcctgagttgttaattaggtgaaaaaagatctgcaatggccccctccctttcctaatctggcttttacatttattttgtgccttaaagattaactacaaagataaacatggccaaaaataaataaataaatatggccatatgtccgttgttgcttagtcttcccttgcagccttttacccttgatttctccttcatctctaccaaatatagcacaactcctcaagtaattttttttttttaagatggagttttgctcttgttgcagtgagctgagattgcgccattgcactccatcctgggagacaagagcgaaactctgcctcaaaaaaaaaaagaatttaaagtatatcctttgaggtcattttatgtaacaattagatataacctcctgtgtatctctctgttcctcttcaaagttattaaaattcagcttaggtcatggatttttaatatgagggccagctgtactggtgtcaggtaggtgttttggggtgtagataatttaggactggagggctgagttaagttttaggaggagaatgtggttgagaatattttgaaaggaatttatggagtttgtgaaataacttcgaagtcctcttcctttacaatatttgaattcatatttgtaccttctcaaaatagtgattcatttttcctagaattacaggagggagctcttttactaatgttgttttgtttgcaactttgatggcttataataggaagtattctagttgtaaagaaaactctttagagacttttgactggtcagtatactgaggtgtgagatttgattcatgatgaagaaagcctatagattgccaaaaaattaattctccaaaccacctttcactctcagaaaatgagaccacaaaggagtatgctataaatcaaatttgccaaccaattatgtagatattactcattctaggactaatgatgatggtaaagaagttgccagtgttatggcaatgaaaatttcagaaaggaggagttgatgatcttctagatgtatatgaacacctgtctatatctgcatgtatatgttttgacctgcagtggttgcaatgttgatatgtgttcaagattattcctgtctacaaaactgaaggcccatgttcaaattgttctttattgggtgtttttatggtcacgtggtaacaattttcttacctaacctacaaaaggttctcttgatgaacatttttatttatatttactaatcttttttaaaaaaagctttcatagcattatataatcagatgaagaaagcccagtagaataaaaaaaaaattcattagcctagcctatattatgttttctgtcaaaggaaaacaaattctcaaataggaattctaaaaatatttactaaagtaaaataactacttaaaatgttttattccagttgggaaggaagggtacagggagaaatcgcaattatttaggggagaagtatatttattataagatggtgtcctcaaattagcctaccatggcacgtaggggcagcagctatattagatttactagaggtgctaagttagaacactaggcttttattgaggcaggttttaatattgatagatgctttttgtttggtttgtttcttctgggagagaatggaggacttaagtagaagtagctactgataacagactttctagtagcagtttccactccacggttacctttttagtttcatagtatcttttcacaaagtattacaaataagctagattctcccagtttgggaatgcaagtttgctacatttttagcctggcaatatttgtgtaggtattgccttattggaaattctggaaacctgatactgcaacctgcaatgtaggatgtttgtatggcatttaaaggtaatggtgatgtttattattctatactttgcattctgtgagagtaattttcactctgtcttaagtgtgagtaagcctcttctaaaaatcttgttcttgccaagaaatttataaatcacatacgaagacgtctgttgctaacagttaactttatgaggtaactatatccttctatttctctggactcatttttaaaaaatatgccgaatactgcatactgtttaaggtagtatataagtttatgagagaagtggagagctttcttccttgaaaagtcggtatttgttgagataccatttgcctcacagagaggtgttccccactcccatccccattgccagataataaatattttgagaaaagtgacctaaaacagctgaaatcttaggtgcatctgtctgcagacctccttaagcaggctgtatcttacaattcccttactgcactgggtaagtgttaacttagtttttgttgtttgctcttttgctttaaatattctccaaattaccatttatgcaacatggttagggttaatactgcatggtattcatttatcttgtttcatgaactttccagtactgtacaaggtcaacaaagtaatgcctgtggtatcctcatctctcacttttttactctgtgattttagcacagtaaggtactgcaaagaccttccttccaaatgttctccttgactttatttcttgggccaattcagtatcctcaacatcctaagattttgttgttttatcactgacctgtggttggcctgttttattctaatttccagaaaagtcaagtcccagtatttgcaatatcaaataactctaaaaccgatgtgtgattctaccttccttactatttttactgggcaaatgccctatttttttaattattattatttttaacttttgggacacacaaaaatcagcaattctcatgaagcgtttgttagtgtggcagacttgtctaattcctgaaactcattcatccccttgagccagccaatggggaggaataggataatgcaaacacatgttttgttttctcattttcaaataatttaccatgttaaaataaacttttctttgttttttatttgtagagtcagctaagtacccatatttaaatgccgtctttattatttttttgaggtctttgtttttgtctgtttttgttttgttttgttttgtaaataaggtaactgggcaatcaaacaccttttggggattctggctttagtattttatcagccattttaaaattaaatataaaaatcctttgtaagaaacttgcatcctaatttttctttattgcaattgaaagtgtaaataataagacaatgtaagtaagaccttcctaatgtctaatacaaactgggctccagcaagtggccctatttttattagggttttgaaggtttgtgtgtgtgtgtgcgtgcgtgtgtgtgtttttcttttttaaatgtatagtagagtggtgtctgtataagtgttacctgtagtggggttttgtccagcaagcctgaaatttatactttgaaataaaactactgggtttttaa

SEQ ID NO: 440559 - DNA, 8001 bp, Homo sapiens
tgcccagtctcacacagtaggtttcctgggagagttggaattcaaatctgtgaatctgtctacagtctacagagttcatgttcttaattgggttattaaaagtgatgaatttttttaaaggaatgcttacttttaatattcagaatggacagtttagaagaacctcagaaaaaagtctttaaggctcgaaaaacgatgagagtgagtgatcgtcagcaacttgaagcagtgtacaaggtcaaagaagaactgttgaaaactgatgtcaagctgttaaatggcaaccatgaaaatggagatttggacccaacctcacctttggaaaacatggattacattaaagacaaggaagaggtgaatggcattgaagagatttgttttgatcctgaaggaagtaaagcagaatggaaggaaacaccctgtatcctaagtgttaatgtaaaaaacaagcaggatgatgatttaaattgtgaacctttgtctccccataatataactccagaaccagtctctaaactgcctgctgaaccagtttctggtgatccagcccctggtgatctggatgccggagatccagcctccggagtactggcctctggtgattccacctctggtgatcccacctctagcgagccctcctctagtgatgctgcctctggtgatgcaacctctggtgatgccccttctggtgatgtgtcccctggtgatgccacctctggtgatgccactgctgatgatctctcctctggtgatcccacctctagtgatcccatcccaggtgaaccggtccctgttgaacccatttctggtgattgtgccgctgatgatatagcctctagtgaaataacttctgttgatctggcttctggagcaccagcttccactgatccagcctctgatgatctggcctctggtgatctatcctctagtgaactggcctctgatgatctggccactggtgaactggcctctgatgagctgacttctgaatcaacctttgatcgtacctttgaaccaaagtctgtaccagtttgtgaaccagttcctgaaattgacaatatagaaccaagtagcaataaagatgatgattttcttgaaaaaaatggagctgatgaaaaattagagcaaattcagagtaaagactcattggatgagaaaaataaagctgataataatattgatgctaatgaagaaactctagaaacagatgatacaactatttgttcagatcgacctcctgaaaatgaaaagaaggtagaggaagatattatcacagagcttgctcttggagaagatgctatatctagcagtatggaaattgaccaaggtgaaaagaatgaagatgaaacttctgcagatcttgtagaaacgattaatgaaaatgttattgaagataacaaaagtgagaatatcttagaaaatacagactctatggagacagatgaaatcattcctattttggaaaagcttgcaccttctgaggatgaacttacttgcttttctaaaacatctctccttccaatcgatgagacaaatccagatttggaagagaaaatggaaagttcttttggttcaccatctaaacaagaaagtagtgagagtttgccaaaagaagcctttctggtcctctctgatgaagaggatatttcgggtgaaaaagatgagtctgaagttatatcgcaaaatgaaacgtgctctccagcagaagtagaaagtaatgaaaaggacaacagacctgaggaagaagagcaagtaatacatgaagatgatgaaagaccttctgagaaaaatgaattttctagacgaaaacgttctaaatcagaagacatggacaatgtacagtctaaacgtcgtcgatatatggaagaagaatatgaggcagaatttcaagtaaagattacagccaaaggagacattaaccagaaacttcaaaaggttatacagtggttgctggaagaaaaattgtgtgcgctgcagtgtgctgtatttgataagactttggcagaattgaaaacacgagtggaaaagattgaatgtaacaagaggcataaaacagttctcactgaactacaggccaagatagccaggttaaccaaacgctttgaagcagccaaagaagatcttaagaaaagacatgaacatccacccaacccaccagtatcaccaggaaaaactgtaaatgatgtcaacagcaataataacatgtcttacagaaatgcaggcacagtgagacagatgctggagtccaaaagaaatgtaagcgagagtgcaccaccatcctttcaaactcctgtgaatacagtatcttcaaccaatcttgtcactcctccagcagttgtcagtagtcaacctaaattgcagactccagtgacttcgggttccctcacagcaacgtcagttcttcctgcacccaatacagctactgtagttgctactactcaggtgcctagtggaaatccccagcctacaatctctttacagcctttgccagtgattttgcatgtacctgttgcagtatcctcccagcctcagcttctacagagccatccagggactttggtgactaatcaaccatctggcaatgttgaattcatttctgtgcaaagcccacctacagtgagtggtcttaccaaaaatccagtatccttgccatccttgccaaatcccactaaaccaaacaacgttccttctgtgcccagtcctagtattcaaaggaaccctactgccagtgctgcaccattgggaacaacacttgctgtgcaggctgttccaacagcacactctattgtacaagccacaaggacttctttacccacagtgggcccatcaggactctatagtccatcaactaatcgaggtcctatacagatgaaaattccaatttctgcatttagtacttcgtctgctgcagaacagaacagcaataccaccccaagaattgaaaaccagacaaacaaaacaatagatgcttctgtcagtaagaaagcagctgatagcacatcacagtgtggaaaagccactggcagtgattcaagtggtgtcattgatctcacaatggatgatgaagagagtggagcttcacaagaccccaaaaaactaaatcacactcctgtatcaaccatgagttcttctcagcctgtgtcacgaccattgcaacccatacaaccagcaccgcctcttcaaccatctggggtgccaacaagtggaccatctcagaccaccatacacttactacctacagctccaactaccgtgaatgtaacacatcgtccagtaactcaggtgaccacaagactccctgtaccaagagctcctgcaaaccaccaggtggtttatacaactcttcctgcaccaccagctcaggctcccttgcgaggaactgttatgcaggctcctgctgttcggcaggtcaatccccaaaatagtgttacagttcgagtgcctcaaacaaccacatatgttgtaaacaatggactaaccctgggatcaacaggacctcagctcacagtgcatcaccgaccaccacaagtgcatactgagcccccacgccccgtgcacccagcacccttaccagaagctccacaaccacagcgtctgcccccagaagctgccagcacatctctgcctcagaagccacacttgaagttagcacgcgttcagagtcaaaatggcatagtactgtcatggagtgtcctggaggtggatcgaagctgtgccactgttgatagctaccatctctatgcttaccatgaggaacccagtgccactgtgccctcacaatggaaaaagattggggaagtcaaggcacttcccttgcccatggcatgtactctcacccagtttgtatctggtagcaaatactactttgcagtacgagccaaggatatttatggacgttttgggcctttctgtgatcctcagtcaacagatgtgatctcttctacccagagcagttaaaccttggagcctttatattttcctcttttaaaatttccaccttttggtcttgtttttaatcttgtgcatgataccccatgtaaaatccaccttgtgcaagatttcttggacagatgtgtgtatacactacatttgtttataaccagaagcaaaataaactcagcccacaaagctagaatcttttcctggacagtttaggctttggggtttggaaatgtaaatgtgtaccttgctttagttttgaggctggggaatatgtgtgggtgtttatgtgtgtttttccttatgtaggtgttattgcattggagtctcccattttcattctcaaatttacctcttaaagtacgaagtaagtagatcaaaggatttgagatgtgtaactggcatgattctgcttttgaaggatctatagtatcattttagttaagtgggtcaaacagaatcaaaacaaaacccaaagaaataaataaaaaacaaaatggctaaatagtttaaaataggttaattcgaacacaggaaaggatctatttgttgtttcttttgtctggtctcctgagttgttaattaggtgaaaaaagatctgcaatggccccctccctttcctaatctggcttttacatttattttgtgccttaaagattaactacaaagataaacatggccaaaaataaataaataaatatggccatatgtccgttgttgcttagtcttcccttgcagccttttacccttgatttctccttcatctctaccaaatatagcacaactcctcaagtaattttttttttttaagatggagttttgctcttgttgcagtgagctgagattgcgccattgcactccatcctgggagacaagagcgaaactctgcctcaaaaaaaaaaagaatttaaagtatatcctttgaggtcattttatgtaacaattagatataacctcctgtgtatctctctgttcctcttcaaagttattaaaattcagcttaggtcatggatttttaatatgagggccagctgtactggtgtcaggtaggtgttttggggtgtagataatttaggactggagggctgagttaagttttaggaggagaatgtggttgagaatattttgaaaggaatttatggagtttgtgaaataacttcgaagtcctcttcctttacaatatttgaattcatatttgtaccttctcaaaatagtgattcatttttcctagaattacaggagggagctcttttactaatgttgttttgtttgcaactttgatggcttataataggaagtattctagttgtaaagaaaactctttagagacttttgactggtcagtatactgaggtgtgagatttgattcatgatgaagaaagcctatagattgccaaaaaattaattctccaaaccacctttcactctcagaaaatgagaccacaaaggagtatgctataaatcaaatttgccaaccaattatgtagatattactcattctaggactaatgatgatggtaaagaagttgccagtgttatggcaatgaaaatttcagaaaggaggagttgatgatcttctagatgtatatgaacacctgtctatatctgcatgtatatgttttgacctgcagtggttgcaatgttgatatgtgttcaagattattcctgtctacaaaactgaaggcccatgttcaaattgttctttattgggtgtttttatggtcacgtggtaacaattttcttacctaacctacaaaaggttctcttgatgaacatttttatttatatttactaatcttttttaaaaaaagctttcatagcattatataatcagatgaagaaagcccagtagaataaaaaaaaaattcattagcctagcctatattatgttttctgtcaaaggaaaacaaattctcaaataggaattctaaaaatatttactaaagtaaaataactacttaaaatgttttattccagttgggaaggaagggtacagggagaaatcgcaattatttaggggagaagtatatttattataagatggtgtcctcaaattagcctaccatggcacgtaggggcagcagctatattagatttactagaggtgctaagttagaacactaggcttttattgaggcaggttttaatattgatagatgctttttgtttggtttgtttcttctgggagagaatggaggacttaagtagaagtagctactgataacagactttctagtagcagtttccactccacggttacctttttagtttcatagtatcttttcacaaagtattacaaataagctagattctcccagtttgggaatgcaagtttgctacatttttagcctggcaatatttgtgtaggtattgccttattggaaattctggaaacctgatactgcaacctgcaatgtaggatgtttgtatggcatttaaaggtaatggtgatgtttattattctatactttgcattctgtgagagtaattttcactctgtcttaagtgtgagtaagcctcttctaaaaatcttgttcttgccaagaaatttataaatcacatacgaagacgtctgttgctaacagttaactttatgaggtaactatatccttctatttctctggactcatttttaaaaaatatgccgaatactgcatactgtttaaggtagtatataagtttatgagagaagtggagagctttcttccttgaaaagtcggtatttgttgagataccatttgcctcacagagaggtgttccccactcccatccccattgccagataataaatattttgagaaaagtgacctaaaacagctgaaatcttaggtgcatctgtctgcagacctccttaagcaggctgtatcttacaattcccttactgcactgggtaagtgttaacttagtttttgttgtttgctcttttgctttaaatattctccaaattaccatttatgcaacatggttagggttaatactgcatggtattcatttatcttgtttcatgaactttccagtactgtacaaggtcaacaaagtaatgcctgtggtatcctcatctctcacttttttactctgtgattttagcacagtaaggtactgcaaagaccttccttccaaatgttctccttgactttatttcttgggccaattcagtatcctcaacatcctaagattttgttgttttatcactgacctgtggttggcctgttttattctaatttccagaaaagtcaagtcccagtatttgcaatatcaaataactctaaaaccgatgtgtgattctaccttccttactatttttactgggcaaatgccctatttttttaattattattatttttaacttttgggacacacaaaaatcagcaattctcatgaagcgtttgttagtgtggcagacttgtctaattcctgaaactcattcatccccttgagccagccaatggggaggaataggataatgcaaacacatgttttgttttctcattttcaaataatttaccatgttaaaataaacttttctttgttttttatttgtagagtcagctaagtacccatatttaaatgccgtctttattatttttttgaggtctttgtttttgtctgtttttgttttgttttgttttgtaaataaggtaactgggcaatcaaacaccttttggggattctggctttagtattttatcagccattttaaaattaaatataaaaatcctttgtaagaaacttgcatcctaatttttctttattgcaattgaaagtgtaaataataagacaatgtaagtaagaccttcctaatgtctaatacaaactgggctccagcaagtggccctatttttattagggttttgaaggtttgtgtgtgtgtgtgcgtgcgtgtgtgtgtttttcttttttaaatgtatagtagagtggtgtctgtataagtgttacctgtagtggggttttgtccagcaagcctgaaatttatactttgaaataaaactactgggtttttaaacacacacacacaaacaaaaaacaacacaaaaaaaacaccaaacaaaaaaacaacaacac

SEQ ID NO: 440560 - DNA, 6750 bp, Homo sapiens
tgcccagtctcacacagtaggtttcctgggagagttggaattcaaatctgtgaatctgtctacagtctacagagttcatgttcttaattgggttattaaaagtgatgaatttttttaaaggaatgcttacttttaatattcagaatggacagtttagaagaacctcagaaaaaagtctttaaggctcgaaaaacgatgagagtgagtgatcgtcagcaacttgaagcagtgtacaaggtcaaagaagaactgttgaaaactgatgtcaagctgttaaatggcaaccatgaaaatggagatttggacccaacctcacctttggaaaacatggattacattaaagacaaggaagaggtgaatggcattgaagagatttgttttgatcctgaaggaagtaaagcagaatggaaggaaacaccctgtatcctaagtgttaatgtaaaaaacaagcaggatgatgatttaaattgtgaacctttgtctccccataatataactccagaaccagtctctaaactgcctgctgaaccagtttctggtgatccagcccctggtgatctggatgccggagatccagcctccggagtactggcctctggtgattccacctctggtgatcccacctctagcgagccctcctctagtgatgctgcctctggtgatgcaacctctggtgatgccccttctggtgatgtgtcccctggtgatgccacctctggtgatgccactgctgatgatctctcctctggtgatcccacctctagtgatcccatcccaggtgaaccggtccctgttgaacccatttctggtgattgtgccgctgatgatatagcctctagtgaaataacttctgttgatctggcttctggagcaccagcttccactgatccagcctctgatgatctggcctctggtgatctatcctctagtgaactggcctctgatgatctggccactggtgaactggcctctgatgagctgacttctgaatcaacctttgatcgtacctttgaaccaaagtctgtaccagtttgtgaaccagttcctgaaattgacaatatagaaccaagtagcaataaagatgatgattttcttgaaaaaaatggagctgatgaaaaattagagcaaattcagagtaaagactcattggatgagaaaaataaagctgataataatattgatgctaatgaagaaactctagaaacagatgatacaactatttgttcagatcgacctcctgaaaatgaaaagaaggtagaggaagatattatcacagagcttgctcttggagaagatgctatatctagcagtatggaaattgaccaaggtgaaaagaatgaagatgaaacttctgcagatcttgtagaaacgattaatgaaaatgttattgaagataacaaaagtgagaatatcttagaaaatacagactctatggagacagatgaaatcattcctattttggaaaagcttgcaccttctgaggatgaacttacttgcttttctaaaacatctctccttccaatcgatgagacaaatccagatttggaagagaaaatggaaagttcttttggttcaccatctaaacaagaaagtagtgagagtttgccaaaagaagcctttctggtcctctctgatgaagaggatatttcgggtgaaaaagatgagtctgaagttatatcgcaaaatgaaacgtgctctccagcagaagtagaaagtaatgaaaaggacaacagacctgaggaagaagagcaagtaatacatgaagatgatgaaagaccttctgagaaaaatgaattttctagacgaaaacgttctaaatcagaagacatggacaatgtacagtctaaacgtcgtcgatatatggaagaagaatatgaggcagaatttcaagtaaagattacagccaaaggagacattaaccagaaacttcaaaaggttatacagtggttgctggaagaaaaattgtgtgcgctgcagtgtgctgtatttgataagactttggcagaattgaaaacacgagtggaaaagattgaatgtaacaagaggcataaaacagttctcactgaactacaggccaagatagccaggttaaccaaacgctttgaagcagccaaagaagatcttaagaaaagacatgaacatccacccaacccaccagtatcaccaggaaaaactgtaaatgatgtcaacagcaataataacatgtcttacagaaatgcaggcacagtgagacagatgctggagtccaaaagaaatgtaagcgagagtgcaccaccatcctttcaaactcctgtgaatacagtatcttcaaccaatcttgtcactcctccagcagttgtcagtagtcaacctaaattgcagactccagtgacttcgggttccctcacagcaacgtcagttcttcctgcacccaatacagctactgtagttgctactactcaggtgcctagtggaaatccccagcctacaatctctttacagcctttgccagtgattttgcatgtacctgttgcagtatcctcccagcctcagcttctacagagccatccagggactttggtgactaatcaaccatctggcaatgttgaattcatttctgtgcaaagcccacctacagtgagtggtcttaccaaaaatccagtatccttgccatccttgccaaatcccactaaaccaaacaacgttccttctgtgcccagtcctagtattcaaaggaaccctactgccagtgctgcaccattgggaacaacacttgctgtgcaggctgttccaacagcacactctattgtacaagccacaaggacttctttacccacagtgggcccatcaggactctatagtccatcaactaatcgaggtcctatacagatgaaaattccaatttctgcatttagtacttcgtctgctgcagaacagaacagcaataccaccccaagaattgaaaaccagacaaacaaaacaatagatgcttctgtcagtaagaaagcagctgatagcacatcacagtgtggaaaagccactggcagtgattcaagtggtgtcattgatctcacaatggatgatgaagagagtggagcttcacaagaccccaaaaaactaaatcacactcctgtatcaaccatgagttcttctcagcctgtgtcacgaccattgcaacccatacaaccagcaccgcctcttcaaccatctggggtgccaacaagtggaccatctcagaccaccatacacttactacctacagctccaactaccgtgaatgtaacacatcgtccagtaactcaggtgaccacaagactccctgtaccaagagctcctgcaaaccaccaggtggtttatacaactcttcctgcaccaccagctcaggctcccttgcgaggaactgttatgcaggctcctgctgttcggcaggtcaatccccaaaatagtgttacagttcgagtgcctcaaacaaccacatatgttgtaaacaatggactaaccctgggatcaacaggacctcagctcacagtgcatcaccgaccaccacaagtgcatactgagcccccacgccccgtgcacccagcacccttaccagaagctccacaaccacagcgtctgcccccagaagctgccagcacatctctgcctcagaagccacacttgaagttagcacgcgttcagagtcaaaatggcatagtactgtcatggagtgtcctggaggtggatcgaagctgtgccactgttgatagctaccatctctatgcttaccatgaggaacccagtgccactgtgccctcacaatggaaaaagattggggaagtcaaggcacttcccttgcccatggcatgtactctcacccagtttgtatctggtagcaaatactactttgcagtacgagccaaggatatttatggacgttttgggcctttctgtgatcctcagtcaacagatgtgatctcttctacccagagcagttaaaccttggagcctttatattttcctcttttaaaatttccaccttttggtcttgtttttaatcttgtgcatgataccccatgtaaaatccaccttgtgcaagatttcttggacagatgtgtgtatacactacatttgtttataaccagaagcaaaataaactcagcccacaaagctagaatcttttcctggacagtttaggctttggggtttggaaatgtaaatgtgtaccttgctttagttttgaggctggggaatatgtgtgggtgtttatgtgtgtttttccttatgtaggtgttattgcattggagtctcccattttcattctcaaatttacctcttaaagtacgaagtaagtagatcaaaggatttgagatgtgtaactggcatgattctgcttttgaaggatctatagtatcattttagttaagtgggtcaaacagaatcaaaacaaaacccaaagaaataaataaaaaacaaaatggctaaatagtttaaaataggttaattcgaacacaggaaaggatctatttgttgtttcttttgtctggtctcctgagttgttaattaggtgaaaaaagatctgcaatggccccctccctttcctaatctggcttttacatttattttgtgccttaaagattaactacaaagataaacatggccaaaaataaataaataaatatggccatatgtccgttgttgcttagtcttcccttgcagccttttacccttgatttctccttcatctctaccaaatatagcacaactcctcaagtaattttttttttttaagatggagttttgctcttgttgcagtgagctgagattgcgccattgcactccatcctgggagacaagagcgaaactctgcctcaaaaaaaaaaagaatttaaagtatatcctttgaggtcattttatgtaacaattagatataacctcctgtgtatctctctgttcctcttcaaagttattaaaattcagcttaggtcatggatttttaatatgagggccagctgtactggtgtcaggtaggtgttttggggtgtagataatttaggactggagggctgagttaagttttaggaggagaatgtggttgagaatattttgaaaggaatttatggagtttgtgaaataacttcgaagtcctcttcctttacaatatttgaattcatatttgtaccttctcaaaatagtgattcatttttcctagaattacaggagggagctcttttactaatgttgttttgtttgcaactttgatggcttataataggaagtattctagttgtaaagaaaactctttagagacttttgactggtcagtatactgaggtgtgagatttgattcatgatgaagaaagcctatagattgccaaaaaattaattctccaaaccacctttcactctcagaaaatgagaccacaaaggagtatgctataaatcaaatttgccaaccaattatgtagatattactcattctaggactaatgatgatggtaaagaagttgccagtgttatggcaatgaaaatttcagaaaggaggagttgatgatcttctagatgtatatgaacacctgtctatatctgcatgtatatgttttgacctgcagtggttgcaatgttgatatgtgttcaagattattcctgtctacaaaactgaaggcccatgttcaaattgttctttattgggtgtttttatggtcacgtggtaacaattttcttacctaacctacaaaaggttctcttgatgaacatttttatttatatttactaatcttttttaaaaaaagctttcatagcattatataatcagatgaagaaagcccagtagaataaaaaaaaaattcattagcctagcctatattatgttttctgtcaaaggaaaacaaattctcaaataggaattctaaaaatatttactaaagtaaaataactacttaaaatgttttattccagttgggaaggaagggtacagggagaaatcgcaattatttaggggagaagtatatttattataagatggtgtcctcaaattagcctaccatggcacgtaggggcagcagctatattagatttactagaggtgctaagttagaacactaggcttttattgaggcaggttttaatattgatagatgctttttgtttggtttgtttcttctgggagagaatggaggacttaagtagaagtagctactgataacagactttctagtagcagtttccactccacggttacctttttagtttcatagtatcttttcacaaagtattacaaataagctagattctcccagtttgggaatgcaagtttgctacatttttagcctggcaatatttgtgtaggtattgccttattggaaattctggaaacctgatactgcaacctgcaatgtaggatgtttgtatggcatttaaaggtaatggtgatgtttattattctatactttgcattctgtgagagtaattttcactctgtcttaagtgtgagtaagcctcttctaaaaatcttgttcttgccaagaaatttataaatcacatacgaagacgtctgttgctaacagttaactttatgaggtaactatatccttctatttctctggactcatttttaaaaaatatgccgaatactgcatactgtttaaggtagtatataagtttatgagagaagtggagagctttcttccttgaaaagtcggtatttgttgagataccatttgcctcacagagaggtgttccccactcccatccccattgccagataataaatattttgagaaaagtgaccta

SEQ ID NO: 440561 - DNA, 5799 bp, Homo sapiens
tgcccagtctcacacagtaggtttcctgggagagttggaattcaaatctgtgaatctgtctacagtctacagagttcatgttcttaattgggttattaaaagtgatgaatttttttaaaggaatgcttacttttaatattcagaatggacagtttagaagaacctcagaaaaaagtctttaaggctcgaaaaacgatgagagtgagtgatcgtcagcaacttgaagcagtgtacaaggtcaaagaagaactgttgaaaactgatgtcaagctgttaaatggcaaccatgaaaatggagatttggacccaacctcacctttggaaaacatggattacattaaagacaaggaagaggtgaatggcattgaagagatttgttttgatcctgaaggaagtaaagcagaatggaaggaaacaccctgtatcctaagtgttaatgtaaaaaacaagcaggatgatgatttaaattgtgaacctttgtctccccataatataactccagaaccagtctctaaactgcctgctgaaccagtttctggtgatccagcccctggtgatctggatgccggagatccagcctccggagtactggcctctggtgattccacctctggtgatcccacctctagcgagccctcctctagtgatgctgcctctggtgatgcaacctctggtgatgccccttctggtgatgtgtcccctggtgatgccacctctggtgatgccactgctgatgatctctcctctggtgatcccacctctagtgatcccatcccaggtgaaccggtccctgttgaacccatttctggtgattgtgccgctgatgatatagcctctagtgaaataacttctgttgatctggcttctggagcaccagcttccactgatccagcctctgatgatctggcctctggtgatctatcctctagtgaactggcctctgatgatctggccactggtgaactggcctctgatgagctgacttctgaatcaacctttgatcgtacctttgaaccaaagtctgtaccagtttgtgaaccagttcctgaaattgacaatatagaaccaagtagcaataaagatgatgattttcttgaaaaaaatggagctgatgaaaaattagagcaaattcagagtaaagactcattggatgagaaaaataaagctgataataatattgatgctaatgaagaaactctagaaacagatgatacaactatttgttcagatcgacctcctgaaaatgaaaagaaggtagaggaagatattatcacagagcttgctcttggagaagatgctatatctagcagtatggaaattgaccaaggtgaaaagaatgaagatgaaacttctgcagatcttgtagaaacgattaatgaaaatgttattgaagataacaaaagtgagaatatcttagaaaatacagactctatggagacagatgaaatcattcctattttggaaaagcttgcaccttctgaggatgaacttacttgcttttctaaaacatctctccttccaatcgatgagacaaatccagatttggaagagaaaatggaaagttcttttggttcaccatctaaacaagaaagtagtgagagtttgccaaaagaagcctttctggtcctctctgatgaagaggatatttcgggtgaaaaagatgagtctgaagttatatcgcaaaatgaaacgtgctctccagcagaagtagaaagtaatgaaaaggacaacagacctgaggaagaagagcaagtaatacatgaagatgatgaaagaccttctgagaaaaatgaattttctagacgaaaacgttctaaatcagaagacatggacaatgtacagtctaaacgtcgtcgatatatggaagaagaatatgaggcagaatttcaagtaaagattacagccaaaggagacattaaccagaaacttcaaaaggttatacagtggttgctggaagaaaaattgtgtgcgctgcagtgtgctgtatttgataagactttggcagaattgaaaacacgagtggaaaagattgaatgtaacaagaggcataaaacagttctcactgaactacaggccaagatagccaggttaaccaaacgctttgaagcagccaaagaagatcttaagaaaagacatgaacatccacccaacccaccagtatcaccaggaaaaactgtaaatgatgtcaacagcaataataacatgtcttacagaaatgcaggcacagtgagacagatgctggagtccaaaagaaatgtaagcgagagtgcaccaccatcctttcaaactcctgtgaatacagtatcttcaaccaatcttgtcactcctccagcagttgtcagtagtcaacctaaattgcagactccagtgacttcgggttccctcacagcaacgtcagttcttcctgcacccaatacagctactgtagttgctactactcaggtgcctagtggaaatccccagcctacaatctctttacagcctttgccagtgattttgcatgtacctgttgcagtatcctcccagcctcagcttctacagagccatccagggactttggtgactaatcaaccatctggcaatgttgaattcatttctgtgcaaagcccacctacagtgagtggtcttaccaaaaatccagtatccttgccatccttgccaaatcccactaaaccaaacaacgttccttctgtgcccagtcctagtattcaaaggaaccctactgccagtgctgcaccattgggaacaacacttgctgtgcaggctgttccaacagcacactctattgtacaagccacaaggacttctttacccacagtgggcccatcaggactctatagtccatcaactaatcgaggtcctatacagatgaaaattccaatttctgcatttagtacttcgtctgctgcagaacagaacagcaataccaccccaagaattgaaaaccagacaaacaaaacaatagatgcttctgtcagtaagaaagcagctgatagcacatcacagtgtggaaaagccactggcagtgattcaagtggtgtcattgatctcacaatggatgatgaagagagtggagcttcacaagaccccaaaaaactaaatcacactcctgtatcaaccatgagttcttctcagcctgtgtcacgaccattgcaacccatacaaccagcaccgcctcttcaaccatctggggtgccaacaagtggaccatctcagaccaccatacacttactacctacagctccaactaccgtgaatgtaacacatcgtccagtaactcaggtgaccacaagactccctgtaccaagagctcctgcaaaccaccaggtggtttatacaactcttcctgcaccaccagctcaggctcccttgcgaggaactgttatgcaggctcctgctgttcggcaggtcaatccccaaaatagtgttacagttcgagtgcctcaaacaaccacatatgttgtaaacaatggactaaccctgggatcaacaggacctcagctcacagtgcatcaccgaccaccacaagtgcatactgagcccccacgccccgtgcacccagcacccttaccagaagctccacaaccacagcgtctgcccccagaagctgccagcacatctctgcctcagaagccacacttgaagttagcacgcgttcagagtcaaaatggcatagtactgtcatggagtgtcctggaggtggatcgaagctgtgccactgttgatagctaccatctctatgcttaccatgaggaacccagtgccactgtgccctcacaatggaaaaagattggggaagtcaaggcacttcccttgcccatggcatgtactctcacccagtttgtatctggtagcaaatactactttgcagtacgagccaaggatatttatggacgttttgggcctttctgtgatcctcagtcaacagatgtgatctcttctacccagagcagttaaaccttggagcctttatattttcctcttttaaaatttccaccttttggtcttgtttttaatcttgtgcatgataccccatgtaaaatccaccttgtgcaagatttcttggacagatgtgtgtatacactacatttgtttataaccagaagcaaaataaactcagcccacaaagctagaatcttttcctggacagtttaggctttggggtttggaaatgtaaatgtgtaccttgctttagttttgaggctggggaatatgtgtgggtgtttatgtgtgtttttccttatgtaggtgttattgcattggagtctcccattttcattctcaaatttacctcttaaagtacgaagtaagtagatcaaaggatttgagatgtgtaactggcatgattctgcttttgaaggatctatagtatcattttagttaagtgggtcaaacagaatcaaaacaaaacccaaagaaataaataaaaaacaaaatggctaaatagtttaaaataggttaattcgaacacaggaaaggatctatttgttgtttcttttgtctggtctcctgagttgttaattaggtgaaaaaagatctgcaatggccccctccctttcctaatctggcttttacatttattttgtgccttaaagattaactacaaagataaacatggccaaaaataaataaataaatatggccatatgtccgttgttgcttagtcttcccttgcagccttttacccttgatttctccttcatctctaccaaatatagcacaactcctcaagtaattttttttttttaagatggagttttgctcttgttgcagtgagctgagattgcgccattgcactccatcctgggagacaagagcgaaactctgcctcaaaaaaaaaaagaatttaaagtatatcctttgaggtcattttatgtaacaattagatataacctcctgtgtatctctctgttcctcttcaaagttattaaaattcagcttaggtcatggatttttaatatgagggccagctgtactggtgtcaggtaggtgttttggggtgtagataatttaggactggagggctgagttaagttttaggaggagaatgtggttgagaatattttgaaaggaatttatggagtttgtgaaataacttcgaagtcctcttcctttacaatatttgaattcatatttgtaccttctcaaaatagtgattcatttttcctagaattacaggagggagctcttttactaatgttgttttgtttgcaactttgatggcttataataggaagtattctagttgtaaagaaaactctttagagacttttgactggtcagtatactgaggtgtgagatttgattcatgatgaagaaagcctatagattgccaaaaaattaattctccaaaccacctttcactctcagaaaatgagaccacaaaggagtatgctataaatcaaatttgccaaccaattatgtagatattactcattctaggactaatgatgatggtaaagaagttgccagtgttatggcaatgaaaatttcagaaaggaggagttgatgatcttctagatgtatatgaacacctgtctatatctgcatgtatatgttttgacctgcagtggttgcaatgttgatatgtgttcaagattattcctgtctacaaaactgaaggcccatgttcaaattgttctttattgggtgtttttatggtcacgtggtaacaattttcttacctaacctacaaaaggttctcttgatgaacatttttatttatatttactaatcttttttaaaaaaagctttcatagcttttttatcagttgaggcctatatatttacacgtggtgg

SEQ ID NO: 440562 - DNA, 5895 bp, Homo sapiens
ttcacagggcaatctcaattacaatatatacaccagacaaacaaaacaatagatgcttctgtcagtaagaaagcagctgatagcacatcacagcatccacccaacccaccagtatcaccaggaaaaactgtaaatgatgtcaacagcaataataacatgtcttacagaaatgcaggcacagtgagacagatgctggagtccaaaagaaatgtaagcgagagtgcaccaccatcctttcaaactcctgtgaatacagtatcttcaaccaatcttgtcactcctccagcagttgtcagtagtcaacctaaattgcagactccagtgacttcgggttccctcacagcaacgtcagttcttcctgcacccaatacagctactgtagttgctactactcaggtgcctagtggaaatccccagcctacaatctctttacagcctttgccagtgattttgcatgtacctgttgcagtatcctcccagcctcagcttctacagagccatccagggactttggtgactaatcaaccatctggcaatgttgaattcatttctgtgcaaagcccacctacagtgagtggtcttaccaaaaatccagtatccttgccatccttgccaaatcccactaaaccaaacaacgttccttctgtgcccagtcctagtattcaaaggaaccctactgccagtgctgcaccattgggaacaacacttgctgtgcaggctgttccaacagcacactctattgtacaagccacaaggacttctttacccacagtgggcccatcaggactctatagtccatcaactaatcgaggtcctatacagatgaaaattccaatttctgcatttagtacttcgtctgctgcagaacagaacagcaataccaccccaagaattgaaaaccagacaaacaaaacaatagatgcttctgtcagtaagaaagcagctgatagcacatcacagtgtggaaaagccactggcagtgattcaagtggtgtcattgatctcacaatggatgatgaagagagtggagcttcacaagaccccaaaaaactaaatcacactcctgtatcaaccatgagttcttctcagcctgtgtcacgaccattgcaacccatacaaccagcaccgcctcttcaaccatctggggtgccaacaagtggaccatctcagaccaccatacacttactacctacagctccaactaccgtgaatgtaacacatcgtccagtaactcaggtgaccacaagactccctgtaccaagagctcctgcaaaccaccaggtggtttatacaactcttcctgcaccaccagctcaggctcccttgcgaggaactgttatgcaggctcctgctgttcggcaggtcaatccccaaaatagtgttacagttcgagtgcctcaaacaaccacatatgttgtaaacaatggactaaccctgggatcaacaggacctcagctcacagtgcatcaccgaccaccacaagtgcatactgagcccccacgccccgtgcacccagcacccttaccagaagctccacaaccacagcgtctgcccccagaagctgccagcacatctctgcctcagaagccacacttgaagttagcacgcgttcagagtcaaaatggcatagtactgtcatggagtgtcctggaggtggatcgaagctgtgccactgttgatagctaccatctctatgcttaccatgaggaacccagtgccactgtgccctcacaatggaaaaagattggggaagtcaaggcacttcccttgcccatggcatgtactctcacccagtttgtatctggtagcaaatactactttgcagtacgagccaaggatatttatggacgttttgggcctttctgtgatcctcagtcaacagatgtgatctcttctacccagagcagttaaaccttggagcctttatattttcctcttttaaaatttccaccttttggtcttgtttttaatcttgtgcatgataccccatgtaaaatccaccttgtgcaagatttcttggacagatgtgtgtatacactacatttgtttataaccagaagcaaaataaactcagcccacaaagctagaatcttttcctggacagtttaggctttggggtttggaaatgtaaatgtgtaccttgctttagttttgaggctggggaatatgtgtgggtgtttatgtgtgtttttccttatgtaggtgttattgcattggagtctcccattttcattctcaaatttacctcttaaagtacgaagtaagtagatcaaaggatttgagatgtgtaactggcatgattctgcttttgaaggatctatagtatcattttagttaagtgggtcaaacagaatcaaaacaaaacccaaagaaataaataaaaaacaaaatggctaaatagtttaaaataggttaattcgaacacaggaaaggatctatttgttgtttcttttgtctggtctcctgagttgttaattaggtgaaaaaagatctgcaatggccccctccctttcctaatctggcttttacatttattttgtgccttaaagattaactacaaagataaacatggccaaaaataaataaataaatatggccatatgtccgttgttgcttagtcttcccttgcagccttttacccttgatttctccttcatctctaccaaatatagcacaactcctcaagtaattttttttttttaagatggagttttgctcttgttgcagtgagctgagattgcgccattgcactccatcctgggagacaagagcgaaactctgcctcaaaaaaaaaaagaatttaaagtatatcctttgaggtcattttatgtaacaattagatataacctcctgtgtatctctctgttcctcttcaaagttattaaaattcagcttaggtcatggatttttaatatgagggccagctgtactggtgtcaggtaggtgttttggggtgtagataatttaggactggagggctgagttaagttttaggaggagaatgtggttgagaatattttgaaaggaatttatggagtttgtgaaataacttcgaagtcctcttcctttacaatatttgaattcatatttgtaccttctcaaaatagtgattcatttttcctagaattacaggagggagctcttttactaatgttgttttgtttgcaactttgatggcttataataggaagtattctagttgtaaagaaaactctttagagacttttgactggtcagtatactgaggtgtgagatttgattcatgatgaagaaagcctatagattgccaaaaaattaattctccaaaccacctttcactctcagaaaatgagaccacaaaggagtatgctataaatcaaatttgccaaccaattatgtagatattactcattctaggactaatgatgatggtaaagaagttgccagtgttatggcaatgaaaatttcagaaaggaggagttgatgatcttctagatgtatatgaacacctgtctatatctgcatgtatatgttttgacctgcagtggttgcaatgttgatatgtgttcaagattattcctgtctacaaaactgaaggcccatgttcaaattgttctttattgggtgtttttatggtcacgtggtaacaattttcttacctaacctacaaaaggttctcttgatgaacatttttatttatatttactaatcttttttaaaaaaagctttcatagcattatataatcagatgaagaaagcccagtagaataaaaaaaaaattcattagcctagcctatattatgttttctgtcaaaggaaaacaaattctcaaataggaattctaaaaatatttactaaagtaaaataactacttaaaatgttttattccagttgggaaggaagggtacagggagaaatcgcaattatttaggggagaagtatatttattataagatggtgtcctcaaattagcctaccatggcacgtaggggcagcagctatattagatttactagaggtgctaagttagaacactaggcttttattgaggcaggttttaatattgatagatgctttttgtttggtttgtttcttctgggagagaatggaggacttaagtagaagtagctactgataacagactttctagtagcagtttccactccacggttacctttttagtttcatagtatcttttcacaaagtattacaaataagctagattctcccagtttgggaatgcaagtttgctacatttttagcctggcaatatttgtgtaggtattgccttattggaaattctggaaacctgatactgcaacctgcaatgtaggatgtttgtatggcatttaaaggtaatggtgatgtttattattctatactttgcattctgtgagagtaattttcactctgtcttaagtgtgagtaagcctcttctaaaaatcttgttcttgccaagaaatttataaatcacatacgaagacgtctgttgctaacagttaactttatgaggtaactatatccttctatttctctggactcatttttaaaaaatatgccgaatactgcatactgtttaaggtagtatataagtttatgagagaagtggagagctttcttccttgaaaagtcggtatttgttgagataccatttgcctcacagagaggtgttccccactcccatccccattgccagataataaatattttgagaaaagtgacctaaaacagctgaaatcttaggtgcatctgtctgcagacctccttaagcaggctgtatcttacaattcccttactgcactgggtaagtgttaacttagtttttgttgtttgctcttttgctttaaatattctccaaattaccatttatgcaacatggttagggttaatactgcatggtattcatttatcttgtttcatgaactttccagtactgtacaaggtcaacaaagtaatgcctgtggtatcctcatctctcacttttttactctgtgattttagcacagtaaggtactgcaaagaccttccttccaaatgttctccttgactttatttcttgggccaattcagtatcctcaacatcctaagattttgttgttttatcactgacctgtggttggcctgttttattctaatttccagaaaagtcaagtcccagtatttgcaatatcaaataactctaaaaccgatgtgtgattctaccttccttactatttttactgggcaaatgccctatttttttaattattattatttttaacttttgggacacacaaaaatcagcaattctcatgaagcgtttgttagtgtggcagacttgtctaattcctgaaactcattcatccccttgagccagccaatggggaggaataggataatgcaaacacatgttttgttttctcattttcaaataatttaccatgttaaaataaacttttctttgttttttatttgtagagtcagctaagtacccatatttaaatgccgtctttattatttttttgaggtctttgtttttgtctgtttttgttttgttttgttttgtaaataaggtaactgggcaatcaaacaccttttggggattctggctttagtattttatcagccattttaaaattaaatataaaaatcctttgtaagaaacttgcatcctaatttttctttattgcaattgaaagtgtaaataataagacaatgtaagtaagaccttcctaatgtctaatacaaactgggctccagcaagtggccctatttttattagggttttgaaggtttgtgtgtgtgtgtgcgtgcgtgtgtgtgtttttcttttttaaatgtatagtagagtggtgtctgtataagtgttacctgtagtggggttttgtccagcaagcctgaaatttatactttgaaataaaactactgggtttttaa

SEQ ID NO: 440563 - DNA, 5789 bp, Homo sapiens
atgagtacgacctgatgtttcgaggtgtgcctgtcgttggtttgcaatgttcttacttggaaaatgcaggcacagtgagacagatgctggagtccaaaagaaatgtaagcgagagtgcaccaccatcctttcaaactcctgtgaatacagtatcttcaaccaatcttgtcactcctccagcagttgtcagtagtcaacctaaattgcagactccagtgacttcgggttccctcacagcaacgtcagttcttcctgcacccaatacagctactgtagttgctactactcaggtgcctagtggaaatccccagcctacaatctctttacagcctttgccagtgattttgcatgtacctgttgcagtatcctcccagcctcagcttctacagagccatccagggactttggtgactaatcaaccatctggcaatgttgaattcatttctgtgcaaagcccacctacagtgagtggtcttaccaaaaatccagtatccttgccatccttgccaaatcccactaaaccaaacaacgttccttctgtgcccagtcctagtattcaaaggaaccctactgccagtgctgcaccattgggaacaacacttgctgtgcaggctgttccaacagcacactctattgtacaagccacaaggacttctttacccacagtgggcccatcaggactctatagtccatcaactaatcgaggtcctatacagatgaaaattccaatttctgcatttagtacttcgtctgctgcagaacagaacagcaataccaccccaagaattgaaaaccagacaaacaaaacaatagatgcttctgtcagtaagaaagcagctgatagcacatcacagtgtggaaaagccactggcagtgattcaagtggtgtcattgatctcacaatggatgatgaagagagtggagcttcacaagaccccaaaaaactaaatcacactcctgtatcaaccatgagttcttctcagcctgtgtcacgaccattgcaacccatacaaccagcaccgcctcttcaaccatctggggtgccaacaagtggaccatctcagaccaccatacacttactacctacagctccaactaccgtgaatgtaacacatcgtccagtaactcaggtgaccacaagactccctgtaccaagagctcctgcaaaccaccaggtggtttatacaactcttcctgcaccaccagctcaggctcccttgcgaggaactgttatgcaggctcctgctgttcggcaggtcaatccccaaaatagtgttacagttcgagtgcctcaaacaaccacatatgttgtaaacaatggactaaccctgggatcaacaggacctcagctcacagtgcatcaccgaccaccacaagtgcatactgagcccccacgccccgtgcacccagcacccttaccagaagctccacaaccacagcgtctgcccccagaagctgccagcacatctctgcctcagaagccacacttgaagttagcacgcgttcagagtcaaaatggcatagtactgtcatggagtgtcctggaggtggatcgaagctgtgccactgttgatagctaccatctctatgcttaccatgaggaacccagtgccactgtgccctcacaatggaaaaagattggggaagtcaaggcacttcccttgcccatggcatgtactctcacccagtttgtatctggtagcaaatactactttgcagtacgagccaaggatatttatggacgttttgggcctttctgtgatcctcagtcaacagatgtgatctcttctacccagagcagttaaaccttggagcctttatattttcctcttttaaaatttccaccttttggtcttgtttttaatcttgtgcatgataccccatgtaaaatccaccttgtgcaagatttcttggacagatgtgtgtatacactacatttgtttataaccagaagcaaaataaactcagcccacaaagctagaatcttttcctggacagtttaggctttggggtttggaaatgtaaatgtgtaccttgctttagttttgaggctggggaatatgtgtgggtgtttatgtgtgtttttccttatgtaggtgttattgcattggagtctcccattttcattctcaaatttacctcttaaagtacgaagtaagtagatcaaaggatttgagatgtgtaactggcatgattctgcttttgaaggatctatagtatcattttagttaagtgggtcaaacagaatcaaaacaaaacccaaagaaataaataaaaaacaaaatggctaaatagtttaaaataggttaattcgaacacaggaaaggatctatttgttgtttcttttgtctggtctcctgagttgttaattaggtgaaaaaagatctgcaatggccccctccctttcctaatctggcttttacatttattttgtgccttaaagattaactacaaagataaacatggccaaaaataaataaataaatatggccatatgtccgttgttgcttagtcttcccttgcagccttttacccttgatttctccttcatctctaccaaatatagcacaactcctcaagtaattttttttttttaagatggagttttgctcttgttgcagtgagctgagattgcgccattgcactccatcctgggagacaagagcgaaactctgcctcaaaaaaaaaaagaatttaaagtatatcctttgaggtcattttatgtaacaattagatataacctcctgtgtatctctctgttcctcttcaaagttattaaaattcagcttaggtcatggatttttaatatgagggccagctgtactggtgtcaggtaggtgttttggggtgtagataatttaggactggagggctgagttaagttttaggaggagaatgtggttgagaatattttgaaaggaatttatggagtttgtgaaataacttcgaagtcctcttcctttacaatatttgaattcatatttgtaccttctcaaaatagtgattcatttttcctagaattacaggagggagctcttttactaatgttgttttgtttgcaactttgatggcttataataggaagtattctagttgtaaagaaaactctttagagacttttgactggtcagtatactgaggtgtgagatttgattcatgatgaagaaagcctatagattgccaaaaaattaattctccaaaccacctttcactctcagaaaatgagaccacaaaggagtatgctataaatcaaatttgccaaccaattatgtagatattactcattctaggactaatgatgatggtaaagaagttgccagtgttatggcaatgaaaatttcagaaaggaggagttgatgatcttctagatgtatatgaacacctgtctatatctgcatgtatatgttttgacctgcagtggttgcaatgttgatatgtgttcaagattattcctgtctacaaaactgaaggcccatgttcaaattgttctttattgggtgtttttatggtcacgtggtaacaattttcttacctaacctacaaaaggttctcttgatgaacatttttatttatatttactaatcttttttaaaaaaagctttcatagcattatataatcagatgaagaaagcccagtagaataaaaaaaaaattcattagcctagcctatattatgttttctgtcaaaggaaaacaaattctcaaataggaattctaaaaatatttactaaagtaaaataactacttaaaatgttttattccagttgggaaggaagggtacagggagaaatcgcaattatttaggggagaagtatatttattataagatggtgtcctcaaattagcctaccatggcacgtaggggcagcagctatattagatttactagaggtgctaagttagaacactaggcttttattgaggcaggttttaatattgatagatgctttttgtttggtttgtttcttctgggagagaatggaggacttaagtagaagtagctactgataacagactttctagtagcagtttccactccacggttacctttttagtttcatagtatcttttcacaaagtattacaaataagctagattctcccagtttgggaatgcaagtttgctacatttttagcctggcaatatttgtgtaggtattgccttattggaaattctggaaacctgatactgcaacctgcaatgtaggatgtttgtatggcatttaaaggtaatggtgatgtttattattctatactttgcattctgtgagagtaattttcactctgtcttaagtgtgagtaagcctcttctaaaaatcttgttcttgccaagaaatttataaatcacatacgaagacgtctgttgctaacagttaactttatgaggtaactatatccttctatttctctggactcatttttaaaaaatatgccgaatactgcatactgtttaaggtagtatataagtttatgagagaagtggagagctttcttccttgaaaagtcggtatttgttgagataccatttgcctcacagagaggtgttccccactcccatccccattgccagataataaatattttgagaaaagtgacctaaaacagctgaaatcttaggtgcatctgtctgcagacctccttaagcaggctgtatcttacaattcccttactgcactgggtaagtgttaacttagtttttgttgtttgctcttttgctttaaatattctccaaattaccatttatgcaacatggttagggttaatactgcatggtattcatttatcttgtttcatgaactttccagtactgtacaaggtcaacaaagtaatgcctgtggtatcctcatctctcacttttttactctgtgattttagcacagtaaggtactgcaaagaccttccttccaaatgttctccttgactttatttcttgggccaattcagtatcctcaacatcctaagattttgttgttttatcactgacctgtggttggcctgttttattctaatttccagaaaagtcaagtcccagtatttgcaatatcaaataactctaaaaccgatgtgtgattctaccttccttactatttttactgggcaaatgccctatttttttaattattattatttttaacttttgggacacacaaaaatcagcaattctcatgaagcgtttgttagtgtggcagacttgtctaattcctgaaactcattcatccccttgagccagccaatggggaggaataggataatgcaaacacatgttttgttttctcattttcaaataatttaccatgttaaaataaacttttctttgttttttatttgtagagtcagctaagtacccatatttaaatgccgtctttattatttttttgaggtctttgtttttgtctgtttttgttttgttttgttttgtaaataaggtaactgggcaatcaaacaccttttggggattctggctttagtattttatcagccattttaaaattaaatataaaaatcctttgtaagaaacttgcatcctaatttttctttattgcaattgaaagtgtaaataataagacaatgtaagtaagaccttcctaatgtctaatacaaactgggctccagcaagtggccctatttttattagggttttgaaggtttgtgtgtgtgtgtgcgtgcgtgtgtgtgtttttcttttttaaatgtatagtagagtggtgtctgtataagtgttacctgtagtggggttttgtccagcaagcctgaaatttatactttgaaataaaactactgggtttttaa

SEQ ID NO: 440564 - DNA, 4781 bp, Homo sapiens
ggtggcacatattctccattgactatttgagaaagggtttgtggtagttagaatttttttttagtgcttgcatgtaagaaagtttttttatccacaggctgattgatagcttggctgaatacgaacaggacctctaggttagaaatatctttcctttcgaatcttgaaaacattgcttcactgccttcaaatatttaatcagttttccaccaaatttacaatagaattatcattttatcctgtaatttttttgtttgtttgtaggtgttacagttcgagtgcctcaaacaaccacatatgttgtaaacaatggactaaccctgggatcaacaggacctcagctcacagtgcatcaccgaccaccacaagtgcatactgagcccccacgccccgtgcacccagcacccttaccagaagctccacaaccacagcgtctgcccccagaagctgccagcacatctctgcctcagaagccacacttgaagttagcacgcgttcagagtcaaaatggcatagtactgtcatggagtgtcctggaggtggatcgaagctgtgccactgttgatagctaccatctctatgcttaccatgaggaacccagtgccactgtgccctcacaatggaaaaagattggggaagtcaaggcacttcccttgcccatggcatgtactctcacccagtttgtatctggtagcaaatactactttgcagtacgagccaaggatatttatggacgttttgggcctttctgtgatcctcagtcaacagatgtgatctcttctacccagagcagttaaaccttggagcctttatattttcctcttttaaaatttccaccttttggtcttgtttttaatcttgtgcatgataccccatgtaaaatccaccttgtgcaagatttcttggacagatgtgtgtatacactacatttgtttataaccagaagcaaaataaactcagcccacaaagctagaatcttttcctggacagtttaggctttggggtttggaaatgtaaatgtgtaccttgctttagttttgaggctggggaatatgtgtgggtgtttatgtgtgtttttccttatgtaggtgttattgcattggagtctcccattttcattctcaaatttacctcttaaagtacgaagtaagtagatcaaaggatttgagatgtgtaactggcatgattctgcttttgaaggatctatagtatcattttagttaagtgggtcaaacagaatcaaaacaaaacccaaagaaataaataaaaaacaaaatggctaaatagtttaaaataggttaattcgaacacaggaaaggatctatttgttgtttcttttgtctggtctcctgagttgttaattaggtgaaaaaagatctgcaatggccccctccctttcctaatctggcttttacatttattttgtgccttaaagattaactacaaagataaacatggccaaaaataaataaataaatatggccatatgtccgttgttgcttagtcttcccttgcagccttttacccttgatttctccttcatctctaccaaatatagcacaactcctcaagtaattttttttttttaagatggagttttgctcttgttgcagtgagctgagattgcgccattgcactccatcctgggagacaagagcgaaactctgcctcaaaaaaaaaaagaatttaaagtatatcctttgaggtcattttatgtaacaattagatataacctcctgtgtatctctctgttcctcttcaaagttattaaaattcagcttaggtcatggatttttaatatgagggccagctgtactggtgtcaggtaggtgttttggggtgtagataatttaggactggagggctgagttaagttttaggaggagaatgtggttgagaatattttgaaaggaatttatggagtttgtgaaataacttcgaagtcctcttcctttacaatatttgaattcatatttgtaccttctcaaaatagtgattcatttttcctagaattacaggagggagctcttttactaatgttgttttgtttgcaactttgatggcttataataggaagtattctagttgtaaagaaaactctttagagacttttgactggtcagtatactgaggtgtgagatttgattcatgatgaagaaagcctatagattgccaaaaaattaattctccaaaccacctttcactctcagaaaatgagaccacaaaggagtatgctataaatcaaatttgccaaccaattatgtagatattactcattctaggactaatgatgatggtaaagaagttgccagtgttatggcaatgaaaatttcagaaaggaggagttgatgatcttctagatgtatatgaacacctgtctatatctgcatgtatatgttttgacctgcagtggttgcaatgttgatatgtgttcaagattattcctgtctacaaaactgaaggcccatgttcaaattgttctttattgggtgtttttatggtcacgtggtaacaattttcttacctaacctacaaaaggttctcttgatgaacatttttatttatatttactaatcttttttaaaaaaagctttcatagcattatataatcagatgaagaaagcccagtagaataaaaaaaaaattcattagcctagcctatattatgttttctgtcaaaggaaaacaaattctcaaataggaattctaaaaatatttactaaagtaaaataactacttaaaatgttttattccagttgggaaggaagggtacagggagaaatcgcaattatttaggggagaagtatatttattataagatggtgtcctcaaattagcctaccatggcacgtaggggcagcagctatattagatttactagaggtgctaagttagaacactaggcttttattgaggcaggttttaatattgatagatgctttttgtttggtttgtttcttctgggagagaatggaggacttaagtagaagtagctactgataacagactttctagtagcagtttccactccacggttacctttttagtttcatagtatcttttcacaaagtattacaaataagctagattctcccagtttgggaatgcaagtttgctacatttttagcctggcaatatttgtgtaggtattgccttattggaaattctggaaacctgatactgcaacctgcaatgtaggatgtttgtatggcatttaaaggtaatggtgatgtttattattctatactttgcattctgtgagagtaattttcactctgtcttaagtgtgagtaagcctcttctaaaaatcttgttcttgccaagaaatttataaatcacatacgaagacgtctgttgctaacagttaactttatgaggtaactatatccttctatttctctggactcatttttaaaaaatatgccgaatactgcatactgtttaaggtagtatataagtttatgagagaagtggagagctttcttccttgaaaagtcggtatttgttgagataccatttgcctcacagagaggtgttccccactcccatccccattgccagataataaatattttgagaaaagtgacctaaaacagctgaaatcttaggtgcatctgtctgcagacctccttaagcaggctgtatcttacaattcccttactgcactgggtaagtgttaacttagtttttgttgtttgctcttttgctttaaatattctccaaattaccatttatgcaacatggttagggttaatactgcatggtattcatttatcttgtttcatgaactttccagtactgtacaaggtcaacaaagtaatgcctgtggtatcctcatctctcacttttttactctgtgattttagcacagtaaggtactgcaaagaccttccttccaaatgttctccttgactttatttcttgggccaattcagtatcctcaacatcctaagattttgttgttttatcactgacctgtggttggcctgttttattctaatttccagaaaagtcaagtcccagtatttgcaatatcaaataactctaaaaccgatgtgtgattctaccttccttactatttttactgggcaaatgccctatttttttaattattattatttttaacttttgggacacacaaaaatcagcaattctcatgaagcgtttgttagtgtggcagacttgtctaattcctgaaactcattcatccccttgagccagccaatggggaggaataggataatgcaaacacatgttttgttttctcattttcaaataatttaccatgttaaaataaacttttctttgttttttatttgtagagtcagctaagtacccatatttaaatgccgtctttattatttttttgaggtctttgtttttgtctgtttttgttttgttttgttttgtaaataaggtaactgggcaatcaaacaccttttggggattctggctttagtattttatcagccattttaaaattaaatataaaaatcctttgtaagaaacttgcatcctaatttttctttattgcaattgaaagtgtaaataataagacaatgtaagtaagaccttcctaatgtctaatacaaactgggctccagcaagtggccctatttttattagggttttgaaggtttgtgtgtgtgtgtgcgtgcgtgtgtgtgtttttcttttttaaatgtatagtagagtggtgtctgtataagtgttacctgtagtggggttttgtccagcaagcctgaaatttatactttgaaataaaactactgggtttttaa

SEQ ID NO: 440565 - DNA, 3591 bp, Homo sapiens
  misc_feature (3565)..(3565): n is a, c, g, or t
tgcccagtctcacacagtaggtttcctgggagagttggaattcaaatctgtgaatctgtctacagtctacagagttcatgttcttaattgggttattaaaagtgatgaatttttttaaaggaatgcttacttttaatattcagaatggacagtttagaagaacctcagaaaaaagtctttaaggctcgaaaaacgatgagagtgagtgatcgtcagcaacttgaagcagtgtacaaggtcaaagaagaactgttgaaaactgatgtcaagctgttaaatggcaaccatgaaaatggagatttggacccaacctcacctttggaaaacatggattacattaaagacaaggaagaggtgaatggcattgaagagatttgttttgatcctgaaggaagtaaagcagaatggaaggaaacaccctgtatcctaagtgttaatgtaaaaaacaagcaggatgatgatttaaattgtgaacctttgtctccccataatataactccagaaccagtctctaaactgcctgctgaaccagtttctggtgatccagcccctggtgatctggatgccggagatccagcctccggagtactggcctctggtgattccacctctggtgatcccacctctagcgagccctcctctagtgatgctgcctctggtgatgcaacctctggtgatgccccttctggtgatgtgtcccctggtgatgccacctctggtgatgccactgctgatgatctctcctctggtgatcccacctctagtgatcccatcccaggtgaaccggtccctgttgaacccatttctggtgattgtgccgctgatgatatagcctctagtgaaataacttctgttgatctggcttctggagcaccagcttccactgatccagcctctgatgatctggcctctggtgatctatcctctagtgaactggcctctgatgatctggccactggtgaactggcctctgatgagctgacttctgaatcaacctttgatcgtacctttgaaccaaagtctgtaccagtttgtgaaccagttcctgaaattgacaatatagaaccaagtagcaataaagatgatgattttcttgaaaaaaatggagctgatgaaaaattagagcaaattcagagtaaagactcattggatgagaaaaataaagctgataataatattgatgctaatgaagaaactctagaaacagatgatacaactatttgttcagatcgacctcctgaaaatgaaaagaaggtagaggaagatattatcacagagcttgctcttggagaagatgctatatctagcagtatggaaattgaccaaggtgaaaagaatgaagatgaaacttctgcagatcttgtagaaacgattaatgaaaatgttattgaagataacaaaagtgagaatatcttagaaaatacagactctatggagacagatgaaatcattcctattttggaaaagcttgcaccttctgaggatgaacttacttgcttttctaaaacatctctccttccaatcgatgagacaaatccagatttggaagagaaaatggaaagttcttttggttcaccatctaaacaagaaagtagtgagagtttgccaaaagaagcctttctggtcctctctgatgaagaggatatttcgggtgaaaaagatgagtctgaagttatatcgcaaaatgaaacgtgctctccagcagaagtagaaagtaatgaaaaggacaacagacctgaggaagaagagcaagtaatacatgaagatgatgaaagaccttctgagaaaaatgaattttctagacgaaaacgttctaaatcagaagacatggacaatgtacagtctaaacgtcgtcgatatatggaagaagaatatgaggcagaatttcaagtaaagattacagccaaaggagacattaaccagaaacttcaaaaggttatacagtggttgctggaagaaaaattgtgtgcgctgcagtgtgctgtatttgataagactttggcagaattgaaaacacgagtggaaaagattgaatgtaacaagaggcataaaacagttctcactgaactacaggccaagatagccaggttaaccaaacgctttgaagcagccaaagaagatcttaagaaaagacatgaacatccacccaacccaccagtatcaccaggaaaaactgtaaatgatgtcaacagcaataataacatgtcttacagaaatgcaggcacagtgagacagatgctggagtccaaaagaaatgtaagcgagagtgcaccaccatcctttcaaactcctgtgaatacagtatcttcaaccaatcttgtcactcctccagcagttgtcagtagtcaacctaaattgcagactccagtgacttcgggttccctcacagcaacgtcagttcttcctgcacccaatacagctactgtagttgctactactcaggtgcctagtggaaatccccagcctacaatctctttacagcctttgccagtgattttgcatgtacctgttgcagtatcctcccagcctcagcttctacagagccatccagggactttggtgactaatcaaccatctggcaatgttgaattcatttctgtgcaaagcccacctacagtgagtggtcttaccaaaaatccagtatccttgccatccttgccaaatcccactaaaccaaacaacgttccttctgtgcccagtcctagtattcaaaggaaccctactgccagtgctgcaccattgggaacaacacttgctgtgcaggctgttccaacagcacactctattgtacaagccacaaggacttctttacccacagtgggcccatcaggactctatagtccatcaactaatcgaggtcctatacagatgaaaattccaatttctgcatttagtacttcgtctgctgcagaacagaacagcaataccaccccaagaattgaaaaccagacaaacaaaacaatagatgcttctgtcagtaagaaagcagctgatagcacatcacagtgtggaaaagccactggcagtgattcaagtggtgtcattgatctcacaatggatgatgaagagagtggagcttcacaagaccccaaaaaactaaatcacactcctgtatcaaccatgagttcttctcagcctgtgtcacgaccattgcaacccatacaaccagcaccgcctcttcaaccatctggggtgccaacaagtggaccatctcagaccaccatacacttactacctacagctccaactaccgtgaatgtaacacatcgtccagtaactcaggtgaccacaagactccctgtaccaagagctcctgcaaaccaccaggtggtttatacaactcttcctgcaccaccagctcaggctcccttgcgaggaactgttatgcaggctcctgctgttcggcaggtcaatccccaaaatagtgttacagttcgagtgcctcaaacaaccacatatgttgtaaacaatggactaaccctgggatcaacaggacctcagctcacagtgcatcaccgaccaccacaagtgcatactgagcccccacgccccgtgcacccagtcntgaacattctactaattttaaaagac

SEQ ID NO: 440566 - DNA, 3554 bp, Homo sapiens
atttgtctcttaatacctaaagaaaggccgccattaacccactgccaccctggtctcattatgtgtgtgcgtgatgttatcacccaacactaactccttagtattctttcaaaggaagcaaatagtaagattacaatatagaatgagctaaaatatcaaggggaaagcttcatttcctctttattctctttatcgtccttcccattttaaccttttaactttgttttgatggtgccaagttgagtctgatgtacccattgttagctttggatagaatttaaagtatatcccagaattagctgggcatgttggtgcatgcctgtaatcccagctactcaggaggcaaggctggagaatcgcttgaacccgggaggcggaggttgcagtgagctgagattgcgccattgcactccatcctgggagacaagagcgaaactctgcctcaaaaaaaaaaagaatttaaagtatatcctttgaggtcattttatgtaacaattagatataacctcctgtgtatctctctgttcctcttcaaagttattaaaattcagcttaggtcatggatttttaatatgagggccagctgtactggtgtcaggtaggtgttttggggtgtagataatttaggactggagggctgagttaagttttaggaggagaatgtggttgagaatattttgaaaggaatttatggagtttgtgaaataacttcgaagtcctcttcctttacaatatttgaattcatatttgtaccttctcaaaatagtgattcatttttcctagaattacaggagggagctcttttactaatgttgttttgtttgcaactttgatggcttataataggaagtattctagttgtaaagaaaactctttagagacttttgactggtcagtatactgaggtgtgagatttgattcatgatgaagaaagcctatagattgccaaaaaattaattctccaaaccacctttcactctcagaaaatgagaccacaaaggagtatgctataaatcaaatttgccaaccaattatgtagatattactcattctaggactaatgatgatggtaaagaagttgccagtgttatggcaatgaaaatttcagaaaggaggagttgatgatcttctagatgtatatgaacacctgtctatatctgcatgtatatgttttgacctgcagtggttgcaatgttgatatgtgttcaagattattcctgtctacaaaactgaaggcccatgttcaaattgttctttattgggtgtttttatggtcacgtggtaacaattttcttacctaacctacaaaaggttctcttgatgaacatttttatttatatttactaatcttttttaaaaaaagctttcatagcattatataatcagatgaagaaagcccagtagaataaaaaaaaaattcattagcctagcctatattatgttttctgtcaaaggaaaacaaattctcaaataggaattctaaaaatatttactaaagtaaaataactacttaaaatgttttattccagttgggaaggaagggtacagggagaaatcgcaattatttaggggagaagtatatttattataagatggtgtcctcaaattagcctaccatggcacgtaggggcagcagctatattagatttactagaggtgctaagttagaacactaggcttttattgaggcaggttttaatattgatagatgctttttgtttggtttgtttcttctgggagagaatggaggacttaagtagaagtagctactgataacagactttctagtagcagtttccactccacggttacctttttagtttcatagtatcttttcacaaagtattacaaataagctagattctcccagtttgggaatgcaagtttgctacatttttagcctggcaatatttgtgtaggtattgccttattggaaattctggaaacctgatactgcaacctgcaatgtaggatgtttgtatggcatttaaaggtaatggtgatgtttattattctatactttgcattctgtgagagtaattttcactctgtcttaagtgtgagtaagcctcttctaaaaatcttgttcttgccaagaaatttataaatcacatacgaagacgtctgttgctaacagttaactttatgaggtaactatatccttctatttctctggactcatttttaaaaaatatgccgaatactgcatactgtttaaggtagtatataagtttatgagagaagtggagagctttcttccttgaaaagtcggtatttgttgagataccatttgcctcacagagaggtgttccccactcccatccccattgccagataataaatattttgagaaaagtgacctaaaacagctgaaatcttaggtgcatctgtctgcagacctccttaagcaggctgtatcttacaattcccttactgcactgggtaagtgttaacttagtttttgttgtttgctcttttgctttaaatattctccaaattaccatttatgcaacatggttagggttaatactgcatggtattcatttatcttgtttcatgaactttccagtactgtacaaggtcaacaaagtaatgcctgtggtatcctcatctctcacttttttactctgtgattttagcacagtaaggtactgcaaagaccttccttccaaatgttctccttgactttatttcttgggccaattcagtatcctcaacatcctaagattttgttgttttatcactgacctgtggttggcctgttttattctaatttccagaaaagtcaagtcccagtatttgcaatatcaaataactctaaaaccgatgtgtgattctaccttccttactatttttactgggcaaatgccctatttttttaattattattatttttaacttttgggacacacaaaaatcagcaattctcatgaagcgtttgttagtgtggcagacttgtctaattcctgaaactcattcatccccttgagccagccaatggggaggaataggataatgcaaacacatgttttgttttctcattttcaaataatttaccatgttaaaataaacttttctttgttttttatttgtagagtcagctaagtacccatatttaaatgccgtctttattatttttttgaggtctttgtttttgtctgtttttgttttgttttgttttgtaaataaggtaactgggcaatcaaacaccttttggggattctggctttagtattttatcagccattttaaaattaaatataaaaatcctttgtaagaaacttgcatcctaatttttctttattgcaattgaaagtgtaaataataagacaatgtaagtaagaccttcctaatgtctaatacaaactgggctccagcaagtggccctatttttattagggttttgaaggtttgtgtgtgtgtgtgcgtgcgtgtgtgtgtttttcttttttaaatgtatagtagagtggtgtctgtataagtgttacctgtagtggggttttgtccagcaagcctgaaatttatactttgaaataaaactactgggtttttaa

SEQ ID NO: 440567 - DNA, 3736 bp, Homo sapiens
cacacacacacaggtgcatgcatagtctcatcttagccgggcatggtggcgacaatcacatttaactccaaaaatttgacgtgctattttcttctaaaactatagatgcttttatttttggtcactatttaactttgtgtaaagtggaccaagagaaaaccatattgtggaagacagtttttcacacattttagtatccgtgttgcacactgtgttagagattatgaaaaccattctagttcagtttatcacccaaagctatcacccaacactaactccttagtattctttcaaaggaagcaaatagtaagattacaatatagaatgagctaaaatatcaaggggaaagcttcatttcctctttattctctttatcgtccttcccattttaaccttttaactttgttttgatggtgccaagttgagtctgatgtacccattgttagctttggatagaatttaaagtatatcccagaattagctgggcatgttggtgcatgcctgtaatcccagctactcaggaggcaaggctggagaatcgcttgaacccgggaggcggaggttgcagtgagctgagattgcgccattgcactccatcctgggagacaagagcgaaactctgcctcaaaaaaaaaaagaatttaaagtatatcctttgaggtcattttatgtaacaattagatataacctcctgtgtatctctctgttcctcttcaaagttattaaaattcagcttaggtcatggatttttaatatgagggccagctgtactggtgtcaggtaggtgttttggggtgtagataatttaggactggagggctgagttaagttttaggaggagaatgtggttgagaatattttgaaaggaatttatggagtttgtgaaataacttcgaagtcctcttcctttacaatatttgaattcatatttgtaccttctcaaaatagtgattcatttttcctagaattacaggagggagctcttttactaatgttgttttgtttgcaactttgatggcttataataggaagtattctagttgtaaagaaaactctttagagacttttgactggtcagtatactgaggtgtgagatttgattcatgatgaagaaagcctatagattgccaaaaaattaattctccaaaccacctttcactctcagaaaatgagaccacaaaggagtatgctataaatcaaatttgccaaccaattatgtagatattactcattctaggactaatgatgatggtaaagaagttgccagtgttatggcaatgaaaatttcagaaaggaggagttgatgatcttctagatgtatatgaacacctgtctatatctgcatgtatatgttttgacctgcagtggttgcaatgttgatatgtgttcaagattattcctgtctacaaaactgaaggcccatgttcaaattgttctttattgggtgtttttatggtcacgtggtaacaattttcttacctaacctacaaaaggttctcttgatgaacatttttatttatatttactaatcttttttaaaaaaagctttcatagcattatataatcagatgaagaaagcccagtagaataaaaaaaaaattcattagcctagcctatattatgttttctgtcaaaggaaaacaaattctcaaataggaattctaaaaatatttactaaagtaaaataactacttaaaatgttttattccagttgggaaggaagggtacagggagaaatcgcaattatttaggggagaagtatatttattataagatggtgtcctcaaattagcctaccatggcacgtaggggcagcagctatattagatttactagaggtgctaagttagaacactaggcttttattgaggcaggttttaatattgatagatgctttttgtttggtttgtttcttctgggagagaatggaggacttaagtagaagtagctactgataacagactttctagtagcagtttccactccacggttacctttttagtttcatagtatcttttcacaaagtattacaaataagctagattctcccagtttgggaatgcaagtttgctacatttttagcctggcaatatttgtgtaggtattgccttattggaaattctggaaacctgatactgcaacctgcaatgtaggatgtttgtatggcatttaaaggtaatggtgatgtttattattctatactttgcattctgtgagagtaattttcactctgtcttaagtgtgagtaagcctcttctaaaaatcttgttcttgccaagaaatttataaatcacatacgaagacgtctgttgctaacagttaactttatgaggtaactatatccttctatttctctggactcatttttaaaaaatatgccgaatactgcatactgtttaaggtagtatataagtttatgagagaagtggagagctttcttccttgaaaagtcggtatttgttgagataccatttgcctcacagagaggtgttccccactcccatccccattgccagataataaatattttgagaaaagtgacctaaaacagctgaaatcttaggtgcatctgtctgcagacctccttaagcaggctgtatcttacaattcccttactgcactgggtaagtgttaacttagtttttgttgtttgctcttttgctttaaatattctccaaattaccatttatgcaacatggttagggttaatactgcatggtattcatttatcttgtttcatgaactttccagtactgtacaaggtcaacaaagtaatgcctgtggtatcctcatctctcacttttttactctgtgattttagcacagtaaggtactgcaaagaccttccttccaaatgttctccttgactttatttcttgggccaattcagtatcctcaacatcctaagattttgttgttttatcactgacctgtggttggcctgttttattctaatttccagaaaagtcaagtcccagtatttgcaatatcaaataactctaaaaccgatgtgtgattctaccttccttactatttttactgggcaaatgccctatttttttaattattattatttttaacttttgggacacacaaaaatcagcaattctcatgaagcgtttgttagtgtggcagacttgtctaattcctgaaactcattcatccccttgagccagccaatggggaggaataggataatgcaaacacatgttttgttttctcattttcaaataatttaccatgttaaaataaacttttctttgttttttatttgtagagtcagctaagtacccatatttaaatgccgtctttattatttttttgaggtctttgtttttgtctgtttttgttttgttttgttttgtaaataaggtaactgggcaatcaaacaccttttggggattctggctttagtattttatcagccattttaaaattaaatataaaaatcctttgtaagaaacttgcatcctaatttttctttattgcaattgaaagtgtaaataataagacaatgtaagtaagaccttcctaatgtctaatacaaactgggctccagcaagtggccctatttttattagggttttgaaggtttgtgtgtgtgtgtgcgtgcgtgtgtgtgtttttcttttttaaatgtatagtagagtggtgtctgtataagtgttacctgtagtggggttttgtccagcaagcctgaaatttatactttgaaataaaactactgggtttttaa

SEQ ID NO: 440568 - DNA, 3776 bp, Homo sapiens
gatacttaactatctagatcaaagtatagtcgaagcgtggtcgtctcaaggcggattctctagaatctatctgctcgttttcgttcttgtgactcggccgtcatcttacacacgtcccgactgggtaaatcctggagaaaatggctaaatagtttaaaataggttaattcgaacacaggaaaggatctatttgttgtttcttttgtctggtctcctgagttgttaattaggtgaaaaaagatctgcaatggccccctccctttcctaatctggcttttacatttattttgtgccttaaagattaactacaaagataaacatggccaaaaataaataaataaatatggccatatgtccgttgttgcttagtcttcccttgcagccttttacccttgatttctccttcatctctaccaaatatagcacaactcctcaagtaattttttttttttaagatggagttttgctcttgttgcccaggctagagtgcggtggcacaatcttggctcactgcaacctctgcctcctgggttcaagcaattcttctgtctcactactcaggaggcaaggctggagaatcgcttgaacccgggaggcggaggttgcagtgagctgagattgcgccattgcactccatcctgggagacaagagcgaaactctgcctcaaaaaaaaaaagaatttaaagtatatcctttgaggtcattttatgtaacaattagatataacctcctgtgtatctctctgttcctcttcaaagttattaaaattcagcttaggtcatggatttttaatatgagggccagctgtactggtgtcaggtaggtgttttggggtgtagataatttaggactggagggctgagttaagttttaggaggagaatgtggttgagaatattttgaaaggaatttatggagtttgtgaaataacttcgaagtcctcttcctttacaatatttgaattcatatttgtaccttctcaaaatagtgattcatttttcctagaattacaggagggagctcttttactaatgttgttttgtttgcaactttgatggcttataataggaagtattctagttgtaaagaaaactctttagagacttttgactggtcagtatactgaggtgtgagatttgattcatgatgaagaaagcctatagattgccaaaaaattaattctccaaaccacctttcactctcagaaaatgagaccacaaaggagtatgctataaatcaaatttgccaaccaattatgtagatattactcattctaggactaatgatgatggtaaagaagttgccagtgttatggcaatgaaaatttcagaaaggaggagttgatgatcttctagatgtatatgaacacctgtctatatctgcatgtatatgttttgacctgcagtggttgcaatgttgatatgtgttcaagattattcctgtctacaaaactgaaggcccatgttcaaattgttctttattgggtgtttttatggtcacgtggtaacaattttcttacctaacctacaaaaggttctcttgatgaacatttttatttatatttactaatcttttttaaaaaaagctttcatagcattatataatcagatgaagaaagcccagtagaataaaaaaaaaattcattagcctagcctatattatgttttctgtcaaaggaaaacaaattctcaaataggaattctaaaaatatttactaaagtaaaataactacttaaaatgttttattccagttgggaaggaagggtacagggagaaatcgcaattatttaggggagaagtatatttattataagatggtgtcctcaaattagcctaccatggcacgtaggggcagcagctatattagatttactagaggtgctaagttagaacactaggcttttattgaggcaggttttaatattgatagatgctttttgtttggtttgtttcttctgggagagaatggaggacttaagtagaagtagctactgataacagactttctagtagcagtttccactccacggttacctttttagtttcatagtatcttttcacaaagtattacaaataagctagattctcccagtttgggaatgcaagtttgctacatttttagcctggcaatatttgtgtaggtattgccttattggaaattctggaaacctgatactgcaacctgcaatgtaggatgtttgtatggcatttaaaggtaatggtgatgtttattattctatactttgcattctgtgagagtaattttcactctgtcttaagtgtgagtaagcctcttctaaaaatcttgttcttgccaagaaatttataaatcacatacgaagacgtctgttgctaacagttaactttatgaggtaactatatccttctatttctctggactcatttttaaaaaatatgccgaatactgcatactgtttaaggtagtatataagtttatgagagaagtggagagctttcttccttgaaaagtcggtatttgttgagataccatttgcctcacagagaggtgttccccactcccatccccattgccagataataaatattttgagaaaagtgacctaaaacagctgaaatcttaggtgcatctgtctgcagacctccttaagcaggctgtatcttacaattcccttactgcactgggtaagtgttaacttagtttttgttgtttgctcttttgctttaaatattctccaaattaccatttatgcaacatggttagggttaatactgcatggtattcatttatcttgtttcatgaactttccagtactgtacaaggtcaacaaagtaatgcctgtggtatcctcatctctcacttttttactctgtgattttagcacagtaaggtactgcaaagaccttccttccaaatgttctccttgactttatttcttgggccaattcagtatcctcaacatcctaagattttgttgttttatcactgacctgtggttggcctgttttattctaatttccagaaaagtcaagtcccagtatttgcaatatcaaataactctaaaaccgatgtgtgattctaccttccttactatttttactgggcaaatgccctatttttttaattattattatttttaacttttgggacacacaaaaatcagcaattctcatgaagcgtttgttagtgtggcagacttgtctaattcctgaaactcattcatccccttgagccagccaatggggaggaataggataatgcaaacacatgttttgttttctcattttcaaataatttaccatgttaaaataaacttttctttgttttttatttgtagagtcagctaagtacccatatttaaatgccgtctttattatttttttgaggtctttgtttttgtctgtttttgttttgttttgttttgtaaataaggtaactgggcaatcaaacaccttttggggattctggctttagtattttatcagccattttaaaattaaatataaaaatcctttgtaagaaacttgcatcctaatttttctttattgcaattgaaagtgtaaataataagacaatgtaagtaagaccttcctaatgtctaatacaaactgggctccagcaagtggccctatttttattagggttttgaaggtttgtgtgtgtgtgtgcgtgcgtgtgtgtgtttttcttttttaaatgtatagtagagtggtgtctgtataagtgttacctgtagtggggttttgtccagcaagcctgaaatttatactttgaaataaaactactgggtttttaa

SEQ ID NO: 440569 - DNA, 3103 bp, Homo sapiens
atcatcttcaattattaacatctttgtttttttaactaagagtttcacctctgaataaactactcattgaagttctttgacttctaccattcaaagaaaataatcactgactctgtataccagattaaatttgggacacaaaaagagtgatgagttctgttctctcttaatatcctcgtgctattaagtttctcttgagaacataagataaacatttctttgatgcacaatggtatcttcagcactgaatgagcggtgacattcacttaataaaccacgggttcttctttcaacttaattaatatcctttggaggaacctatgagaacctcatcatatcatgtacagcctattgtgccttactcataaagctcttctaaaatagagatttaagaagaagtattctagttgtaaagaaaactctttagagacttttgactggtcagtatactgaggtgtgagatttgattcatgatgaagaaagcctatagattgccaaaaaattaattctccaaaccacctttcactctcagaaaatgagaccacaaaggagtatgctataaatcaaatttgccaaccaattatgtagatattactcattctaggactaatgatgatggtaaagaagttgccagtgttatggcaatgaaaatttcagaaaggaggagttgatgatcttctagatgtatatgaacacctgtctatatctgcatgtatatgttttgacctgcagtggttgcaatgttgatatgtgttcaagattattcctgtctacaaaactgaaggcccatgttcaaattgttctttattgggtgtttttatggtcacgtggtaacaattttcttacctaacctacaaaaggttctcttgatgaacatttttatttatatttactaatcttttttaaaaaaagctttcatagcattatataatcagatgaagaaagcccagtagaataaaaaaaaaattcattagcctagcctatattatgttttctgtcaaaggaaaacaaattctcaaataggaattctaaaaatatttactaaagtaaaataactacttaaaatgttttattccagttgggaaggaagggtacagggagaaatcgcaattatttaggggagaagtatatttattataagatggtgtcctcaaattagcctaccatggcacgtaggggcagcagctatattagatttactagaggtgctaagttagaacactaggcttttattgaggcaggttttaatattgatagatgctttttgtttggtttgtttcttctgggagagaatggaggacttaagtagaagtagctactgataacagactttctagtagcagtttccactccacggttacctttttagtttcatagtatcttttcacaaagtattacaaataagctagattctcccagtttgggaatgcaagtttgctacatttttagcctggcaatatttgtgtaggtattgccttattggaaattctggaaacctgatactgcaacctgcaatgtaggatgtttgtatggcatttaaaggtaatggtgatgtttattattctatactttgcattctgtgagagtaattttcactctgtcttaagtgtgagtaagcctcttctaaaaatcttgttcttgccaagaaatttataaatcacatacgaagacgtctgttgctaacagttaactttatgaggtaactatatccttctatttctctggactcatttttaaaaaatatgccgaatactgcatactgtttaaggtagtatataagtttatgagagaagtggagagctttcttccttgaaaagtcggtatttgttgagataccatttgcctcacagagaggtgttccccactcccatccccattgccagataataaatattttgagaaaagtgacctaaaacagctgaaatcttaggtgcatctgtctgcagacctccttaagcaggctgtatcttacaattcccttactgcactgggtaagtgttaacttagtttttgttgtttgctcttttgctttaaatattctccaaattaccatttatgcaacatggttagggttaatactgcatggtattcatttatcttgtttcatgaactttccagtactgtacaaggtcaacaaagtaatgcctgtggtatcctcatctctcacttttttactctgtgattttagcacagtaaggtactgcaaagaccttccttccaaatgttctccttgactttatttcttgggccaattcagtatcctcaacatcctaagattttgttgttttatcactgacctgtggttggcctgttttattctaatttccagaaaagtcaagtcccagtatttgcaatatcaaataactctaaaaccgatgtgtgattctaccttccttactatttttactgggcaaatgccctatttttttaattattattatttttaacttttgggacacacaaaaatcagcaattctcatgaagcgtttgttagtgtggcagacttgtctaattcctgaaactcattcatccccttgagccagccaatggggaggaataggataatgcaaacacatgttttgttttctcattttcaaataatttaccatgttaaaataaacttttctttgttttttatttgtagagtcagctaagtacccatatttaaatgccgtctttattatttttttgaggtctttgtttttgtctgtttttgttttgttttgttttgtaaataaggtaactgggcaatcaaacaccttttggggattctggctttagtattttatcagccattttaaaattaaatataaaaatcctttgtaagaaacttgcatcctaatttttctttattgcaattgaaagtgtaaataataagacaatgtaagtaagaccttcctaatgtctaatacaaactgggctccagcaagtggccctatttttattagggttttgaaggtttgtgtgtgtgtgtgcgtgcgtgtgtgtgtttttcttttttaaatgtatagtagagtggtgtctgtataagtgttacctgtagtggggttttgtccagcaagcctgaaatttatactttgaaataaaactactgggtttttaa

SEQ ID NO: 440570 - DNA, 3051 bp, Homo sapiens
tgcccagtctcacacagtaggtttcctgggagagttggaattcaaatctgtgaatctgtctacagtctacagagttcatgttcttaattgggttattaaaagtgatgaatttttttaaaggaatgcttacttttaatattcagaatggacagtttagaagaacctcagaaaaaagtctttaaggctcgaaaaacgatgagagtgagtgatcgtcagcaacttgaagcagtgtacaaggtcaaagaagaactgttgaaaactgatgtcaagctgttaaatggcaaccatgaaaatggagatttggacccaacctcacctttggaaaacatggattacattaaagacaaggaagaggtgaatggcattgaagagatttgttttgatcctgaaggaagtaaagcagaatggaaggaaacaccctgtatcctaagtgttaatgtaaaaaacaagcaggatgatgatttaaattgtgaacctttgtctccccataatataactccagaaccagtctctaaactgcctgctgaaccagtttctggtgatccagcccctggtgatctggatgccggagatccagcctccggagtactggcctctggtgattccacctctggtgatcccacctctagcgagccctcctctagtgatgctgcctctggtgatgcaacctctggtgatgccccttctggtgatgtgtcccctggtgatgccacctctggtgatgccactgctgatgatctctcctctggtgatcccacctctagtgatcccatcccaggtgaaccggtccctgttgaacccatttctggtgattgtgccgctgatgatatagcctctagtgaaataacttctgttgatctggcttctggagcaccagcttccactgatccagcctctgatgatctggcctctggtgatctatcctctagtgaactggcctctgatgatctggccactggtgaactggcctctgatgagctgacttctgaatcaacctttgatcgtacctttgaaccaaagtctgtaccagtttgtgaaccagttcctgaaattgacaatatagaaccaagtagcaataaagatgatgattttcttgaaaaaaatggagctgatgaaaaattagagcaaattcagagtaaagactcattggatgagaaaaataaagctgataataatattgatgctaatgaagaaactctagaaacagatgatacaactatttgttcagatcgacctcctgaaaatgaaaagaaggtagaggaagatattatcacagagcttgctcttggagaagatgctatatctagcagtatggaaattgaccaaggtgaaaagaatgaagatgaaacttctgcagatcttgtagaaacgattaatgaaaatgttattgaagataacaaaagtgagaatatcttagaaaatacagactctatggagacagatgaaatcattcctattttggaaaagcttgcaccttctgaggatgaacttacttgcttttctaaaacatctctccttccaatcgatgagacaaatccagatttggaagagaaaatggaaagttcttttggttcaccatctaaacaagaaagtagtgagagtttgccaaaagaagcctttctggtcctctctgatgaagaggatatttcgggtgaaaaagatgagtctgaagttatatcgcaaaatgaaacgtgctctccaggttagcatataacttaaatgttaaagattttttattgactttgatgaactgtttaataaaacattatcataatgttttaaatttattttagctgcagagaaagttgagaatagtgatgactctatagaaagatgtcttaacttcatagaattcagaattagtgtgtgtactctgtgagtagcattgtactaaatactaagaagggagataaaataagtagaaaatatgcccttatagtctggaaatagagatgaagtagagcaccataacactgagataacagcttaagttagtacataattgactagagttgtagcagttctttcttgctatcacttagcgaacaaataacttagaactaaaagcctaatagtttaatctatttgcttcaagtgtaacaaattatattttcaattaatattcccaatgaaatcctgttctttaatattctttgtccaggaatgacagcaccattgttgtaagccagaaaccttaaagcttgattatccatttgataaagactttacccatttgctccctcagcccttttgattctacccagcctattctcttccccattttctgaatgagctccctgtaacccaattctcttatttgatattgtccgtctatgtcttagatctctgttacttttaggttgatttcaaactccttatgtaaaaggtacattaactttatggtttgttcagtacctatctctcccatctcttttattttatttattattcctagagaaaaagaatgagaaaaattctaccttcttttatggtcaaactgaaaaacattattcctctatgaaactttctaagcctgtggaagactgagaaaagcatgaatacctttcttttcccattatatcacattcttttagatttagacatctctgagagaagtgaccttgctagcataaaacaccatctaatttcttcaaagaaaaaaaaatggaggcaggtctaagagacagagacaacttttttccccaatatatcataccagcttttggaggtagagatttttttcttattaaaaaatggcttttttttttttttggccaggtaaggtggctcacacctataatcctaggactttgggaggctgaggcaggcagattgcttgagctcaggagttcgagaccagcctgggcaacatggtgagaccccgtctctacaaaagtacaaaaattagccaggcgtggtggcacttgtctgtagtccagggtacttgagggcctgaggtagggggatcacttgaacctgggtggtcgaggctgcagtgagccgagatcgcgccactactccagcctgggtgacaaagtaagaccctgcctc

SEQ ID NO: 440571 - DNA, 2323 bp, Homo sapiens
tgcccagtctcacacagtaggtttcctgggagagttggaattcaaatctgtgaatctgtctacagtctacagagttcatgttcttaattgggttattaaaagtgatgaatttttttaaaggaatgcttacttttaatattcagaatggacagtttagaagaacctcagaaaaaagtctttaaggctcgaaaaacgatgagagtgagtgatcgtcagcaacttgaagcagtgtacaaggtcaaagaagaactgttgaaaactgatgtcaagctgttaaatggcaaccatgaaaatggagatttggacccaacctcacctttggaaaacatggattacattaaagacaaggaagaggtgaatggcattgaagagatttgttttgatcctgaaggaagtaaagcagaatggaaggaaacaccctgtatcctaagtgttaatgtaaaaaacaagcaggatgatgatttaaattgtgaacctttgtctccccataatataactccagaaccagtctctaaactgcctgctgaaccagtttctggtgatccagcccctggtgatctggatgccggagatccagcctccggagtactggcctctggtgattccacctctggtgatcccacctctagcgagccctcctctagtgatgctgcctctggtgatgcaacctctggtgatgccccttctggtgatgtgtcccctggtgatgccacctctggtgatgccactgctgatgatctctcctctggtgatcccacctctagtgatcccatcccaggtgaaccggtccctgttgaacccatttctggtgattgtgccgctgatgatatagcctctagtgaaataacttctgttgatctggcttctggagcaccagcttccactgatccagcctctgatgatctggcctctggtgatctatcctctagtgaactggcctctgatgatctggccactggtgaactggcctctgatgagctgacttctgaatcaacctttgatcgtacctttgaaccaaagtctgtaccagtttgtgaaccagttcctgaaattgacaatatagaaccaagtagcaataaagatgatgattttcttgaaaaaaatggagctgatgaaaaattagagcaaattcagagtaaagactcattggatgagaaaaataaagctgataataatattgatgctaatgaagaaactctagaaacagatgatacaactatttgttcagatcgacctcctgaaaatgaaaagaaggtagaggaagatattatcacagagcttgctcttggagaagatgctatatctagcagtatggaaattgaccaaggtgaaaagaatgaagatgaaacttctgcagatcttgtagaaacgattaatgaaaatgttattgaagataacaaaagtgagaatatcttagaaaatacagactctatggagacagatgaaatcattcctattttggaaaagcttgcaccttctgaggatgaacttacttgcttttctaaaacatctctccttccaatcgatgagacaaatccagatttggaagagaaaatggaaagttcttttggttcaccatctaaacaagaaagtagtgagagtttgccaaaagaagcctttctggtcctctctgatgaagaggatatttcgggtgaaaaagatgagtctgaagttatatcgcaaaatgaaacgtgctctccagcagaagtagaaagtaatgaaaaggacaacagacctgaggaagaagagcaagtaatacatgaagatgatgaaagaccttctgagaaaaatgaattttctagacgaaaacgttctaaatcagaagacatggacaatgtacagtctaaacgtcgtcgatatatggaagaagaatatgaggcagaatttcaagtaaagattacagccaaaggagacattaaccagaaacttcaaaaggtattgtgtcaattataagttataaaccatattgaataaatagcaccactatcttcttctaggtttctgacattattctgtattttattgacataatgtggtttatcatagaaagaaagaacttgaagaaagtggttgagcttttaaagtctattactggccagatgtggtggatcacccctgtaatcccaatcctttgggaggctgaggtggatggatcacctgaagtcaggagttcaagaccagcctgaccaacatggtgaaactctgactctactaatacattagctggatgttgtggtgggtgcctgtaatcccagctacctgggaggctgaggcaggagaatcacttgcccgggaggtggaggtggcagtgagccgagatcat

SEQ ID NO: 440572 - DNA, 367 bp, Homo sapiens
gtaagagatttttcttgtatatggccccaagatacatgtagttctcttcagcatttagttggaatggcatataataatgttaaattttgcaaaaatttcttataatgtcatattaaaagtattgttataagttcaagagatctgtactacaacatagaaactatagtatagttaaaatcaatgtagtatattcttgaaaatagctgatagagcagattttaagtattgtcaccacacacaaaaaaggtaagtatgtgagatcatgcatatgtcagctagatttagccattctgcagtgtatgcatatttcaaacatgttgtataccataaatatatataatttttgtcaattaaaaaatagttttca

SEQ ID NO: 440573 - DNA, 7941 bp, Homo sapiens
tgcccagtctcacacagtaggtttcctgggagagttggaattcaaatctgtgaatctgtctacagtctacagagttcatgttcttaattgggttattaaaagtgatgaatttttttaaaggaatgcttacttttaatattcagaatggacagtttagaagaacctcagaaaaaagtctttaaggctcgaaaaacgatgagagtgagtgatcgtcagcaacttgaagcagtgtacaaggtcaaagaagaactgttgaaaactgatgtcaagctgttaaatggcaaccatgaaaatggagatttggacccaacctcacctttggaaaacatggattacattaaagacaaggaagaggtgaatggcattgaagagatttgttttgatcctgaaggaagtaaagcagaatggaaggaaacaccctgtatcctaagtgttaatgtaaaaaacaagcaggatgatgatttaaattgtgaacctttgtctccccataatataactccagaaccagtctctaaactgcctgctgaaccagtttctggtgatccagcccctggtgatctggatgccggagatccagcctccggagtactggcctctggtgattccacctctggtgatcccacctctagcgagccctcctctagtgatgctgcctctggtgatgcaacctctggtgatgccccttctggtgatgtgtcccctggtgatgccacctctggtgatgccactgctgatgatctctcctctggtgatcccacctctagtgatcccatcccaggtgaaccggtccctgttgaacccatttctggtgattgtgccgctgatgatatagcctctagtgaaataacttctgttgatctggcttctggagcaccagcttccactgatccagcctctgatgatctggcctctggtgatctatcctctagtgaactggcctctgatgatctggccactggtgaactggcctctgatgagctgacttctgaatcaacctttgatcgtacctttgaaccaaagtctgtaccagtttgtgaaccagttcctgaaattgacaatatagaaccaagtagcaataaagatgatgattttcttgaaaaaaatggagctgatgaaaaattagagcaaattcagagtaaagactcattggatgagaaaaataaagctgataataatattgatgctaatgaagaaactctagaaacagatgatacaactatttgttcagatcgacctcctgaaaatgaaaagaaggtagaggaagatattatcacagagcttgctcttggagaagatgctatatctagcagtatggaaattgaccaaggtgaaaagaatgaagatgaaacttctgcagatcttgtagaaacgattaatgaaaatgttattgaagataacaaaagtgagaatatcttagaaaatacagactctatggagacagatgaaatcattcctattttggaaaagcttgcaccttctgaggatgaacttacttgcttttctaaaacatctctccttccaatcgatgagacaaatccagatttggaagagaaaatggaaagttcttttggttcaccatctaaacaagaaagtagtgagagtttgccaaaagaagcctttctggtcctctctgatgaagaggatatttcgggtgaaaaagatgagtctgaagttatatcgcaaaatgaaacgtgctctccagcagaagtagaaagtaatgaaaaggacaacagacctgaggaagaagagcaagtaatacatgaagatgatgaaagaccttctgagaaaaatgaattttctagacgaaaacgttctaaatcagaagacatggacaatgtacagtctaaacgtcgtcgatatatggaagaagaatatgaggcagaatttcaagtaaagattacagccaaaggagacattaaccagaaacttcaaaaggttatacagtggttgctggaagaaaaattgtgtgcgctgcagtgtgctgtatttgataagactttggcagaattgaaaacacgagtggaaaagattgaatgtaacaagaggcataaaacagttctcactgaactacaggccaagatagccaggttaaccaaacgctttgaagcagccaaagaagatcttaagaaaagacatgaacatccacccaacccaccagtatcaccaggaaaaactgtaaatgatgtcaacagcaataataacatgtcttacagaaatgcaggcacagtgagacagatgctggagtccaaaagaaatgtaagcgagagtgcaccaccatcctttcaaactcctgtgaatacagtatcttcaaccaatcttgtcactcctccagcagttgtcagtagtcaacctaaattgcagactccagtgacttcgggttccctcacagcaacgtcagttcttcctgcacccaatacagctactgtagttgctactactcaggtgcctagtggaaatccccagcctacaatctctttacagcctttgccagtgattttgcatgtacctgttgcagtatcctcccagcctcagcttctacagagccatccagggactttggtgactaatcaaccatctggcaatgttgaattcatttctgtgcaaagcccacctacagtgagtggtcttaccaaaaatccagtatccttgccatccttgccaaatcccactaaaccaaacaacgttccttctgtgcccagtcctagtattcaaaggaaccctactgccagtgctgcaccattgggaacaacacttgctgtgcaggctgttccaacagcacactctattgtacaagccacaaggacttctttacccacagtgggcccatcaggactctatagtccatcaactaatcgaggtcctatacagatgaaaattccaatttctgcatttagtacttcgtctgctgcagaacagaacagcaataccaccccaagaattgaaaaccagacaaacaaaacaatagatgcttctgtcagtaagaaagcagctgatagcacatcacagtgtggaaaagccactggcagtgattcaagtggtgtcattgatctcacaatggatgatgaagagagtggagcttcacaagaccccaaaaaactaaatcacactcctgtatcaaccatgagttcttctcagcctgtgtcacgaccattgcaacccatacaaccagcaccgcctcttcaaccatctggggtgccaacaagtggaccatctcagaccaccatacacttactacctacagctccaactaccgtgaatgtaacacatcgtccagtaactcaggtgaccacaagactccctgtaccaagagctcctgcaaaccaccaggtggtttatacaactcttcctgcaccaccagctcaggctcccttgcgaggaactgttatgcaggctcctgctgttcggcaggtcaatccccaaaatagtgttacagttcgagtgcctcaaacaaccacatatgttgtaaacaatggactaaccctgggatcaacaggacctcagctcacagtgcatcaccgaccaccacaagtgcatactgagcccccacgccccgtgcacccagcacccttaccagaagctccacaaccacagcgtctgcccccagaagctgccagcacatctctgcctcagaagccacacttgaagttagcacgcgttcagagtcaaaatggcatagtactgtcatggagtgtcctggaggtggatcgaagctgtgccactgttgatagctaccatctctatgcttaccatgaggaacccagtgccactgtgccctcacaatggaaaaagattggggaagtcaaggcacttcccttgcccatggcatgtactctcacccagtttgtatctggtagcaaatactactttgcagtacgagccaaggatatttatggacgttttgggcctttctgtgatcctcagtcaacagatgtgatctcttctacccagagcagttaaaccttggagcctttatattttcctcttttaaaatttccaccttttggtcttgtttttaatcttgtgcatgataccccatgtaaaatccaccttgtgcaagatttcttggacagatgtgtgtatacactacatttgtttataaccagaagcaaaataaactcagcccacaaagctagaatcttttcctggacagtttaggctttggggtttggaaatgtaaatgtgtaccttgctttagttttgaggctggggaatatgtgtgggtgtttatgtgtgtttttccttatgtaggtgttattgcattggagtctcccattttcattctcaaatttacctcttaaagtacgaagtaagtagatcaaaggatttgagatgtgtaactggcatgattctgcttttgaaggatctatagtatcattttagttaagtgggtcaaacagaatcaaaacaaaacccaaagaaataaataaaaaacaaaatggctaaatagtttaaaataggttaattcgaacacaggaaaggatctatttgttgtttcttttgtctggtctcctgagttgttaattaggtgaaaaaagatctgcaatggccccctccctttcctaatctggcttttacatttattttgtgccttaaagattaactacaaagataaacatggccaaaaataaataaataaatatggccatatgtccgttgttgcttagtcttcccttgcagccttttacccttgatttctccttcatctctaccaaatatagcacaactcctcaagtaattttttttttttaagatggagttttgctcttgttgcagtgagctgagattgcgccattgcactccatcctgggagacaagagcgaaactctgcctcaaaaaaaaaaagaatttaaagtatatcctttgaggtcattttatgtaacaattagatataacctcctgtgtatctctctgttcctcttcaaagttattaaaattcagcttaggtcatggatttttaatatgagggccagctgtactggtgtcaggtaggtgttttggggtgtagataatttaggactggagggctgagttaagttttaggaggagaatgtggttgagaatattttgaaaggaatttatggagtttgtgaaataacttcgaagtcctcttcctttacaatatttgaattcatatttgtaccttctcaaaatagtgattcatttttcctagaattacaggagggagctcttttactaatgttgttttgtttgcaactttgatggcttataataggaagtattctagttgtaaagaaaactctttagagacttttgactggtcagtatactgaggtgtgagatttgattcatgatgaagaaagcctatagattgccaaaaaattaattctccaaaccacctttcactctcagaaaatgagaccacaaaggagtatgctataaatcaaatttgccaaccaattatgtagatattactcattctaggactaatgatgatggtaaagaagttgccagtgttatggcaatgaaaatttcagaaaggaggagttgatgatcttctagatgtatatgaacacctgtctatatctgcatgtatatgttttgacctgcagtggttgcaatgttgatatgtgttcaagattattcctgtctacaaaactgaaggcccatgttcaaattgttctttattgggtgtttttatggtcacgtggtaacaattttcttacctaacctacaaaaggttctcttgatgaacatttttatttatatttactaatcttttttaaaaaaagctttcatagcattatataatcagatgaagaaagcccagtagaataaaaaaaaaattcattagcctagcctatattatgttttctgtcaaaggaaaacaaattctcaaataggaattctaaaaatatttactaaagtaaaataactacttaaaatgttttattccagttgggaaggaagggtacagggagaaatcgcaattatttaggggagaagtatatttattataagatggtgtcctcaaattagcctaccatggcacgtaggggcagcagctatattagatttactagaggtgctaagttagaacactaggcttttattgaggcaggttttaatattgatagatgctttttgtttggtttgtttcttctgggagagaatggaggacttaagtagaagtagctactgataacagactttctagtagcagtttccactccacggttacctttttagtttcatagtatcttttcacaaagtattacaaataagctagattctcccagtttgggaatgcaagtttgctacatttttagcctggcaatatttgtgtaggtattgccttattggaaattctggaaacctgatactgcaacctgcaatgtaggatgtttgtatggcatttaaaggtaatggtgatgtttattattctatactttgcattctgtgagagtaattttcactctgtcttaagtgtgagtaagcctcttctaaaaatcttgttcttgccaagaaatttataaatcacatacgaagacgtctgttgctaacagttaactttatgaggtaactatatccttctatttctctggactcatttttaaaaaatatgccgaatactgcatactgtttaaggtagtatataagtttatgagagaagtggagagctttcttccttgaaaagtcggtatttgttgagataccatttgcctcacagagaggtgttccccactcccatccccattgccagataataaatattttgagaaaagtgacctaaaacagctgaaatcttaggtgcatctgtctgcagacctccttaagcaggctgtatcttacaattcccttactgcactgggtaagtgttaacttagtttttgttgtttgctcttttgctttaaatattctccaaattaccatttatgcaacatggttagggttaatactgcatggtattcatttatcttgtttcatgaactttccagtactgtacaaggtcaacaaagtaatgcctgtggtatcctcatctctcacttttttactctgtgattttagcacagtaaggtactgcaaagaccttccttccaaatgttctccttgactttatttcttgggccaattcagtatcctcaacatcctaagattttgttgttttatcactgacctgtggttggcctgttttattctaatttccagaaaagtcaagtcccagtatttgcaatatcaaataactctaaaaccgatgtgtgattctaccttccttactatttttactgggcaaatgccctatttttttaattattattatttttaacttttgggacacacaaaaatcagcaattctcatgaagcgtttgttagtgtggcagacttgtctaattcctgaaactcattcatccccttgagccagccaatggggaggaataggataatgcaaacacatgttttgttttctcattttcaaataatttaccatgttaaaataaacttttctttgttttttatttgtagagtcagctaagtacccatatttaaatgccgtctttattatttttttgaggtctttgtttttgtctgtttttgttttgttttgttttgtaaataaggtaactgggcaatcaaacaccttttggggattctggctttagtattttatcagccattttaaaattaaatataaaaatcctttgtaagaaacttgcatcctaatttttctttattgcaattgaaagtgtaaataataagacaatgtaagtaagaccttcctaatgtctaatacaaactgggctccagcaagtggccctatttttattagggttttgaaggtttgtgtgtgtgtgtgcgtgcgtgtgtgtgtttttcttttttaaatgtatagtagagtggtgtctgtataagtgttacctgtagtggggttttgtccagcaagcctgaaatttatactttgaaataaaactactgggtttttaa

SEQ ID NO: 440574 - DNA, 8071 bp, Homo sapiens
tgcccagtctcacacagtaggtttcctgggagagttggaattcaaatctgtgaatctgtctacagtctacagagttcatgttcttaattgggttattaaaagtgatgaatttttttaaaggaatgcttacttttaatattcagaatggacagtttagaagaacctcagaaaaaagtctttaaggctcgaaaaacgatgagagtgagtgatcgtcagcaacttgaagcagtgtacaaggtcaaagaagaactgttgaaaactgatgtcaagctgttaaatggcaaccatgaaaatggagatttggacccaacctcacctttggaaaacatggattacattaaagacaaggaagaggtgaatggcattgaagagatttgttttgatcctgaaggaagtaaagcagaatggaaggaaacaccctgtatcctaagtgttaatgtaaaaaacaagcaggatgatgatttaaattgtgaacctttgtctccccataatataactccagaaccagtctctaaactgcctgctgaaccagtttctggtgatccagcccctggtgatctggatgccggagatccagcctccggagtactggcctctggtgattccacctctggtgatcccacctctagcgagccctcctctagtgatgctgcctctggtgatgcaacctctggtgatgccccttctggtgatgtgtcccctggtgatgccacctctggtgatgccactgctgatgatctctcctctggtgatcccacctctagtgatcccatcccaggtgaaccggtccctgttgaacccatttctggtgattgtgccgctgatgatatagcctctagtgaaataacttctgttgatctggcttctggagcaccagcttccactgatccagcctctgatgatctggcctctggtgatctatcctctagtgaactggcctctgatgatctggccactggtgaactggcctctgatgagctgacttctgaatcaacctttgatcgtacctttgaaccaaagtctgtaccagtttgtgaaccagttcctgaaattgacaatatagaaccaagtagcaataaagatgatgattttcttgaaaaaaatggagctgatgaaaaattagagcaaattcagagtaaagactcattggatgagaaaaataaagctgataataatattgatgctaatgaagaaactctagaaacagatgatacaactatttgttcagatcgacctcctgaaaatgaaaagaaggtagaggaagatattatcacagagcttgctcttggagaagatgctatatctagcagtatggaaattgaccaaggtgaaaagaatgaagatgaaacttctgcagatcttgtagaaacgattaatgaaaatgttattgaagataacaaaagtgagaatatcttagaaaatacagactctatggagacagatgaaatcattcctattttggaaaagcttgcaccttctgaggatgaacttacttgcttttctaaaacatctctccttccaatcgatgagacaaatccagatttggaagagaaaatggaaagttcttttggttcaccatctaaacaagaaagtagtgagagtttgccaaaagaagcctttctggtcctctctgatgaagaggatatttcgggtgaaaaagatgagtctgaagttatatcgcaaaatgaaacgtgctctccagcagaagtagaaagtaatgaaaaggacaacagacctgaggaagaagagcaagtaatacatgaagatgatgaaagaccttctgagaaaaatgaattttctagacgaaaacgttctaaatcagaagacatggacaatgtacagtctaaacgtcgtcgatatatggaagaagaatatgaggcagaatttcaagtaaagattacagccaaaggagacattaaccagaaacttcaaaaggttatacagtggttgctggaagaaaaattgtgtgcgctgcagtgtgctgtatttgataagactttggcagaattgaaaacacgagtggaaaagattgaatgtaacaagaggcataaaacagttctcactgaactacaggccaagatagccaggttaaccaaacgctttgaagcagccaaagaagatcttaagaaaagacatgaacatccacccaacccaccagtatcaccaggaaaaactgtaaatgatgtcaacagcaataataacatgtcttacagaaatgcaggcacagtgagacagatgctggagtccaaaagaaatgtaagcgagagtgcaccaccatcctttcaaactcctgtgaatacagtatcttcaaccaatcttgtcactcctccagcagttgtcagtagtcaacctaaattgcagactccagtgacttcgggttccctcacagcaacgtcagttcttcctgcacccaatacagctactgtagttgctactactcaggtgcctagtggaaatccccagcctacaatctctttacagcctttgccagtgattttgcatgtacctgttgcagtatcctcccagcctcagcttctacagagccatccagggactttggtgactaatcaaccatctggcaatgttgaattcatttctgtgcaaagcccacctacagtgagtggtcttaccaaaaatccagtatccttgccatccttgccaaatcccactaaaccaaacaacgttccttctgtgcccagtcctagtattcaaaggaaccctactgccagtgctgcaccattgggaacaacacttgctgtgcaggctgttccaacagcacactctattgtacaagccacaaggacttctttacccacagtgggcccatcaggactctatagtccatcaactaatcgaggtcctatacagatgaaaattccaatttctgcatttagtacttcgtctgctgcagaacagaacagcaataccaccccaagaattgaaaaccagacaaacaaaacaatagatgcttctgtcagtaagaaagcagctgatagcacatcacagtgtggaaaagccactggcagtgattcaagtggtgtcattgatctcacaatggatgatgaagagagtggagcttcacaagaccccaaaaaactaaatcacactcctgtatcaaccatgagttcttctcagcctgtgtcacgaccattgcaacccatacaaccagcaccgcctcttcaaccatctggggtgccaacaagtggaccatctcagaccaccatacacttactacctacagctccaactaccgtgaatgtaacacatcgtccagtaactcaggtgaccacaagactccctgtaccaagagctcctgcaaaccaccaggtggtttatacaactcttcctgcaccaccagctcaggctcccttgcgaggaactgttatgcaggctcctgctgttcggcaggtcaatccccaaaatagtgttacagttcgagtgcctcaaacaaccacatatgttgtaaacaatggactaaccctgggatcaacaggacctcagctcacagtgcatcaccgaccaccacaagtgcatactgagcccccacgccccgtgcacccagcacccttaccagaagctccacaaccacagcgtctgcccccagaagctgccagcacatctctgcctcagaagccacacttgaagttagcacgcgttcagagtcaaaatggcatagtactgtcatggagtgtcctggaggtggatcgaagctgtgccactgttgatagctaccatctctatgcttaccatgaggaacccagtgccactgtgccctcacaatggaaaaagattggggaagtcaaggcacttcccttgcccatggcatgtactctcacccagtttgtatctggtagcaaatactactttgcagtacgagccaaggatatttatggacgttttgggcctttctgtgatcctcagtcaacagatgtgatctcttctacccagagcagttaaaccttggagcctttatattttcctcttttaaaatttccaccttttggtcttgtttttaatcttgtgcatgataccccatgtaaaatccaccttgtgcaagatttcttggacagatgtgtgtatacactacatttgtttataaccagaagcaaaataaactcagcccacaaagctagaatcttttcctggacagtttaggctttggggtttggaaatgtaaatgtgtaccttgctttagttttgaggctggggaatatgtgtgggtgtttatgtgtgtttttccttatgtaggtgttattgcattggagtctcccattttcattctcaaatttacctcttaaagtacgaagtaagtagatcaaaggatttgagatgtgtaactggcatgattctgcttttgaaggatctatagtatcattttagttaagtgggtcaaacagaatcaaaacaaaacccaaagaaataaataaaaaacaaaatggctaaatagtttaaaataggttaattcgaacacaggaaaggatctatttgttgtttcttttgtctggtctcctgagttgttaattaggtgaaaaaagatctgcaatggccccctccctttcctaatctggcttttacatttattttgtgccttaaagattaactacaaagataaacatggccaaaaataaataaataaatatggccatatgtccgttgttgcttagtcttcccttgcagccttttacccttgatttctccttcatctctaccaaatatagcacaactcctcaagtaattttttttttttaagatggagttttgctcttgttgcccaggctagagtgcggtggcacaatcttggctcactgcaacctctgcctcctgggttcaagcaattcttctgtctcactactcaggaggcaaggctggagaatcgcttgaacccgggaggcggaggttgcagtgagctgagattgcgccattgcactccatcctgggagacaagagcgaaactctgcctcaaaaaaaaaaagaatttaaagtatatcctttgaggtcattttatgtaacaattagatataacctcctgtgtatctctctgttcctcttcaaagttattaaaattcagcttaggtcatggatttttaatatgagggccagctgtactggtgtcaggtaggtgttttggggtgtagataatttaggactggagggctgagttaagttttaggaggagaatgtggttgagaatattttgaaaggaatttatggagtttgtgaaataacttcgaagtcctcttcctttacaatatttgaattcatatttgtaccttctcaaaatagtgattcatttttcctagaattacaggagggagctcttttactaatgttgttttgtttgcaactttgatggcttataataggaagtattctagttgtaaagaaaactctttagagacttttgactggtcagtatactgaggtgtgagatttgattcatgatgaagaaagcctatagattgccaaaaaattaattctccaaaccacctttcactctcagaaaatgagaccacaaaggagtatgctataaatcaaatttgccaaccaattatgtagatattactcattctaggactaatgatgatggtaaagaagttgccagtgttatggcaatgaaaatttcagaaaggaggagttgatgatcttctagatgtatatgaacacctgtctatatctgcatgtatatgttttgacctgcagtggttgcaatgttgatatgtgttcaagattattcctgtctacaaaactgaaggcccatgttcaaattgttctttattgggtgtttttatggtcacgtggtaacaattttcttacctaacctacaaaaggttctcttgatgaacatttttatttatatttactaatcttttttaaaaaaagctttcatagcattatataatcagatgaagaaagcccagtagaataaaaaaaaaattcattagcctagcctatattatgttttctgtcaaaggaaaacaaattctcaaataggaattctaaaaatatttactaaagtaaaataactacttaaaatgttttattccagttgggaaggaagggtacagggagaaatcgcaattatttaggggagaagtatatttattataagatggtgtcctcaaattagcctaccatggcacgtaggggcagcagctatattagatttactagaggtgctaagttagaacactaggcttttattgaggcaggttttaatattgatagatgctttttgtttggtttgtttcttctgggagagaatggaggacttaagtagaagtagctactgataacagactttctagtagcagtttccactccacggttacctttttagtttcatagtatcttttcacaaagtattacaaataagctagattctcccagtttgggaatgcaagtttgctacatttttagcctggcaatatttgtgtaggtattgccttattggaaattctggaaacctgatactgcaacctgcaatgtaggatgtttgtatggcatttaaaggtaatggtgatgtttattattctatactttgcattctgtgagagtaattttcactctgtcttaagtgtgagtaagcctcttctaaaaatcttgttcttgccaagaaatttataaatcacatacgaagacgtctgttgctaacagttaactttatgaggtaactatatccttctatttctctggactcatttttaaaaaatatgccgaatactgcatactgtttaaggtagtatataagtttatgagagaagtggagagctttcttccttgaaaagtcggtatttgttgagataccatttgcctcacagagaggtgttccccactcccatccccattgccagataataaatattttgagaaaagtgacctaaaacagctgaaatcttaggtgcatctgtctgcagacctccttaagcaggctgtatcttacaattcccttactgcactgggtaagtgttaacttagtttttgttgtttgctcttttgctttaaatattctccaaattaccatttatgcaacatggttagggttaatactgcatggtattcatttatcttgtttcatgaactttccagtactgtacaaggtcaacaaagtaatgcctgtggtatcctcatctctcacttttttactctgtgattttagcacagtaaggtactgcaaagaccttccttccaaatgttctccttgactttatttcttgggccaattcagtatcctcaacatcctaagattttgttgttttatcactgacctgtggttggcctgttttattctaatttccagaaaagtcaagtcccagtatttgcaatatcaaataactctaaaaccgatgtgtgattctaccttccttactatttttactgggcaaatgccctatttttttaattattattatttttaacttttgggacacacaaaaatcagcaattctcatgaagcgtttgttagtgtggcagacttgtctaattcctgaaactcattcatccccttgagccagccaatggggaggaataggataatgcaaacacatgttttgttttctcattttcaaataatttaccatgttaaaataaacttttctttgttttttatttgtagagtcagctaagtacccatatttaaatgccgtctttattatttttttgaggtctttgtttttgtctgtttttgttttgttttgttttgtaaataaggtaactgggcaatcaaacaccttttggggattctggctttagtattttatcagccattttaaaattaaatataaaaatcctttgtaagaaacttgcatcctaatttttctttattgcaattgaaagtgtaaataataagacaatgtaagtaagaccttcctaatgtctaatacaaactgggctccagcaagtggccctatttttattagggttttgaaggtttgtgtgtgtgtgtgcgtgcgtgtgtgtgtttttcttttttaaatgtatagtagagtggtgtctgtataagtgttacctgtagtggggttttgtccagcaagcctgaaatttatactttgaaataaaactactgggtttttaa

SEQ ID NO: 440575 - DNA, 7232 bp, Homo sapiens
tgcccagtctcacacagtaggtttcctgggagagttggaattcaaatctgtgaatctgtctacagtctacagagttcatgttcttaattgggttattaaaagtgatgaatttttttaaaggaatgcttacttttaatattcagaatggacagtttagaagaacctcagaaaaaagtctttaaggctcgaaaaacgatgagagtgagtgatcgtcagcaacttgaagcagtgtacaaggtcaaagaagaactgttgaaaactgatgtcaagctgttaaatggcaaccatgaaaatggagatttggacccaacctcacctttggaaaacatggattacattaaagacaaggaagaggtgaatggcattgaagagatttgttttgatcctgaaggaagtaaagcagaatggaaggaaacaccctgtatcctaagtgttaatgtaaaaaacaagcaggatgatgatttaaattgtgaacctttgtctccccataatataactccagaaccagtctctaaactgcctgctgaaccagtttctggtgatccagcccctggtgatctggatgccggagatccagcctccggagtactggcctctggtgattccacctctggtgatcccacctctagcgagccctcctctagtgatgctgcctctggtgatgcaacctctggtgatgccccttctggtgatgtgtcccctggtgatgccacctctggtgatgccactgctgatgatctctcctctggtgatcccacctctagtgatcccatcccaggtgaaccggtccctgttgaacccatttctggtgattgtgccgctgatgatatagcctctagtgaaataacttctgttgatctggcttctggagcaccagcttccactgatccagcctctgatgatctggcctctggtgatctatcctctagtgaactggcctctgatgatctggccactggtgaactggcctctgatgagctgacttctgaatcaacctttgatcgtacctttgaaccaaagtctgtaccagtttgtgaaccagttcctgaaattgacaatatagaaccaagtagcaataaagatgatgattttcttgaaaaaaatggagctgatgaaaaattagagcaaattcagagtaaagactcattggatgagaaaaataaagctgataataatattgatgctaatgaagaaactctagaaacagatgatacaactatttgttcagatcgacctcctgaaaatgaaaagaaggtagaggaagatattatcacagagcttgctcttggagaagatgctatatctagcagtatggaaattgaccaaggtgaaaagaatgaagatgaaacttctgcagatcttgtagaaacgattaatgaaaatgttattgaagataacaaaagtgagaatatcttagaaaatacagactctatggagacagatgaaatcattcctattttggaaaagcttgcaccttctgaggatgaacttacttgcttttctaaaacatctctccttccaatcgatgagacaaatccagatttggaagagaaaatggaaagttcttttggttcaccatctaaacaagaaagtagtgagagtttgccaaaagaagcctttctggtcctctctgatgaagaggatatttcgggtgaaaaagatgagtctgaagttatatcgcaaaatgaaacgtgctctccagcagaagtagaaagtaatgaaaaggacaacagacctgaggaagaagagcaagtaatacatgaagatgatgaaagaccttctgagaaaaatgaattttctagacgaaaacgttctaaatcagaagacatggacaatgtacagtctaaacgtcgtcgatatatggaagaagaatatgaggcagaatttcaagtaaagattacagccaaaggagacattaaccagaaacttcaaaaggttatacagtggttgctggaagaaaaattgtgtgcgctgcagtgtgctgtatttgataagactttggcagaattgaaaacacgagtggaaaagattgaatgtaacaagaggcataaaacagttctcactgaactacaggccaagatagccaggttaaccaaacgctttgaagcagccaaagaagatcttaagaaaagacatgaacatccacccaacccaccagtatcaccaggaaaaactgtaaatgatgtcaacagcaataataacatgtcttacagaaatgcaggcacagtgagacagatgctggagtccaaaagaaatgtaagcgagagtgcaccaccatcctttcaaactcctgtgaatacagtatcttcaaccaatcttgtcactcctccagcagttgtcagtagtcaacctaaattgcagactccagtgacttcgggttccctcacagcaacgtcagttcttcctgcacccaatacagctactgtagttgctactactcaggtgcctagtggaaatccccagcctacaatctctttacagcctttgccagtgattttgcatgtacctgttgcagtatcctcccagcctcagcttctacagagccatccagggactttggtgactaatcaaccatctggcaatgttgaattcatttctgtgcaaagcccacctacagtgagtggtcttaccaaaaatccagtatccttgccatccttgccaaatcccactaaaccaaacaacgttccttctgtgcccagtcctagtattcaaaggaaccctactgccagtgctgcaccattgggaacaacacttgctgtgcaggctgttccaacagcacactctattgtacaagccacaaggacttctttacccacagtgggcccatcaggactctatagtccatcaactaatcgaggtcctatacagatgaaaattccaatttctgcatttagtacttcgtctgctgcagaacagaacagcaataccaccccaagaattgaaaaccagacaaacaaaacaatagatgcttctgtcagtaagaaagcagctgatagcacatcacagtgtggaaaagccactggcagtgattcaagtggtgtcattgatctcacaatggatgatgaagagagtggagcttcacaagaccccaaaaaactaaatcacactcctgtatcaaccatgagttcttctcagcctgtgtcacgaccattgcaacccatacaaccagcaccgcctcttcaaccatctggggtgccaacaagtggaccatctcagaccaccatacacttactacctacagctccaactaccgtgaatgtaacacatcgtccagtaactcaggtgaccacaagactccctgtaccaagagctcctgcaaaccaccaggtggtttatacaactcttcctgcaccaccagctcaggctcccttgcgaggaactgttatgcaggctcctgctgttcggcaggtcaatccccaaaatagtgttacagttcgagtgcctcaaacaaccacatatgttgtaaacaatggactaaccctgggatcaacaggacctcagctcacagtgcatcaccgaccaccacaagtgcatactgagcccccacgccccgtgcacccagcacccttaccagaagctccacaaccacagcgtctgcccccagaagctgccagcacatctctgcctcagaagccacacttgaagttagcacgcgttcagagtcaaaatggcatagtactgtcatggagtgtcctggaggtggatcgaagctgtgccactgttgatagctaccatctctatgcttaccatgaggaacccagtgccactgtgccctcacaatggaaaaagattggggaagtcaaggcacttcccttgcccatggcatgtactctcacccagtttgtatctggtagcaaatactactttgcagtacgagccaaggatatttatggacgttttgggcctttctgtgatcctcagtcaacagatgtgatctcttctacccagagcagttaaaccttggagcctttatattttcctcttttaaaatttccaccttttggtcttgtttttaatcttgtgcatgataccccatgtaaaatccaccttgtgcaagatttcttggacagatgtgtgtatacactacatttgtttataaccagaagcaaaataaactcagcccacaaagctagaatcttttcctggacagtttaggctttggggtttggaaatgtaaatgtgtaccttgctttagttttgaggctggggaatatgtgtgggtgtttatgtgtgtttttccttatgtaggtgttattgcattggagtctcccattttcattctcaaatttacctcttaaagtacgaagtaagtagatcaaaggatttgagatgtgtaactggcatgattctgcttttgaaggatctatagtatcattttagttaagtgggtcaaacagaatcaaaacaaaacccaaagaaataaataaaaaacaaaatggctaaatagtttaaaataggttaattcgaacacaggaaaggatctatttgttgtttcttttgtctggtctcctgagttgttaattaggtgaaaaaagatctgcaatggccccctccctttcctaatctggcttttacatttattttgtgccttaaagattaactacaaagataaacatggccaaaaataaataaataaatatggccatatgtccgttgttgcttagtcttcccttgcagccttttacccttgatttctccttcatctctaccaaatatagcacaactcctcaagtaattttttttttttaagatggagttttgctcttgttgcagtgagctgagattgcgccattgcactccatcctgggagacaagagcgaaactctgcctcaaaaaaaaaaagaatttaaagtatatcctttgaggtcattttatgtaacaattagatataacctcctgtgtatctctctgttcctcttcaaagttattaaaattcagcttaggtcatggatttttaatatgagggccagctgtactggtgtcaggtaggtgttttggggtgtagataatttaggactggagggctgagttaagttttaggaggagaatgtggttgagaatattttgaaaggaatttatggagtttgtgaaataacttcgaagtcctcttcctttacaatatttgaattcatatttgtaccttctcaaaatagtgattcatttttcctagaattacaggagggagctcttttactaatgttgttttgtttgcaactttgatggcttataataggaagtattctagttgtaaagaaaactctttagagacttttgactggtcagtatactgaggtgtgagatttgattcatgatgaagaaagcctatagattgccaaaaaattaattctccaaaccacctttcactctcagaaaatgagaccacaaaggagtatgctataaatcaaatttgccaaccaattatgtagatattactcattctaggactaatgatgatggtaaagaagttgccagtgttatggcaatgaaaatttcagaaaggaggagttgatgatcttctagatgtatatgaacacctgtctatatctgcatgtatatgttttgacctgcagtggttgcaatgttgatatgtgttcaagattattcctgtctacaaaactgaaggcccatgttcaaattgttctttattgggtgtttttatggtcacgtggtaacaattttcttacctaacctacaaaaggttctcttgatgaacatttttatttatatttactaatcttttttaaaaaaagctttcatagcattatataatcagatgaagaaagcccagtagaataaaaaaaaaattcattagcctagcctatattatgttttctgtcaaaggaaaacaaattctcaaataggaattctaaaaatatttactaaagtaaaataactacttaaaatgttttattccagttgggaaggaagggtacagggagaaatcgcaattatttaggggagaagtatatttattataagatggtgtcctcaaattagcctaccatggcacgtaggggcagcagctatattagatttactagaggtgctaagttagaacactaggcttttattgaggcaggttttaatattgatagatgctttttgtttggtttgtttcttctgggagagaatggaggacttaagtagaagtagctactgataacagactttctagtagcagtttccactccacggttacctttttagtttcatagtatcttttcacaaagtattacaaataagctagattctcccagtttgggaatgcaagtttgctacatttttagcctggcaatatttgtgtaggtattgccttattggaaattctggaaacctgatactgcaacctgcaatgtaggatgtttgtatggcatttaaaggtaatggtgatgtttattattctatactttgcattctgtgagagtaattttcactctgtcttaagtgtgagtaagcctcttctaaaaatcttgttcttgccaagaaatttataaatcacatacgaagacgtctgttgctaacagttaactttatgaggtaactatatccttctatttctctggactcatttttaaaaaatatgccgaatactgcatactgtttaaggtagtatataagtttatgagagaagtggagagctttcttccttgaaaagtcggtatttgttgagataccatttgcctcacagagaggtgttccccactcccatccccattgccagataataaatattttgagaaaagtgacctaaaacagctgaaatcttaggtgcatctgtctgcagacctccttaagcaggctgtatcttacaattcccttactgcactgggtaagtgttaacttagtttttgttgtttgctcttttgctttaaatattctccaaattaccatttatgcaacatggttagggttaatactgcatggtattcatttatcttgtttcatgaactttccagtactgtacaaggtcaacaaagtaatgcctgtggtatcctcatctctcacttttttactctgtgattttagcacagtaaggtactgcaaagaccttccttccaaatgttctccttgactttatttcttgggccaattcagtatcctcaacatcctaagattttgttgttttatcactgacctgtggttggcctgttttattctaatttccagaaaagtcaagtcccagtatttgcaatatcaaataactctattttttaattaattaatattttaaa

SEQ ID NO: 440576 - DNA, 5842 bp, Homo sapiens
tgcccagtctcacacagtaggtttcctgggagagttggaattcaaatctgtgaatctgtctacagtctacagagttcatgttcttaattgggttattaaaagtgatgaatttttttaaaggaatgcttacttttaatattcagaatggacagtttagaagaacctcagaaaaaagtctttaaggctcgaaaaacgatgagagtgagtgatcgtcagcaacttgaagcagtgtacaaggtcaaagaagaactgttgaaaactgatgtcaagctgttaaatggcaaccatgaaaatggagatttggacccaacctcacctttggaaaacatggattacattaaagacaaggaagaggtgaatggcattgaagagatttgttttgatcctgaaggaagtaaagcagaatggaaggaaacaccctgtatcctaagtgttaatgtaaaaaacaagcaggatgatgatttaaattgtgaacctttgtctccccataatataactccagaaccagtctctaaactgcctgctgaaccagtttctggtgatccagcccctggtgatctggatgccggagatccagcctccggagtactggcctctggtgattccacctctggtgatcccacctctagcgagccctcctctagtgatgctgcctctggtgatgcaacctctggtgatgccccttctggtgatgtgtcccctggtgatgccacctctggtgatgccactgctgatgatctctcctctggtgatcccacctctagtgatcccatcccaggtgaaccggtccctgttgaacccatttctggtgattgtgccgctgatgatatagcctctagtgaaataacttctgttgatctggcttctggagcaccagcttccactgatccagcctctgatgatctggcctctggtgatctatcctctagtgaactggcctctgatgatctggccactggtgaactggcctctgatgagctgacttctgaatcaacctttgatcgtacctttgaaccaaagtctgtaccagtttgtgaaccagttcctgaaattgacaatatagaaccaagtagcaataaagatgatgattttcttgaaaaaaatggagctgatgaaaaattagagcaaattcagagtaaagactcattggatgagaaaaataaagctgataataatattgatgctaatgaagaaactctagaaacagatgatacaactatttgttcagatcgacctcctgaaaatgaaaagaaggtagaggaagatattatcacagagcttgctcttggagaagatgctatatctagcagtatggaaattgaccaaggtgaaaagaatgaagatgaaacttctgcagatcttgtagaaacgattaatgaaaatgttattgaagataacaaaagtgagaatatcttagaaaatacagactctatggagacagatgaaatcattcctattttggaaaagcttgcaccttctgaggatgaacttacttgcttttctaaaacatctctccttccaatcgatgagacaaatccagatttggaagagaaaatggaaagttcttttggttcaccatctaaacaagaaagtagtgagagtttgccaaaagaagcctttctggtcctctctgatgaagaggatatttcgggtgaaaaagatgagtctgaagttatatcgcaaaatgaaacgtgctctccagcagaagtagaaagtaatgaaaaggacaacagacctgaggaagaagagcaagtaatacatgaagatgatgaaagaccttctgagaaaaatgaattttctagacgaaaacgttctaaatcagaagacatggacaatgtacagtctaaacgtcgtcgatatatggaagaagaatatgaggcagaatttcaagtaaagattacagccaaaggagacattaaccagaaacttcaaaaggttatacagtggttgctggaagaaaaattgtgtgcgctgcagtgtgctgtatttgataagactttggcagaattgaaaacacgagtggaaaagattgaatgtaacaagaggcataaaacagttctcactgaactacaggccaagatagccaggttaaccaaacgctttgaagcagccaaagaagatcttaagaaaagacatgaacatccacccaacccaccagtatcaccaggaaaaactgtaaatgatgtcaacagcaataataacatgtcttacagaaatgcaggcacagtgagacagatgctggagtccaaaagaaatgtaagcgagagtgcaccaccatcctttcaaactcctgtgaatacagtatcttcaaccaatcttgtcactcctccagcagttgtcagtagtcaacctaaattgcagactccagtgacttcgggttccctcacagcaacgtcagttcttcctgcacccaatacagctactgtagttgctactactcaggtgcctagtggaaatccccagcctacaatctctttacagcctttgccagtgattttgcatgtacctgttgcagtatcctcccagcctcagcttctacagagccatccagggactttggtgactaatcaaccatctggcaatgttgaattcatttctgtgcaaagcccacctacagtgagtggtcttaccaaaaatccagtatccttgccatccttgccaaatcccactaaaccaaacaacgttccttctgtgcccagtcctagtattcaaaggaaccctactgccagtgctgcaccattgggaacaacacttgctgtgcaggctgttccaacagcacactctattgtacaagccacaaggacttctttacccacagtgggcccatcaggactctatagtccatcaactaatcgaggtcctatacagatgaaaattccaatttctgcatttagtacttcgtctgctgcagaacagaacagcaataccaccccaagaattgaaaaccagacaaacaaaacaatagatgcttctgtcagtaagaaagcagctgatagcacatcacagtgtggaaaagccactggcagtgattcaagtggtgtcattgatctcacaatggatgatgaagagagtggagcttcacaagaccccaaaaaactaaatcacactcctgtatcaaccatgagttcttctcagcctgtgtcacgaccattgcaacccatacaaccagcaccgcctcttcaaccatctggggtgccaacaagtggaccatctcagaccaccatacacttactacctacagctccaactaccgtgaatgtaacacatcgtccagtaactcaggtgaccacaagactccctgtaccaagagctcctgcaaaccaccaggtggtttatacaactcttcctgcaccaccagctcaggctcccttgcgaggaactgttatgcaggctcctgctgttcggcaggtcaatccccaaaatagtgttacagttcgagtgcctcaaacaaccacatatgttgtaaacaatggactaaccctgggatcaacaggacctcagctcacagtgcatcaccgaccaccacaagtgcatactgagcccccacgccccgtgcacccagcacccttaccagaagctccacaaccacagcgtctgcccccagaagctgccagcacatctctgcctcagaagccacacttgaagttagcacgcgttcagagtcaaaatggcatagtactgtcatggagtgtcctggaggtggatcgaagctgtgccactgttgatagctaccatctctatgcttaccatgaggaacccagtgccactgtgccctcacaatggaaaaagattggggaagtcaaggcacttcccttgcccatggcatgtactctcacccagtttgtatctggtagcaaatactactttgcagtacgagccaaggatatttatggacgttttgggcctttctgtgatcctcagtcaacagatgtgatctcttctacccagagcagttaaaccttggagcctttatattttcctcttttaaaatttccaccttttggtcttgtttttaatcttgtgcatgataccccatgtaaaatccaccttgtgcaagatttcttggacagatgtgtgtatacactacatttgtttataaccagaagcaaaataaactcagcccacaaagctagaatcttttcctggacagtttaggctttggggtttggaaatgtaaatgtgtaccttgctttagttttgaggctggggaatatgtgtgggtgtttatgtgtgtttttccttatgtaggtgttattgcattggagtctcccattttcattctcaaatttacctcttaaagtacgaagtaagtagatcaaaggatttgagatgtgtaactggcatgattctgcttttgaaggatctatagtatcattttagttaagtgggtcaaacagaatcaaaacaaaacccaaagaaataaataaaaaacaaaatggctaaatagtttaaaataggttaattcgaacacaggaaaggatctatttgttgtttcttttgtctggtctcctgagttgttaattaggtgaaaaaagatctgcaatggccccctccctttcctaatctggcttttacatttattttgtgccttaaagattaactacaaagataaacatggccaaaaataaataaataaatatggccatatgtccgttgttgcttagtcttcccttgcagccttttacccttgatttctccttcatctctaccaaatatagcacaactcctcaagtaattttttttttttaagatggagttttgctcttgttgcagtgagctgagattgcgccattgcactccatcctgggagacaagagcgaaactctgcctcaaaaaaaaaaagaatttaaagtatatcctttgaggtcattttatgtaacaattagatataacctcctgtgtatctctctgttcctcttcaaagttattaaaattcagcttaggtcatggatttttaatatgagggccagctgtactggtgtcaggtaggtgttttggggtgtagataatttaggactggagggctgagttaagttttaggaggagaatgtggttgagaatattttgaaaggaatttatggagtttgtgaaataacttcgaagtcctcttcctttacaatatttgaattcatatttgtaccttctcaaaatagtgattcatttttcctagaattacaggagggagctcttttactaatgttgttttgtttgcaactttgatggcttataataggaagtattctagttgtaaagaaaactctttagagacttttgactggtcagtatactgaggtgtgagatttgattcatgatgaagaaagcctatagattgccaaaaaattaattctccaaaccacctttcactctcagaaaatgagaccacaaaggagtatgctataaatcaaatttgccaaccaattatgtagatattactcattctaggactaatgatgatggtaaagaagttgccagtgttatggcaatgaaaatttcagaaaggaggagttgatgatcttctagatgtatatgaacacctgtctatatctgcatgtatatgttttgacctgcagtggttgcaatgttgatatgtgttcaagattattcctgtctacaaaactgaaggcccatgttcaaattgttctttattgggtgtttttatggtcacgtggtaacaattttcttacctaacctacaaaaggttctcttgatgaacatttttatttatatttactaatcttttttaaaaaaagctttcatagcattatataatcagatgaagaaagcccagtagaataaaaaaaaagtcgacgcggccgcgaatttagtagtagtagtagtaggc

SEQ ID NO: 440577 - DNA, 6259 bp, Homo sapiens
  misc_feature (131)..(131): n is a, c, g, or t
  misc_feature (365)..(365): n is a, c, g, or t
cagggactttggtgactaatcaaccatctggcaatgttgaattcatttctgtgcaaagcccacctacagtgagtgtcttaccaaaaatccagtatccttgccatccttgccaaatcccactaaaccaaacnacgttccttctgtgcccagtcctagtattcaaaggaaccctactgccagtgctgcaccattgggaacaacacttgctgtgcaggctgttccaacagcacactctattgtacaagccacaaggacttctttacccacagtgggcccatcaggactctatagtccatcaactaatcgaggtcctatacagatgaaaattccaatttctgcatttagtacttcgtctgctgcagaanagaacagcaataccaccccaagaattgaaaaccagacaaacaaaacaatagatgcttctgtcagtaagaaagcagctgatagcacatcacagcatccacccaacccaccagtatcaccaggaaaaactgtaaatgatgtcaacagcaataataacatgtcttacagaaatgcaggcacagtgagacagatgctggagtccaaaagaaatgtaagcgagagtgcaccaccatcctttcaaactcctgtgaatacagtatcttcaaccaatcttgtcactcctccagcagttgtcagtagtcaacctaaattgcagactccagtgacttcgggttccctcacagcaacgtcagttcttcctgcacccaatacagctactgtagttgctactactcaggtgcctagtggaaatccccagcctacaatctctttacagcctttgccagtgattttgcatgtacctgttgcagtatcctcccagcctcagcttctacagagccatccagggactttggtgactaatcaaccatctggcaatgttgaattcatttctgtgcaaagcccacctacagtgagtggtcttaccaaaaatccagtatccttgccatccttgccaaatcccactaaaccaaacaacgttccttctgtgcccagtcctagtattcaaaggaaccctactgccagtgctgcaccattgggaacaacacttgctgtgcaggctgttccaacagcacactctattgtacaagccacaaggacttctttacccacagtgggcccatcaggactctatagtccatcaactaatcgaggtcctatacagatgaaaattccaatttctgcatttagtacttcgtctgctgcagaacagaacagcaataccaccccaagaattgaaaaccagacaaacaaaacaatagatgcttctgtcagtaagaaagcagctgatagcacatcacagtgtggaaaagccactggcagtgattcaagtggtgtcattgatctcacaatggatgatgaagagagtggagcttcacaagaccccaaaaaactaaatcacactcctgtatcaaccatgagttcttctcagcctgtgtcacgaccattgcaacccatacaaccagcaccgcctcttcaaccatctggggtgccaacaagtggaccatctcagaccaccatacacttactacctacagctccaactaccgtgaatgtaacacatcgtccagtaactcaggtgaccacaagactccctgtaccaagagctcctgcaaaccaccaggtggtttatacaactcttcctgcaccaccagctcaggctcccttgcgaggaactgttatgcaggctcctgctgttcggcaggtcaatccccaaaatagtgttacagttcgagtgcctcaaacaaccacatatgttgtaaacaatggactaaccctgggatcaacaggacctcagctcacagtgcatcaccgaccaccacaagtgcatactgagcccccacgccccgtgcacccagcacccttaccagaagctccacaaccacagcgtctgcccccagaagctgccagcacatctctgcctcagaagccacacttgaagttagcacgcgttcagagtcaaaatggcatagtactgtcatggagtgtcctggaggtggatcgaagctgtgccactgttgatagctaccatctctatgcttaccatgaggaacccagtgccactgtgccctcacaatggaaaaagattggggaagtcaaggcacttcccttgcccatggcatgtactctcacccagtttgtatctggtagcaaatactactttgcagtacgagccaaggatatttatggacgttttgggcctttctgtgatcctcagtcaacagatgtgatctcttctacccagagcagttaaaccttggagcctttatattttcctcttttaaaatttccaccttttggtcttgtttttaatcttgtgcatgataccccatgtaaaatccaccttgtgcaagatttcttggacagatgtgtgtatacactacatttgtttataaccagaagcaaaataaactcagcccacaaagctagaatcttttcctggacagtttaggctttggggtttggaaatgtaaatgtgtaccttgctttagttttgaggctggggaatatgtgtgggtgtttatgtgtgtttttccttatgtaggtgttattgcattggagtctcccattttcattctcaaatttacctcttaaagtacgaagtaagtagatcaaaggatttgagatgtgtaactggcatgattctgcttttgaaggatctatagtatcattttagttaagtgggtcaaacagaatcaaaacaaaacccaaagaaataaataaaaaacaaaatggctaaatagtttaaaataggttaattcgaacacaggaaaggatctatttgttgtttcttttgtctggtctcctgagttgttaattaggtgaaaaaagatctgcaatggccccctccctttcctaatctggcttttacatttattttgtgccttaaagattaactacaaagataaacatggccaaaaataaataaataaatatggccatatgtccgttgttgcttagtcttcccttgcagccttttacccttgatttctccttcatctctaccaaatatagcacaactcctcaagtaattttttttttttaagatggagttttgctcttgttgcagtgagctgagattgcgccattgcactccatcctgggagacaagagcgaaactctgcctcaaaaaaaaaaagaatttaaagtatatcctttgaggtcattttatgtaacaattagatataacctcctgtgtatctctctgttcctcttcaaagttattaaaattcagcttaggtcatggatttttaatatgagggccagctgtactggtgtcaggtaggtgttttggggtgtagataatttaggactggagggctgagttaagttttaggaggagaatgtggttgagaatattttgaaaggaatttatggagtttgtgaaataacttcgaagtcctcttcctttacaatatttgaattcatatttgtaccttctcaaaatagtgattcatttttcctagaattacaggagggagctcttttactaatgttgttttgtttgcaactttgatggcttataataggaagtattctagttgtaaagaaaactctttagagacttttgactggtcagtatactgaggtgtgagatttgattcatgatgaagaaagcctatagattgccaaaaaattaattctccaaaccacctttcactctcagaaaatgagaccacaaaggagtatgctataaatcaaatttgccaaccaattatgtagatattactcattctaggactaatgatgatggtaaagaagttgccagtgttatggcaatgaaaatttcagaaaggaggagttgatgatcttctagatgtatatgaacacctgtctatatctgcatgtatatgttttgacctgcagtggttgcaatgttgatatgtgttcaagattattcctgtctacaaaactgaaggcccatgttcaaattgttctttattgggtgtttttatggtcacgtggtaacaattttcttacctaacctacaaaaggttctcttgatgaacatttttatttatatttactaatcttttttaaaaaaagctttcatagcattatataatcagatgaagaaagcccagtagaataaaaaaaaaattcattagcctagcctatattatgttttctgtcaaaggaaaacaaattctcaaataggaattctaaaaatatttactaaagtaaaataactacttaaaatgttttattccagttgggaaggaagggtacagggagaaatcgcaattatttaggggagaagtatatttattataagatggtgtcctcaaattagcctaccatggcacgtaggggcagcagctatattagatttactagaggtgctaagttagaacactaggcttttattgaggcaggttttaatattgatagatgctttttgtttggtttgtttcttctgggagagaatggaggacttaagtagaagtagctactgataacagactttctagtagcagtttccactccacggttacctttttagtttcatagtatcttttcacaaagtattacaaataagctagattctcccagtttgggaatgcaagtttgctacatttttagcctggcaatatttgtgtaggtattgccttattggaaattctggaaacctgatactgcaacctgcaatgtaggatgtttgtatggcatttaaaggtaatggtgatgtttattattctatactttgcattctgtgagagtaattttcactctgtcttaagtgtgagtaagcctcttctaaaaatcttgttcttgccaagaaatttataaatcacatacgaagacgtctgttgctaacagttaactttatgaggtaactatatccttctatttctctggactcatttttaaaaaatatgccgaatactgcatactgtttaaggtagtatataagtttatgagagaagtggagagctttcttccttgaaaagtcggtatttgttgagataccatttgcctcacagagaggtgttccccactcccatccccattgccagataataaatattttgagaaaagtgacctaaaacagctgaaatcttaggtgcatctgtctgcagacctccttaagcaggctgtatcttacaattcccttactgcactgggtaagtgttaacttagtttttgttgtttgctcttttgctttaaatattctccaaattaccatttatgcaacatggttagggttaatactgcatggtattcatttatcttgtttcatgaactttccagtactgtacaaggtcaacaaagtaatgcctgtggtatcctcatctctcacttttttactctgtgattttagcacagtaaggtactgcaaagaccttccttccaaatgttctccttgactttatttcttgggccaattcagtatcctcaacatcctaagattttgttgttttatcactgacctgtggttggcctgttttattctaatttccagaaaagtcaagtcccagtatttgcaatatcaaataactctaaaaccgatgtgtgattctaccttccttactatttttactgggcaaatgccctatttttttaattattattatttttaacttttgggacacacaaaaatcagcaattctcatgaagcgtttgttagtgtggcagacttgtctaattcctgaaactcattcatccccttgagccagccaatggggaggaataggataatgcaaacacatgttttgttttctcattttcaaataatttaccatgttaaaataaacttttctttgttttttatttgtagagtcagctaagtacccatatttaaatgccgtctttattatttttttgaggtctttgtttttgtctgtttttgttttgttttgttttgtaaataaggtaactgggcaatcaaacaccttttggggattctggctttagtattttatcagccattttaaaattaaatataaaaatcctttgtaagaaacttgcatcctaatttttctttattgcaattgaaagtgtaaataataagacaatgtaagtaagaccttcctaatgtctaatacaaactgggctccagcaagtggccctatttttattagggttttgaaggtttgtgtgtgtgtgtgcgtgcgtgtgtgtgtttttcttttttaaatgtatagtagagtggtgtctgtataagtgttacctgtagtggggttttgtccagcaagcctgaaatttatactttgaaataaaactactgggtttttaa

SEQ ID NO: 440578 - DNA, 4891 bp, Homo sapiens
cttcgctgcaccactcagcgtcaggctgctccttgtcgaggaacatgttattgcaggctctctgctgttacggcacggtcaaggccccaaaagttgtgttacagttgcgagtgccgtcaaacaactcacatattgttgtaaacaactggactaaaccctgggagtcaacaggacctcagctaacagtgcatcaccggatcaagagaagtgcatagtgagcaaccacggcgccggtgcaacacagctccctgtaccaagagctcctgcaaaccaccaggtggtttatacaactcttcctgcaccaccagctcaggctcccttgcgaggaactgttatgcaggctcctgctgttcggcaggtcaatccccaaaatagtgttacagttcgagtgcctcaaacaaccacatatgttgtaaacaatggactaaccctgggatcaacaggacctcagctcacagtgcatcaccgaccaccacaagtgcatactgagcccccacgccccgtgcacccagcacccttaccagaagctccacaaccacagcgtctgcccccagaagctgccagcacatctctgcctcagaagccacacttgaagttagcacgcgttcagagtcaaaatggcatagtactgtcatggagtgtcctggaggtggatcgaagctgtgccactgttgatagctaccatctctatgcttaccatgaggaacccagtgccactgtgccctcacaatggaaaaagattggggaagtcaaggcacttcccttgcccatggcatgtactctcacccagtttgtatctggtagcaaatactactttgcagtacgagccaaggatatttatggacgttttgggcctttctgtgatcctcagtcaacagatgtgatctcttctacccagagcagttaaaccttggagcctttatattttcctcttttaaaatttccaccttttggtcttgtttttaatcttgtgcatgataccccatgtaaaatccaccttgtgcaagatttcttggacagatgtgtgtatacactacatttgtttataaccagaagcaaaataaactcagcccacaaagctagaatcttttcctggacagtttaggctttggggtttggaaatgtaaatgtgtaccttgctttagttttgaggctggggaatatgtgtgggtgtttatgtgtgtttttccttatgtaggtgttattgcattggagtctcccattttcattctcaaatttacctcttaaagtacgaagtaagtagatcaaaggatttgagatgtgtaactggcatgattctgcttttgaaggatctatagtatcattttagttaagtgggtcaaacagaatcaaaacaaaacccaaagaaataaataaaaaacaaaatggctaaatagtttaaaataggttaattcgaacacaggaaaggatctatttgttgtttcttttgtctggtctcctgagttgttaattaggtgaaaaaagatctgcaatggccccctccctttcctaatctggcttttacatttattttgtgccttaaagattaactacaaagataaacatggccaaaaataaataaataaatatggccatatgtccgttgttgcttagtcttcccttgcagccttttacccttgatttctccttcatctctaccaaatatagcacaactcctcaagtaattttttttttttaagatggagttttgctcttgttgcagtgagctgagattgcgccattgcactccatcctgggagacaagagcgaaactctgcctcaaaaaaaaaaagaatttaaagtatatcctttgaggtcattttatgtaacaattagatataacctcctgtgtatctctctgttcctcttcaaagttattaaaattcagcttaggtcatggatttttaatatgagggccagctgtactggtgtcaggtaggtgttttggggtgtagataatttaggactggagggctgagttaagttttaggaggagaatgtggttgagaatattttgaaaggaatttatggagtttgtgaaataacttcgaagtcctcttcctttacaatatttgaattcatatttgtaccttctcaaaatagtgattcatttttcctagaattacaggagggagctcttttactaatgttgttttgtttgcaactttgatggcttataataggaagtattctagttgtaaagaaaactctttagagacttttgactggtcagtatactgaggtgtgagatttgattcatgatgaagaaagcctatagattgccaaaaaattaattctccaaaccacctttcactctcagaaaatgagaccacaaaggagtatgctataaatcaaatttgccaaccaattatgtagatattactcattctaggactaatgatgatggtaaagaagttgccagtgttatggcaatgaaaatttcagaaaggaggagttgatgatcttctagatgtatatgaacacctgtctatatctgcatgtatatgttttgacctgcagtggttgcaatgttgatatgtgttcaagattattcctgtctacaaaactgaaggcccatgttcaaattgttctttattgggtgtttttatggtcacgtggtaacaattttcttacctaacctacaaaaggttctcttgatgaacatttttatttatatttactaatcttttttaaaaaaagctttcatagcattatataatcagatgaagaaagcccagtagaataaaaaaaaaattcattagcctagcctatattatgttttctgtcaaaggaaaacaaattctcaaataggaattctaaaaatatttactaaagtaaaataactacttaaaatgttttattccagttgggaaggaagggtacagggagaaatcgcaattatttaggggagaagtatatttattataagatggtgtcctcaaattagcctaccatggcacgtaggggcagcagctatattagatttactagaggtgctaagttagaacactaggcttttattgaggcaggttttaatattgatagatgctttttgtttggtttgtttcttctgggagagaatggaggacttaagtagaagtagctactgataacagactttctagtagcagtttccactccacggttacctttttagtttcatagtatcttttcacaaagtattacaaataagctagattctcccagtttgggaatgcaagtttgctacatttttagcctggcaatatttgtgtaggtattgccttattggaaattctggaaacctgatactgcaacctgcaatgtaggatgtttgtatggcatttaaaggtaatggtgatgtttattattctatactttgcattctgtgagagtaattttcactctgtcttaagtgtgagtaagcctcttctaaaaatcttgttcttgccaagaaatttataaatcacatacgaagacgtctgttgctaacagttaactttatgaggtaactatatccttctatttctctggactcatttttaaaaaatatgccgaatactgcatactgtttaaggtagtatataagtttatgagagaagtggagagctttcttccttgaaaagtcggtatttgttgagataccatttgcctcacagagaggtgttccccactcccatccccattgccagataataaatattttgagaaaagtgacctaaaacagctgaaatcttaggtgcatctgtctgcagacctccttaagcaggctgtatcttacaattcccttactgcactgggtaagtgttaacttagtttttgttgtttgctcttttgctttaaatattctccaaattaccatttatgcaacatggttagggttaatactgcatggtattcatttatcttgtttcatgaactttccagtactgtacaaggtcaacaaagtaatgcctgtggtatcctcatctctcacttttttactctgtgattttagcacagtaaggtactgcaaagaccttccttccaaatgttctccttgactttatttcttgggccaattcagtatcctcaacatcctaagattttgttgttttatcactgacctgtggttggcctgttttattctaatttccagaaaagtcaagtcccagtatttgcaatatcaaataactctaaaaccgatgtgtgattctaccttccttactatttttactgggcaaatgccctatttttttaattattattatttttaacttttgggacacacaaaaatcagcaattctcatgaagcgtttgttagtgtggcagacttgtctaattcctgaaactcattcatccccttgagccagccaatggggaggaataggataatgcaaacacatgttttgttttctcattttcaaataatttaccatgttaaaataaacttttctttgttttttatttgtagagtcagctaagtacccatatttaaatgccgtctttattatttttttgaggtctttgtttttgtctgtttttgttttgttttgttttgtaaataaggtaactgggcaatcaaacaccttttggggattctggctttagtattttatcagccattttaaaattaaatataaaaatcctttgtaagaaacttgcatcctaatttttctttattgcaattgaaagtgtaaataataagacaatgtaagtaagaccttcctaatgtctaatacaaactgggctccagcaagtggccctatttttattagggttttgaaggtttgtgtgtgtgtgtgcgtgcgtgtgtgtgtttttcttttttaaatgtatagtagagtggtgtctgtataagtgttacctgtagtggggttttgtccagcaagcctgaaatttatactttgaaataaaactactgggtttttaa

SEQ ID NO: 440579 - DNA, 3911 bp, Homo sapiens
tgcccagtctcacacagtaggtttcctgggagagttggaattcaaatctgtgaatctgtctacagtctacagagttcatgttcttaattgggttattaaaagtgatgaatttttttaaaggaatgcttacttttaatattcagaatggacagtttagaagaacctcagaaaaaagtctttaaggctcgaaaaacgatgagagtgagtgatcgtcagcaacttgaagcagtgtacaaggtcaaagaagaactgttgaaaactgatgtcaagctgttaaatggcaaccatgaaaatggagatttggacccaacctcacctttggaaaacatggattacattaaagacaaggaagaggtgaatggcattgaagagatttgttttgatcctgaaggaagtaaagcagaatggaaggaaacaccctgtatcctaagtgttaatgtaaaaaacaagcaggatgatgatttaaattgtgaacctttgtctccccataatataactccagaaccagtctctaaactgcctgctgaaccagtttctggtgatccagcccctggtgatctggatgccggagatccagcctccggagtactggcctctggtgattccacctctggtgatcccacctctagcgagccctcctctagtgatgctgcctctggtgatgcaacctctggtgatgccccttctggtgatgtgtcccctggtgatgccacctctggtgatgccactgctgatgatctctcctctggtgatcccacctctagtgatcccatcccaggtgaaccggtccctgttgaacccatttctggtgattgtgccgctgatgatatagcctctagtgaaataacttctgttgatctggcttctggagcaccagcttccactgatccagcctctgatgatctggcctctggtgatctatcctctagtgaactggcctctgatgatctggccactggtgaactggcctctgatgagctgacttctgaatcaacctttgatcgtacctttgaaccaaagtctgtaccagtttgtgaaccagttcctgaaattgacaatatagaaccaagtagcaataaagatgatgattttcttgaaaaaaatggagctgatgaaaaattagagcaaattcagagtaaagactcattggatgagaaaaataaagctgataataatattgatgctaatgaagaaactctagaaacagatgatacaactatttgttcagatcgacctcctgaaaatgaaaagaaggtagaggaagatattatcacagagcttgctcttggagaagatgctatatctagcagtatggaaattgaccaaggtgaaaagaatgaagatgaaacttctgcagatcttgtagaaacgattaatgaaaatgttattgaagataacaaaagtgagaatatcttagaaaatacagactctatggagacagatgaaatcattcctattttggaaaagcttgcaccttctgaggatgaacttacttgcttttctaaaacatctctccttccaatcgatgagacaaatccagatttggaagagaaaatggaaagttcttttggttcaccatctaaacaagaaagtagtgagagtttgccaaaagaagcctttctggtcctctctgatgaagaggatatttcgggtgaaaaagatgagtctgaagttatatcgcaaaatgaaacgtgctctccagcagaagtagaaagtaatgaaaaggacaacagacctgaggaagaagagcaagtaatacatgaagatgatgaaagaccttctgagaaaaatgaattttctagacgaaaacgttctaaatcagaagacatggacaatgtacagtctaaacgtcgtcgatatatggaagaagaatatgaggcagaatttcaagtaaagattacagccaaaggagacattaaccagaaacttcaaaaggttatacagtggttgctggaagaaaaattgtgtgcgctgcagtgtgctgtatttgataagactttggcagaattgaaaacacgagtggaaaagattgaatgtaacaagaggcataaaacagttctcactgaactacaggccaagatagccaggttaaccaaacgctttgaagcagccaaagaagatcttaagaaaagacatgaacatccacccaacccaccagtatcaccaggaaaaactgtaaatgatgtcaacagcaataataacatgtcttacagaaatgcaggcacagtgagacagatgctggagtccaaaagaaatgtaagcgagagtgcaccaccatcctttcaaactcctgtgaatacagtatcttcaaccaatcttgtcactcctccagcagttgtcagtagtcaacctaaattgcagactccagtgacttcgggttccctcacagcaacgtcagttcttcctgcacccaatacagctactgtagttgctactactcaggtgcctagtggaaatccccagcctacaatctctttacagcctttgccagtgattttgcatgtacctgttgcagtatcctcccagcctcagcttctacagagccatccagggactttggtgactaatcaaccatctggcaatgttgaattcatttctgtgcaaagcccacctacagtgagtggtcttaccaaaaatccagtatccttgccatccttgccaaatcccactaaaccaaacaacgttccttctgtgcccagtcctagtattcaaaggaaccctactgccagtgctgcaccattgggaacaacacttgctgtgcaggctgttccaacagcacactctattgtacaagccacaaggacttctttacccacagtgggcccatcaggactctatagtccatcaactaatcgaggtcctatacagatgaaaattccaatttctgcatttagtacttcgtctgctgcagaacagaacagcaataccaccccaagaattgaaaaccagacaaacaaaacaatagatgcttctgtcagtaagaaagcagctgatagcacatcacagtgtggaaaagccactggcagtgattcaagtggtgtcattgatctcacaatggatgatgaagagagtggagcttcacaagaccccaaaaaactaaatcacactcctgtatcaaccatgagttcttctcagcctgtgtcacgaccattgcaacccatacaaccagcaccgcctcttcaaccatctggggtgccaacaagtggaccatctcagaccaccatacacttactacctacagctccaactaccgtgaatgtaacacatcgtccagtaactcaggtgaccacaagactccctgtaccaagagctcctgcaaaccaccaggtggtttatacaactcttcctgcaccaccagctcaggctcccttgcgaggaactgttatgcaggctcctgctgttcggcaggtcaatccccaaaatagagagttaaacagagaaaattgttgatgtatactagttgatttgtgctctgagtgttgtctttaatttaactttatttatggcctgtattagtatagtacacaatttgatattggtatattctctactctattaagaaacaccttacctagttagagtgggaatggtcaattgtgatttaccccagatgatggaaatcatggtaaaggatagccttcaatgagagtcttaaagatatggaaagtggctgagaaaagaagggaaaatgttaaagaaagcttgtagtttcttgtatatatcatatattagttacatacatatgttacatgcatgttacatatgtagatgacattttaaaattatatattaaccacatgtatataagcagtagtagaatatatcacataaacacaagcttatataaaaggtatatttaaactttaaagtaaagaaaaataataaaatgaactacgtatgaactcttaaaa

SEQ ID NO: 440580 - DNA, 3363 bp, Homo sapiens
tgcccagtctcacacagtaggtttcctgggagagttggaattcaaatctgtgaatctgtctacagtctacagagttcatgttcttaattgggttattaaaagtgatgaatttttttaaaggaatgcttacttttaatattcagaatggacagtttagaagaacctcagaaaaaagtctttaaggctcgaaaaacgatgagagtgagtgatcgtcagcaacttgaagcagtgtacaaggtcaaagaagaactgttgaaaactgatgtcaagctgttaaatggcaaccatgaaaatggagatttggacccaacctcacctttggaaaacatggattacattaaagacaaggaagaggtgaatggcattgaagagatttgttttgatcctgaaggaagtaaagcagaatggaaggaaacaccctgtatcctaagtgttaatgtaaaaaacaagcaggatgatgatttaaattgtgaacctttgtctccccataatataactccagaaccagtctctaaactgcctgctgaaccagtttctggtgatccagcccctggtgatctggatgccggagatccagcctccggagtactggcctctggtgattccacctctggtgatcccacctctagcgagccctcctctagtgatgctgcctctggtgatgcaacctctggtgatgccccttctggtgatgtgtcccctggtgatgccacctctggtgatgccactgctgatgatctctcctctggtgatcccacctctagtgatcccatcccaggtgaaccggtccctgttgaacccatttctggtgattgtgccgctgatgatatagcctctagtgaaataacttctgttgatctggcttctggagcaccagcttccactgatccagcctctgatgatctggcctctggtgatctatcctctagtgaactggcctctgatgatctggccactggtgaactggcctctgatgagctgacttctgaatcaacctttgatcgtacctttgaaccaaagtctgtaccagtttgtgaaccagttcctgaaattgacaatatagaaccaagtagcaataaagatgatgattttcttgaaaaaaatggagctgatgaaaaattagagcaaattcagagtaaagactcattggatgagaaaaataaagctgataataatattgatgctaatgaagaaactctagaaacagatgatacaactatttgttcagatcgacctcctgaaaatgaaaagaaggtagaggaagatattatcacagagcttgctcttggagaagatgctatatctagcagtatggaaattgaccaaggtgaaaagaatgaagatgaaacttctgcagatcttgtagaaacgattaatgaaaatgttattgaagataacaaaagtgagaatatcttagaaaatacagactctatggagacagatgaaatcattcctattttggaaaagcttgcaccttctgaggatgaacttacttgcttttctaaaacatctctccttccaatcgatgagacaaatccagatttggaagagaaaatggaaagttcttttggttcaccatctaaacaagaaagtagtgagagtttgccaaaagaagcctttctggtcctctctgatgaagaggatatttcgggtgaaaaagatgagtctgaagttatatcgcaaaatgaaacgtgctctccagcagaagtagaaagtaatgaaaaggacaacagacctgaggaagaagagcaagtaatacatgaagatgatgaaagaccttctgagaaaaatgaattttctagacgaaaacgttctaaatcagaagacatggacaatgtacagtctaaacgtcgtcgatatatggaagaagaatatgaggcagaatttcaagtaaagattacagccaaaggagacattaaccagaaacttcaaaaggttatacagtggttgctggaagaaaaattgtgtgcgctgcagtgtgctgtatttgataagactttggcagaattgaaaacacgagtggaaaagattgaatgtaacaagaggcataaaacagttctcactgaactacaggccaagatagccaggttaaccaaacgctttgaagcagccaaagaagatcttaagaaaagacatgaacatccacccaacccaccagtatcaccaggaaaaactgtaaatgatgtcaacagcaataataacatgtcttacagaaatgcaggcacagtgagacagatgctggagtccaaaagaaatgtaagcgagagtgcaccaccatcctttcaaactcctgtgaatacagtatcttcaaccaatcttgtcactcctccagcagttgtcagtagtcaacctaaattgcagactccagtgacttcgggttccctcacagcaacgtcagttcttcctgcacccaatacagctactgtagttgctactactcaggtgcctagtggaaatccccagcctacaatctctttacagcctttgccagtgattttgcatgtacctgttgcagtatcctcccagcctcagcttctacagagccatccagggactttggtgactaatcaaccatctggcaatgttgaattcatttctgtgcaaagcccacctacagtgagtggtcttaccaaaaatccagtatccttgccatccttgccaaatcccactaaaccaaacaacgttccttctgtgcccagtcctagtattcaaaggaaccctactgccagtgctgcaccattgggaacaacacttgctgtgcaggctgttccaacagcacactctattgtacaagccacaaggacttctttacccacagtgggcccatcaggactctatagtccatcaactaatcgaggtcctatacagatgaaaattccaatttctgcatttagtacttcgtctgctgcagaacagaacagcaataccaccccaagaattgaaaaccagacaaacaaaacaatagatgcttctgtcagtaagaaagcagctgatagcacatcacagtgtggaaaagccactggcagtgattcaagtggtgtcattgatctcacaatggatgatgaagagagtggagcttcacaagaccccaaaaaactaaatcacactcctgtatcaaccatgagttcttctcagcctgtgtcacgaccattgcaacccatacaaccagcaccgcctcttcaaccatctggggtgccaacaagtggaccatctcagaccaccatacacttactacctacagctccaactaccgtgaatgtaacacatcgtccagtattgctcagcggcgctgagctaatacaggaccatagaaacaccaaacccagtatctcaataactgccagtcctaatgatattccaata

SEQ ID NO: 440581 - DNA, 879 bp, Homo sapiens
  misc_feature (814)..(814): n is a, c, g, or t
ggaggtggtcgccctccgtcgtggtctggcgtgtattccgagccttggtgtctggcggtttccgagcgttggtgtctggcggtttccgagcgttggtgtcttggcggtttccgaccgttggtgtctggcggtttccgaccgttggtgtctggcacgcgccaccctctcttgctttggttgcgccatgccgatgtaccagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatcttttcaatgctgcgaaagctgccaaaagtgacatgcagggatgtccttcctgagatccgtgctatctgcattgaggaaattgggtgttggatgcgaagctacagcacgtctttcctcaccgacagctatttaaaatatattggttggactctgcatgataagcaccgagaagtccgcgtgaagtgcgtgaaggctctgaaagggctgtacggtaaccgggacctgaccgcacgcctggagctcttcactggctgcttcaaggactggatggtttccatgatcatggacagagagtacagtgtggcagtggaggccgtcagattactgatacttatccttaagaaacatggaaggggtgctgatggacgtggactgtgaagagcgtctaccccattgtgtaggcctctaattgaggcctggctctgctggggtgaatttctgtactggaanttctacctggtggaatagaacatggggaaaacgcaagccaggcaaagatccaccgggccttgtgg

SEQ ID NO: 440582 - DNA, 1187 bp, Homo sapiens
  misc_feature (1122)..(1122): n is a, c, g, or t
ggaggtggtcgccctccgtcgtggtctggcgtgtattccgagccttggtgtctggcggtttccgagcgttggtgtctggcggtttccgagcgttggtgtcttggcggtttccgaccgttggtgtctggcggtttccgaccgttggtgtctggcacgcgccaccctctcttgctttggttgcgccatgccgatgtaccagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatcttttcaatgctgcgaaagctgccaaaagtgacatgcagggatgtccttcctgagatccgtgctatctgcattgaggaaattgggtgttggatgcgaagctacagcacgtctttcctcaccgacagctatttaaaatatattggttggactctgcatgataagcaccgagaagtccgcgtgaagtgcgtgaaggctctgaaagggctgtacggtaaccgggacctgaccgcacgcctggagctcttcactggctgcttcaaggactggatggtttccatgatcatggacagagagtacagtgtggcagtggaggccgtcagattactgatacttatccttaagtgagtcctgggaagaggggaggccagtgtctcagacctttgcccttccagggtcatctccctccacctgtcacagctgactcttccatctgtgcaggttgactgaggtcattcctgagttgcagtatgttgagagggtaatatttctgtcttctctaactccccatactcccttgtcttccactctccatttaggagttttttgtgagttatgtccttgttgcttttgcctctttttctttctagccttgattgtgccagaagacaatgtccctattcacacactctttctgcttttctgtgggcaggaaacatggaaggggtgctgatggacgtggactgtgaagagcgtctaccccattgtgtaggcctctaattgaggcctggctctgctggggtgaatttctgtactggaanttctacctggtggaatagaacatggggaaaacgcaagccaggcaaagatccaccgggccttgtgg

SEQ ID NO: 440583 - DNA, 1304 bp, Homo sapiens
  misc_feature (1239)..(1239): n is a, c, g, or t
ggaggtggtcgccctccgtcgtggtctggcgtgtattccgagccttggtgtctggcggtttccgagcgttggtgtctggcggtttccgagcgttggtgtcttggcggtttccgaccgttggtgtctggcggtttccgaccgttggtgtctggcacgcgccaccctctcttgctttggttgcgccatgccgatgtaccaggtaaagccctatcaccgggtctgcgcccctctccgtgtggagcccacctgcatgtactggctccccaacatgcacggcaggagcggcggcccagcacttggcactggccacttgcagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatcttttcaatgctgcgaaagctgccaaaagtgacatgcagggatgtccttcctgagatccgtgctatctgcattgaggaaattgggtgttggatgcgaagctacagcacgtctttcctcaccgacagctatttaaaatatattggttggactctgcatgataagcaccgagaagtccgcgtgaagtgcgtgaaggctctgaaagggctgtacggtaaccgggacctgaccgcacgcctggagctcttcactggctgcttcaaggactggatggtttccatgatcatggacagagagtacagtgtggcagtggaggccgtcagattactgatacttatccttaagtgagtcctgggaagaggggaggccagtgtctcagacctttgcccttccagggtcatctccctccacctgtcacagctgactcttccatctgtgcaggttgactgaggtcattcctgagttgcagtatgttgagagggtaatatttctgtcttctctaactccccatactcccttgtcttccactctccatttaggagttttttgtgagttatgtccttgttgcttttgcctctttttctttctagccttgattgtgccagaagacaatgtccctattcacacactctttctgcttttctgtgggcaggaaacatggaaggggtgctgatggacgtggactgtgaagagcgtctaccccattgtgtaggcctctaattgaggcctggctctgctggggtgaatttctgtactggaanttctacctggtggaatagaacatggggaaaacgcaagccaggcaaagatccaccgggccttgtgg

SEQ ID NO: 440584 - DNA, 316 bp, Homo sapiens
cgtaatgagatattgagtgactttctcctttctgcaggactggatggtttccatgatcatggacagagagtacagtgtggcagtggaggccgtcagattactgatacttatccttaagtgagtcctgggaagaggggaggccagtgtctcagacctttgcccttccagggtcatctccctccacctgtcacagctgactcttccatctgtgcaggttgactgaggtcattcctgagttgcagtatgttgagagggtaatatttctgtcttctctaactccccatactcccttgtcttccactctccatttaggagt

SEQ ID NO: 440585 - DNA, 795 bp, Homo sapiens
ggaggtggtcgccctccgtcgtggtctggcgtgtattccgagccttggtgtctggcggtttccgagcgttggtgtctggcggtttccgagcgttggtgtcttggcggtttccgaccgttggtgtctggcggtttccgaccgttggtgtctggcacgcgccaccctctcttgctttggttgcgccatgccgatgtaccagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatcttttcaatgctgcgaaagctgccaaaagtgacatgcagcaccgagaagtccgcgtgaagtgcgtgaaggctctgaaagggctgtacggtaaccgggacctgaccgcacgcctggagctcttcactggctgcttcaaggactggatggtttccatgatcatggacagagagtacagtgtggcagtggaggccgtcagattactgatacttatccttaagaaacatggaaggggtgctgatggacgtggactgtgaagagcgtctaccccattgtgtaggcctctaattgaggcctggctctgctggggtgaatttctgtactggaaacttttctaccctgagtgcgagataagaacgatgggtggaagagagcaacgccagagcccaggtgcccagaggactttcttccagcttctgctgtccttctttgtg

SEQ ID NO: 440586 - DNA, 416 bp, Homo sapiens
cttcctctgctgcaagtctctgcttagaagtctcctcactaacccctgccgtgatcttctggtttaaactctgtttaaaactgggactggttcccacctctgcatttcctagtcccacctttccccgcaagcacctgtcgtcttccaataccagatttaaataacatttcaccattacgtttatcgcctgtctccccctgctggaatgtgagctccatgtgggcagggatttttgtcttgttcactgttgaatccctggttcctagaacagtgcctggattgtggcaggtgcttaataatattcattgtatgagtgaatgaatatatgagaaatcaggaatttaatggctagttattttataatatacatcaatttaactctgcaaatattaaaatgaagagtgactttgtaacac

SEQ ID NO: 440587 - DNA, 1913 bp, Homo sapiens
  misc_feature (1)..(1): n is a, c, g, or t
  misc_feature (7)..(7): n is a, c, g, or t
  misc_feature (14)..(14): n is a, c, g, or t
  misc_feature (17)..(17): n is a, c, g, or t
ngcacgnggcgctnccnggccgcgcttcctgcgtccccaacccggtccctgagagggcactgcgccctctccaccactgcgttccctcggctaagaatcccccgaaccccagccccgcgatcgcggcgcccaccgaggaggccgcccgggtggggcgcgggggtcgcgaagcccgcagccccggaccgcccagccgagacggagccggacccgccgcctcccgggcccttccaccgcagctatccgcacgggaggcctcgcgattgctcggaaccatcccgcaggagttcagctgatattttctagtgtggggcgagagattttgtggagcgcatttaaggggtttttgttgtgactgctgccttgtatatatttattttctttcttggaactgggcctcgccctcctcccactgacatgatggcccagtccaaggccaatggctcgcactatgcgctgaccgccatcggcctggggatgctggtccttggggtgatcatggccatgtggaacctggtacccggcttcagcgcggccgagaagccaacagctcagggcagcaacaagaccgaggtgggtggcggcatcctcaagagcaagaccttctctgtggcctacgtgctggtcggggccggggtgatgctgctgctgctttctatctgcctgagtatcagggataagaggaagcagcggcagggcgaggacctggcccatgtccagcacccgacaggcgctgggcctcacgcccaggaggaagacagccaggaggaagaagaggaggatgaggaggctgcctcaaggtactatgttcccagctacgaggaagtgatgaacacaaactactcagaagcaaggggagaggagcagaacccgaggttgagcatctctctcccgtcctatgagtcactgacggggctcgacgagaccacccccacatccaccagggctgacgtggaggccagccctgggaacccccctgacaggcagaactctaagttggccaaacgactgaaaccgctgaaagttcgaaggattaaatctgaaaagcttcacctcaaagactttaggatcaacctcccagacaaaaacgtccctcctccctcgatagagcctttgactcctccaccgcagtatgatgaagtccaggagaaggcccccgacacccggccgcccgactgaatggccccacttgagccacgctccctcctgtctctcacacctttcacccccaagactctaacaaagccacatgagccacagttgagaagcggaggggccagctgtgcatggagccatttggatggcggcgggcggggggggattctctgtatcaggagtgactttgttgccccacacagcctcctgctgcaggtgctttggaaagagatgctgccttggagctggtgaatctgtggaccacattcaagggtgtggcacaggcatcttcccatccttttcactccgaatcgctggcgacacattctcctttccagctaggaaagggttcctcgcggctggtttagattgtggttgtttgttttgcttctactaagactgttttgtttcaaaaaggaaacaagttttgtgtttgctgtctacgctggagtcctgaactgtgggtagaaaacacgacctggctttgtagaaaggacacagggctgttttatgaactaagcggtgaggctcaggtggcggctctcgcagagcccctgatgctgttgttctttgagggcttaaggcctgatgaacgtaggcacgtgatgcgtaatagtcttcaatggtacacttaactagtctcttctgtgtaacagcaaaaaaaaaaaaaaaagaagaagaaagaaaactgtaggaaatgttctttttgaaatgccatgcaatggagctttttgtaataaaatattttatatgtagta

SEQ ID NO: 440588 - DNA, 409 bp, Homo sapiens
gctggacgctcacccaagaaggggaccccggcctgacctctctcggaattcaaaaaaatctaaggctcagagagggaatgggagctggctcttccctctgtgtttagcatccacgttttttggcggtctggctgaaaccagcccaccctagttcgggcgccagagcaacgcagttccgagggcagatctccaagggaagaggcagagccgcgggttgttctttgagggcttaaggcctgatgaacgtaggcacgtgatgcgtaatagtcttcaatggtacacttaactagtctcttctgtgtaacagcaaaaaaaaaaaaaaaagaagaagaaagaaaactgtaggaaatgttctttttgaaatgccatgcaatggagctttttgtaataaaatattttatatgtagta

SEQ ID NO: 440589 - DNA, 1975 bp, Homo sapiens
gctggacgctcacccaagaaggggaccccggcctgacctctctcggaattcaaaaaaatctaaggctcagagagggaatgggagctggctcttccctctgtgtttagcatccacgttttttggcggtctggctgaaaccagcccaccctagttcgggcgccagagcaacgcagttccgagggcagatctccaagggaagaggcagagccgcgggtggatctttaactcaagactagcatgaagagttgccttctggcctgccctgagtctcctcaaataacaacaggcccttccaccgcagctatccgcacgggaggcctcgcgattgctcggaaccatcccgcaggagttcagctgatattttctagtgtggggcgagagattttgtggagcgcatttaaggggtttttgttgtgactgctgccttgtatatatttattttctttcttggaactgggcctcgccctcctcccactgacatgatggcccagtccaaggccaatggctcgcactatgcgctgaccgccatcggcctggggatgctggtccttggggtgatcatggccatgtggaacctggtacccggcttcagcgcggccgagaagccaacagctcagggcagcaacaagaccgaggtgggtggcggcatcctcaagagcaagaccttctctgtggcctacgtgctggtcggggccggggtgatgctgctgctgctttctatctgcctgagtatcagggataagaggaagcagcggcagggcgaggacctggcccatgtccagcacccgacaggcgctgggcctcacgcccaggaggaagacagccaggaggaagaagaggaggatgaggaggctgcctcaaggtactatgttcccagctacgaggaagtgatgaacacaaactactcagaagcaaggggagaggagcagaacccgaggttgagcatctctctcccgtcctatgagtcactgacggggctcgacgagaccacccccacatccaccagggctgacgtggaggccagccctgggaacccccctgacaggcagaactctaagttggccaaacgactgaaaccgctgaaagttcgaaggattaaatctgaaaagcttcacctcaaagactttaggatcaacctcccagacaaaaacgtccctcctccctcgatagagcctttgactcctccaccgcagtatgatgaagtccaggagaaggcccccgacacccggccgcccgactgaatggccccacttgagccacgctccctcctgtctctcacacctttcacccccaagactctaacaaagccacatgagccacagttgagaagcggaggggccagctgtgcatggagccatttggatggcggcgggcggggggggattctctgtatcaggagtgactttgttgccccacacagcctcctgctgcaggtgctttggaaagagatgctgccttggagctggtgaatctgtggaccacattcaagggtgtggcacaggcatcttcccatccttttcactccgaatcgctggcgacacattctcctttccagctaggaaagggttcctcgcggctggtttagattgtggttgtttgttttgcttctactaagactgttttgtttcaaaaaggaaacaagttttgtgtttgctgtctacgctggagtcctgaactgtgggtagaaaacacgacctggctttgtagaaaggacacagggctgttttatgaactaagcggtgaggctcaggtggcggctctcgcagagcccctgatgctgttgttctttgagggcttaaggcctgatgaacgtaggcacgtgatgcgtaatagtcttcaatggtacacttaactagtctcttctgtgtaacagcaaaaaaaaaaaaaaaagaagaagaaagaaaactgtaggaaatgttctttttgaaatgccatgcaatggagctttttgtaataaaatattttatatgtagta

SEQ ID NO: 440590 - DNA, 1938 bp, Homo sapiens
  misc_feature (1)..(1): n is a, c, g, or t
  misc_feature (7)..(7): n is a, c, g, or t
  misc_feature (14)..(14): n is a, c, g, or t
  misc_feature (17)..(17): n is a, c, g, or t
ngcacgnggcgctnccnggccgcgcttcctgcgtccccaacccggtccctgagagggcactgcgccctctccaccactgcgttccctcggctaagaatcccccgaaccccagccccgcgatcgcggcgcccaccgaggaggccgcccgggtggggcgcgggggtcgcgaagcccgcagccccggaccgcccagccgagacggagccggacccgccgcctcccgggtggatctttaactcaagactagcatgaagagttgccttctggcctgccctgagtctcctcaaataacaacaggcccttccaccgcagctatccgcacgggaggcctcgcgattgctcggaaccatcccgcaggagttcagctgatattttctagtgtggggcgagagattttgtggagcgcatttaaggggtttttgttgtgactgctgccttgtatatatttattttctttcttggaactgggcctcgccctcctcccactgacatgatggcccagtccaaggccaatggctcgcactatgcgctgaccgccatcggcctggggatgctggtccttggggtgatcatggccatgtggaacctggtacccggcttcagcgcggccgagaagccaacagctcagggcagcaacaagaccgaggtgggtggcggcatcctcaagagcaagaccttctctgtggcctacgtgctggtcggggccggggtgatgctgctgctgctttctatctgcctgagtatcagggataagaggaagcagcggcagggcgaggacctggcccatgtccagcacccgacaggcgctgggcctcacgcccaggaggaagacagccaggaggaagaagaggaggatgaggaggctgcctcaaggtactatgttcccagctacgaggaagtgatgaacacaaactactcagaagcaaggggagaggagcagaacccgaggttgagcatctctctcccgtcctatgagtcactgacggggctcgacgagaccacccccacatccaccagggctgacgtggaggccagccctgggaacccccctgacaggcagaactctaagttggccaaacgactgaaaccgctgaaagttcgaaggattaaatctgaaaagcttcacctcaaagactttaggatcaacctcccagacaaaaacgtccctcctccctcgatagagcctttgactcctccaccgcagtatgatgaagtccaggagaaggcccccgacacccggccgcccgactgaatggccccacttgagccacgctccctcctgtctctcacacctttcacccccaagactctaacaaaccatttggatggcggcgggcggggggggattctctgtatcaggagtgactttgttgccccacacagcctcctgctgcaggtgctttggaaagagatgctgccttggagctggtgaatctgtggaccacattcaagggtgtggcacaggcatcttcccatccttttcactccgaatcgctggcgacacattctcctttccagctaggaaagggttcctcgcggctggtttagattgtggttgtttgttttgcttctactaagactgttttgtttcaaaaaggaaacaagttttgtgtttgctgtctacgctggagtcctgaactgtgggtagaaaacacgacctggctttgtagaaaggacacagggctgttttatgaactaagcggtgaggctcaggtggcggctctcgcagagcccctgatgctgttgttctttgagggcttaaggcctgatgaacgtaggcacgtgatgcgtaatagtcttcaatggtacacttaactagtctcttctgtgtaacagcaaaaaaaaaaaaaaaagaagaagaaagaaaactgtaggaaatgttctttttgaaatgccatgcaatggagctttttgtaataaaatattttatatgtagta

SEQ ID NO: 440591 - DNA, 1992 bp, Homo sapiens
  misc_feature (1)..(1): n is a, c, g, or t
  misc_feature (7)..(7): n is a, c, g, or t
  misc_feature (14)..(14): n is a, c, g, or t
  misc_feature (17)..(17): n is a, c, g, or t
ngcacgnggcgctnccnggccgcgcttcctgcgtccccaacccggtccctgagagggcactgcgccctctccaccactgcgttccctcggctaagaatcccccgaaccccagccccgcgatcgcggcgcccaccgaggaggccgcccgggtggggcgcgggggtcgcgaagcccgcagccccggaccgcccagccgagacggagccggacccgccgcctcccgggtggatctttaactcaagactagcatgaagagttgccttctggcctgccctgagtctcctcaaataacaacaggcccttccaccgcagctatccgcacgggaggcctcgcgattgctcggaaccatcccgcaggagttcagctgatattttctagtgtggggcgagagattttgtggagcgcatttaaggggtttttgttgtgactgctgccttgtatatatttattttctttcttggaactgggcctcgccctcctcccactgacatgatggcccagtccaaggccaatggctcgcactatgcgctgaccgccatcggcctggggatgctggtccttggggtgatcatggccatgtggaacctggtacccggcttcagcgcggccgagaagccaacagctcagggcagcaacaagaccgaggtgggtggcggcatcctcaagagcaagaccttctctgtggcctacgtgctggtcggggccggggtgatgctgctgctgctttctatctgcctgagtatcagggataagaggaagcagcggcagggcgaggacctggcccatgtccagcacccgacaggcgctgggcctcacgcccaggaggaagacagccaggaggaagaaaaggaggaatgacgagagctgacctcaacgacaacaatgaacacccagactacgcaggcaagtgaatgcagcacacccagcctactcacgaagcacaggggagacgatggacgccggaacacccgagggttagaccatcctcgactccccgaacctaatgcagtcgctggcaccggggcctacgatgctcactacaccactcccgacacaatatcacaccccacgcttcactagacctattagtaacctacccaatacaccttacatcatacacgtctctccctactacacacggatcagcaaccatactatacacatttatttcccaactaccactacattgccaacaccccacctatgcgacagtcatttctgaatatacaactatacacagctcccgcgatagcaggcgcgtgcgacgcgacgatagatagcagccatacttcacggagccgacgacaccacgcgcagagcacaacacaccgacatcggttagccggagacgcaaccgccgtgcgcgaacgtgacaagtccagcaaggcacgagctccgccatccgcaagaaccagcacgaggaagcaggcagggcgacagcgcacaccacggggaggacgaggcgagagcaccggatccagcacccggaggactgcatgcgccggtctcgcgggaacgagcactcacgccctcgcggcatggaggtgaccgcgccgtgcgatagtatcgacactcacacaagcctgtgcacggcccgcaaaagcaacacgacagaggataaggccagcacgacagagcgacgccgagcgcacacagcgagccgctggcacgacagcatcaccacgaccccacctaactcccccctcacccctctaccgcgcagcaccgccactcgcaactaccacacataccatacccgccacctaaacacttacctcaacacatcccacacaacaccactcacctcgccgacaccctcctcactcaccaccctcctacacaaccacacccccaactacacatcgacaccatccatccaacacaccacactacacaagcctgcacccacatacgataccctacactctcccccacaaccacatccactcaatcacaactcaaaatctactcaaatactacatcacccccca

SEQ ID NO: 440592 - DNA, 490 bp, Homo sapiens
tgcactcttctatatctacattgcactcttctatatctacattgcactcttctatatctacattgcactcttctatatctacattgcactcttctatatctacattgcactcttctatatctacattaagactgttttgtttcaaaaaggaaacaagttttgtgtttgctgtctacgctggagtcctgaactgtgggtagaaaacacgacctggctttgtagaaaggacacagggctgttttatgaactaagcggtgaggctcaggtggcggctctcgcagagcccctgatgctgttgttctttgagggcttaaggcctgatgaacgtaggcacgtgatgcgtaatagtcttcaatggtacacttaactagtctcttctgtgtaacagcaaaaaaaaaaaaaaaagaagaagaaagaaaactgtaggaaatgttctttttgaaatgccatgcaatggagctttttgtaataaaatattttatatgtagta

SEQ ID NO: 440593 - DNA, 1986 bp, Homo sapiens
  misc_feature (1)..(1): n is a, c, g, or t
  misc_feature (7)..(7): n is a, c, g, or t
  misc_feature (14)..(14): n is a, c, g, or t
  misc_feature (17)..(17): n is a, c, g, or t
ngcacgnggcgctnccnggccgcgcttcctgcgtccccaacccggtccctgagagggcactgcgccctctccaccactgcgttccctcggctaagaatcccccgaaccccagccccgcgatcgcggcgcccaccgaggaggccgcccgggtggggcgcgggggtcgcgaagcccgcagccccggaccgcccagccgagacggagccggacccgccgcctcccgggtggatctttaactcaagactagcatgaagagttgccttctggcctgccctgagtctcctcaaataacaacaggcccttccaccgcagctatccgcacgggaggcctcgcgattgctcggaaccatcccgcaggagttcagctgatattttctagtgtggggcgagagattttgtggagcgcatttaaggggtttttgttgtgactgctgccttgtatatatttattttctttcttggaactgggcctcgccctcctcccactgacatgatggcccagtccaaggccaatggctcgcactatgcgctgaccgccatcggcctggggatgctggtccttggggtgatcatggccatgtggaacctggtacccggcttcagcgcggccgagaagccaacagctcagggcagcaacaagaccgaggtgggtggcggcatcctcaagagcaagaccttctctgtggcctacgtgctggtcggggccggggtgatgctgctgctgctttctatctgcctgagtatcagggataagaggaagcagcggcagggcgaggacctggcccatgtccagcacccgacaggcgctgggcctcacgcccaggaggaagacagccaggaggaagaagaggaggatgaggaggctgcctcaaggtactatgttcccagctacgaggaagtgatgaacacaaactactcagaagcaaggggagaggagcagaacccgaggttgagcatctctctcccgtcctatgagtcactgacggggctcgacgagaccacccccacatccaccagggctgacgtggaggccagccctgggaacccccctgacaggcagaactctaagttggccaaacgactgaaaccgctgaaagttcgaaggattaaatctgaaaagcttcacctcaaagactttaggatcaacctcccagacaaaaacgtccctcctccctcgatagagcctttgactcctccaccgcagtatgatgaagtccaggagaaggcccccgacacccggccgcccgactgaatggccccacttgagccacgctccctcctgtctctcacacctttcacccccaagactctaacaaagccacatgagccacagttgagaagcggaggggccagctgtgcatggagccatttggatggcggcgggcggggggggattctctgtatcaggagtgactttgttgccccacacagcctcctgctgcaggtgctttggaaagagatgctgccttggagctggtgaatctgtggaccacattcaagggtgtggcacaggcatcttcccatccttttcactccgaatcgctggcgacacattctcctttccagctaggaaagggttcctcgcggctggtttagattgtggttgtttgttttgcttctactaagactgttttgtttcaaaaaggaaacaagttttgtgtttgctgtctacgctggagtcctgaactgtgggtagaaaacacgacctggctttgtagaaaggacacagggctgttttatgaactaagcggtgaggctcaggtggcggctctcgcagagcccctgatgctgttgttctttgagggcttaaggcctgatgaacgtaggcacgtgatgcgtaatagtcttcaatggtacacttaactagtctcttctgtgtaacagcaaaaaaaaaaaaaaaagaagaagaaagaaaactgtaggaaatgttctttttgaaatgccatgcaatggagctttttgtaataaaatattttatatgtagta

SEQ ID NO: 440594 - DNA, 1902 bp, Homo sapiens
gctggacgctcacccaagaaggggaccccggcctgacctctctcggaattcaaaaaaatctaaggctcagagagggaatgggagctggctcttccctctgtgtttagcatccacgttttttggcggtctggctgaaaccagcccaccctagttcgggcgccagagcaacgcagttccgagggcagatctccaagggaagaggcagagccgcgggcccttccaccgcagctatccgcacgggaggcctcgcgattgctcggaaccatcccgcaggagttcagctgatattttctagtgtggggcgagagattttgtggagcgcatttaaggggtttttgttgtgactgctgccttgtatatatttattttctttcttggaactgggcctcgccctcctcccactgacatgatggcccagtccaaggccaatggctcgcactatgcgctgaccgccatcggcctggggatgctggtccttggggtgatcatggccatgtggaacctggtacccggcttcagcgcggccgagaagccaacagctcagggcagcaacaagaccgaggtgggtggcggcatcctcaagagcaagaccttctctgtggcctacgtgctggtcggggccggggtgatgctgctgctgctttctatctgcctgagtatcagggataagaggaagcagcggcagggcgaggacctggcccatgtccagcacccgacaggcgctgggcctcacgcccaggaggaagacagccaggaggaagaagaggaggatgaggaggctgcctcaaggtactatgttcccagctacgaggaagtgatgaacacaaactactcagaagcaaggggagaggagcagaacccgaggttgagcatctctctcccgtcctatgagtcactgacggggctcgacgagaccacccccacatccaccagggctgacgtggaggccagccctgggaacccccctgacaggcagaactctaagttggccaaacgactgaaaccgctgaaagttcgaaggattaaatctgaaaagcttcacctcaaagactttaggatcaacctcccagacaaaaacgtccctcctccctcgatagagcctttgactcctccaccgcagtatgatgaagtccaggagaaggcccccgacacccggccgcccgactgaatggccccacttgagccacgctccctcctgtctctcacacctttcacccccaagactctaacaaagccacatgagccacagttgagaagcggaggggccagctgtgcatggagccatttggatggcggcgggcggggggggattctctgtatcaggagtgactttgttgccccacacagcctcctgctgcaggtgctttggaaagagatgctgccttggagctggtgaatctgtggaccacattcaagggtgtggcacaggcatcttcccatccttttcactccgaatcgctggcgacacattctcctttccagctaggaaagggttcctcgcggctggtttagattgtggttgtttgttttgcttctactaagactgttttgtttcaaaaaggaaacaagttttgtgtttgctgtctacgctggagtcctgaactgtgggtagaaaacacgacctggctttgtagaaaggacacagggctgttttatgaactaagcggtgaggctcaggtggcggctctcgcagagcccctgatgctgttgttctttgagggcttaaggcctgatgaacgtaggcacgtgatgcgtaatagtcttcaatggtacacttaactagtctcttctgtgtaacagcaaaaaaaaaaaaaaaagaagaagaaagaaaactgtaggaaatgttctttttgaaatgccatgcaatggagctttttgtaataaaatattttatatgtagta

SEQ ID NO: 440595 - DNA, 1038 bp, Homo sapiens
  misc_feature (1)..(1): n is a, c, g, or t
  misc_feature (36)..(36): n is a, c, g, or t
  misc_feature (38)..(38): n is a, c, g, or t
  misc_feature (40)..(40): n is a, c, g, or t
  misc_feature (54)..(54): n is a, c, g, or t
ngagagagagagagagagagagagagagagagaganananagagagagagaganccccacatccaccagggctgacgtggaggccagccctgggaacccccctgacaggcagaactctaagttggccaaacgactgaaaccgctgaaagttcgaaggattaaatctgaaaagcttcacctcaaagactttaggatcaacctcccagacaaaaacgtccctcctccctcgatagagcctttgactcctccaccgcagtatgatgaagtccaggagaaggcccccgacacccggccgcccgactgaatggccccacttgagccacgctccctcctgtctctcacacctttcacccccaagactctaacaaagccacatgagccacagttgagaagcggaggggccagctgtgcatggagccatttggatggcggcgggcggggggggattctctgtatcaggagtgactttgttgccccacacagcctcctgctgcaggtgctttggaaagagatgctgccttggagctggtgaatctgtggaccacattcaagggtgtggcacaggcatcttcccatccttttcactccgaatcgctggcgacacattctcctttccagctaggaaagggttcctcgcggctggtttagattgtggttgtttgttttgcttctactaagactgttttgtttcaaaaaggaaacaagttttgtgtttgctgtctacgctggagtcctgaactgtgggtagaaaacacgacctggctttgtagaaaggacacagggctgttttatgaactaagcggtgaggctcaggtggcggctctcgcagagcccctgatgctgttgttctttgagggcttaaggcctgatgaacgtaggcacgtgatgcgtaatagtcttcaatggtacacttaactagtctcttctgtgtaacagcaaaaaaaaaaaaaaaagaagaagaaagaaaactgtaggaaatgttctttttgaaatgccatgcaatggagctttttgtaataaaatattttatatgtagta

SEQ ID NO: 440596 - DNA, 3395 bp, Homo sapiens
  misc_feature (176)..(176): n is a, c, g, or t
  misc_feature (222)..(222): n is a, c, g, or t
ctcgctgctgccttgcagtttgatctcagactgctgtgctagcaatcagcgagactccatgggcgtaggaccctccgagccaggtgcgggatataatcttgtggcgcgccgttttttaagcctgttggaagagcgcagtattcgggtgggagtgacccgattttccaggtgcgtcngtcacccctttctttgactcagaaagggaactccctgaccccttgngcttcccaagtgaggcaatgcctcaccctgctttggcttgcgcacggtgcgcgcacccactgacctgcgcccattgtctggcactccctagtgagatgaacccggtacctcagatggaaatgcagaaatcacccgtcttctgcgtcgctcacgctgggagctgtgcaccggagctgttcctatttggccatcttggctcctctccccttgttcctgattttaatgggactaccttggttatttcacagcacacttacggtgctttgtgaagtgcctgctatgttactatcatcatcttcctgacaagatggtgctgtagaaatctttgcatattgctatgggcttccaagaaaaactacctcgaaggaaaacaaagacaagatgacgatcattctaatgagaagaattataatatgacatgcacactctttacaaagggtagaagtaagacatatcaagatttaaaacataaatagcttggaacaccctgaagagcaacatgggagaaactgagaaaagaattgaaacccatagaataagatgtctttccaagttgaagatgtttctgttggcaataacatgtgcatttgtatccaaaacactgtctggatcttatatgaattccatgctcacacaaatagagagacaattcaacatcccaacatctctagttggattcattaatggaagctttgagattggaaatcttttgttgattatatttgtgagttattttggaaccaaactgcatagacctataatgattggcattggatgtgtggttatgggcttaggctgtttcttaaaatcactacctcatttcctcatgaaccaatatgaatatgaatctacagtttcagtttcaggcaacttgtcctcaaacagtttcttgtgtatggaaaatggaacccagattttaagaccaacgcaggatccatcagagtgtacaaaggaagttaaatcattaatgtgggtgtacgtcctagtaggcaatattgtacgtggaatgggtgaaactcccatcctgcctttgggtatttcctatatagaagattttgccaaatttgaaaattctcctttatatattgggcttgtagaaacaggagctattattggtcctttgattggacttttgttggcatcattctgtgcaaatgtttatgttgacactggatttgtgaacacagatgatctgatcataactcccactgacactcgttgggtcggtgcatggtggtttggctttctgatttgtgcaggagttaacgtgctcactgccattccttttttctttttgcccaacacacttccaaaggaaggactagagactaatgctgacatcattaaaaatgaaaatgaagacaaacaaaaagaagaggtcaagaaggaaaaatatggaatcactaaagattttctacctttcatgaaaagtctttcctgcaatccaatttatatgcttttcatacttgtaagtgtgatacagttcaatgcattcgttaacatgatctccttcatgcctaaatacctagaacagcaatatggaatatcatcttcagatgcaatctttctaatgggtatttataacttacctccaatatgtattggatatataattggtggtttaattatgaagaagttcaagattactgtcaaacaagctgcccacataggatgttggttatccttacttgagtatcttctctattttttatcttttctcatgacttgtgaaaattcttcagttgttggaataaatacctcttatgaaggaattccacaagatttatatgtggaaaatgacatctttgctgattgcaatgtggattgcaactgtccatctaaaatatgggatcctgtgtgtggaaacaatggcttgtcatatctgtcagcttgtcttgctggttgtgagacatccattggaacgggaataaacatggtgttccaaaattgcagctgtattcaaacatcaggaaattcatctgcagttcttgggctgtgcgacaaaggacctgactgttccttgatgctccagtacttcctaatcttgtcagcgatgagcagtttcatttattctttggctgccatacctggatatatggttctcttgaggtgtatgaaatctgaagagaagtcccttggtgtgggattacatacattttgcacaagagtatttgctggcattcctgcacctatatattttggcgctttaatggattccacatgtttacactggggaactttgaaatgtggtgagtcaggggcatgcaggatatatgattccaccaccttcagatacatctacctcggattgccggcagcactaagaggatcaagctttgttccagccttaatcatcttaattcttttgaggaagtgtcatctacctggtgaaaatgcctcttcaggaacagagcttatagagacaaaagtcaaagggaaggaaaatgagtgcaaagatatataccaaaagtccacggttttgaaagatgatgaattgaaaactaaattgtaattgtcctattatattacttttttcagaattagagaacatgctgtacaacttaattgttttaaaaatcagtagagatataatagataactttttcttgtctttaagaacctaaaaaacctcttaactcaaaataataaaatgttcactaatgatatttctaaggtatcagtgacacttgagttttcctaggagggacatcaataacagccccctaaagaagattcttagagccagctttatttttatgttgaaacagcaatttcccttaattcatcgaagtaagggtgtacttcctacatctccttctactaatacttctaaaaattttctgttatgaaaacctatttaattccactaaatttgttctttgatattggaattattcagatgcctaaattctcattctgttatgtgaagatttaaatattttattcaagtttatcgcttccatgtgagagaagcctacatcttcttattctatttaggaatcgttctttaactcttcttattcattctaggcatgactcctatataatagattactcataaatataccctcctactttcaattttttcttttctttattactcatacatttgctcaatttgtacagaatactgacaaacttaagcaggttattaaacatcatgaggcaaagat

SEQ ID NO: 440597 - DNA, 2964 bp, Homo sapiens
ctgctttatgcaaccatcagagccaaagaaacttaaccaaaggtttaaaacttacataaacaaagattcttttatttacaactctgcttctctgatgaacaagaagctgcagcttacacgtttgaggtgccttattcatactggctactcaatatgtaattttttaaaaaatctgttggtcttacagtatggaagcaaaaatgaatggtgatgttggtgaatgctaagggtagaagtaagacatatcaagatttaaaacataaatagcttggaacaccctgaagagcaacatgggagaaactgagaaaagaattgaaacccatagaataagatgtctttccaagttgaagatgtttctgttggcaataacatgtgcatttgtatccaaaacactgtctggatcttatatgaattccatgctcacacaaatagagagacaattcaacatcccaacatctctagttggattcattaatggaagctttgagattggaaatcttttgttgattatatttgtgagttattttggaaccaaactgcatagacctataatgattggcattggatgtgtggttatgggcttaggctgtttcttaaaatcactacctcatttcctcatgaaccaatatgaatatgaatctacagtttcagtttcaggcaacttgtcctcaaacagtttcttgtgtatggaaaatggaacccagattttaagaccaacgcaggatccatcagagtgtacaaaggaagttaaatcattaatgtgggtgtacgtcctagtaggcaatattgtacgtggaatgggtgaaactcccatcctgcctttgggtatttcctatatagaagattttgccaaatttgaaaattctcctttatatattgggcttgtagaaacaggagctattattggtcctttgattggacttttgttggcatcattctgtgcaaatgtttatgttgacactggatttgtgaacacagatgatctgatcataactcccactgacactcgttgggtcggtgcatggtggtttggctttctgatttgtgcaggagttaacgtgctcactgccattccttttttctttttgcccaacacacttccaaaggaaggactagagactaatgctgacatcattaaaaatgaaaatgaagacaaacaaaaagaagaggtcaagaaggaaaaatatggaatcactaaagattttctacctttcatgaaaagtctttcctgcaatccaatttatatgcttttcatacttgtaagtgtgatacagttcaatgcattcgttaacatgatctccttcatgcctaaatacctagaacagcaatatggaatatcatcttcagatgcaatctttctaatgggtatttataacttacctccaatatgtattggatatataattggtggtttaattatgaagaagttcaagattactgtcaaacaagctgcccacataggatgttggttatccttacttgagtatcttctctattttttatcttttctcatgacttgtgaaaattcttcagttgttggaataaatacctcttatgaaggaattccacaagatttatatgtggaaaatgacatctttgctgattgcaatgtggattgcaactgtccatctaaaatatgggatcctgtgtgtggaaacaatggcttgtcatatctgtcagcttgtcttgctggttgtgagacatccattggaacgggaataaacatggtgttccaaaattgcagctgtattcaaacatcaggaaattcatctgcagttcttgggctgtgcgacaaaggacctgactgttccttgatgctccagtacttcctaatcttgtcagcgatgagcagtttcatttattctttggctgccatacctggatatatggttctcttgaggtgtatgaaatctgaagagaagtcccttggtgtgggattacatacattttgcacaagagtatttgctggcattcctgcacctatatattttggcgctttaatggattccacatgtttacactggggaactttgaaatgtggtgagtcaggggcatgcaggatatatgattccaccaccttcagatacatctacctcggattgccggcagcactaagaggatcaagctttgttccagccttaatcatcttaattcttttgaggaagtgtcatctacctggtgaaaatgcctcttcaggaacagagcttatagagacaaaagtcaaagggaaggaaaatgagtgcaaagatatataccaaaagtccacggttttgaaagatgatgaattgaaaactaaattgtaattgtcctattatattacttttttcagaattagagaacatgctgtacaacttaattgttttaaaaatcagtagagatataatagataactttttcttgtctttaagaacctaaaaaacctcttaactcaaaataataaaatgttcactaatgatatttctaaggtatcagtgacacttgagttttcctaggagggacatcaataacagccccctaaagaagattcttagagccagctttatttttatgttgaaacagcaatttcccttaattcatcgaagtaagggtgtacttcctacatctccttctactaatacttctaaaaattttctgttatgaaaacctatttaattccactaaatttgttctttgatattggaattattcagatgcctaaattctcattctgttatgtgaagatttaaatattttattcaagtttatcgcttccatgtgagagaagcctacatcttcttattctatttaggaatcgttctttaactcttcttattcattctaggcatgactcctatataatagattactcataaatataccctcctactttcaattttttcttttctttattactcatacatttgctcaatttgtacagaatactgacaaacttaagcaggttattaaacatcatgaggcaaagat

SEQ ID NO: 440598 - DNA, 1820 bp, Homo sapiens
acagtgcctggtaaacagctctcatataacaagaactgcttagcatgtgaatggcaattcaaggtgaacaaaggacatgttgtttggaaggctgatgctctggttaaagagtcaagagaatctttttcttttaaattatttattctttagagcaattgggtgaagtatgtttttatgagcaaatttacctttctctccaagttctcccaaatttggaaaccatgtttctgttggcaataacatgtgcatttgtatccaaaacactgtctggatcttatatgaattccatgctcacacaaatagagagacaattcaacatcccaacatctctagttggattcattaatggaagctttgagattggaaatcttttgttgattatatttgtgagttattttggaaccaaactgcatagacctataatgattggcattggatgtgtggttatgggcttaggctgtttcttaaaatcactacctcatttcctcatgaaccaatatgaatatgaatctacagtttcagtttcaggcaacttgtcctcaaacagtttcttgtgtatggaaaatggaacccagattttaagaccaacgcaggatccatcagagtgtacaaaggaagttaaatcattaatgtgggtgtacgtcctagtaggcaatattgtacgtggaatgggtgaaactcccatcctgcctttgggtatttcctatatagaagattttgccaaatttgaaaattctcctttatatattgggcttgtagaaacaggagctattattggtcctttgattggacttttgttggcatcattctgtgcaaatgtttatgttgacactggatttgtgaacacagatgatctgatcataactcccactgacactcgttgggtcggtgcatggtggtttggctttctgatttgtgcaggagttaacgtgctcactgccattccttttttctttttgcccaacacacttccaaaggaaggactagagactaatgctgacatcattaaaaatgaaaatgaagacaaacaaaaagaagaggtcaagaaggaaaaatatggaatcactaaagaatgaattgtgagcagtttattaagcaaaccaagattgtgcataagaaagtcaagacagagaacatgtggacaggaaaagtgaaaggaaattaaaaattttctacctttcatgaaaagtctttcctgcaatccaatttatatgcttttcatacttgtaagtgtgatacagttcaatgcattcgttaacatgatctccttcatgcctaaatacctagaacagcaatatggaatatcatcttcagatgcaatctttctaatgggtatttataacttacctccaatatgtattggatatataattggtggtttaattatgaagaagttcaagattactgtcaaacaagctgcccacataggatgttggttatccttacttgagtatcttctctattttttatcttttctcatgacttgtgaaaattcttcagttgttggaataaatacctcttatgaagggtatgttgttttctaatgaatgtgagaatctttcaacaaatggttaatatgatattttttacaatggcaatgcacgatcagatcattttcttattggagttaatgatagtaatccatgcttttcctgtatctttcctccatctgtcaatcaagccaatctatccaagctctaggcttattaatgaggttgggaacatatcacagggtgagtgaatttatgattgtatgtgcatgtgggtgtgtgtgcatgattgtctttgtgatatccgagtagacattatcctatgaaaga

SEQ ID NO: 440599 - DNA, 1503 bp, Homo sapiens
acagtgcctggtaaacagctctcatataacaagaactgcttagcatgtgaatggcaattcaaggtgaacaaaggacatgttgtttggaaggctgatgctctggttaaagagtcaagagaatctttttcttttaaattatttattctttagagcaattgggtgaagtatgtttttatgagcaaatttacctttctctccaagttctcccaaatttggaaaccatgtttctgttggcaataacatgtgcatttgtatccaaaacactgtctggatcttatatgaattccatgctcacacaaatagagagacaattcaacatcccaacatctctagttggattcattaatggaagctttgagattggaaatcttttgttgattatatttgtgagttattttggaaccaaactgcatagacctataatgattggcattggatgtgtggttatgggcttaggctgtttcttaaaatcactacctcatttcctcatgaaccaatatgaatatgaatctacagtttcagtttcaggcaacttgtcctcaaacagtttcttgtgtatggaaaatggaacccagattttaagaccaacgcaggatccatcagagtgtacaaaggaagttaaatcattaatgtgggtgtacgtcctagtaggcaatattgtacgtggaatgggtgaaactcccatcctgcctttgggtatttcctatatagaagattttgccaaatttgaaaattctcctttatatattgggcttgtagaaacaggagctattattggtcctttgattggacttttgttggcatcattctgtgcaaatgtttatgttgacactggatttgtgaacacagatgatctgatcataactcccactgacactcgttgggtcggtgcatggtggtttggctttctgatttgtgcaggagttaacgtgctcactgccattccttttttctttttgcccaacacacttccaaaggaaggactagagactaatgctgacatcattaaaaatgaaaatgaagacaaacaaaaagaagaggtcaagaaggaaaaatatggaatcactaaagaatgaattgtgagcagtttattaagcaaaccaagattgtgcataagaaagtcaagacagagaacatgtggacaggaaaagtgaaaggaaattaaaagtgagaacttgagcctgaatggtagcagtgtgaccaagaacatttactagaagcaggccacacattactagaggcaggccacacattactagaagcaggccaaacattactagaggcaggccacacatttggctctgtgctttttctaacaggaatcatttttgattaaatcatttacatagtccttagaatgtaccaaatgaatcagcatctctgaggatgggacctggatgttggtattttaaaaaatatctccaggtagatcttgctgagaaccaatggcagaaccactgaaactgttgttctgaagaagcaaaaaaaaattccggatacttg

SEQ ID NO: 440600 - DNA, 412 bp, Homo sapiens
ataaactttgccgtacaaataaagaaaattgaaatatttccaaataaatcaagtatcttaattcttgttgatagatttttctttccctgtcaattgtagctggcattcctgcacctatatattttggcgctttaatggattccacatgtttacactggggaactttgaaatgtggtgagtcaggggcatgcaggatatatgattccaccaccttcaggtaaagataataatttgtttaaaattgttttataagcatagactgtgcataacgcagcaccattcacacgtaactttttctttgtcaagtgaaaagaatacttttgtggttatttccagcagagatactgatgttatatctccattccttatttgcatactagaattgtattttcccattatttctcaagtgctt

SEQ ID NO: 440601 - DNA, 541 bp, Homo sapiens
agacaatattttggtcactttgtagttttgcttactgatctttaagactcaacagtgacttattgagggcaaaactgttgtgttctgatccctacccagtcagctacatcactgacttccagaagccaccaaaacattgctatgacttcagctttcaaggggaaaaaagaattagcaaacaatacatattacaaaatagtaaaaaacataatttgttgaggaggtggatgtttcaggaaaagccagtcacaaaatgcaaagccaagttcgtttgacacagttgtcattctttcatttcagattttctacctttcatgaaaagtctttcctgcaatccaatttatatgcttttcatacttgtaagtgtgatacagttcaatgcattcgttaacatgatctccttcatgcctaaatacctagaacagcaatatggaatatcatcttcagatgcaatctttctaatgggtatgtttgtttttctctgccttactagcacactttcccccccacgaacagtgtgatggcgggtgtagcaaactcc

SEQ ID NO: 440602 - DNA, 2487 bp, Homo sapiens
acagtgcctggtaaacagctctcatataacaagaactgcttagcatgtgaatggcaattcaaggtgaacaaaggacatgttgtttggaaggctgatgctctggttaaagagtcaagagaatctttttcttttaaattatttattctttagagcaattgggtgaagtatgtttttatgagcaaatttacctttctctccaagttctcccaaatttggaaaccctgagaaaccctgaaaatactctgtcctgggcttatatgccttagacacaactgggattgctgagctcaagggttgcagagcatcctactatgggaagaatgaggacataactcagattgttctggatatttccctcattgctgagaatgcagaatgtttctgaccaagaattgcaagcaagaacaggaaagagtggagtcggccaagatgtttctgttggcaataacatgtgcatttgtatccaaaacactgtctggatcttatatgaattccatgctcacacaaatagagagacaattcaacatcccaacatctctagttggattcattaatggaagctttgagattggaaatcttttgttgattatatttgtgagttattttggaaccaaactgcatagacctataatgattggcattggatgtgtggttatgggcttaggctgtttcttaaaatcactacctcatttcctcatgaaccaatatgaatatgaatctacagtttcagtttcaggcaacttgtcctcaaacagtttcttgtgtatggaaaatggaacccagattttaagaccaacgcaggatccatcagagtgtacaaaggaagttaaatcattaatgtgggtgtacgtcctagtaggcaatattgtacgtggaatgggtgaaactcccatcctgcctttgggtatttcctatatagaagattttgccaaatttgaaaattctcctttatatattgggcttgtagaaacaggagctattattggtcctttgattggacttttgttggcatcattctgtgcaaatgtttatgttgacactggatttgtgaacacagatgatctgatcataactcccactgacactcgttgggtcggtgcatggtggtttggctttctgatttgtgcaggagttaacgtgctcactgccattccttttttctttttgcccaacacacttccaaaggaaggactagagactaatgctgacatcattaaaaatgaaaatgaagacaaacaaaaagaagaggtcaagaaggaaaaatatggaatcactaaagattttctacctttcatgaaaagtctttcctgcaatccaatttatatgcttttcatacttgtaagtgtgatacagttcaatgcattcgttaacatgatctccttcatgcctaaatacctagaacagcaatatggaatatcatcttcagatgcaatctttctaatgggtatttataacttacctccaatatgtattggatatataattggtggtttaattatgaagaagttcaagattactgtcaaacaagctgcccacataggatgttggttatccttacttgagtatcttctctattttttatcttttctcatgacttgtgaaaattcttcagttgttggaataaatacctcttatgaaggaattccacaagatttatatgtggaaaatgacatctttgctgattgcaatgtggattgcaactgtccatctaaaatatgggatcctgtgtgtggaaacaatggcttgtcatatctgtcagcttgtcttgctggttgtgagacatccattggaacgggaataaacatggtgttccaaaattgcagctgtattcaaacatcaggaaattcatctgcagttcttgggctgtgcgacaaaggacctgactgttccttgatgctccagtacttcctaatcttgtcagcgatgagcagtttcatttattctttggctgccatacctggatatatggttctcttgaggtgtatgaaatctgaagagaagtcccttggtgtgggattacatacattttgcacaagagtatttggtaaaaatagttattttttcccacatcctatcagaacaatattattattattattttttattacactttaagttttagggtacatgtgcacaacgtgcaggtttgttacatatgtatacatgtgccatgttggtgtgctgcacccattaactcatcatttaacattaggtgaatctcctaatgctatccctccccccttcccccaccccacaacaggccctggtgtgtgatgttccccttcctgtgtccatgtgcagaacaatattaaatactagataaacaaggtaatattatttcagaaaagcagtctagcaaatgtcccttctgtatgtaaaaagcacgttataaatatgagaatgcagcacacaaagagatagagaatctcttttacttgaaaaggccctgtctgaccttaattacactattctttgtttgaagatttg

SEQ ID NO: 440603 - DNA, 2835 bp, Homo sapiens
acagtgcctggtaaacagctctcatataacaagaactgcttagcatgtgaatggcaattcaaggtgaacaaaggacatgttgtttggaaggctgatgctctggttaaagagtcaagagaatctttttcttttaaattatttattctttagagcaattgggtgaagtatgtttttatgagcaaatttacctttctctccaagttctcccaaatttggaaaccatgtttctgttggcaataacatgtgcatttgtatccaaaacactgtctggatcttatatgaattccatgctcacacaaatagagagacaattcaacatcccaacatctctagttggattcattaatggaagctttgagattggaaatcttttgttgattatatttgtgagttattttggaaccaaactgcatagacctataatgattggcattggatgtgtggttatgggcttaggctgtttcttaaaatcactacctcatttcctcatgaaccaatatgaatatgaatctacagtttcagtttcaggcaacttgtcctcaaacagtttcttgtgtatggaaaatggaacccagattttaagaccaacgcaggatccatcagagtgtacaaaggaagttaaatcattaatgtgggtgtacgtcctagtaggcaatattgtacgtggaatgggtgaaactcccatcctgcctttgggtatttcctatatagaagattttgccaaatttgaaaattctcctttatatattgggcttgtagaaacaggagctattattggtcctttgattggacttttgttggcatcattctgtgcaaatgtttatgttgacactggatttgtgaacacagatgatctgatcataactcccactgacactcgttgggtcggtgcatggtggtttggctttctgatttgtgcaggagttaacgtgctcactgccattccttttttctttttgcccaacacacttccaaaggaaggactagagactaatgctgacatcattaaaaatgaaaatgaagacaaacaaaaagaagaggtcaagaaggaaaaatatggaatcactaaagattttctacctttcatgaaaagtctttcctgcaatccaatttatatgcttttcatacttgtaagtgtgatacagttcaatgcattcgttaacatgatctccttcatgcctaaatacctagaacagcaatatggaatatcatcttcagatgcaatctttctaatgggtatttataacttacctccaatatgtattggatatataattggtggtttaattatgaagaagttcaagattactgtcaaacaagctgcccacataggatgttggttatccttacttgagtatcttctctattttttatcttttctcatgacttgtgaaaattcttcagttgttggaataaatacctcttatgaaggaattccacaagatttatatgtggaaaatgacatctttgctgattgcaatgtggattgcaactgtccatctaaaatatgggatcctgtgtgtggaaacaatggcttgtcatatctgtcagcttgtcttgctggttgtgagacatccattggaacgggaataaacatggtgttccaaaattgcagctgtattcaaacatcaggaaattcatctgcagttcttgggctgtgcgacaaaggacctgactgttccttgatgctccagtacttcctaatcttgtcagcgatgagcagtttcatttattctttggctgccatacctggatatatggttctcttgaggtgtatgaaatctgaagagaagtcccttggtgtgggattacatacattttgcacaagagtatttgctggcattcctgcacctatatattttggcgctttaatggattccacatgtttacactggggaactttgaaatgtggtgagtcaggggcatgcaggatatatgattccaccaccttcagatacatctacctcggattgccggcagcactaagaggatcaagctttgttccagccttaatcatcttaattcttttgaggaagtgtcatctacctggtgaaaatgcctcttcaggaacagagcttatagagacaaaagtcaaagggaaggaaaatgagtgcaaagatatataccaaaagtccacggttttgaaagatgatgaattgaaaactaaattgtaattgtcctattatattacttttttcagaattagagaacatgctgtacaacttaattgttttaaaaatcagtagagatataatagataactttttcttgtctttaagaacctaaaaaacctcttaactcaaaataataaaatgttcactaatgatatttctaaggtatcagtgacacttgagttttcctaggagggacatcaataacagccccctaaagaagattcttagagccagctttatttttatgttgaaacagcaatttcccttaattcatcgaagtaagggtgtacttcctacatctccttctactaatacttctaaaaattttctgttatgaaaacctatttaattccactaaatttgttctttgatattggaattattcagatgcctaaattctcattctgttatgtgaagatttaaatattttattcaagtttatcgcttccatgtgagagaagcctacatcttcttattctatttaggaatcgttctttaactcttcttattcattctaggcatgactcctatataatagattactcataaatataccctcctactttcaattttttcttttctttattactcatacatttgctcaatttgtacagaatactgacaaacttaagcaggttattaaacatcatgaggcaaagat

SEQ ID NO: 440604 - DNA, 1255 bp, Homo sapiens
acagtgcctggtaaacagctctcatataacaagaactgcttagcatgtgaatggcaattcaaggtgaacaaaggacatgttgtttggaaggctgatgctctggttaaagagtcaagagaatctttttcttttaaattatttattctttagagcaattgggtgaagtatgtttttatgagcaaatttacctttctctccaagttctcccaaatttggaaaccatgtttctgttggcaataacatgtgcatttgtatccaaaacactgtctggatcttatatgaattccatgctcacacaaatagagagacaattcaacatcccaacatctctagttggattcattaatggaagctttgagattggaaatcttttgttgattatatttgtgagttattttggaaccaaactgcatagacctataatgattggcattggatgtgtggttatgggcttaggctgtttcttaaaatcactacctcatttcctcatgaaccaatatgaatatgaatctacagtttcagtttcaggcaacttgtcctcaaacagtttcttgtgtatggaaaatggaacccagattttaagaccaacgcaggatccatcagagtgtacaaaggaagttaaatcattaatgtgggtgtacgtcctagtaggcaatattgtacgtggaatgggtgaaactcccatcctgcctttgggtatttcctatatagaagattttgccaaatttgaaaattctcctttatatattgggcttgtagaaacaggagctattattggtcctttgattggacttttgttggcatcattctgtgcaaatgtttatgttgacactggatttgtgaacacagatgatctgatcataactcccactgacactcgttgggtcggtgcatggtggtttggctttctgatttgtgcaggagttaacgtgctcactgccattccttttttctttttgcccaacacacttccaaaggaaggactagagactaatgctgacatcattaaaaatgaaaatgaagacaaacaaaaagaagaggtcaagaaggaaaaatatggaatcactaaaggcaaatatacatattctaaatactatgaaattgaccttttatttcatatagatatgtctgtattttagtctaacactatgatatgctatgctgtgttgagacaatttgtcatcaacagtcaccagtcaagaatacctaactagtccgattcttcctatggtactacttgaaaataaatattata

SEQ ID NO: 440605 - DNA, 516 bp, Homo sapiens
cccaaagtgctgggattacaggcatgagccactgcacccagcctactttgttattattatagatgtaagatacaatgaatttctctgagtttctctttaaagatttagcctgctaacttccttgacctttgttttcaaacctcaacttttctgttcctccttgcccctagttattgtaaaatagcctacccccttcccatcagttctaatcaatacctcacatctgttgccttggttacctgcacccattgttcccctcaaactgcatgtctcacacacttcaccactgtacctcacgtccccttcccctccatatttagaaaaatatttccaagtagccagtcaggtcagctcagattgcgcagtctgaccccagctcatgcgggagggacacagaggtagggattgcattaaggatataaaaactgcctggtctcctttgttctttgtgctcttgcaatcttgattgactcaagtggcacccttctgcagaagtaaattgccttgctgagaaaa

SEQ ID NO: 440606 - DNA, 1400 bp, Homo sapiens
gtggcttgtggaaaaagaacttatggtcagtgttcttgggcccttgtcaattgacccaaatatgctaaacacacaaaggcagcaggtgcagattttgctgcaagaattcgccactcggaaacctcaatatgaacagctgacagcagctggtcagggcattctgagcaggcctggagaagacccttctttacgtgggattgtgaaagagcaactggcagctgtgacccaaaaatgggatagcctaacagggcaattgagtgacagatgtgactggattgaccaagccattgttaaaagcacacagtatcaaagcctgctgagaagcctttctgataaactgagtgacttggataataaactcagcagcagtctggctgtgagcacgcaccctgatgctatgaaccaacagttggaaacagcccaaaaaatgaagcaggagatacagcaggaaaagaagcagataaaagtggcccaggcactctgtgaggatttgtcagcactggttaaagaagagtacttgaaagcagaacttagtaggcaactagaaggcatcttaaaatcatttaaggatgttgaacagaaagcagagaatcatgtccagcaccttcagtcggcctgtgcaagctctcatcaatttcagcaaatgtctagagattttcaggcttggctggatacaaagaaagaagagcaaaacaaatctcatccaatatctgccaaactcgatgtcttggagtcattaattaaagatcataaagactttagtaaaactttgaccgctcagtctcatatgtatgaaaaaaccattgcagaaggtgaaaatctgttattaaaaacacaagggtctgagaaggcagccttacagttacagcttaatacaattaaaaccaattgggatacatttaataagcaggtgaaagaaagagaaaacaagttaaaagagtcattggaaaaagcccttaagtataaagagcaagtagagactctctggccatggatagacaaatgccaaaacaacctggaggaaataaaattttgcttggatcctgctgaaggagagaattctattgccaagttaaagtctctgcagaaggaaatggaccaacactttggtatggtagaattactgaacaacacagccaatagcttgctcagtgtctgtgagatagataaagaagttgttacagatgagaataagtcactgatccagaaggtggacatggtcactgaacaacttcacagtaagaaattctgtctggagaacatgactcagaagtttaaagaatttcaagaagtttccaaagaatctaaaaggcagcttcagtgtgcaaaggagcagctagatatccatgattcgctgggatcccaggcttacagtaacaaatacctgaccatgttgcaaa

SEQ ID NO: 440607 - DNA, 1138 bp, Homo sapiens
gtggcttgtggaaaaagaacttatggtcagtgttcttgggcccttgtcaattgacccaaatatgctaaacacacaaaggcagcaggtgcagattttgctgcaagaattcgccactcggaaacctcaatatgaacagctgacagcagctggtcagggcattctgagcaggcctggagaagacccttctttacgtgggattgtgaaagagcaactggcagctgtgacccaaaaatgggatagcctaacagggcaattgagtgacagatgtgactggattgaccaagccattgttaaaagcacacagtatcaaagcctgctgagaagcctttctgataaactgagtgacttggataataaactcagcagcagtctggctgtgagcacgcaccctgatgctatgaaccaacagttggaaacagcccaaaaaatgaagcaggagatacagcaggaaaagaagcagataaaagtggcccaggcactctgtgaggatttgtcagcactggttaaagaagagtacttgaaagcagaacttagtaggcaactagaaggcatcttaaaatcatttaaggatgttgaacagaaagcagagaatcatgtccagcaccttcagtcggcctgtgcaagctctcatcaatttcagcaaatgtctagagattttcaggcttggctggatacaaagaaagaagagcaaaacaaatctcatccaatatctgccaaactcgatgtcttggagtcattaattaaagatcataaagactttagtaaaactttgaccgctcagtctcatatgtatgaaaaaaccattgcagaaggtgaaaatctgttattaaaaacacaagggtctgagaaggcagccttacagttacagcttaatacaattaaaaccaattgggatacatttaataagcaggtgaaagaaagagaaaacaagttaaaagagtcattggaaaaagccctagggtttgcctatggaagtgaggtggaaaggttgcaacttgccagctactgtgaagtggcaggagctggttatctggaatcctaggggaaagtcgtagcaccagttgaggatgcgtgctcatgacacacatcaccatgtggacaacgtgcatgtagcagatcaatggctatctgctgtcct

SEQ ID NO: 440608 - DNA, 2112 bp, Homo sapiens
cattccctaggaagtgctttgaagaaaaacttgaggtatatgaaatggttaaaaatcagaaactaaaccttttaacatggacatcaaagctttgccataagcaattcagcatattcctagaaatgtttctaatccataacctgagagaatgttgatctccatagtgtgaaaatgacttgggccagtttaacttgctcttttttttattttttcactaattcccttttgtttttctctgataattcttctctttcctgagcctctttagagcagcacttacaggattgcctctgtaaagccttattcctgtcccagaaaaggtaacccaaaaagtctctagtatccactaaaaggtaacccaaaaatctctagtatccactggctttctccagtgtggaagctttcccctccacctcccatagatcactggaaaggacccgaggcctcggttctaatccctggcttatcactaactgctgtgtggctttggcttgtcccttagtctctgtgagactgctgcaccctcatctgtcaaagatggaactgaacttagttgagctctgaggtccctgtggacttggcccctccacaccctcattatggcaactggacataaacttaacagaggacttcccagcaaaatgtcctcttcttcctacaaacaggctgtttctatatgtgcatgtttcatgctaagcacttctttcttgggtggagatggcaaaggcctctttctgctgagacaaagtgatttggagagtcacctggcccctgaagggggagtggtaggatccagccacccagtgtgcagtgaattggagcagggatctcagcacacagggaggtggggaggctccccctaacctcgggcacctgttgctcctccagactgcagcgcatgctcttagctcatcctcttaactggctctcaccgtgctcctggctttggtcaccacgtagctctcactccagcttcaggtagccatcagtaggacctggcaatatacactgatttggtttgttttatgtttgtctgcaggtgaaatccctaagggctctgccgtgtactccagccttgtgacccttgccttccaggaaccatgcaagaagcgcagccaccagaagtccttaaaacagcaggaaaggtgagcctgtcccccttttgtgcagctacctatctgctgaggagcatctgggcctcattcctccaagtccactggagggtccagaagagggagtcagagatgtatcctggtggagctgggagaaaggcagaaagcctttgtgacagctatggaataccgttagccaaggtccacttggcccagcactaagcaaaagatgcgtagtttgcacagaaggttttgtgatactgcctctcaacagccccagcagcttgggaactagcaagagcacatttcttgcctcatcagctgtcctgagatggaaaactcagtggatataggaccctgattccgatgaaaggggcacgtggtcccaatgctggagctcctctggcaggttctaaaagcacactacggagcagcggtgccctgccggacactgctggcgggggctcagtgagcactactcacagatccacacctgaccctgttgggtcgagtcaggctgggctttggtctgcactgtagcacctgtgttctttgagttcacatcatgaatgtggtgatttcccagataccatctcaggcttaacctagcacatcctatttcttttcttctatgatatccaaattggactgacctcacttcaaagttgctgtcccattttgtcaccctatcttatctcggggaaattgcagactgatggccagaccaactctgttgaaattcttgcatagagcaaacctgtgctcatttttaagtggcatgggagaggccccaagcctagtaaagcctagtctgtgtcttcacagtgctggtagaatgtgtttgtgtgtataaatatatgatatagatttatatatgttgctaacgccacatattgaaggccaacataactggtggacagggtgggtgacagaaaatgaaagtctttttggtgattgtttaagcaagatgtgtataaagaaataaatagtttttctttca

SEQ ID NO: 440609 - DNA, 2058 bp, Homo sapiens
cattccctaggaagtgctttgaagaaaaacttgaggtatatgaaatggttaaaaatcagaaactaaaccttttaacatggacatcaaagctttgccataagcaattcagcatattcctagaaatgtttctaatccataacctgagagaatgttgatctccatagtgtgaaaatgacttgggccagtttaacttgctcttttttttattttttcactaattcccttttgtttttctctgataattcttctctttcctgagcctctttagagcagcacttacaggattgcctctgtaaagccttattcctgtcccagaaaaggtaacccaaaaagtctctagtatccactaaaaggtaacccaaaaatctctagtatccactggctttctccagtgtggaagctttcccctccacctcccatagatcactggaaaggacccgaggcctcggttctaatccctggcttatcactaactgctgtgtggctttggcttgtcccttagtctctgtgagactgctgcaccctcatctgtcaaagatggaactgaacttagttgagctctgaggtccctgtggacttggcccctccacaccctcattatggcaactggacataaacttaacagaggacttcccagcaaaatgtcctcttcttcctacaaacaggctgtttctatatgtgcatgtttcatgctaagcacttctttcttgggtggagatggcaaaggcctctttctgctgagacaaagtgatttggagagtcacctggcccctgaagggggagtggtaggatccagccacccagtgtgcagtgaattggagcagggatctcagcacacagggaggtggggaggctccccctaacctcgggcacctgttgctcctccagactgcagcgcatgctcttagctcatcctcttaactggctctcaccgtgctcctggctttggtcaccacgtagctctcactccagcttcaggtagccatcagtaggacctggcaatatacactgatttggtttgttttatgtttgtctgcaggtgaaatccctaagggctctgccgtgtactccagccttgtgacccttgccttccaggaaccatgcaagaagcgcagccaccagaagtccttaaaacagcaggaaaggtgagcctgtcccccttttgtgcagctacctatctgctgaggagcatctgggcctcattcctccaagtccactggagggtccagaagagggagtcagagatgtatcctggtggagctgggagaaaggcagaaagcctttgtgacagctatggaataccgttagccaaggtccacttggcccagcactaagcaaaagatgcgtagtttgcacagaaggttttgtgatactgcctctcaacagccccagcagcttgggaactagcaagagcacatttcttgcctcatcagctgtcctgagatggaaaactcagtggatataggaccctgattccgatgaaaggggcacgtggtcccaatgctggagctcctctggcaggttctatgagcactactcacagatccacacctgaccctgttgggtcgagtcaggctgggctttggtctgcactgtagcacctgtgttctttgagttcacatcatgaatgtggtgatttcccagataccatctcaggcttaacctagcacatcctatttcttttcttctatgatatccaaattggactgacctcacttcaaagttgctgtcccattttgtcaccctatcttatctcggggaaattgcagactgatggccagaccaactctgttgaaattcttgcatagagcaaacctgtgctcatttttaagtggcatgggagaggccccaagcctagtaaagcctagtctgtgtcttcacagtgctggtagaatgtgtttgtgtgtataaatatatgatatagatttatatatgttgctaacgccacatattgaaggccaacataactggtggacagggtgggtgacagaaaatgaaagtctttttggtgattgtttaagcaagatgtgtataaagaaataaatagtttttctttca

SEQ ID NO: 440610 - DNA, 1393 bp, Homo sapiens
cattccctaggaagtgctttgaagaaaaacttgaggtatatgaaatggttaaaaatcagaaactaaaccttttaacatggacatcaaagctttgccataagcaattcagcatattcctagaaatgtttctaatccataacctgagagaatgttgatctccatagtgtgaaaatgacttgggccagtttaacttgctcttttttttattttttcactaattcccttttgtttttctctgataattcttctctttcctgagcctctttagagcagcacttacaggattgcctctgtaaagccttattcctgtcccagaaaaggtgaaatccctaagggctctgccgtgtactccagccttgtgacccttgccttccaggaaccatgcaagaagcgcagccaccagaagtccttaaaacagcaggaaaggtgagcctgtcccccttttgtgcagctacctatctgctgaggagcatctgggcctcattcctccaagtccactggagggtccagaagagggagtcagagatgtatcctggtggagctgggagaaaggcagaaagcctttgtgacagctatggaataccgttagccaaggtccacttggcccagcactaagcaaaagatgcgtagtttgcacagaaggttttgtgatactgcctctcaacagccccagcagcttgggaactagcaagagcacatttcttgcctcatcagctgtcctgagatggaaaactcagtggatataggaccctgattccgatgaaaggggcacgtggtcccaatgctggagctcctctggcaggttctaaaagcacactacggagcagcggtgccctgccggacactgctggcgggggctcagtgagcactactcacagatccacacctgaccctgttgggtcgagtcaggctgggctttggtctgcactgtagcacctgtgttctttgagttcacatcatgaatgtggtgatttcccagataccatctcaggcttaacctagcacatcctatttcttttcttctatgatatccaaattggactgacctcacttcaaagttgctgtcccattttgtcaccctatcttatctcggggaaattgcagactgatggccagaccaactctgttgaaattcttgcatagagcaaacctgtgctcatttttaagtggcatgggagaggccccaagcctagtaaagcctagtctgtgtcttcacagtgctggtagaatgtgtttgtgtgtataaatatatgatatagatttatatatgttgctaacgccacatattgaaggccaacataactggtggacagggtgggtgacagaaaatgaaagtctttttggtgattgtttaagcaagatgtgtataaagaaataaatagtttttctttca

SEQ ID NO: 440611 - DNA, 1794 bp, Homo sapiens
cattccctaggaagtgctttgaagaaaaacttgaggtatatgaaatggttaaaaatcagaaactaaaccttttaacatggacatcaaagctttgccataagcaattcagcatattcctagaaatgtttctaatccataacctgagagaatgttgatctccatagtgtgaaaatgacttgggccagtttaacttgctcttttttttattttttcactaattcccttttgtttttctctgataattcttctctttcctgagcctctttagagcagcacttacaggattgcctctgtaaagccttattcctgtcccagaaaaggtaacccaaaaagtctctagtatccactaaaaggtaacccaaaaatctctagtatccactggctttctccagtgtggaagctttcccctccacctcccatagatcactggaaaggacccgaggcctcggttctaatccctggcttatcactaactgctgtgtggctttggcttgtcccttagtctctgtgagactgctgcaccctcatctgtcaaagatggaactgaacttagttgagctctgaggtccctgtggacttggcccctccacaccctcattatggcaactggacataaacttaacagaggacttcccagcaaaatgtcctcttcttcctacaaacaggctgtttctatatgtgcatgtttcatgctaagcacttctttcttgggtggagatggcaaaggcctctttctgctgagacaaagtgatttggagagtcacctggcccctgaagggggagtggtaggatccagccacccagtgtgcagtgaattggagcagggatctcagcacacagggaggtggggaggctccccctaacctcgggcacctgttgctcctccagactgcagcgcatgctcttagctcatcctcttaactggctctcaccgtgctcctggctttggtcaccacgtagctctcactccagcttcaggtagccatcagtaggacctggcaatatacactgatttggtttgttttatgtttgtctgcaggtgaaatccctaagggctctgccgtgtactccagccttgtgacccttgccttccaggaaccatgcaagaagcgcagccaccagaagtccttaaaacagcaggaaagaactacaagtttataggacatggatttcagtgccctcatctggccaagcatcttcagctgccaatgcccaagtgtcttcctggtagtacacatgaagatgtcccgctctcccctgctcaaggagagagtgcctgacctgagctgggcccatcagatccagtacttacctggaataggaaaacgatggggagggtgaccaaagattgcaaaaatctttgaagcttatctacttgagagagagtccctgaagatactggcctctcattcctgctatgtatatccaatgtgactgaactctgaataaaatatacaagttataacaatgtagcaattgacccagcaaatgaggacacaaacgtgttggagggtgtctacagagaaatagacaagcgatgcacgacagatacatgtgtcagtctggtccctgcagttgtatttgtaataatacacattggagcaatttcatggccatcagttagagaatgtttgaggaatgatccattcatatcaagaaggacatttcaaagatcaaagcctgatggaaatgctggagaccatggcgctgataggagctcatgcgtgttgaccaattactacatgacaggcattggctccaggcttttcctgcactgctcatttaaacactgga

SEQ ID NO: 440612 - DNA, 1114 bp, Homo sapiens
ggagaatcaacagaaagggaacttctggaactgagaaccaaagtatccaaacaggagcagctccttcagagcacaactgagcatctgaagaacgccaaccagcagaaggagagcatggaacagttcattgtcagccagctaaccagaacacatgatgttttaaagaaggcaaggactaacttagaggtgaaatccctaagggctctgccgtgtactccagccttgtgacccttgccttccaggaaccatgcaagaagcgcagccaccagaagtccttaaaacagcaggaaagtggcggagcgagggctactgcacagctagcagagtcgtggcgaggaggacagcacctgcatcgagctctccgcctcccccacccgccagcccaggcggccccagcagcagcgaccagaggagcccctgcagcaacgcaacggccaggtggacacctccatctacagcctcgtggcggacgggacctgttaggacactgccattgtgggcaacaaggacccgccttccatctgggccgccgtcccagggaaaaccttcctcaacgtcacgccagctgaggttggtgtcctggttggcaaagactggtcaagctttgtcatgaatgggctgacactggggggccagaaatatactgtggtcctggactcactgctgcaggatggggaattgaccacggatcttcgtatgaagagcatcggtggagcccccaccttcaacgtcattgtcaccatgactgccaagacgctaggcctgctgatgggcaaagaaggtatccatggcaatttcatcgacaagtaatgttatgaaatggcctcccaccttcagcgttcccagtactgacctcctttgttccttccactccaccgctccccacagctttgcccgcctttccttcacatacacacaccattttaatttcaggagtcattactccacacaccttattgctgccaaaaccacatgggctgggggccagggatagatggacagacaccttcccccacccatacccctcctgtgtgtggctggaaaacttttttgttttgatggattttttatgaataaaaaagtttctactaaaaaaaatcaataactgtacata

SEQ ID NO: 440613 - DNA, 1259 bp, Homo sapiens
ggagaatcaacagaaagggaacttctggaactgagaaccaaagtatccaaacaggagcagctccttcagagcacaactgagcatctgaagaacgccaaccagcagaaggagagcatggaacagttcattgtcagccagctaaccagaacacatgatgttttaaagaaggcaaggactaacttagaggtgaaatccctaagggctctgccgtgtactccagccttgtgacccttgccttccaggaaccatgcaagaagcgcagccaccagaagtccttaaaacagcaggaaaggtgagcctgtcccccttttgtgcagctacctatctgctgaggagcatctgggcctcattcctccaagtccactggagggtccagaagagggagtcagagatgtatcctggtggagctgggagaaaggcagaaagcctttgtgacagctatggaataccgttagccaaggtccacttggcccagcactaagcaaaagatgcgtagtttgcacagaaggttttgtgatactgcctctcaacagccccagcagcttgggaactagcaagagcacatttcttgcctcatcagctgtcctgagatggaaaactcagtggatataggaccctgattccgatgaaaggggcacgtggtcccaatgctggagctcctctggcaggttctaaaagcacactacggagcagcggtgccctgccggacactgctggcgggggctcagtgagcactactcacagatccacacctgaccctgttgggtcgagtcaggctgggctttggtctgcactgtagcacctgtgttctttgagttcacatcatgaatgtggtgatttcccagataccatctcaggcttaacctagcacatcctatttcttttcttctatgatatccaaattggactgacctcacttcaaagttgctgtcccattttgtcaccctatcttatctcggggaaattgcagactgatggccagaccaactctgttgaaattcttgcatagagcaaacctgtgctcatttttaagtggcatgggagaggccccaagcctagtaaagcctagtctgtgtcttcacagtgctggtagaatgtgtttgtgtgtataaatatatgatatagatttatatatgttgctaacgccacatattgaaggccaacataactggtggacagggtgggtgacagaaaatgaaagtctttttggtgattgtttaagcaagatgtgtataaagaaataaatagtttttctttca

SEQ ID NO: 440614 - DNA, 521 bp, Homo sapiens
ggagaatcaacagaaagggaacttctggaactgagaaccaaagtatccaaacaggagcagctccttcagagcacaactgagcatctgaagaacgccaaccagcagaaggagagcatggaacagttcattgtcagccagctaaccagaacacatgatgttttaaagaaggcaaggactaacttagaggtgaaatccctaagggctctgccgtgtactccagccttgtgacccttgccttccaggaaccatgcaagaagcgcagccaccagaagtccttaaaacagcaggaaagaactacaagtttataggacatggatttcagtgccctcatctggccaagcatcttcagctgccaatgcccaaggtaacctctctccctactaagacctgactcaggacctttccttaaggagatgtcctgttctttctttcccaccagaaccgccctggcccagaccccatttctgtctggtgaccaggacagtcccctcaccagtctcccaggttggggagggcagatc

SEQ ID NO: 440615 - DNA, 4198 bp, Homo sapiens
tttaaactgtgctttctaagcacagtcaggtagcaaaagtaataaaaaggatggttgaacaagttttcttgtatgttccaggatatgtttgggacttttctttgtttattatatgagttgttccctttgaaattaaagctattttgtaggttttgtgggacataatttgataagtagagttaattaaatttcttctggaagagatctaaattcttattcttagtgagagactgtagttaaaaggaaggcttttagaacttgggttcaaggaagatggagatgcgtcggaagctctttggcgggggtgaggaagttcagaaagtgtgcattttccttctggcatttaggtcttgtccgtgtgatttggtggtgcttgggtcataagcctgattaaaattcagggacatgtaccacggcggccaaagcggaattaatttttttatatggggactggagcgctgaaaagttgttcctgaccaggctctaatgagaaattcctctctccccaggttatgaagacagtatggagtttccagaccatagtagacatttgctacagtgtctgagcgagcagagacaccagggttttctttgtgactgcactgttctggtgggagatgcccagttccgagcgcaccgagctgtactggcttcatgcagcatgtatttccacctcttttacaaggaccagctggacaaaagagacattgttcatctgaacagcgacattgttacagcccccgctttcgctctcctgcttgaattcatgtatgaagggaaactccagttcaaagacttgcccattgaagacgtgctagcagctgccagttatctccacatgtatgacattgtcaaagtctgcaaaaagaagctgaaagagaaagccaccacggaggcagacagcaccaaaaaggaagaagatgcttcaagttgttcggacaaagtcgagagtctctccgatggcagcagccacatagcaggcgatttgcccagtgatgaagatgaaggagaagatgaaaaattgaacatcctgcccagcaaaagggacttggcggccgagcctgggaacatgtggatgcgattgccctcagactcagcaggcatcccccaggctggcggagaggcagagccacacgccacagcagctggaaaaacagtagccagcccctgcagctcaacagagtctttgtcccagaggtctgtcacctccgtgagggattcggcagatgttgactgtgtgctggacctgtctgtcaagtccagcctttcaggagttgaaaatctgaacagctcttatttctcttcacaggacgtgctgagaagcaacctggtgcaggtgaaggtggagaaagaggcttcctgtgatgagagtgatgttggcactaatgactatgacatggaacatagcactgtgaaagaaagtgtgagcactaataacagggtacagtatgagccggcccatctggctcccctgagggaggactcggtcttgagggagctggaccgggaggacaaagccagtgatgatgagatgatgaccccagagagcgagcgtgtccaggtggagggaggcatggagagcagtctgctcccctacgtctccaacatcctgagccccgcgggccagatcttcatgtgccccctgtgcaacaaggtcttccccagcccccacatcctgcagatccacctgagcacgcacttccgcgagcaggacggcatccgcagcaagcccgccgccgatgtcaacgtgcccacgtgctcgctgtgtgggaagactttctcttgcatgtacaccctcaagcgccacgagaggactcactcgggggagaagccctacacatgcacccagtgcggcaagagcttccagtactcgcacaacctgagccgccatgccgtggtgcacacccgcgagaagccgcacgcctgcaagtggtgcgagcgcaggttcacgcagtccggggacctgtacagacacattcgcaagttccactgtgagttggtgaactccttgtcggtcaaaagcgaagcactgagcttgcctactgtcagagactggaccttagaagatagctctcaagaactttggaaataattttatatatatataaataatatatatatatatacatatatataaatagatctctatatagttgtggtacggtctaaaagcagtcttgtttcctggaaataaaaagttgggatattaacttgtttttgcactttagaatagcatgagaatctcactaatttagcattctgataaaagaaactttagagcaagtcagaatagagaggtgtttttcctttgaggggataggggaagtaagccaataagaaccttttaaacaaatcgtcctgtcacaaaatgctttcatatggcttaattttgtcaacactgcattgtcttttgagctcttttttcccccccaacaaagtttttttgttttttgtttttttttttaagtagaaattccctccagttttattagcctctttatatgtctcaaattgcatgaattttttctggctgttggaaacctgaatgcttttagacccaaatggaaaatttctgaaatgctggattatctatttttaaacaagcagttgacttaaaactttctgtggcaacttctggttttctgacagttcccagtgagagaaatgctgaaagtacactgggatcactgggacactgtcttatgaaggtttgcttgggatgaaaaaggatattgcagcttcagcagtgttgaactgtgtgtttaaaaatgtgaattactgttattgtatactgtaattgattacatgggctgggggggtgtcaaagaacttgacaggttgtgttgatgctcttagttgagtcttgaaaagtaaatattaacgctacagaaatgcatgagtttcaatatattttttgtctttgtttgcattgtataactttaacgagtgagtttaaaattatttaatttccttagaaaaatagcaccatttggaaaaaaaaactggtgttatgaagaacgtaaatgcactgtttttatttttattttatataatttaaattgactttcccactgtctttaagttgaaactgttaagctgaataaaaacttaagctgcaaattgataacttcgctacataacaaggaaaatataaatgtttacaaacagcttaaagatttgcatgtgcagtgtgcatttataacaaacttctaattgcacaaaacccatgccagctcagagtttaggtgtacacatttacccagttgagcgttcttagaataactactgcacaagttgacaataggtcgttctctctttttttttgtttgctccctttttctttttctccccttcctccttaccctccctcccttactctccccccccaccaccaccctccacccccaactcatgaaaagattctatggactgaaaaagccccaggctgaaaggactggactgccttgattgacatggggaagggggttagtagactatgtggattgcggcagcagaggctgcagcctaacgtgtggttttaatgaccagcacgcaaggcaaaagcattttgcacagtgtttgttttcctgtcttgcacttacaaataaggtctatgggagtagcatggaaaacgtttgctgtttttcccttttttttttaattgcttttgtttaaaatttgatcgccttaactactgtaaacatagcctatttttgtgcttaagatactgaatggaaaactccattgtgtgttgctggactgttttggaaatatttggttaaatgtgtgttaatttggctgtaatggcatttaaagcaaacaaacaaacaaaaaaagctgtgaaaatggccttggagcattatctttagttacttgaagagtttctagtttttttaaaatacagtttatgttaaaataatttttattaatttagagaagacaatcaatgtctgtgagaaaacggactttcttttggattttctttttgtggtcattgtgagtgattgctttttccttttcttagtttcacattcttcctttgttctaaaacttagactgacatctagctttgacaatcatagtatgttttattttcctgagggggaataacttataatgctgtttagttttgtactattggtgtgttggtgaatttttaaactgtgtgctaactgcaataaattatatgaactgagaa

SEQ ID NO: 440616 - DNA, 260 bp, Homo sapiens
ggatccaacggatccaacgttggatccggttggatccggttgatccgatgtggtcattgtgagtgattgctttttccttttcttagtttcacattcttcctttgttctaaaacttagactgacatctagctttgacaatcatagtatgttttattttcctgagggggaataacttataatgctgtttagttttgtactattggtgtgttggtgaatttttaaactgtgtgctaactgcaataaattatatgaactgagaa

SEQ ID NO: 440617 - DNA, 3632 bp, Homo sapiens
gaggaggcggaggacgcggcggcggcggggacgcggtgacttagggccgctccgtgttatgaagacagtatggagtttccagaccatagtagacatttgctacagtgtctgagcgagcagagacaccagggttttctttgtgactgcactgttctggtgggagatgcccagttccgagcgcaccgagctgtactggcttcatgcagcatgtatttccacctcttttacaaggaccagctggacaaaagagacattgttcatctgaacagcgacattgttacagcccccgctttcgctctcctgcttgaattcatgtatgaagggaaactccagttcaaagacttgcccattgaagacgtgctagcagctgccagttatctccacatgtatgacattgtcaaagtctgcaaaaagaagctgaaagagaaagccaccacggaggcagacagcaccaaaaaggaagaagatgcttcaagttgttcggacaaagtcgagagtctctccgatggcagcagccacatagcaggcgatttgcccagtgatgaagatgaaggagaagatgaaaaattgaacatcctgcccagcaaaagggacttggcggccgagcctgggaacatgtggatgcgattgccctcagactcagcaggcatcccccaggctggcggagaggcagagccacacgccacagcagctggaaaaacagtagccagcccctgcagctcaacagagtctttgtcccagaggacgtgctgagaagcaacctggtgcaggtgaaggtggagaaagaggcttcctgtgatgagagtgatgttggcactaatgactatgacatggaacatagcactgtgaaagaaagtgtgagcactaataacagggtacagtatgagccggcccatctggctcccctgagggaggactcggtcttgagggagctggaccgggaggacaaagccagtgatgatgagatgatgaccccagagagcgagcgtgtccaggtggagggaggcatggagagcagtctgctcccctacgtctccaacatcctgagccccgcgggccagatcttcatgtgccccctgtgcaacaaggtcttccccagcccccacatcctgcagatccacctgagcacgcacttccgcgagcaggacggcatccgcagcaagcccgccgccgatgtcaacgtgcccacgtgctcgctgtgtgggaagactttctcttgcatgtacaccctcaagcgccacgagaggactcactcgggggagaagccctacacatgcacccagtgcggcaagagcttccagtactcgcacaacctgagccgccatgccgtggtgcacacccgcgagaagccgcacgcctgcaagtggtgcgagcgcaggttcacgcagtccggggacctgtacagacacattcgcaagttccactgtgagttggtgaactccttgtcggtcaaaagcgaagcactgagcttgcctactgtcagagactggaccttagaagatagctctcaagaactttggaaataattttatatatatataaataatatatatatatatacatatatataaatagatctctatatagttgtggtacggtctaaaagcagtcttgtttcctggaaataaaaagttgggatattaacttgtttttgcactttagaatagcatgagaatctcactaatttagcattctgataaaagaaactttagagcaagtcagaatagagaggtgtttttcctttgaggggataggggaagtaagccaataagaaccttttaaacaaatcgtcctgtcacaaaatgctttcatatggcttaattttgtcaacactgcattgtcttttgagctcttttttcccccccaacaaagtttttttgttttttgtttttttttttaagtagaaattccctccagttttattagcctctttatatgtctcaaattgcatgaattttttctggctgttggaaacctgaatgcttttagacccaaatggaaaatttctgaaatgctggattatctatttttaaacaagcagttgacttaaaactttctgtggcaacttctggttttctgacagttcccagtgagagaaatgctgaaagtacactgggatcactgggacactgtcttatgaaggtttgcttgggatgaaaaaggatattgcagcttcagcagtgttgaactgtgtgtttaaaaatgtgaattactgttattgtatactgtaattgattacatgggctgggggggtgtcaaagaacttgacaggttgtgttgatgctcttagttgagtcttgaaaagtaaatattaacgctacagaaatgcatgagtttcaatatattttttgtctttgtttgcattgtataactttaacgagtgagtttaaaattatttaatttccttagaaaaatagcaccatttggaaaaaaaaactggtgttatgaagaacgtaaatgcactgtttttatttttattttatataatttaaattgactttcccactgtctttaagttgaaactgttaagctgaataaaaacttaagctgcaaattgataacttcgctacataacaaggaaaatataaatgtttacaaacagcttaaagatttgcatgtgcagtgtgcatttataacaaacttctaattgcacaaaacccatgccagctcagagtttaggtgtacacatttacccagttgagcgttcttagaataactactgcacaagttgacaataggtcgttctctctttttttttgtttgctccctttttctttttctccccttcctccttaccctccctcccttactctccccccccaccaccaccctccacccccaactcatgaaaagattctatggactgaaaaagccccaggctgaaaggactggactgccttgattgacatggggaagggggttagtagactatgtggattgcggcagcagaggctgcagcctaacgtgtggttttaatgaccagcacgcaaggcaaaagcattttgcacagtgtttgttttcctgtcttgcacttacaaataaggtctatgggagtagcatggaaaacgtttgctgtttttcccttttttttttaattgcttttgtttaaaatttgatcgccttaactactgtaaacatagcctatttttgtgcttaagatactgaatggaaaactccattgtgtgttgctggactgttttggaaatatttggttaaatgtgtgttaatttggctgtaatggcatttaaagcaaacaaacaaacaaaaaaagctgtgaaaatggccttggagcattatctttagttacttgaagagtttctagtttttttaaaatacagtttatgttaaaataatttttattaatttagagaagacaatcaatgtctgtgagaaaacggactttcttttggattttctttttgtggtcattgtgagtgattgctttttccttttcttagtttcacattcttcctttgttctaaaacttagactgacatctagctttgacaatcatagtatgttttattttcctgagggggaataacttataatgctgtttagttttgtactattggtgtgttggtgaatttttaaactgtgtgctaactgcaataaattatatgaactgagaa

SEQ ID NO: 440618 - DNA, 2384 bp, Homo sapiens
tttaaactgtgctttctaagcacagtcaggtagcaaaagtaataaaaaggatggttgaacaagttttcttgtatgttccaggatatgtttgggacttttctttgtttattatatgagttgttccctttgaaattaaagctattttgtaggttttgtgggacataatttgataagtagagttaattaaatttcttctggaagagatctaaattcttattcttagtgagagactgtagttaaaaggaaggcttttagaacttgggttcaaggaagatggagatgcgtcggaagctctttggcgggggtgaggaagttcagaaagtgtgcattttccttctggcatttaggtcttgtccgtgtgatttggtggtgcttgggtcataagcctgattaaaattcagggacatgtaccacggcggccaaagcggaattaatttttttatatggggactggagcgctgaaaagttgttcctgaccaggctctaatgagaaattcctctctccccaggttatgaagacagtatggagtttccagaccatagtagacatttgctacagtgtctgagcgagcagagacaccagggttttctttgtgactgcactgttctggtgggagatgcccagttccgagcgcaccgagctgtactggcttcatgcagcatgtatttccacctcttttacaaggaccagctggacaaaagagacattgttcatctgaacagcgacattgttacagcccccgctttcgctctcctgcttgaattcatgtatgaagggaaactccagttcaaagacttgcccattgaagacgtgctagcagctgccagttatctccacatgtatgacattgtcaaagtctgcaaaaagaagctgaaagagaaagccaccacggaggcagacagcaccaaaaaggaagaagatgcttcaagttgttcggacaaagtcgagagtctctccgatggcagcagccacatagcaggcgatttgcccagtgatgaagatgaaggagaagatgaaaaattgaacatcctgcccagcaaaagggacttggcggccgagcctgggaacatgtggatgcgattgccctcagactcagcaggcatcccccaggctggcggagaggcagagccacacgccacagcagctggaaaaacagtagccagcccctgcagctcaacagagtctttgtcccagaggtctgtcacctccgtgagggattcggcagatgttgactgtgtgctggacctgtctgtcaagtccagcctttcaggagttgaaaatctgaacagctcttatttctcttcacaggacgtgctgagaagcaacctggtgcaggtgaaggtggagaaagaggcttcctgtgatgagagtgatgttggcactaatgactatgacatggaacatagcactgtgaaagaaagtgtgagcactaataacagggtacagtatgagccggcccatctggctcccctgagggaggactcggtcttgagggagctggaccgggaggacaaagccagtgatgatgagatgatgaccccagagagcgagcgtgtccaggtggagggaggcatggagagcagtctgctcccctacgtctccaacatcctgagccccgcgggccagatcttcatgtgccccctgtgcaacaaggtcttccccagcccccacatcctgcagatccacctgagcacgcacttccgcgagcaggacggcatccgcagcaagcccgccgccgatgtcaacgtgcccacgtgctcgctgtgtgggaagactttctcttgcatgtacaccctcaagcgccacgagaggactcactcgggggagaagccctacacatgcacccagtgcggcaagagcttccagtactcgcacaacctgagccgccatgccgtggtgcacacccgcgagaagccgcacgcctgcaagtggtgcgagcgcaggttcacgcagtccggggacctgtacagacacattcgcaagttccactgtgagttggtgaactccttgtcggtcaaaagcgaagcactgagcttgcctactgtcagagactggaccttagaagatagctctcaagaactttggaaataattttatatatatataaataatatatatatatatacatatatataaatagatctctatatagttgtggtacggtctaaaagcagtcttgtttcctggaaataaaaagttgggatattaacttgtttttgcactttagaatagcatgagaatctcactaatttagcattctgataaaagaaactttagagcaagtcagaatagagaggtgtttttcttctttttctttttttttttttttttacaataggccagtagaaatcttagtgagaacagcttttaaagcacttcaagg

SEQ ID NO: 440619 - DNA, 3743 bp, Homo sapiens
agttagtgtgtgcggatctgtggtggagaaggtatctcattcctctctaacatcatctccactttgcatctgtctctcttagtctgctttttttccaccgatgtaacagacctggagccagcaggactcagaggaaaggacttaatcaggtttatgtgtcctaaaggttatgaagacagtatggagtttccagaccatagtagacatttgctacagtgtctgagcgagcagagacaccagggttttctttgtgactgcactgttctggtgggagatgcccagttccgagcgcaccgagctgtactggcttcatgcagcatgtatttccacctcttttacaaggaccagctggacaaaagagacattgttcatctgaacagcgacattgttacagcccccgctttcgctctcctgcttgaattcatgtatgaagggaaactccagttcaaagacttgcccattgaagacgtgctagcagctgccagttatctccacatgtatgacattgtcaaagtctgcaaaaagaagctgaaagagaaagccaccacggaggcagacagcaccaaaaaggaagaagatgcttcaagttgttcggacaaagtcgagagtctctccgatggcagcagccacatagcaggcgatttgcccagtgatgaagatgaaggagaagatgaaaaattgaacatcctgcccagcaaaagggacttggcggccgagcctgggaacatgtggatgcgattgccctcagactcagcaggcatcccccaggctggcggagaggcagagccacacgccacagcagctggaaaaacagtagccagcccctgcagctcaacagagtctttgtcccagaggacgtgctgagaagcaacctggtgcaggtgaaggtggagaaagaggcttcctgtgatgagagtgatgttggcactaatgactatgacatggaacatagcactgtgaaagaaagtgtgagcactaataacagggtacagtatgagccggcccatctggctcccctgagggaggactcggtcttgagggagctggaccgggaggacaaagccagtgatgatgagatgatgaccccagagagcgagcgtgtccaggtggagggaggcatggagagcagtctgctcccctacgtctccaacatcctgagccccgcgggccagatcttcatgtgccccctgtgcaacaaggtcttccccagcccccacatcctgcagatccacctgagcacgcacttccgcgagcaggacggcatccgcagcaagcccgccgccgatgtcaacgtgcccacgtgctcgctgtgtgggaagactttctcttgcatgtacaccctcaagcgccacgagaggactcactcgggggagaagccctacacatgcacccagtgcggcaagagcttccagtactcgcacaacctgagccgccatgccgtggtgcacacccgcgagaagccgcacgcctgcaagtggtgcgagcgcaggttcacgcagtccggggacctgtacagacacattcgcaagttccactgtgagttggtgaactccttgtcggtcaaaagcgaagcactgagcttgcctactgtcagagactggaccttagaagatagctctcaagaactttggaaataattttatatatatataaataatatatatatatatacatatatataaatagatctctatatagttgtggtacggtctaaaagcagtcttgtttcctggaaataaaaagttgggatattaacttgtttttgcactttagaatagcatgagaatctcactaatttagcattctgataaaagaaactttagagcaagtcagaatagagaggtgtttttcctttgaggggataggggaagtaagccaataagaaccttttaaacaaatcgtcctgtcacaaaatgctttcatatggcttaattttgtcaacactgcattgtcttttgagctcttttttcccccccaacaaagtttttttgttttttgtttttttttttaagtagaaattccctccagttttattagcctctttatatgtctcaaattgcatgaattttttctggctgttggaaacctgaatgcttttagacccaaatggaaaatttctgaaatgctggattatctatttttaaacaagcagttgacttaaaactttctgtggcaacttctggttttctgacagttcccagtgagagaaatgctgaaagtacactgggatcactgggacactgtcttatgaaggtttgcttgggatgaaaaaggatattgcagcttcagcagtgttgaactgtgtgtttaaaaatgtgaattactgttattgtatactgtaattgattacatgggctgggggggtgtcaaagaacttgacaggttgtgttgatgctcttagttgagtcttgaaaagtaaatattaacgctacagaaatgcatgagtttcaatatattttttgtctttgtttgcattgtataactttaacgagtgagtttaaaattatttaatttccttagaaaaatagcaccatttggaaaaaaaaactggtgttatgaagaacgtaaatgcactgtttttatttttattttatataatttaaattgactttcccactgtctttaagttgaaactgttaagctgaataaaaacttaagctgcaaattgataacttcgctacataacaaggaaaatataaatgtttacaaacagcttaaagatttgcatgtgcagtgtgcatttataacaaacttctaattgcacaaaacccatgccagctcagagtttaggtgtacacatttacccagttgagcgttcttagaataactactgcacaagttgacaataggtcgttctctctttttttttgtttgctccctttttctttttctccccttcctccttaccctccctcccttactctccccccccaccaccaccctccacccccaactcatgaaaagattctatggactgaaaaagccccaggctgaaaggactggactgccttgattgacatggggaagggggttagtagactatgtggattgcggcagcagaggctgcagcctaacgtgtggttttaatgaccagcacgcaaggcaaaagcattttgcacagtgtttgttttcctgtcttgcacttacaaataaggtctatgggagtagcatggaaaacgtttgctgtttttcccttttttttttaattgcttttgtttaaaatttgatcgccttaactactgtaaacatagcctatttttgtgcttaagatactgaatggaaaactccattgtgtgttgctggactgttttggaaatatttggttaaatgtgtgttaatttggctgtaatggcatttaaagcaaacaaacaaacaaaaaaagctgtgaaaatggccttggagcattatctttagttacttgaagagtttctagtttttttaaaatacagtttatgttaaaataatttttattaatttagagaagacaatcaatgtctgtgagaaaacggactttcttttggattttctttttgtggtcattgtgagtgattgctttttccttttcttagtttcacattcttcctttgttctaaaacttagactgacatctagctttgacaatcatagtatgttttattttcctgagggggaataacttataatgctgtttagttttgtactattggtgtgttggtgaatttttaaactgtgtgctaactgcaataaattatatgaactgagaa

SEQ ID NO: 440620 - DNA, 3897 bp, Homo sapiens
agttagtgtgtgcggatctgtggtggagaaggtatctcattcctctctaacatcatctccactttgcatctgtctctcttagtctgctttttttccaccgatgtaacagacctggagccagcaggactcagaggaaaggacttaatcaggtttatgtgtcctaaaggttatgaagacagtatggagtttccagaccatagtagacatttgctacagtgtctgagcgagcagagacaccagggttttctttgtgactgcactgttctggtgggagatgcccagttccgagcgcaccgagctgtactggcttcatgcagcatgtatttccacctcttttacaaggaccagctggacaaaagagacattgttcatctgaacagcgacattgttacagcccccgctttcgctctcctgcttgaattcatgtatgaagggaaactccagttcaaagacttgcccattgaagacgtgctagcagctgccagttatctccacatgtatgacattgtcaaagtctgcaaaaagaagctgaaagagaaagccaccacggaggcagacagcaccaaaaaggaagaagatgcttcaagttgttcggacaaagtcgagagtctctccgatggcagcagccacatagcaggcgatttgcccagtgatgaagatgaaggagaagatgaaaaattgaacatcctgcccagcaaaagggacttggcggccgagcctgggaacatgtggatgcgattgccctcagactcagcaggcatcccccaggctggcggagaggcagagccacacgccacagcagctggaaaaacagtagccagcccctgcagctcaacagagtctttgtcccagaggacgtgctgagaagcaacctggtgcaggtgaaggtggagaaagaggcttcctgtgatgagagtgatgttggcactaatgactatgacatggaacatagcactgtgaaagaaagtgtgagcactaataacagggtacagtatgagccggcccatctggctcccctgagggaggactcggtcttgagggagctggaccgggaggacaaagccagtgatgatgagatgatgaccccagagagcgagcgtgtccaggtggagggaggcatggagagcagtctgctcccctacgtctccaacatcctgagccccgcgggccagatcttcatgtgccccctgtgcaacaaggtcttccccagcccccacatcctgcagatccacctgagcacgcacttccgcgagcaggacggcatccgcagcaagcccgccgccgatgtcaacgtgcccacgtgctcgctgtgtgggaagactttctcttgcatgtacaccctcaagcgccacgagaggactcactcgggggagaagccctacacatgcacccagtgcggcaagagcttccagtactcgcacaacctgagccgccatgccgtggtgcacacccgcgagaagccgcacgcctgcaagtggtgcgagcgcaggttcacgcagtccggggacctgtacagacacattcgcaagttccactgtgagttggtgaactccttgtcggtcaaaagcgaagcactgagcttgcctactgtcagagactggaccttagaagatagctctcaagaactttggaaataattttatatatatataaataatatatatatatatacatatatataaatagatctctatatagttgtggtacggtctaaaagcagtcttgtttcctggaaataaaaagttgggatattaacttgtttttgcactttagaatagcatgagaatctcactaatttagcattctgataaaagaaactttagagcaagtcagaatagagaggtgtttttcctttgaggggataggggaagtaagccaataagaaccttttaaacaaatcgtcctgtcacaaaatgctttcatatggcttaattttgtcaacactgcattgtcttttgagctcttttttcccccccaacaaagtttttttgttttttgtttttttttttaagtagaaattccctccagttttattagcctctttatatgtctcaaattgcatgaattttttctggctgttggaaacctgaatgcttttagacccaaatggaaaatttctgaaatgctggattatctatttttaaacaagcagttgacttaaaactttctgtggcaacttctggttttctgacagttcccagtgagagaaatgctgaaagtacactgggatcactgggacactgtcttatgaaggtttgcttgggatgaaaaaggatattgcagcttcagcagtgttgaactgtgtgtttaaaaatgtgaattactgttattgtatactgtaattgattacatgggctgggggggtgtcaaagaacttgacaggttgtgttgatgctcttagttgagtcttgaaaagtaaatattaacgctacagaaatgcatgagtttcaatatattttttgtctttgtttgcattgtataactttaacgagtgagtttaaaattatttaatttccttagaaaaatagcaccatttggaaaaaaaaactggtgttatgaagaacgtaaatgcactgtttttatttttattttatataatttaaattgactttcccactgtctttaagttgaaactgttaagctgaataaaaacttaagctgcaaattgataacttcgctacataacaaggaaaatataaatgtttacaaacagcttaaagatttgcatgtgcagtgtgcatttataacaaacttctaattgcacaaaacccatgccagctcagagtttaggtgtacacatttacccagttgagcgttcttagaataactactgcacaagttgacaataggtcgttctctctttttttttgtttgctccctttttctttttctccccttcctccttaccctccctcccttactctccccccccaccaccaccctccacccccaactcatgaaaagattctatggactgaaaaagccccaggctgaaaggactggactgccttgattgacatggggaagggggttagtagactatgtggattgcggcagcagaggctgcagcctaacgtgtggttttaatgaccagcacgcaaggcaaaagcattttgcacagtgtttgttttcctgtcttgcacttacaaataaggtctatgggagtagcatggaaaacgtttgctgtttttcccttttttttttaattgcttttgtttaaaatttgatcgccttaactactgtaaacatagcctatttttgtgcttaagatactgaatggaaaactccattgtgtgttgctggactgttttggaaatatttggttaaatgtgtgttaatttggctgtaatggcatttaaagcaaacaaacaaacaaaaaaagctgtgaaaatggccttggagcattatctttagttacttgaagagtttctagtttttttaaaatacagtttatgttaaaataatttttattaatttagagaagacaatcaatgtctgtgagaaaacggactttcttttggattttctttttgtggtcattgtgagtgattgctttttccttttcttagtttcacattcttcctttgttctaaaacttagactgacatctagctttgacaatcatagtatgttttattttcctgagggggaataacttataatgctgtttagttttgtactattggtgtgttggtgaatttttaaactgtgtgctaactgcaataaattatatgaactgagaaaaaaaaaagaaaaaaaaaaaatgttgtggcggtgggacctggaaaagttttagaccaattggttggggggggggcaattggtatggaaatgggcccagcgggtcccaggaactcgggcagagaggggtgggtttcccaataaaaagcgggggga

SEQ ID NO: 440621 - DNA, 1640 bp, Homo sapiens
atatctgcagaattcggcttactcactatagggccgagcggccgcccgggcggtcgtggctgtactggcggcggcagggctggcggcttaggccgcagaggtctgtgggcctgagcccacgctggactctgtccgttctgcgatgactgctgctctggccgtcgtcacgacgtcgggtttggaagatggggtgcctaggtcccgtggcgaagggaccggggaagtggtcttggagcgggggcccggcgcggcctaccacatgttcgtggtgatggaggacttggtggagaagctgaagctgctccgctacgaggaggagttcctccggaagagcaacctgaaggccccgtccagacactattttgcactgcctaccaaccctggcgaacagttctacatgttttgtactcttgctgcttggttgattaataaagcgggacgtccctttgagcagcctcaagaatatgatgaccctaatgcaacaatatctaacatactatccgagcttcggtcatttggaagaactgcagattttcctccttcaaaattaaagtcaggttatggagaacatgtatgctatgttcttgattgcttcgctgaagaagcattgaaatatattggtttcacctggaaaaggccaatatacccagtagaagaattagaagaagaaagcgttgcagaagatgatgcagaattaacattaaataaagtggatgaagaatttgtggaagaagagacagataatgaagaaaactttattgatctcaacgttttaaaggcccagacatatcacttggatatgaacgagactgccaaacaagaagatattttggaatccacaacagatgctgcagaatggagcctagaagtggaacgtgtactaccgcaactgaaagtcacgattaggactgacaataaggattggagaatccatgttgaccaaatgcaccagcacagaagtggaattgaatctgctctaaaggagaccaagggatttttggacaaactccataatgaaattactaggactttggaaaagatcagcagccgagaaaagtacatcaacaatcagcttgagaatttggttcaagaatatcgtgcagctcaagcccagctgagtgaggcaaaggagcgataccagcagggaaatggaggagtgacggaaagaaccagactcctctctgaggttatggaagaattagaaaaggtaaaacaagaaatggaagaaaagggcagcagcatgactgatggtgctcctttggtgaagattaaacagagcttaacaaaactgaagcaagaaactgtagagatggacattagaattggcattgtggaacacacactactccaatcaaagctgaaggagaagtccaacatgactaggaacatgcatgccacagttattccagaaccagcaacaggcttttattaaaacatactggttttcatgtttctgattagttgggttttttatatcaaactatatttcatgttgcatagatttcaaaacataattttatgttcaatgggtatttttttacatatacatactcacatattatatcatggtgattatgatggttaaagcctttacactgaatgtaatgtttaataaagaaattacaaattctcactttcta

SEQ ID NO: 440622 - DNA, 647 bp, Homo sapiens
acacctgtttagcagctctttcccctagaaaaggaagaaagtttagtctcaatacatcaaacactacatcatttttccatcctaaaaaatctcaggtgcttaaaatgccacagcaaaactgtgtgaatgtcagtaagtttttggctatatttttaaccctattttgggcttaagacaaagtgaggaaaatgtcatacaattctgtaatacactgatactccaaatgaacatttttatttcatgttattttcattctgcagctcctttggtgaagattaaacagagcttaacaaaactgaagcaagaaactgtagagatggacattagaattggcattgtggaacacacactactccaatcaaagctgaaggagaagtccaacatgactaggaacatgcatgccacagttattccagaaccagcaacaggcttttattaaaacatactggttttcatgtttctgattagttgggttttttatatcaaactatatttcatgttgcatagatttcaaaacataattttatgttcaatgggtatttttttacatatacatactcacatattatatcatggtgattatgatggttaaagcctttacactgaatgtaatgtttaataaagaaattacaaattctcactttcta

SEQ ID NO: 440623 - DNA, 1112 bp, Homo sapiens
acattttttagtgtcctatagaggaaaaagtgacataatgtcttatagaactataatattaagaaagatacccagaaaagctttagaaatctaaaatctcttcaggatgtttatactattttaattaataaccagttattagagaatttcaaagtatatgcgatgagataattgcgaggtttgagtgtctagtgactaaaacaactttgattgtgtttagtatattgcaacatgagaaaacagatgtgacagccatttggtgaagtttaacattaggagcattctgaaaaactgaaaagctttgtatatctgcatactttatattatttgaattatgtccaaaatattcctaatatctttatttttctatatgtgtggctaatatctaaattacattttcttaacacataattcaaaaattgtgaaagtttattaaaatgtaatgctcatgaaaacttgttttcatgaaaggttatggaagaattagaaaaggtaaaacaagaaatggaagaaaagggcagcagcatgactgatggtggtaagtacatgctcattttaggggaaaaactgagcaagagaaaaatagctcttcaagaaacctacttaacaaaatagtattaatatataaaacaaattatttgttgcttgtttgaagagagattcattgtacaaaaatgtctgataatcagcgtactgtttttcttataaatcagctgagaagggtaggctttttaactataatttagaggtttttaacattcaaactattgattcaaagagtgggaaatatttaaatatgtactttgttatgccagtttaaaaaataatattgtgttctgttttcatcaaatgagcttcactttttctattttatatacaaaagggcactaagtatatgcccaaatgacactaaggcagtgatgtgataacccgtagtttattttccctcctccccagtagaactgactgggcaggggtcaaatagagaagaattaatcatcctctggtaatcatcctccattgtgagcaggttactttgatatgggccagtagtgattgccgaaggcttttctatgccctagaaaaattttctagagttctattgatatata

SEQ ID NO: 440624 - DNA, 451 bp, Homo sapiens
acacctgtttagcagctctttcccctagaaaaggaagaaagtttagtctcaatacatcaaacactacatcatttttccatcctaaaaaatctcaggtgcttaaaatgccacagcaaaactgtgtgaatgtcagtaagtttttggctatatttttaaccctattttgggcttaagacaaagtgaggaaaatgtcatacaattctgtaatacactgatactccaaatgaacatttttatttcatgttattttcattctgcagctcctttggtgaagattaaacagagcttaacaaaactgaagcaagaaactgtagagatggacattagaattggcattgtggaacacacactactccaatcaaagctgaaggagaagtcaatatagtttgatataaaaaacccaactaatcagaaacatgagaaccagtatgtcttaataaaagcctgttgc

SEQ ID NO: 440625 - DNA, 1470 bp, Homo sapiens
caagaagagggccacaggtgacgtcattcaggaaagccgccctgattggagggaaggaggcggagtctagtttccctggtgacggattgtccggtggtcgcctggtaaccggtcgtggctgtactggcggcggcagggctggcggcttaggccgcagaggtctgtgggcctgagcccacgctggactctgtccgttctgcgatgactgctgctctggccgtcgtcacgacgtcgggtttggaagatggggtgcctaggtcccgtggcgaagggaccggggaagtggtcttggagcgggggcccggcgcggcctaccacatgttcgtggtgatggaggacttggtggagaagctgaagctgctccgctacgaggaggagttcctccggaagagcaacctgaaggccccgtccagacactattttgcactgcctaccaaccctggcgaacagttctacatgttttgtactcttgctgcttggttgattaataaagcgggacgtccctttgagcagcctcaagaatatgatgaccctaatgcaacaatatctaacatactatccgagcttcggtcatttggaagaactgcagattttcctccttcaaaattaaagtcaggttatggagaacatgtatgctatgttcttgattgcttcgctgaagaagcattgaaatatattggtttcacctggaaaaggccaatatacccagtagaagaattagaagaagaaagcgttgcagaagatgatgcagaattaacattaaataaagtggatgaagaatttgtggaagaagagacagataatgaagaaaactttattgatctcaacgttttaaaggcccagacatatcacttggatatgaacgagactgccaaacaagaagatattttggaatccacaacagatgctgcagaatggagcctagaagtggaacgtgtactaccgcaactgaaagtcacgattaggactgacaataaggattggagaatccatgttgaccaaatgcaccagcacagaagtggaattgaatctgctctaaaggagaccaagggatttttggacaaactccataatgaaattactaggactttggaaaagatcagcagccgagaaaagtacatcaacaatcagcttgagaatttggttcaagaatatcgtgcagctcaagcccagctgagtgaggcaaaggagcgataccagcagggaaatggaggagtgacggaaagaaccagactcctctctgaggttatggaagaattagaaaaggtaaaacaagaaatggaagaaaagggcagcagcatgactgatggtgctcctttggtgaagattaaacagagcttaacaaaactgaagcaagaaactgtagagatggacattagaattggcattgtggaacacacactactccaatcaaagctgaaggagaagtctatgtagtcacgtgtagtatgtagtccggaagtatgtagt

SEQ ID NO: 440626 - DNA, 1751 bp, Homo sapiens
atatctgcagaattcggcttactcactatagggccgagcggccgcccgggcggtcgtggctgtactggcggcggcagggctggcggcttaggccgcagaggtctgtgggcctgagcccacgctggactctgtccgttctgcgatgactgctgctctggccgtcgtcacgacgtcgggtttggaagatggggtgcctaggtcccgtggcgaagggaccggggaagtggtcttggagcgggggcccggcgcggcctaccacatgttcgtggtgatggaggacttggtggagaagctgaagctgctccgctacgaggaggagttcctccggaagagcaacctgaaggccccgtccagacactattttgcactgcctaccaaccctggcgaacagttctacatgttttgtactcttgctgcttggttgattaataaagcgggacgtccctttgagcagcctcaagaatatgatgaccctaatgcaacaatatctaacatactatccgagcttcggtcatttggaagaactgcagattttcctccttcaaaattaaagtcaggttatggagaacatgtatgctatgttcttgattgcttcgctgaagaagcattgaaatatattggtttcacctggaaaagggtttcaccatgttgcccaggctggtctcaaactcctggtctcagacagtccacctgccttggcctcccaaagtgctgggattatagatgtgagccatcacacccagccaggccaatatacccagtagaagaattagaagaagaaagcgttgcagaagatgatgcagaattaacattaaataaagtggatgaagaatttgtggaagaagagacagataatgaagaaaactttattgatctcaacgttttaaaggcccagacatatcacttggatatgaacgagactgccaaacaagaagatattttggaatccacaacagatgctgcagaatggagcctagaagtggaacgtgtactaccgcaactgaaagtcacgattaggactgacaataaggattggagaatccatgttgaccaaatgcaccagcacagaagtggaattgaatctgctctaaaggagaccaagggatttttggacaaactccataatgaaattactaggactttggaaaagatcagcagccgagaaaagtacatcaacaatcagcttgagaatttggttcaagaatatcgtgcagctcaagcccagctgagtgaggcaaaggagcgataccagcagggaaatggaggagtgacggaaagaaccagactcctctctgaggttatggaagaattagaaaaggtaaaacaagaaatggaagaaaagggcagcagcatgactgatggtgctcctttggtgaagattaaacagagcttaacaaaactgaagcaagaaactgtagagatggacattagaattggcattgtggaacacacactactccaatcaaagctgaaggagaagtccaacatgactaggaacatgcatgccacagttattccagaaccagcaacaggcttttattaaaacatactggttttcatgtttctgattagttgggttttttatatcaaactatatttcatgttgcatagatttcaaaacataattttatgttcaatgggtatttttttacatatacatactcacatattatatcatggtgattatgatggttaaagcctttacactgaatgtaatgtttaataaagaaattacaaattctcactttcta

SEQ ID NO: 440627 - DNA, 1013 bp, Homo sapiens
caagaagagggccacaggtgacgtcattcaggaaagccgccctgattggagggaaggaggcggagtctagtttccctggtgacggattgtccggtggtcgcctggtaaccggtcgtggctgtactggcggcggcagggctggcggcttaggccgcagaggtctgtgggcctgagcccacgctggactctgtccgttctgcgatgactgctgctctggccgtcgtcacgacgtcgggtttggaagatggggtgcctaggtcccgtggcgaagggaccggggaagtggtcttggagcgggggcccggcgcggcctaccacatgttcgtggtgatggaggacttggtggagaagctgaagctgctccgctacgaggaggagttcctccggaagagcaacctgaaggccccgtccagacactattttgcactgcctaccaaccctggcgaacagttctacatgttttgtactcttgctgcttggttgattaataaagcgggacgtccctttgagcagcctcaagaatatgatgaccctaatgcaacaatatctaacatactatccgagcttcggtcatttggaagaactgcagattttcctccttcaaaattaaagtcaggttatggagaacatgtatgctatgttcttgattgcttcgctgaagaagcattgaaatatattggtttcacctggaaaaggccaatatacccagtagaagaattagaagaagaaagcgttgcagaagatgatgcagaattaacattaaataaagtggatgaagaatttgtggaagaagagacagataatgaagaaaactttattgatctcaacgttttaaaggcccagacatatcacttggatatgaacgagactgccaaacaagaagatattttggaatccacaacagatgctgcagaatggagcctagaagtggaacgtgtactaccgcaactgaaagtcacgattaggactgacaataaggtatcaaagtgggaacacattttcttaaaaaaaaa

SEQ ID NO: 440628 - DNA, 840 bp, Homo sapiens
taaaactcttctaagtgtggttaaaatatttctcatcacagatattttgtgctattgaaaatttcaagctgtcttcttttgcacatgtagttgattatttgtagaatggattgagatgtaacccatttttaatatttttgaaaaaatatgtttgtgagttcttctatctgcaaattccatggaatttctagggatttttggacaaactccataatgaaattactaggactttggaaaagatcagcagccgagaaaagtacatcaacaatcagcttgagaatttggttcaagaatatcgtgcagctcaagcccagctgagtgaggcaaaggagcgataccagcagggaaatggaggagtgacggaaagaaccagactcctctctgaggttatggaagaattagaaaaggtaaaacaagaaatggaagaaaagggcagcagcatgactgatggtgctcctttggtgaagattaaacagagcttaacaaaactgaagcaagaaactgtagagatggacattagaattggcattgtggaacacacactactccaatcaaagctgaaggagaagtccaacatgactaggaacatgcatgccacagttattccagaaccagcaacaggcttttattaaaacatactggttttcatgtttctgattagttgggttttttatatcaaactatatttcatgttgcatagatttcaaaacataattttatgttcaatgggtatttttttacatatacatactcacatattatatcatggtgattatgatggttaaagcctttacactgaatgtaatgtttaataaagaaattacaaattctcactttcta

SEQ ID NO: 440629 - DNA, 2391 bp, Homo sapiens
acattttttagtgtcctatagaggaaaaagtgacataatgtcttatagaactataatattaagaaagatacccagaaaagctttagaaatctaaaatctcttcaggatgtttatactattttaattaataaccagttattagagaatttcaaagtatatgcgatgagataattgcgaggtttgagtgtctagtgactaaaacaactttgattgtgtttagtatattgcaacatgagaaaacagatgtgacagccatttggtgaagtttaacattaggagcattctgaaaaactgaaaagctttgtatatctgcatactttatattatttgaattatgtccaaaatattcctaatatctttatttttctatatgtgtggctaatatctaaattacattttcttaacacataattcaaaaattgtgaaagtttattaaaatgtaatgctcatgaaaacttgttttcatgaaaggttatggaagaattagaaaaggtaaaacaagaaatggaagaaaagggcagcagcatgactgatggtgctcctttggtgaagattaaacagagcttaacaaaactgaagcaagaaactgtagagatggacattagaattggcattgtggaacacacactactccaatcaaagctgaaggagaagtccaacatgactaggaacatgcatgccacagttattccagaaccagcaacaggcttttattaaaacatactggttttcatgtttctgattagttgggttttttatatcaaactatatttcatgttgcatagatttcaaaacataattttatgttcaatgggtatttttttacatatacatactcacatattatatcatggtgattatgatggttaaagcctttacactgaatgtaatgtttaataaagaaattacaaattctcactttctaagaagctttcactaatcattacctatgttaaagctcccacctggtggctcatttttcatagcattccttgtgtaagccaaggtatatgacctgcgttttctgcagatgctgctgctgtcacaacatgaactgctgacacagtcctttaccttgctccacctctgcagtgatcataagtgctttgtgcccagaggccactgaagatggtaggcaggattctttccaagaacccaaactgcctttgcctcagctttatggttacctaaaattgccactttttttaggttaaaaaaaacttcagtatcctcattaacatttgaagttggtttcttatgaatatttcgtggctaaaatgattttatagggaatctatcttctaggatctaagccactaaataaaaggataaatgaatgatgataagtcagtcactcatgtttgactctgttcttagaatgaagagaaggtgcatatgcatgtctcaatttctacctttttctgtggtatcggctatactagggaaccattttgtagaagaaggaacgatgacaggtcgcatgaagatcagcctctagtactgatgatctttacttatgcatcttcctgagcaactttctaggctaggatttctaaattggtgaaaaaagcagcattagagtgccagaattagcactggggaaaactggccaggggaacacaaagcaggagacagcctgcgttaatttttttttttaataattttcaaaagcagtggtagaaaatttgataagaatgctttatgtttaggacaacaaaaataattttaaaaagttattttttaccctaatacttttctccactgaatattattatttttttcttagctttttctttctagatgtattccccaacatgctcacatacacagatctttccctttccttactagacctctctttagtttaagataagtttagacaggagaaagtgtatgtaaactacctgaaaggatgacaatcaatacaatgacaaatatgccagtttatttaatttgtttaaaaaaaaaaaggcagaaaacccaccatgggaaaataagcattttttaaaatctgaagttgctcttttcctgtgtggtctttgggaggagtctagtacaaaaactgaaaacctttggtcctgggaatttattttcatggctgttgtcatggctgagtagttttttgatgaattcaatcaatgcagagaacgcttttagataaatcagaactctccttaaaatgcatttcaatcagaagcaaagtacacccattatttatgcagacatgtaaaaaatctaaaaattcttgcaatgagtagtataagccacctatttttacttccttctctgaaatattccagttaactcagcttgggttctgtgctcctcctctcttcctatagaacactgtgcataccttgaataaagagcttattatactatattgttatt

SEQ ID NO: 440630 - DNA, 2113 bp, Homo sapiens
acacctgtttagcagctctttcccctagaaaaggaagaaagtttagtctcaatacatcaaacactacatcatttttccatcctaaaaaatctcaggtgcttaaaatgccacagcaaaactgtgtgaatgtcagtaagtttttggctatatttttaaccctattttgggcttaagacaaagtgaggaaaatgtcatacaattctgtaatacactgatactccaaatgaacatttttatttcatgttattttcattctgcagctcctttggtgaagattaaacagagcttaacaaaactgaagcaagaaactgtagagatggacattagaattggcattgtggaacacacactactccaatcaaagctgaaggagaagtccaacatgactaggaacatgcatgccacagttattccagaaccagcaacaggcttttattaaaacatactggttttcatgtttctgattagttgggttttttatatcaaactatatttcatgttgcatagatttcaaaacataattttatgttcaatgggtatttttttacatatacatactcacatattatatcatggtgattatgatggttaaagcctttacactgaatgtaatgtttaataaagaaattacaaattctcactttctaagaagctttcactaatcattacctatgttaaagctcccacctggtggctcatttttcatagcattccttgtgtaagccaaggtatatgacctgcgttttctgcagatgctgctgctgtcacaacatgaactgctgacacagtcctttaccttgctccacctctgcagtgatcataagtgctttgtgcccagaggccactgaagatggtaggcaggattctttccaagaacccaaactgcctttgcctcagctttatggttacctaaaattgccactttttttaggttaaaaaaaacttcagtatcctcattaacatttgaagttggtttcttatgaatatttcgtggctaaaatgattttatagggaatctatcttctaggatctaagccactaaataaaaggataaatgaatgatgataagtcagtcactcatgtttgactctgttcttagaatgaagagaaggtgcatatgcatgtctcaatttctacctttttctgtggtatcggctatactagggaaccattttgtagaagaaggaacgatgacaggtcgcatgaagatcagcctctagtactgatgatctttacttatgcatcttcctgagcaactttctaggctaggatttctaaattggtgaaaaaagcagcattagagtgccagaattagcactggggaaaactggccaggggaacacaaagcaggagacagcctgcgttaatttttttttttaataattttcaaaagcagtggtagaaaatttgataagaatgctttatgtttaggacaacaaaaataattttaaaaagttattttttaccctaatacttttctccactgaatattattatttttttcttagctttttctttctagatgtattccccaacatgctcacatacacagatctttccctttccttactagacctctctttagtttaagataagtttagacaggagaaagtgtatgtaaactacctgaaaggatgacaatcaatacaatgacaaatatgccagtttatttaatttgtttaaaaaaaaaaaggcagaaaacccaccatgggaaaataagcattttttaaaatctgaagttgctcttttcctgtgtggtctttgggaggagtctagtacaaaaactgaaaacctttggtcctgggaatttattttcatggctgttgtcatggctgagtagttttttgatgaattcaatcaatgcagagaacgcttttagataaatcagaactctccttaaaatgcatttcaatcagaagcaaagtacacccattatttatgcagacatgtaaaaaatctaaaaattcttgcaatgagtagtataagccacctatttttacttccttctctgaaatattccagttaactcagcttgggttctgtgctcctcctctcttcctatagaacactgtgcataccttgaataaagagcttattatactatattgttatt

SEQ ID NO: 440631 - DNA, 791 bp, Homo sapiens
atatctgcagaattcggcttactcactatagggccgagcggccgcccgggcggtcgtggctgtactggcggcggcagggctggcggcttaggccgcagaggtctgtgggcctgagcccacgctggactctgtccgttctgcgatgactgctgctctggccgtcgtcacgacgtcgggtttggaagatggggtgcctaggtcccgtggcgaagggaccggggaagtggtcttggagcgggggcccggcgcggcctaccacatgttcgtggtgatggaggacttggtggagaagctgaagctgctccgctacgaggaggagttcctccggaagagcaacctgaaggccccgtccagggaagaactgcagattttcctccttcaaaattaaagtcaggttatggagaacatgtatgctatgttcttgattgcttcgctgaagaagcattgaaatatattggtttcacctggaaaaggccaatatacccagtagaagaattagaagaagaaagcgttgcagaagatgatgcagaattaacattaaataaagtggatgaagaatttgtggaagaagagacagataatgaagaaaactttattgatctcaacgttttaaaggcccagacatatcacttggatatgaacgagactgccaaacaagaagatattttggaatccacaacagatgctgcagaatggagcctagaagtggaacgtgtactaccgcaactgaaagtcacgattaggactgacaataaggtatcaaagtgggaacacattttcttaaaaaaaaa

SEQ ID NO: 440632 - DNA, 321 bp, Homo sapiens
ggtctcactctgtcgcccaggctggagtgaacctctgcctgccgggctcaagcgatcctcccacctcagcctcccgcatagctgggactacaggtgcacaccaccactcccagctaattttttattttttttgtcaagacagggtttcaccatgttgcccaggctggtctcaaactcctggtctcagacagtccacctgccttggcctcccaaagtgctgggattatagatgtgagccatcacacccagccaggtacaagtttttaatacaagttttctctctagctttgttactggattaaaaaaaggaaaaaaaatatg

SEQ ID NO: 440633 - DNA, 3165 bp, Homo sapiens
caagaagagggccacaggtgacgtcattcaggaaagccgccctgattggagggaaggaggcggagtctagtttccctggtgacggattgtccggtggtcgcctggtaaccggtcgtggctgtactggcggcggcagggctggcggcttaggccgcagaggtctgtgggcctgagcccacgctggactctgtccgttctgcgatgactgctgctctggccgtcgtcacgacgtcgggtttggaagatggggtgcctaggtcccgtggcgaagggaccggggaagtggtcttggagcgggggcccggcgcggcctaccacatgttcgtggtgatggaggacttggtggagaagctgaagctgctccgctacgaggaggagttcctccggaagagcaacctgaaggccccgtccagacactattttgcactgcctaccaaccctggcgaacagttctacatgttttgtactcttgctgcttggttgattaataaagcgggacgtccctttgagcagcctcaagaatatgatgaccctaatgcaacaatatctaacatactatccgagcttcggtcatttggaagaactgcagattttcctccttcaaaattaaagtcaggttatggagaacatgtatgctatgttcttgattgcttcgctgaagaagcattgaaatatattggtttcacctggaaaaggccaatatacccagtagaagaattagaagaagaaagcgttgcagaagatgatgcagaattaacattaaataaagtggatgaagaatttgtggaagaagagacagataatgaagaaaactttattgatctcaacgttttaaaggcccagacatatcacttggatatgaacgagactgccaaacaagaagatattttggaatccacaacagatgctgcagaatggagcctagaagtggaacgtgtactaccgcaactgaaagtcacgattaggactgacaataaggattggagaatccatgttgaccaaatgcaccagcacagaagtggaattgaatctgctctaaaggagaccaagggatttttggacaaactccataatgaaattactaggactttggaaaagatcagcagccgagaaaagtacatcaacaatcagcttgagaatttggttcaagaatatcgtgcagctcaagcccagctgagtgaggcaaaggagcgataccagcagggaaatggaggagtgacggaaagaaccagactcctctctgaggttatggaagaattagaaaaggtaaaacaagaaatggaagaaaagggcagcagcatgactgatggtgctcctttggtgaagattaaacagagcttaacaaaactgaagcaagaaactgtagagatggacattagaattggcattgtggaacacacactactccaatcaaagctgaaggagaagtccaacatgactaggaacatgcatgccacagttattccagaaccagcaacaggcttttattaaaacatactggttttcatgtttctgattagttgggttttttatatcaaactatatttcatgttgcatagatttcaaaacataattttatgttcaatgggtatttttttacatatacatactcacatattatatcatggtgattatgatggttaaagcctttacactgaatgtaatgtttaataaagaaattacaaattctcactttctaagaagctttcactaatcattacctatgttaaagctcccacctggtggctcatttttcatagcattccttgtgtaagccaaggtatatgacctgcgttttctgcagatgctgctgctgtcacaacatgaactgctgacacagtcctttaccttgctccacctctgcagtgatcataagtgctttgtgcccagaggccactgaagatggtaggcaggattctttccaagaacccaaactgcctttgcctcagctttatggttacctaaaattgccactttttttaggttaaaaaaaacttcagtatcctcattaacatttgaagttggtttcttatgaatatttcgtggctaaaatgattttatagggaatctatcttctaggatctaagccactaaataaaaggataaatgaatgatgataagtcagtcactcatgtttgactctgttcttagaatgaagagaaggtgcatatgcatgtctcaatttctacctttttctgtggtatcggctatactagggaaccattttgtagaagaaggaacgatgacaggtcgcatgaagatcagcctctagtactgatgatctttacttatgcatcttcctgagcaactttctaggctaggatttctaaattggtgaaaaaagcagcattagagtgccagaattagcactggggaaaactggccaggggaacacaaagcaggagacagcctgcgttaatttttttttttaataattttcaaaagcagtggtagaaaatttgataagaatgctttatgtttaggacaacaaaaataattttaaaaagttattttttaccctaatacttttctccactgaatattattatttttttcttagctttttctttctagatgtattccccaacatgctcacatacacagatctttccctttccttactagacctctctttagtttaagataagtttagacaggagaaagtgtatgtaaactacctgaaaggatgacaatcaatacaatgacaaatatgccagtttatttaatttgtttaaaaaaaaaaaggcagaaaacccaccatgggaaaataagcattttttaaaatctgaagttgctcttttcctgtgtggtctttgggaggagtctagtacaaaaactgaaaacctttggtcctgggaatttattttcatggctgttgtcatggctgagtagttttttgatgaattcaatcaatgcagagaacgcttttagataaatcagaactctccttaaaatgcatttcaatcagaagcaaagtacacccattatttatgcagacatgtaaaaaatctaaaaattcttgcaatgagtagtataagccacctatttttacttccttctctgaaatattccagttaactcagcttgggttctgtgctcctcctctcttcctatagaacactgtgcataccttgaataaagagcttattatactatattgttatt

SEQ ID NO: 440634 - DNA, 1518 bp, Homo sapiens
caagaagagggccacaggtgacgtcattcaggaaagccgccctgattggagggaaggaggcggagtctagtttccctggtgacggattgtccggtggtcgcctggtaaccggtcgtggctgtactggcggcggcagggctggcggcttaggccgcagaggtctgtgggcctgagcccacgctggactctgtccgttctgcgatgactgctgctctggccgtcgtcacgacgtcgggtttggaagatggggtgcctaggtcccgtggcgaagggaccggggaagtggtcttggagcgggggcccggcgcggcctaccacatgttcgtggtgatggaggacttggtggagaagctgaagctgctccgctacgaggaggagttcctccggaagagcaacctgaaggccccgtccagacactattttgcactgcctaccaaccctggcgaacagttctacatgttttgtactcttgctgcttggttgattaataaagcgggacgtccctttgagcagcctcaagaatatgatgaccctaatgcaacaatatctaacatactatccgagcttcggtcatttggaagaactgcagattttcctccttcaaaattaaagtcaggttatggagaacatgtatgctatgttcttgattgcttcgctgaagaagcattgaaatatattggtttcacctggaaaaggccaatatacccagtagaagaattagaagaagaaagcgttgcagaagatgatgcagaattaacattaaataaagtggatgaagaatttgtggaagaagagacagataatgaagaaaactttattgatctcaacgttttaaaggcccagacatatcacttggatatgaacgagactgccaaacaagaagatattttggaatccacaacagatgctgcagaatggagcctagaagtggaacgtgtactaccgcaactgaaagtcacgattaggactgacaataaggattggagaatccatgttgaccaaatgcaccagcacagaagtggaattgaatctgctctaaaggagaccaagggatttttggacaaactccataatgaaattactaggactttggaaaagatcagcagccgagaaaagtacatcaacaatcagcttgagaatttggttcaagaatatcgtgcagctcaagcccagctgagtgaggcaaaggagcgataccagcagggaaatggaggagtgacggaaagaaccagactcctctctgaggttatggaagaattagaaaaggtaaaacaagaaatggaagaaaagggcagcagcatgactgatggtgctcctttggtgaagattaaacagagcttaacaaaaggagcaccagcagcatgactgatggtgctcctttggtgaagattaaacagagcttaacaaaactgaagcatgttcctagtcatgttggacttctccttcagctttgattggagtagtgtgtgttccacaatgccaattctaatgcccatctctacagtttcttgcttcccg

SEQ ID NO: 440635 - DNA, 785 bp, Homo sapiens
atatctgcagaattcggcttactcactatagggccgagcggccgcccgggcggtcgtggctgtactggcggcggcagggctggcggcttaggccgcagaggtctgtgggcctgagcccacgctggactctgtccgttctgcgatgactgctgctctggccgtcgtcacgacgtcgggtttggaagatggggtgcctaggtcccgtggcgaagggaccggggaagtggtcttggagcgggggcccggcgcggcctaccacatgttcgtggtgatggaggacttggtggagaagctgaagctgctccgctacgaggaggagttcctccggaagagcaacctgaaggccccgtccagacactattttgcactgcctaccaaccctggcgaacagttctacatgttttgtactcttgctgcttggttgattaataaagcgggacgtccctttgagcagcctcaagaatatgatgaccctaatgcaacaatatctaacatactatccgagcttcggtcatttggaagaactgcagattttcctccttcaaaattaaagtcaggttatggagaacatgtatgctatgttcttgattgcttcgctgaagaagcattgaaatatattggtttcacctggaaaaggtaaaaattacccaccctgatgatagtaattttatgggcatagcatttgcctctgagggtacagagctgttcaattgaacataaaagaattattctttttgactattctaaattgaaaatgccacagataattaagaaaagccagtata

SEQ ID NO: 440636 - DNA, 2293 bp, Homo sapiens
  misc_feature (1052)..(1052): n is a, c, g, or t
tagcttccctagggtggcccaggagagagcgttccttgcacagaaacccgagtttattttctgcttgtttgtattcctggagcacggtcacggatggatctgcctggctcgccctcgcgccaggcctgctcctctcagccagcccagatgctgtcagtggacacaggccacgctgaccgacaggccagtggccgcatggacgtgtcagcctctgtggagcaggaggccctgagcaacgccttccgctcggtgccgctggctgaggaggaggatttcgacagcaaagagtgggtcatcatcgacaaggagacggagctcaaggacttccctccaggggctgagcccagcacatcgggcaccacggatgaggagcccgaggagctgcggccactgcccgaggagggcgaagagcggcggcggctgggggcagagcccaccgtccggccccggggacgcagcatgcaggcgctggcggaggaggacctgcagcatttgccgccccagcccctgccaccccagctgagccagggcgatggccgttccgagacgtcacagccccccacgcctggcagcccttcccactcacccctgcactcgggaccccgccctcgacggagagagtcggaccccacaggcccacagagacagttggaggaggacagactctcggggcactccctcccgcggtacagccccctgcgacgactggcgtcctccgtgttctcctcctccacgctggagacggagcattaccctcaccccggcggcggcggctcctcgggctcctccggttccctcattcagcgcagccgctcggctgagagcagccctgtgcgggcgccccaccggcgccacgcgcccctcgctgctggcaaccacagactcatgccctcggtgctccgcatctcgcggtcccagctgcagcaggtgtgggcccggttcacccacaagacctaggctgggccccccccctcctggagggggcaggtgggggggggtggggagcaggcagaggaccatggttccttcccaggacgcaataatcacacacncacacacacgtgcacattcctcccttacatgctcatttgtgccttaaatgtgccttataggtaaatccaggatgactgaggaatccctcgtcactgggagattttgtatatattcttttattattagattgagttgggtgtggggaaaaatttttttctgaaggctcaaaagtggtttcctaaaagtgagccactatcagatttgcacatcaggagaaaagaaatagggttacgtccattaggaaaatcccagtttgcaggagtgcaatcacatcaaaaaaacaaccagccaggattaaaggtattataaatcctcatagcggaacatttctcagggcaaaggaacctggctcatttgaagattaatgttccatgcctttgtggtcaaacggtcagcacttaacacaggaaaaaactaggtgttgttttgttttgttattttggacaacataaaattcaggaatgttttatttagccttggtttctagaaggaagggaaataatatttcttgagcatttactagggtgttgcgtgctgtgctaagtaaattttaagtctttcagttttatagatacggaaaacaagggtgactctttaccacaggatgaataaagaactaagtaatatgggaatgcagcaatttctggactagctgagccgattccttcctgtgagcacactgtaagctttcaagttctctgggcaggaattacagcacctgtcccctgcaatggccctgctgtgtgatgctcatcgcttcccttcgtgctggagcagtcccccaggtgtccatctcctatctttttgttccaatcttctgtgagttccagctagcaggctttacatctggggaaaggaaaaccaggggttttagctctgttctctgctcccatccttcgctcaccagctgagtgagaacatgaactttttgcaccatgtacccatggcttacactacttagaaaatcaccttttcagataaaacagtttatgagttcatagagaacaccagcactctttgacaaaactgtgagtgaccctttttaaacaatgctgagcaggccctgagctataatcaacggtgagctttaatgtctatgctgacagttaggttttgctctcttttgtaacaggttacgtagaccagcagtgtttaaatctaaatacgttgtgagtctgttatctgtcctatcgcgttttttaaatgactttttattctttatcatagctaagtaaatacc

SEQ ID NO: 440637 - DNA, 6830 bp, Homo sapiens
atcttgaatatttgtgctaggaaaaaaatctccaacttaaagagatgaaaactgaggcccagaaaggttagttgaaaggttcaaggccacccagcaggcctgctgccttaggcagccacaccagttacaccaaatcacattgccttgctggggagtcccaaaaatgtggagctgtacagacgtggctgagtcaccacttgctgtgtaatctcagagatgcttcctaagctctttgacctttagtttcctcatctctaaaatggggatgatcacacccacccctcagatgagaggctgtgacctgatgcacacatgtgaatactgacgtttccttgcgggcgagtgaatgtggggctgaaagcccttcaccagctgcagagctgtttcttggtgccccttgaggtggcccagctggggttggggcccccagagctcacagctgctgtctcccccagtcaaactttgccatgggcaggctgccctccacctacaggaagtgctatatgctggacttcgggctggcccggcagtacaccaacaccacgggggatgtgcggccccctcggaatgtggccgggtttcgaggaacggttcgctatgcctcagtcaatgcccacaagaaccgggagatgggccgccacgacgacctgtggtccctcttctacatgctggtggagtttgcagtgggccagctgccctggaggaagatcaaggacaaggaacaggtagggatgatcaaggagaagtatgagcaccggatgctgctgaagcacatgccgtcagagttccacctcttcctggaccacattgccagcctcgactacttcaccaagcccgactaccagttgatcatgtcagtgtttgagaacagcatgaaggagaggggcattgccgagaatgaggcctttgactgggagaaggcaggcaccgatgccctcctgtccacgagcacctctaccccgccccagcagaacacccggcagacggcagccatgtttggggtggtcaatgtgacgccagtgcctggggacctgctccgggagaacaccgaggatgtgctacagggagagcacctgagtgaccaggagaatgcacccccaattctgcccgggaggccctctgaggggctgggccccagtccccaccttgtcccccaccccgggggtcctgaggctgaagtctgggaggagacagatgtcaaccggaacaaactccggatcaacatcggcaaaagcccctgtgtggaggaggaacagagccgaggcatgggggtccccagctccccagtgcgtgcccccccagactcccccacaaccccagtccgttctctgcgctaccggagggtgaacagccctgagtcagaaaggctgtccacggcggacgggcgagtggagctacctgagaggaggtcacggatggatctgcctggctcgccctcgcgccaggcctgctcctctcagccagcccagatgctgtcagtggacacaggccacgctgaccgacaggccagtggccgcatggacgtgtcagcctctgtggagcaggaggccctgagcaacgccttccgctcggtgccgctggctgaggaggaggatttcgacagcaaagagtgggtcatcatcgacaaggagacggagctcaaggacttccctccaggggctgagcccagcacatcgggcaccacggatgaggagcccgaggagctgcggccactgcccgaggagggcgaagagcggcggcggctgggggcagagcccaccgtccggccccggggacgcagcatgcaggcgctggcggaggaggacctgcagcatttgccgccccagcccctgccaccccagctgagccagggcgatggccgttccgagacgtcacagccccccacgcctggcagcccttcccactcacccctgcactcgggaccccgccctcgacggagagagtcggaccccacaggcccacagagacaggtgttctccgtggcgcccccatttgaggtgaatggcctcccacgagctgtgcctctgagtctgccctaccaggacttcaaaagagacctctccgattaccgagaacgggcgcggttgctcaacagggtccggagggtgggcttctcgcacatgctgctcaccaccccccaggtcccactggctcctgttcagcctcaggctaatgggaaggaggaagaggaggaggaggaggaagatgaggaagaggaagaagaggatgaggaagaagaagaggaggaagaggaagaggaggaggaagaagaggaggaggaggaagaggaggaggaggctgcagcggcagttgccttgggggaggtgctggggcctcgtagtggctccagcagtgaggggagtgagaggagcactgaccggagccaggagggtgccccgtccacgctgctggcagacgatcagaaggagtccaggggccgggcctccatggccgatggggacctggagcctgaggagggctccaaaacgctggtgcttgtctctcctggcgacatgaagaagtcgcccgtcactgccgaactggcccccgaccccgacctgggcaccctggctgccctcactcctcagcatgagcggccccagcccacgggcagccagctggacgtatctgagccaggcaccctgtcctctgtcctcaagtctgagcccaagcccccggggcctggggcagggctgggggccgggacagtgaccacaggggtcgggggcgtggcagtcacctcctcacccttcaccaaagttgagaggacctttgtgcacattgcggagaaaacccacctcaacgtcatgtcttccggtggacaagccttgcggtctgaggagttcagcgctgggggcgagctgggtctggagctggcctctgatgggggcgctgtggaggagggggcccgagcgcccctggagaacggcctcgccctgtcagggctgaatggggctgagatagagggctctgccctgtctggggccccccgggaaaccccctcagagatggccacaaactcactgcccaatggcccggcccttgcagacgggccagccccggtgtccccgctggagccaagccctgagaaagtggccaccatctcccccagacgccatgctatgccaggctctcgccccaggagccgtatccctgtcctgctctctgaggaggacacgggctcggagccctcaggctcactgtcggccaaagagcggtggagcaagcgggctcggccgcagcaggacctggcgcggctggtgatggagaagaggcagggccgcctgctgttgcggctggcctcaggggcctcgtcctcctccagtgaggagcagcgccgtgcctctgagaccctctcaggcacgggctctgaggaggacacgcccgcctctgagccggcagcggccttgcccaggaagagcgggagggcagccgccaccaggagccggattccccgccccattggcctccgcatgcccatgcctgttgcagcccagcagcccgccagcagatcccatggcgcggccccagcattggacacagccatcaccagcaggctccagctgcagacgcccccagggtcggccactgctgctgacctccgccccaaacaacctcctggccgcggcctgggcccagggcgagcccaagccggagccaggcccccagcgccgcgcagcccgcgcctccccgcgtccacatccgccgcgcgcaatgccagcgcgtccccccggagccagtccctgtcccgcagagagagcccctccccctcgcaccaggcccggcccggggtccccccgccccggggcgtcccgccggcccgggcccagcctgatggcaccccctcccccgggggctccaagaaaggacccagagggaaactccaggctcagcgcgcaacaaccaaaggccgggcaggaggcgcggagggccgggctggggccagataatgacgcccgctgctctccgcggtcccccaccctcaccccggccccccacccgcagccggccacactggagcagctcccagcacagccttacgcgcccgacgcgcgccacccgcggccccagctttccgcctgcacccgcgaggacgcgcgcgagcacacgcggcgccccgccaggccttagggcccgtgggggacgcggccccgcgccgcggggagggtctgcctccccttcctcgccctgtgtcctctcatcctcccgccgcccgtcaggccggccagcctcacatcagtctctccgccccggggaaggctcagccacttttcatcgaggactccacttctggggacgcctggttcgttcgcccaccaggcctaggctacgctccatgctcccccagcaatctctgcctacacctcctgcggcgccttgccctcctccgacccctttccagccaaagtccccccaccccttcagagaagcagcctcaaattccagaagtggaggctccagcctccccgcgagggtccagccccacagtcttctgggagccattgtggccagggacggcctctggactgccaggctgggttggggacccagggaacatcggtctactcaggtgtgagggggcaggtctgacctgccccaaagttggctccatcctggacaactcggtgagaggcagtgggcaagtgatcttggagatgggtgggcaggtgattctgtgggcaggggatgtgctcccctgcacctctggggtgcagaaacctcttgcctccagatttgggtggagcctctgtgggaaccataggaagtgtgtgggctgccttcctgggcaagtatttcccagtgggaagttggagggggctttaacaaagttttactccctcccctgttcccctgatctagtgctcaggacccttcaccatcaggaattccttcctgtcatctaacctcagtcctgcctactgcagttccagccaacctgctctttcctgagttcaaagcaggtggagactggctggttaccatctttgcactggcccttcggagattcggggactcagttctggtggggtcaccctccctgtcctcccgcctgtgggagggagggagggctggctcaggcatcgtctcccgcaatgggcagagagagcagagacaggtggaccaacagacagctggcccctggaggcagaaaggcccttctaacttccagattgtatgcttgagtgatgggtccccagcccaagcccactcttccctcagctcacccttcagcctgttccttcttgccctgaccccagcccgtgcagctgctctactccaggaatggatgtggggactcttcctgggttctggctcctgcatagctcaccccacctcatcatgagcctcaactgcctacatctggggcaagcagcacaccggctgcagatgggacagccagccctgcctatctggacaggcccctgcagcctctgtcccctggcctagcctctctgtccttccctgagtcacagagagcaagccaagacatccagggaaagaggaagaaaggccttagtgtgccccagcagtctggctgcgtccagccaccatcacccggaaggatgcccacaaggcagctgaccctgaaagcagcctccccctcatggagagtcagcagcttgggcagccacttccaggccagggtggtggcttctctgcagaccagctgaggggaggactcctgggtggacagcctttgacgtccaccccacgctgatgcagaagctcccagaacactcaggaaacttctccggacagagccctccttgtcaacttgaggccctcccaaggccctctactgccctctgggtccagcagagggagtggaggaagggccactgcctcccacctagagcttctccgaatgacaatcagctcgtgccaggtggggaccaggatatgactcctggtgcccaggccctgggcctgctccttgccaccaaccgaaccgtgaatgtagggcccccagcctcacctctgccccaggaccaacaacaccctggtttggagctgggaggaagaagggggcctgagagagccccaggtccattctacccccagcttcactcagcactggagctggcagagacgcaaaacccagtctgcccttgggattccaaacctccctagggctcccaactgacctcaggcctctgagtcactgaatgtcaccaggagaggtgggggagggaaagtgggccagtggggagggggtcacctaggggactgcctctgtgcctctccccaggaagcatccagggcagaggaagccacatctcccggtgcccccaaccccagctgcagcctcctccccctgagcattcattctctccaccaggcctccaggtcctgagcccttcctctgtaaaagtgtcacaccacctccctcagcacttccccatcacaacaacctatgtcactgactcagatgcagggtctgctcaccccaacacatgccttccctccccagccacaccgtgcacgaagggggcacaggagaggagaggggctgtgccccaggctccccatttcccagctcctcacagaggcctggtttgctcagtcttctgaactccagggaccagccctggtgggcatggggtggggagcagggagttgcccttcccctccctcgggaagccacctaagaatgtttacatgccaaacagaatgtaacacccctccccaagcccttcccagtcactgcatggcctctgcccatcctgcacctgtccaccccaccccaacaccctggaagccactgtcaatgattagatcgggtctcggaagggaagtagccatcacaccattaaaaagcctgtggacct

SEQ ID NO: 440638 - DNA, 6884 bp, Homo sapiens
atcttgaatatttgtgctaggaaaaaaatctccaacttaaagagatgaaaactgaggcccagaaaggttagttgaaaggttcaaggccacccagcaggcctgctgccttaggcagccacaccagttacaccaaatcacattgccttgctggggagtcccaaaaatgtggagctgtacagacgtggctgagtcaccacttgctgtgtaatctcagagatgcttcctaagctctttgacctttagtttcctcatctctaaaatggggatgatcacacccacccctcagatgagaggctgtgacctgatgcacacatgtgaatactgacgtttccttgcgggcgagtgaatgtggggctgaaagcccttcaccagctgcagagctgtttcttggtgccccttgaggtggcccagctggggttggggcccccagagctcacagctgctgtctcccccagtcaaactttgccatgggcaggctgccctccacctacaggaagtgctatatgctggacttcgggctggcccggcagtacaccaacaccacgggggatgtgcggccccctcggaatgtggccgggtttcgaggaacggttcgctatgcctcagtcaatgcccacaagaaccgggagatgggccgccacgacgacctgtggtccctcttctacatgctggtggagtttgcagtgggccagctgccctggaggaagatcaaggacaaggaacaggtagggatgatcaaggagaagtatgagcaccggatgctgctgaagcacatgccgtcagagttccacctcttcctggaccacattgccagcctcgactacttcaccaagcccgactaccagttgatcatgtcagtgtttgagaacagcatgaaggagaggggcattgccgagaatgaggcctttgactgggagaaggcaggcaccgatgccctcctgtccacgagcacctctaccccgccccagcagaacacccggcagacggcagccatgtttggggtggtcaatgtgacgccagtgcctggggacctgctccgggagaacaccgaggatgtgctacagggagagcacctgagtgaccaggagaatgcacccccaattctgcccgggaggccctctgaggggctgggccccagtccccaccttgtcccccaccccgggggtcctgaggctgaagtctgggaggagacagatgtcaaccggaacaaactccggatcaacatcggcaaaagcccctgtgtggaggaggaacagagccgaggcatgggggtccccagctccccagtgcgtgcccccccagactcccccacaaccccagtccgttctctgcgctaccggagggtgaacagccctgagtcagaaaggctgtccacggcggacgggcgagtggagctacctgagaggaggtcacggatggatctgcctggctcgccctcgcgccaggcctgctcctctcagccagcccagatgctgtcagtggacacaggccacgctgaccgacaggccagtggccgcatggacgtgtcagcctctgtggagcaggaggccctgagcaacgccttccgctcggtgccgctggctgaggaggaggatttcgacagcaaagagtgggtcatcatcgacaaggagacggagctcaaggacttccctccaggggctgagcccagcacatcgggcaccacggatgaggagcccgaggagctgcggccactgcccgaggagggcgaagagcggcggcggctgggggcagagcccaccgtccggccccggggacgcagcatgcaggcgctggcggaggaggacctgcagcatttgccgccccagcccctgccaccccagctgagccagggcgatggccgttccgagacgtcacagccccccacgcctggcagcccttcccactcacccctgcactcgggaccccgccctcgacggagagagtcggaccccacaggcccacagagacaggtgttctccgtggcgcccccatttgaggtgaatggcctcccacgagctgtgcctctgagtctgccctaccaggacttcaaaagagacctctccgattaccgagaacgggcgcggttgctcaacagggtccggagggtgggcttctcgcacatgctgctcaccaccccccaggtcccactggctcctgttcagcctcaggctaatgggaaggaggaagaggaggaggaggaggaagatgaggaagaggaagaagaggatgaggaagaagaagaggaggaagaggaagaggaggaggaagaagaggaggaggaggaagaggaggaggaggctgcagcggcagttgccttgggggaggtgctggggcctcgtagtggctccagcagtgaggggagtgagaggagcactgaccggagccaggagggtgccccgtccacgctgctggcagacgatcagaaggagtccaggggccgggcctccatggccgatggggacctggagcctgaggagggctccaaaacgctggtgcttgtctctcctggcgacatgaagaagtcgcccgtcactgccgaactggcccccgaccccgacctgggcaccctggctgccctcactcctcagcatgagcggccccagcccacgggcagccagctggacgtatctgagccaggcaccctgtcctctgtcctcaagtctgagcccaagcccccggggcctggggcagggctgggggccgggacagtgaccacaggggtcgggggcgtggcagtcacctcctcacccttcaccaaagttgagaggacctttgtgcacattgcggagaaaacccacctcaacgtcatgtcttccggtggacaagccttgcggtctgaggagttcagcgctgggggcgagctgggtctggagctggcctctgatgggggcgctgtggaggagggggcccgagcgcccctggagaacggcctcgccctgtcagggctgaatggggctgagatagagggctctgccctgtctggggccccccgggaaaccccctcagagatggccacaaactcactgcccaatggcccggcccttgcagacgggccagccccggtgtccccgctggagccaagccctgagaaagtggccaccatctcccccagacgccatgctatgccaggctctcgccccaggagccgtatccctgtcctgctctctgaggaggacacgggctcggagccctcaggctcactgtcggccaaagagcggtggagcaagcgggctcggccgcagcaggacctggcgcggctggtgatggagaagaggcagggccgcctgctgttgcggctggcctcaggggcctcgtcctcctccagtgaggagcagcgccgtgcctctgagaccctctcaggcacgggctctgaggaggacacgcccgcctctgagccggcagcggccttgcccaggaagagcgggagggcagccgccaccaggagccggattccccgccccattggcctccgcatgcccatgcctgttgcagcccagcagcccgccagcagatcccatggcgcggccccagcattggacacagccatcaccagcaggctccagctgcagacgcccccagggtcggccactgctgctgacctccgccccaaacaacctcctggccgcggcctgggcccagggcgagcccaagccggagccaggcccccagcgccgcgcagcccgcgcctccccgcgtccacatccgccgcgcgcaatgccagcgcgtccccccggagccagtccctgtcccgcagagagagcccctccccctcgcaccaggcccggcccggggtccccccgccccggggcgtcccgccggcccgggcccagcctgatggcaccccctcccccgggggctccaagaaaggacccagagggaaactccaggctcagcgcgcaacaaccaaaggccgggcaggaggcgcggagggccgggctggggccagataatgacgcccgctgctctccgcggtcccccaccctcaccccggccccccacccgcagccggccacactggagcagctcccagcacagccttacgcgcccgacgcgcgccacccgcggccccagctttccgcctgcacccgcgaggacgcgcgcgagcacacgcggcgccccgccaggccttagggcccgtgggggacgcggccccgcgccgcggggagggtctgcctccccttcctcgccctgtgtcctctcatcctcccgccgcccgtcaggccggccagcctcacatcagtctctccgccccggggaaggctcagccacttttcatcgaggactccacttctggggacgcctggttcgttcgcccaccaggcctaggctacgctccatgctcccccagcaatctctgcctacacctcctgcggcgccttgccctcctccgacccctttccagccaaagtccccccaccccttcagagaagcagcctcaaattccagaagtggaggctccagcctccccgcgagggtccagccccacagtcttctgggagccattgtggccagggacggcctctggactgccaggctgggttggggacccagggaacatcggtctactcaggtgtgagggggcaggtctgacctgccccaaagttggctccatcctggacaactcggtgagaggcagtgggcaagtgatcttggagatgggtgggcaggtgattctgtgggcaggggatgtgctcccctgcacctctggggtgcagaaacctcttgcctccagatttgggtggagcctctgtgggaaccataggaagtgtgtgggctgccttcctgggcaagtatttcccagtgggaagttggagggggctttaacaaagttttactccctcccctgttcccctgatctagtgctcaggacccttcaccatcaggaattccttcctgtcatctaacctcagtcctgcctactgcagttccagccaacctgctctttcctgagttcaaagcaggtggagactggctggttaccatctttgcactggcccttcggagattcggggactcagttctggtggggtcaccctccctgtcctcccgcctgtgggagggagggagggctggctcaggcatcgtctcccgcaatgggcagagagagcagagacaggtggaccaacagacagctggcccctggaggcagaaaggcccttctaacttccagattgtatgcttgagtgatgggtccccagcccaagcccactcttccctcagctcacccttcagcctgttccttcttgccctgaccccagcccgtgcagctgctctactccaggaatggatgtggggactcttcctgggttctggctcctgcatagctcaccccacctcatcatgagcctcaactgcctacatctggggcaagcagcacaccggctgcagatgggacagccagccctgcctatctggacaggcccctgcagcctctgtcccctggcctagcctctctgtccttccctgagtcacagagagcaagccaagacatccagggaaagaggaagaaaggccttagtgtgccccagcagtctggctgcgtccagccaccatcacccggaaggatgcccacaaggcagctgaccctgaaagcagcctccccctcatggagagtcagcagcttgggcagccacttccaggccagggtggtggcttctctgcagaccagctgaggggaggactcctgggtggacagcctttgacgtccaccccacgctgatgcagaagctcccagaacactcaggaaacttctccggacagagccctccttgtcaacttgaggccctcccaaggccctctactgccctctgggtccagcagagggagtggaggaagggccactgcctcccacctagagcttctccgaatgacaatcagctcgtgccaggtggggaccaggatatgactcctggtgcccaggccctgggcctgctccttgccaccaaccgaaccgtgaatgtagggcccccagcctcacctctgccccaggaccaacaacaccctggtttggagctgggaggaagaagggggcctgagagagccccaggtccattctacccccagcttcactcagcactggagctggcagagacgcaaaacccagtctgcccttgggattccaaacctccctagggctcccaactgacctcaggcctctgagtcactgaatgtcaccaggagaggtgggggagggaaagtgggccagtggggagggggtcacctaggggactgcctctgtgcctctccccaggaagcatccagggcagaggaagccacatctcccggtgcccccaaccccagctgcagcctcctccccctgagcattcattctctccaccaggcctccaggtcctgagcccttcctctgtaaaagtgtcacaccacctccctcagcacttccccatcacaacaacctatgtcactgactcagatgcagggtctgctcaccccaacacatgccttccctccccagccacaccgtgcacgaagggggcacaggagaggagaggggctgtgccccaggctccccatttcccagctcctcacagaggcctggtttgctcagtcttctgaactccagggaccagccctggtgggcatggggtggggagcagggagttgcccttcccctccctcgggaagccacctaagaatgtttacatgccaaacagaatgtaacacccctccccaagcccttcccagtcactgcatggcctctgcccatcctgcacctgtccaccccaccccaacaccctggaagccactgtcaatgattagatcgggtctcggaagggaagtagccatcacaccattaaaaagcctgtggacctactaaaacaaaaacaaaaaacaaaaacacaaaacaaaagaaaaacaaaagagag

SEQ ID NO: 440639 - DNA, 347 bp, Homo sapiens
  misc_feature (15)..(15): n is a, c, g, or t
  misc_feature (28)..(28): n is a, c, g, or t
  misc_feature (123)..(123): n is a, c, g, or t
  misc_feature (132)..(132): n is a, c, g, or t
  misc_feature (181)..(181): n is a, c, g, or t
  misc_feature (189)..(189): n is a, c, g, or t
gcctgtgagcaaganccagggttgtccnagtcccagcctctggggcagagcttgtagccctggatggcctctggggcaggaccactagctaagcaagcccaggagaagacccctgccctgagngccataagnaccacacctgtcctgaattgctgtgaatgacaccagctaacgacaatgncttgtctngcactcctagacccaataaaaagccacctggaagccactgtcaatgattagatcgggtctcggaagggaagtagccatcacaccattaaaaagcctgtggacctactaaaacaaaaacaaaaaacaaaaacacaaaacaaaagaaaaacaaaagagag

SEQ ID NO: 440640 - DNA, 284 bp, Homo sapiens
ccagcagcaggctcttccagcagcagcctggaagcgtgtggcccctcgaggtcctgccctggaggacagagagccaggcctcagtttacccatctgtgccatggtctcagtctcagctctgaggatgccggactccagtgctcagtgcccaggaggattctgaaatatttctccttgttttgtttctttgccctcttcttttctcctgccttctgctctcaagcaggctccagctgcagacgcccccagggtcggccactgctgctgacctccgccccaaacaa

SEQ ID NO: 440641 - DNA, 6803 bp, Homo sapiens
gtgggggaggggagcaggccgacatcctgccggccaactacgtggtcaaggatcgctggaaggtgctgaaaaagatcgggggcgggggctttggtgagatctacgaggccatggacctgctgaccagggagaatgtggccctcaaggtggagtcagcccagcagcccaagcaggtcctcaagatggaggtggccgtgctcaagaagttgcaagggaaggaccatgtgtgcaggttcattggctgtggcaggaacgagaagtttaactatgtagtgatgcagctccagggccggaacctggccgacctgcgccgtagccagccgcgaggcaccttcacgctgagcaccacattgcggctgggcaagcagatcttggagtccatcgaggccatccactctgtgggcttcctgcaccgtgacatcaagccttcaaactttgccatgggcaggctgccctccacctacaggaagtgctatatgctggacttcgggctggcccggcagtacaccaacaccacgggggatgtgcggccccctcggaatgtggccgggtttcgaggaacggttcgctatgcctcagtcaatgcccacaagaaccgggagatgggccgccacgacgacctgtggtccctcttctacatgctggtggagtttgcagtgggccagctgccctggaggaagatcaaggacaaggaacaggtagggatgatcaaggagaagtatgagcaccggatgctgctgaagcacatgccgtcagagttccacctcttcctggaccacattgccagcctcgactacttcaccaagcccgactaccagttgatcatgtcagtgtttgagaacagcatgaaggagaggggcattgccgagaatgaggcctttgactgggagaaggcaggcaccgatgccctcctgtccacgagcacctctaccccgccccagcagaacacccggcagacggcagccatgtttggggtggtcaatgtgacgccagtgcctggggacctgctccgggagaacaccgaggatgtgctacagggagagcacctgagtgaccaggagaatgcacccccaattctgcccgggaggccctctgaggggctgggccccagtccccaccttgtcccccaccccgggggtcctgaggctgaagtctgggaggagacagatgtcaaccggaacaaactccggatcaacatcggcaaaagcccctgtgtggaggaggaacagagccgaggcatgggggtccccagctccccagtgcgtgcccccccagactcccccacaaccccagtccgttctctgcgctaccggagggtgaacagccctgagtcagaaaggctgtccacggcggacgggcgagtggagctacctgagaggaggtcacggatggatctgcctggctcgccctcgcgccaggcctgctcctctcagccagcccagatgctgtcagtggacacaggccacgctgaccgacaggccagtggccgcatggacgtgtcagcctctgtggagcaggaggccctgagcaacgccttccgctcggtgccgctggctgaggaggaggatttcgacagcaaagagtgggtcatcatcgacaaggagacggagctcaaggacttccctccaggggctgagcccagcacatcgggcaccacggatgaggagcccgaggagctgcggccactgcccgaggagggcgaagagcggcggcggctgggggcagagcccaccgtccggccccggggacgcagcatgcaggcgctggcggaggaggacctgcagcatttgccgccccagcccctgccaccccagctgagccagggcgatggccgttccgagacgtcacagccccccacgcctggcagcccttcccactcacccctgcactcgggaccccgccctcgacggagagagtcggaccccacaggcccacagagacaggtgttctccgtggcgcccccatttgaggtgaatggcctcccacgagctgtgcctctgagtctgccctaccaggacttcaaaagagacctctccgattaccgagaacgggcgcggttgctcaacagggtccggagggtgggcttctcgcacatgctgctcaccaccccccaggtcccactggctcctgttcagcctcaggctaatgggaaggaggaagaggaggaggaggaggaagatgaggaagaggaagaagaggatgaggaagaagaagaggaggaagaggaagaggaggaggaagaagaggaggaggaggaagaggaggaggaggctgcagcggcagttgccttgggggaggtgctggggcctcgtagtggctccagcagtgaggggagtgagaggagcactgaccggagccaggagggtgccccgtccacgctgctggcagacgatcagaaggagtccaggggccgggcctccatggccgatggggacctggagcctgaggagggctccaaaacgctggtgcttgtctctcctggcgacatgaagaagtcgcccgtcactgccgaactggcccccgaccccgacctgggcaccctggctgccctcactcctcagcatgagcggccccagcccacgggcagccagctggacgtatctgagccaggcaccctgtcctctgtcctcaagtctgagcccaagcccccggggcctggggcagggctgggggccgggacagtgaccacaggggtcgggggcgtggcagtcacctcctcacccttcaccaaagttgagaggacctttgtgcacattgcggagaaaacccacctcaacgtcatgtcttccggtggacaagccttgcggtctgaggagttcagcgctgggggcgagctgggtctggagctggcctctgatgggggcgctgtggaggagggggcccgagcgcccctggagaacggcctcgccctgtcagggctgaatggggctgagatagagggctctgccctgtctggggccccccgggaaaccccctcagagatggccacaaactcactgcccaatggcccggcccttgcagacgggccagccccggtgtccccgctggagccaagccctgagaaagtggccaccatctcccccagacgccatgctatgccaggctctcgccccaggagccgtatccctgtcctgctctctgaggaggacacgggctcggagccctcaggctcactgtcggccaaagagcggtggagcaagcgggctcggccgcagcaggacctggcgcggctggtgatggagaagaggcagggccgcctgctgttgcggctggcctcaggggcctcgtcctcctccagtgaggagcagcgccgtgcctctgagaccctctcaggcacgggctctgaggaggacacgcccgcctctgagccggcagcggccttgcccaggaagagcgggagggcagccgccaccaggagccggattccccgccccattggcctccgcatgcccatgcctgttgcagcccagcagcccgccagcagatcccatggcgcggccccagcattggacacagccatcaccagcaggctccagctgcagacgcccccagggtcggccactgctgctgacctccgccccaaacaacctcctggccgcggcctgggcccagggcgagcccaagccggagccaggcccccagcgccgcgcagcccgcgcctccccgcgtccacatccgccgcgcgcaatgccagcgcgtccccccggagccagtccctgtcccgcagagagagcccctccccctcgcaccaggcccggcccggggtccccccgccccggggcgtcccgccggcccgggcccagcctgatggcaccccctcccccgggggctccaagaaaggacccagagggaaactccaggctcagcgcgcaacaaccaaaggccgggcaggaggcgcggagggccgggctggggccagataatgacgcccgctgctctccgcggtcccccaccctcaccccggccccccacccgcagccggccacactggagcagctcccagcacagccttacgcgcccgacgcgcgccacccgcggccccagctttccgcctgcacccgcgaggacgcgcgcgagcacacgcggcgccccgccaggccttagggcccgtgggggacgcggccccgcgccgcggggagggtctgcctccccttcctcgccctgtgtcctctcatcctcccgccgcccgtcaggccggccagcctcacatcagtctctccgccccggggaaggctcagccacttttcatcgaggactccacttctggggacgcctggttcgttcgcccaccaggcctaggctacgctccatgctcccccagcaatctctgcctacacctcctgcggcgccttgccctcctccgacccctttccagccaaagtccccccaccccttcagagaagcagcctcaaattccagaagtggaggctccagcctccccgcgagggtccagccccacagtcttctgggagccattgtggccagggacggcctctggactgccaggctgggttggggacccagggaacatcggtctactcaggtgtgagggggcaggtctgacctgccccaaagttggctccatcctggacaactcggtgagaggcagtgggcaagtgatcttggagatgggtgggcaggtgattctgtgggcaggggatgtgctcccctgcacctctggggtgcagaaacctcttgcctccagatttgggtggagcctctgtgggaaccataggaagtgtgtgggctgccttcctgggcaagtatttcccagtgggaagttggagggggctttaacaaagttttactccctcccctgttcccctgatctagtgctcaggacccttcaccatcaggaattccttcctgtcatctaacctcagtcctgcctactgcagttccagccaacctgctctttcctgagttcaaagcaggtggagactggctggttaccatctttgcactggcccttcggagattcggggactcagttctggtggggtcaccctccctgtcctcccgcctgtgggagggagggagggctggctcaggcatcgtctcccgcaatgggcagagagagcagagacaggtggaccaacagacagctggcccctggaggcagaaaggcccttctaacttccagattgtatgcttgagtgatgggtccccagcccaagcccactcttccctcagctcacccttcagcctgttccttcttgccctgaccccagcccgtgcagctgctctactccaggaatggatgtggggactcttcctgggttctggctcctgcatagctcaccccacctcatcatgagcctcaactgcctacatctggggcaagcagcacaccggctgcagatgggacagccagccctgcctatctggacaggcccctgcagcctctgtcccctggcctagcctctctgtccttccctgagtcacagagagcaagccaagacatccagggaaagaggaagaaaggccttagtgtgccccagcagtctggctgcgtccagccaccatcacccggaaggatgcccacaaggcagctgaccctgaaagcagcctccccctcatggagagtcagcagcttgggcagccacttccaggccagggtggtggcttctctgcagaccagctgaggggaggactcctgggtggacagcctttgacgtccaccccacgctgatgcagaagctcccagaacactcaggaaacttctccggacagagccctccttgtcaacttgaggccctcccaaggccctctactgccctctgggtccagcagagggagtggaggaagggccactgcctcccacctagagcttctccgaatgacaatcagctcgtgccaggtggggaccaggatatgactcctggtgcccaggccctgggcctgctccttgccaccaaccgaaccgtgaatgtagggcccccagcctcacctctgccccaggaccaacaacaccctggtttggagctgggaggaagaagggggcctgagagagccccaggtccattctacccccagcttcactcagcactggagctggcagagacgcaaaacccagtctgcccttgggattccaaacctccctagggctcccaactgacctcaggcctctgagtcactgaatgtcaccaggagaggtgggggagggaaagtgggccagtggggagggggtcacctaggggactgcctctgtgcctctccccaggaagcatccagggcagaggaagccacatctcccggtgcccccaaccccagctgcagcctcctccccctgagcattcattctctccaccaggcctccaggtcctgagcccttcctctgtaaaagtgtcacaccacctccctcagcacttccccatcacaacaacctatgtcactgactcagatgcagggtctgctcaccccaacacatgccttccctccccagccacaccgtgcacgaagggggcacaggagaggagaggggctgtgccccaggctccccatttcccagctcctcacagaggcctggtttgctcagtcttctgaactccagggaccagccctggtgggcatggggtggggagcagggagttgcccttcccctccctcgggaagccacctaagaatgtttacatgccaaacagaatgtaacacccctccccaagcccttcccagtcactgcatggcctctgcccatcctgcacctgtccaccccaccccaacaccctggaagccactgtcaatgattagatcgggtctcggaagggaagtagccatcacaccattaaaaagcctgtggacct

SEQ ID NO: 440642 - DNA, 4245 bp, Homo sapiens
ctctgacgatccctttcgcttagcccgacagcctcacaagtagctggtgtactacaggtgcccgccaccgcacctggctactttttgtatttttagtagagatggtgtttcaccatgttagccaggatggtctcgatctcccgacctcgtgatccacccgcctcagcctcacaaattgagaggacctttgtgcacattgcggagaaaacccacctcaacgtcatgtcttccggtggacaagccttgcggtctgaggagttcagcgctgggggcgagctgggtctggagctggcctctgatgggggcgctgtggaggagggggcccgagcgcccctggagaacggcctcgccctgtcagggctgaatggggctgagatagagggctctgccctgtctggggccccccgggaaaccccctcagagatggccacaaactcactgcccaatggcccggcccttgcagacgggccagccccggtgtccccgctggagccaagccctgagaaagtggccaccatctcccccagacgccatgctatgccaggctctcgccccaggagccgtatccctgtcctgctctctgaggaggacacgggctcggagccctcaggctcactgtcggccaaagagcggtggagcaagcgggctcggccgcagcaggacctggcgcggctggtgatggagaagaggcagggccgcctgctgttgcggctggcctcaggggcctcgtcctcctccagtgaggagcagcgccgtgcctctgagaccctctcaggcacgggctctgaggaggacacgcccgcctctgagccggcagcggccttgcccaggaagagcgggagggcagccgccaccaggagccggattccccgccccattggcctccgcatgcccatgcctgttgcagcccagcagcccgccagcagatcccatggcgcggccccagcattggacacagccatcaccagcaggctccagctgcagacgcccccagggtcggccactgctgctgacctccgccccaaacaacctcctggccgcggcctgggcccagggcgagcccaagccggagccaggcccccagcgccgcgcagcccgcgcctccccgcgtccacatccgccgcgcgcaatgccagcgcgtccccccggagccagtccctgtcccgcagagagagcccctccccctcgcaccaggcccggcccggggtccccccgccccggggcgtcccgccggcccgggcccagcctgatggcaccccctcccccgggggctccaagaaaggacccagagggaaactccaggctcagcgcgcaacaaccaaaggccgggcaggaggcgcggagggccgggctggggccagataatgacgcccgctgctctccgcggtcccccaccctcaccccggccccccacccgcagccggccacactggagcagctcccagcacagccttacgcgcccgacgcgcgccacccgcggccccagctttccgcctgcacccgcgaggacgcgcgcgagcacacgcggcgccccgccaggccttagggcccgtgggggacgcggccccgcgccgcggggagggtctgcctccccttcctcgccctgtgtcctctcatcctcccgccgcccgtcaggccggccagcctcacatcagtctctccgccccggggaaggctcagccacttttcatcgaggactccacttctggggacgcctggttcgttcgcccaccaggcctaggctacgctccatgctcccccagcaatctctgcctacacctcctgcggcgccttgccctcctccgacccctttccagccaaagtccccccaccccttcagagaagcagcctcaaattccagaagtggaggctccagcctccccgcgagggtccagccccacagtcttctgggagccattgtggccagggacggcctctggactgccaggctgggttggggacccagggaacatcggtctactcaggtgtgagggggcaggtctgacctgccccaaagttggctccatcctggacaactcggtgagaggcagtgggcaagtgatcttggagatgggtgggcaggtgattctgtgggcaggggatgtgctcccctgcacctctggggtgcagaaacctcttgcctccagatttgggtggagcctctgtgggaaccataggaagtgtgtgggctgccttcctgggcaagtatttcccagtgggaagttggagggggctttaacaaagttttactccctcccctgttcccctgatctagtgctcaggacccttcaccatcaggaattccttcctgtcatctaacctcagtcctgcctactgcagttccagccaacctgctctttcctgagttcaaagcaggtggagactggctggttaccatctttgcactggcccttcggagattcggggactcagttctggtggggtcaccctccctgtcctcccgcctgtgggagggagggagggctggctcaggcatcgtctcccgcaatgggcagagagagcagagacaggtggaccaacagacagctggcccctggaggcagaaaggcccttctaacttccagattgtatgcttgagtgatgggtccccagcccaagcccactcttccctcagctcacccttcagcctgttccttcttgccctgaccccagcccgtgcagctgctctactccaggaatggatgtggggactcttcctgggttctggctcctgcatagctcaccccacctcatcatgagcctcaactgcctacatctggggcaagcagcacaccggctgcagatgggacagccagccctgcctatctggacaggcccctgcagcctctgtcccctggcctagcctctctgtccttccctgagtcacagagagcaagccaagacatccagggaaagaggaagaaaggccttagtgtgccccagcagtctggctgcgtccagccaccatcacccggaaggatgcccacaaggcagctgaccctgaaagcagcctccccctcatggagagtcagcagcttgggcagccacttccaggccagggtggtggcttctctgcagaccagctgaggggaggactcctgggtggacagcctttgacgtccaccccacgctgatgcagaagctcccagaacactcaggaaacttctccggacagagccctccttgtcaacttgaggccctcccaaggccctctactgccctctgggtccagcagagggagtggaggaagggccactgcctcccacctagagcttctccgaatgacaatcagctcgtgccaggtggggaccaggatatgactcctggtgcccaggccctgggcctgctccttgccaccaaccgaaccgtgaatgtagggcccccagcctcacctctgccccaggaccaacaacaccctggtttggagctgggaggaagaagggggcctgagagagccccaggtccattctacccccagcttcactcagcactggagctggcagagacgcaaaacccagtctgcccttgggattccaaacctccctagggctcccaactgacctcaggcctctgagtcactgaatgtcaccaggagaggtgggggagggaaagtgggccagtggggagggggtcacctaggggactgcctctgtgcctctccccaggaagcatccagggcagaggaagccacatctcccggtgcccccaaccccagctgcagcctcctccccctgagcattcattctctccaccaggcctccaggtcctgagcccttcctctgtaaaagtgtcacaccacctccctcagcacttccccatcacaacaacctatgtcactgactcagatgcagggtctgctcaccccaacacatgccttccctccccagccacaccgtgcacgaagggggcacaggagaggagaggggctgtgccccaggctccccatttcccagctcctcacagaggcctggtttgctcagtcttctgaactccagggaccagccctggtgggcatggggtggggagcagggagttgcccttcccctccctcgggaagccacctaagaatgtttacatgccaaacagaatgtaacacccctccccaagcccttcccagtcactgcatggcctctgcccatcctgcacctgtccaccccaccccaacaccctggaagccactgtcaatgattagatcgggtctcggaagggaagtagccatcacaccattaaaaagcctgtggacct

SEQ ID NO: 440643 - DNA, 2080 bp, Homo sapiens
atcttgaatatttgtgctaggaaaaaaatctccaacttaaagagatgaaaactgaggcccagaaaggttagttgaaaggttcaaggccacccagcaggcctgctgccttaggcagccacaccagttacaccaaatcacattgccttgctggggagtcccaaaaatgtggagctgtacagacgtggctgagtcaccacttgctgtgtaatctcagagatgcttcctaagctctttgacctttagtttcctcatctctaaaatggggatgatcacacccacccctcagatgagaggctgtgacctgatgcacacatgtgaatactgacgtttccttgcgggcgagtgaatgtggggctgaaagcccttcaccagctgcagagctgtttcttggtgccccttgaggtggcccagctggggttggggcccccagagctcacagctgctgtctcccccagtcaaactttgccatgggcaggctgccctccacctacaggaagtgctatatgctggacttcgggctggcccggcagtacaccaacaccacgggggatgtgcggccccctcggaatgtggccgggtttcgaggaacggttcgctatgcctcagtcaatgcccacaagaaccgggagatgggccgccacgacgacctgtggtccctcttctacatgctggtggagtttgcagtgggccagctgccctggaggaagatcaaggacaaggaacaggtagggatgatcaaggagaagtatgagcaccggatgctgctgaagcacatgccgtcagagttccacctcttcctggaccacattgccagcctcgactacttcaccaagcccgactaccagttgatcatgtcagtgtttgagaacagcatgaaggagaggggcattgccgagaatgaggcctttgactgggagaaggcaggcaccgatgccctcctgtccacgagcacctctaccccgccccagcagaacacccggcagacggcagccatgtttggggtggtcaatgtgacgccagtgcctggggacctgctccgggagaacaccgaggatgtgctacagggagagcacctgagtgaccaggagaatgcacccccaattctgcccgggaggccctctgaggggctgggccccagtccccaccttgtcccccaccccgggggtcctgaggctgaagtctgggaggagacagatgtcaaccggaacaaactccggatcaacatcggcaaaagcccctgtgtggaggaggaacagagccgaggcatgggggtccccagctccccagtgcgtgcccccccagactcccccacaaccccagtccgttctctgcgctaccggagggtgaacagccctgagtcagaaaggctgtccacggcggacgggcgagtggagctacctgagaggaggtcacggatggatctgcctggctcgccctcgcgccaggcctgctcctctcagccagcccagatgctgtcagtggacacaggccacgctgaccgacaggccagtggccgcatggacgtgtcagcctctgtggagcaggaggccctgagcaacgccttccgctcggtgccgctggctgaggaggaggatttcgacagcaaagagtgggtcatcatcgacaaggagacggagctcaaggacttccctccaggggctgagcccagcacatcgggcaccacggatgaggagcccgaggagctgcggccactgcccgaggagggcgaagagcggcggcggctgggggcagagcccaccgtccggccccggggacgcagcatgcaggcgctggcggaggaggacctgcagcatttgccgccccagcccctgccaccccagctgagccagggcgatggccgttccgagacgtcacagccctccctcgggaagccacctaagaatgtttacatgccaaacagaatgtaacacccctccccaagcccttcccagtcactgcatggcctctgcccatcctgcacctgtccaccccaccccaacaccctggaagccactgtcaatgattagatcgggtctcggaagggaagtagccatcacaccattaaaaagcctgtggacct

SEQ ID NO: 440644 - DNA, 2398 bp, Homo sapiens
gaaatcagcctttctattggtcagggttagaaaccccgcctttgaggcattttcaaccaatggaagcgcggcattcttcatttaaactgtctataaatttctgcctagtcaaagttaagagtggcgccagggatttgaaccgcgctgacgaagtttggtgatccatcttccgagtatcgccgggatttcgaatcgcgatgatcatcccctctctagaggagctggactccctcaagtacagtgacctgcagaacttagccaagagtctgggtctccgggccaacctgagggcaaccaagttgttaaaagccttgaaaggctacattaaacatgaggcaagaaaaggaaatgagaatcaggatgaaagtcaaacttctgcatcctcttgtgatgagactgagatacagatcagcaaccaggaagaagctgagagacagccacttggccatgtcaccaaaacaaggagaaggtgcaagactgtccgtgtggaccctgactcacagcagaatcattcagagataaaaataagtaatcccactgaattccagaatcatgaaaagcaggaaagccaggatctcagagctactgcaaaagttccttctccaccagacgagcaccaagaagctgagaatgctgtttcctcaggtaacagagattcaaaggtaccttcagaaggaaagaaatctctctacacagatgagtcatccaaacctggaaaaaataaaagaactgcaatcactactccaaactttaagaagcttcatgaagctcattttaaggaaatggagtccattgatcaatatattgagagaaaaaagaaacattttgaagaacacaattccatgaatgaactgaagcagcagcccatcaataagggaggggtcaggactccagtacctccaagaggaagactctctgtggcttctactcccatcagccaacgacgctcgcaaggccggtcttgtggccctgcaagtcagagtaccttgggtctgaaggggtcactcaagcgctctgctatctctgcagctaaaacgggtgtcaggttttcagctgctactaaagataatgagcataagcgttcactgaccaagactccagccagaaagtctgcacatgtgaccgtgtctgggggcaccccaaaaggcgaggctgtgcttgggacacacaaattaaagaccatcacggggaattctgctgctgttattaccccattcaagttgacaactgaggcaacgcagactccagtctccaataagaaaccagtgtttgatcttaaagcaagtttgtctcgtcccctcaactatgaaccacacaaaggaaagctaaaaccatgggggcaatctaaagaaaataattatctaaatcaacatgtcaacagaattaacttctacaagaaaacttacaaacaaccccatctccagacaaaggaagagcaacggaagaaacgcgagcaagaacgaaaggagaagaaagcaaaggttttgggaatgcgaaggggcctcattttggctgaagattaataattttttaacatcttgtaaatattcctgtattctcaacttttttccttttgtaaattttttttttttgctgtcatccccactttagtcacgagatctttttctgctaactgttcatagtctgtgtagtgtccatgggttcttcatgtgctatgatctctgaaaagacgttatcaccttaaagctcaaattctttgggatggtttttacttaagtccattaacaattcaggtttctaacgagacccatcctaaaattctgtttctagatttttaatgtcaagttcccaagttccccctgctggttctaatattaacagaactgcagtcttctgctagccaatagcatttacctgatggcagctagttatgcaagcttcaggagaatttgaacaataacaagaatagggtaagctgggatagaaaggccacctcttcactctctatagaatatagtaacctttatgaaacggggccatatagtttggttatgacatcaatattttacctaggtgaaattgtttaggcttatgtaccttcgttcaaatatcctcatgtaattgccatctgtcactcactatattcacaaaaataaaactctacaactcattctaacattgcttacttaaaagctacatagccctatcgaaatgcgaggattaatgctttaatgcttttagagacagggtctcactgtgttgcccaggctggtctcaaactccaccaaatgtacttcttattcattttatggaaaagactaggctttgcttagtatcatgtccatgtttccttcacctcagtggagcttctgagttttatactgctcaagatcgtcataaataaaattttttctcattgtcaaaaaaaaattctttg

SEQ ID NO: 440645 - DNA, 884 bp, Homo sapiens
gaaatcagcctttctattggtcagggttagaaaccccgcctttgaggcattttcaaccaatggaagcgcggcattcttcatttaaactgtctataaatttctgcctagtcaaagttaagagtggcgccagggatttgaaccgcgctgacgaagtttggtgatccatcttccgagtatcgccgggatttcgaatcgcgatgatcatcccctctctagaggagctggactccctcaagtacagtgacctgcagaacttagccaagagtctgggtctccgggccaacctgagggcaaccaagttgttaaaagccttgaaaggctacattaaacatgaggcaagaaaaggaaatgagaatcaggatgaaagtcaaacttctgcatcctcttgtgatgagactgagatacagatcagcaaccaggaagaagctgagagacagccacttggccatgtcaccaaaacaaggagaaggtgcaagactgtccgtgtggaccctgactcacagcagaatcattcagagataaaaataagtaatcccactgaattccagaatcatgaaaagcaggaaagccaggatctcagagctactgcaaaagttccttctccaccagacgagcaccaagaagctgagaatgctgtttcctcaggtaacagagattcaaaggtaccttcagaaggaaagaaatctctctacacagatgagtcatccaaacctggaaaaaataaaaaaaaaaaaaattttgtgggggggtccggaatggaaaatttttaaacaaattttgtgggggggcgggccagtgttttggaaatggtctgggggtcaagggagccgctggaagggggggttcccaaaaaaaggggggacgcgttgcaaatcagggggtgg

SEQ ID NO: 440646 - DNA, 466 bp, Homo sapiens
taatcccagcagtttgggaggctgaggcaggcagatcacaaggtcagcagttcaagaccagcctggccaacacagtgaaaccccgtctctactaaaaatacaaaaattactgggactataggcacatgccacaacgcccggctaatttttgtatttttagtagagatggggtttcaccatgttggagaggccaagcttttaaaatgatgcattttctcttcagcacagcagcccatcaataagggaggggtcaggactccagtacctccaagaggaagactctctgtggcttctactcccatcagccaacgacgctcgcaaggccggtcttgtggccctgcaagtcagagtaccttgggtctgaaggggtcactcaagcgctctgctatctctgcagctaaaacgggtgtcaggtaaagaaatcactccaaaatgtaatcatgaacaagatttcacatggactata

SEQ ID NO: 440647 - DNA, 2353 bp, Homo sapiens
gaaatcagcctttctattggtcagggttagaaaccccgcctttgaggcattttcaaccaatggaagcgcggcattcttcatttaaactgtctataaatttctgcctagtcaaagttaagagtggcgccagggatttgaaccgcgctgacgaagtttggtgatccatcttccgagtatcgccgggatttcgaatcgcgatgatcatcccctctctagaggagctggactccctcaagtacagtgacctgcagaacttagccaagagtctgggtctccgggccaacctgagggcaaccaagttgttaaaagccttgaaaggctacattaaacatgaggcaagaaaaggaaatgagaatcaggatgaaagtcaaacttctgcatcctcttgtgatgagactgagatacagatcagcaaccaggaagaagctgagagacagccacttggccatgtcaccaaaacaaggagaaggtgcaagactgtccgtgtggaccctgactcacagaatcatgaaaagcaggaaagccaggatctcagagctactgcaaaagttccttctccaccagacgagcaccaagaagctgagaatgctgtttcctcaggtaacagagattcaaaggtaccttcagaaggaaagaaatctctctacacagatgagtcatccaaacctggaaaaaataaaagaactgcaatcactactccaaactttaagaagcttcatgaagctcattttaaggaaatggagtccattgatcaatatattgagagaaaaaagaaacattttgaagaacacaattccatgaatgaactgaagcagcagcccatcaataagggaggggtcaggactccagtacctccaagaggaagactctctgtggcttctactcccatcagccaacgacgctcgcaaggccggtcttgtggccctgcaagtcagagtaccttgggtctgaaggggtcactcaagcgctctgctatctctgcagctaaaacgggtgtcaggttttcagctgctactaaagataatgagcataagcgttcactgaccaagactccagccagaaagtctgcacatgtgaccgtgtctgggggcaccccaaaaggcgaggctgtgcttgggacacacaaattaaagaccatcacggggaattctgctgctgttattaccccattcaagttgacaactgaggcaacgcagactccagtctccaataagaaaccagtgtttgatcttaaagcaagtttgtctcgtcccctcaactatgaaccacacaaaggaaagctaaaaccatgggggcaatctaaagaaaataattatctaaatcaacatgtcaacagaattaacttctacaagaaaacttacaaacaaccccatctccagacaaaggaagagcaacggaagaaacgcgagcaagaacgaaaggagaagaaagcaaaggttttgggaatgcgaaggggcctcattttggctgaagattaataattttttaacatcttgtaaatattcctgtattctcaacttttttccttttgtaaattttttttttttgctgtcatccccactttagtcacgagatctttttctgctaactgttcatagtctgtgtagtgtccatgggttcttcatgtgctatgatctctgaaaagacgttatcaccttaaagctcaaattctttgggatggtttttacttaagtccattaacaattcaggtttctaacgagacccatcctaaaattctgtttctagatttttaatgtcaagttcccaagttccccctgctggttctaatattaacagaactgcagtcttctgctagccaatagcatttacctgatggcagctagttatgcaagcttcaggagaatttgaacaataacaagaatagggtaagctgggatagaaaggccacctcttcactctctatagaatatagtaacctttatgaaacggggccatatagtttggttatgacatcaatattttacctaggtgaaattgtttaggcttatgtaccttcgttcaaatatcctcatgtaattgccatctgtcactcactatattcacaaaaataaaactctacaactcattctaacattgcttacttaaaagctacatagccctatcgaaatgcgaggattaatgctttaatgcttttagagacagggtctcactgtgttgcccaggctggtctcaaactccaccaaatgtacttcttattcattttatggaaaagactaggctttgcttagtatcatgtccatgtttccttcacctcagtggagcttctgagttttatactgctcaagatcgtcataaataaaattttttctcattgtcaaaaaaaaattctttg

SEQ ID NO: 440648 - DNA, 2145 bp, Homo sapiens
  misc_feature (1903)..(1905): n is a, c, g, or t
gaaatcagcctttctattggtcagggttagaaaccccgcctttgaggcattttcaaccaatggaagcgcggcattcttcatttaaactgtctataaatttctgcctagtcaaagttaagagtggcgccagggatttgaaccgcgctgacgaagtttggtgatccatcttccgagtatcgccgggatttcgaatcgcgatgatcatcccctctctagaggagctggactccctcaagtacagtgacctgcagaacttagccaagagtctgggtctccgggccaacctgagggcaaccaagttgttaaaagccttgaaaggctacattaaacatgaggcaagaaaaggaaatgagaatcaggatgaaagtcaaacttctgcatcctcttgtgatgagactgagatacagatcagcaaccaggaagaagctgagagacagccacttggccatgtcaccaaaacaaggagaaggtgcaagactgtccgtgtggaccctgactcacagcagaatcattcagagataaaaataagtaatcccactgaattccagaatcatgaaaagcaggaaagccaggatctcagagctactgcaaaagttccttctccaccagacgagcaccaagaagctgagaatgctgtttcctcaggtaacagagattcaaaggtaccttcagaaggaaagaaatctctctacacagatgagtcatccaaacctggaaaaaataaaagaactgcaatcactactccaaactttaagaagcttcatgaagctcattttaaggaaatggagtccattgatcaatatattgagagaaaaaagaaacattttgaagaacacaattccatgaatgaactgaagcagcagcccatcaataagggaggggtcaggactccagtacctccaagaggaagactctctgtggcttctactcccatcagccaacgacgctcgcaaggccggtcttgtggccctgcaagtcagagtaccttgggtctgaaggggtcactcaagcgctctgctatctctgcagctaaaacgggtgtcaggttttcagctgctactaaagataatgagcataagcgttcactgaccaagactccagccagaaagtctgcacatgtgaccgtgtctgggggcaccccaaaaggcgaggctgtgcttgggacacacaaattaaagaccatcacggggaattctgctgctgttattaccccattcaagttgacaactgaggcaacgcagactccagtctccaataagaaaccagtgtttgatcttaaagcaagtttgtctcgtcccctcaactatgaaccacacaaaggaaagctaaaaccatgggggcaatctaaagaaaataattatctaaatcaacatgtcaacagaattaacttctacaagaaaacttacaaacaaccccatctccagacaaaggaagagcaacggaagaaacgcgagcaagaacgaaaggagaagaaagcaaaggttttgggaatgcgaaggggcctcattttggctgaagattaataattttttaacatcttgtaaatattcctgtattctcaacttttttccttttgtaaattttttttttttgctgtcatccccactttagtcacgagatctttttctgctaactgttcatagtctgtgtagtgtccatgggttcttcatgtgctatgatctctgaaaagacgttatcaccttaaagctcaaattctttgggatggtttttacttaagtccattaacaattcaggtttctaacgagacccatcctaaaattctgtttctagatttttaatgtcaagttcccaagttccccctgctggttctaatattaacagaactgcagtcttctgctagccaatagcatttacctgatggcagggaaagctaagacaaacnnnctacaatgttcagcctaggtcgatcctcaactagacatcctgcgcataaaatagatgatgatagcacaacacatcctgctaactagctgacgtcgtgcatagacgcctcggatcgccatacctaggtggacaacacctttgaaagtgtgactctagatgcgtcagcataaaggcaactcgacactagatttctagaacgatagtctcctacctatgcatatcatagacaaaagctaactt

SEQ ID NO: 440649 - DNA, 2281 bp, Homo sapiens
gaaatcagcctttctattggtcagggttagaaaccccgcctttgaggcattttcaaccaatggaagcgcggcattcttcatttaaactgtctataaatttctgcctagtcaaagttaagagtggcgccagggatttgaaccgcgctgacgaagtttggtgatccatcttccgagtatcgccgggatttcgaatcgcgatgatcatcccctctctagaggagctggactccctcaagtacagtgacctgcagaacttagccaagagtctgggtctccgggccaacctgagggcaaccaagttgttaaaagccttgaaaggctacattaaacatgaggcaagaaaaggaaatgagaatcaggatgaaagtcaaacttctgcatcctcttgtgatgagactgagatacagatcagcaaccaggaagaagctgagagacagccacttggccatgtcaccaaaacaaggagaaggtgcaagactgtccgtgtggaccctgactcacagcagaatcattcagagataaaaataagtaatcccactgaattccagaatcatgaaaagcaggaaagccaggatctcagagctactgcaaaagttccttctccaccagacgagcaccaagaagctgagaatgctgtttcctcaggtaacagagattcaaaggtaccttcagaaggaaagaaatctctctacacagatgagtcatccaaacctggaaaaaataaaagaactgcaatcactactccaaactttaagaagcttcatgaagctcattttaaggaaatggagtccattgatcaatatattgagagaaaaaagaaacattttgaagaacacaattccatgaatgaactgaagcagcagcccatcaataagggaggggtcaggactccagtacctccaagaggaagactctctgtggcttctactcccatcagccaacgacgctcgcaaggccggtcttgtggccctgcaagtcagagtaccttgggtctgaaggggtcactcaagcgctctgctatctctgcagctaaaacgggtgtcaggttttcagctgctactaaagataatgagcataagcgttcactgaccaagactccagccagaaagtctgcacatgtgaccgtgtctgggggcaccccaaaaggcgaggctgtgcttgggacacacaaattaaagaccatcacggggaattctgctgctggaaagctaaaaccatgggggcaatctaaagaaaataattatctaaatcaacatgtcaacagaattaacttctacaagaaaacttacaaacaaccccatctccagacaaaggaagagcaacggaagaaacgcgagcaagaacgaaaggagaagaaagcaaaggttttgggaatgcgaaggggcctcattttggctgaagattaataattttttaacatcttgtaaatattcctgtattctcaacttttttccttttgtaaattttttttttttgctgtcatccccactttagtcacgagatctttttctgctaactgttcatagtctgtgtagtgtccatgggttcttcatgtgctatgatctctgaaaagacgttatcaccttaaagctcaaattctttgggatggtttttacttaagtccattaacaattcaggtttctaacgagacccatcctaaaattctgtttctagatttttaatgtcaagttcccaagttccccctgctggttctaatattaacagaactgcagtcttctgctagccaatagcatttacctgatggcagctagttatgcaagcttcaggagaatttgaacaataacaagaatagggtaagctgggatagaaaggccacctcttcactctctatagaatatagtaacctttatgaaacggggccatatagtttggttatgacatcaatattttacctaggtgaaattgtttaggcttatgtaccttcgttcaaatatcctcatgtaattgccatctgtcactcactatattcacaaaaataaaactctacaactcattctaacattgcttacttaaaagctacatagccctatcgaaatgcgaggattaatgctttaatgcttttagagacagggtctcactgtgttgcccaggctggtctcaaactccaccaaatgtacttcttattcattttatggaaaagactaggctttgcttagtatcatgtccatgtttccttcacctcagtggagcttctgagttttatactgctcaagatcgtcataaataaaattttttctcattgtcaaaaaaaaattctttg

SEQ ID NO: 440650 - DNA, 2329 bp, Homo sapiens
gaaatcagcctttctattggtcagggttagaaaccccgcctttgaggcattttcaaccaatggaagcgcggcattcttcatttaaactgtctataaatttctgcctagtcaaagttaagagtggcgccagggatttgaaccgcgctgacgaagtttggtgatccatcttccgagtatcgccgggatttcgaatcgcgatgatcatcccctctctagaggagctggactccctcaagtacagtgacctgcagaacttagccaagagtctgggtctccgggccaacctgagggcaaccaagttgttaaaagccttgaaaggctacattaaacatgaggcaagaaaaggaaatgagaatcaggatgaaagtcaaacttctgcatcctcttgtgatgagactgagatacagatcagcaaccaggaagaagctgagagacagccacttggccatgtcaccaaaacaaggagaaggtgcaagactgtccgtgtggaccctgactcacagcagaatcattcagagataaaaataagtaatcccactgaattccagaatcatgaaaagcaggaaagccaggatctcagagctactgcaaaagttccttctccaccagacgagcaccaagaagctgagaatgctgtttcctcaggtaacagagattcaaaggtaccttcagaaggaaagaaatctctctacacagatgagtcatccaaacctggaaaaaataaaagaactgcaatcactactccaaactttaagaagcttcatgaagctcattttaaggaaatggagtccattgatcaatatattgagagaaaaaagaaacattttgaagaacacaattccatgaatgaactgaagcagcagcccatcaataagggaggggtcaggactccagtacctccaagaggaagactctctgtggcttctactcccatcagccaacgacgctcgcaaggccggtcttgtggccctgcaagtcagagtaccttgggtctgaaggggtcactcaagcgctctgctatctctgcagctaaaacgggtgtcaggttcaagtgattcttctgcctcagcctcccgagtagctgggactacaggttttcagctgctactaaagataatgagcataagcgttcactgaccaagactccagccagaaagtctgcacatgtgaccgtgtctgggggcaccccaaaaggcgaggctgtgcttgggacacacaaattaaagaccatcacggggaattctgctgctggaaagctaaaaccatgggggcaatctaaagaaaataattatctaaatcaacatgtcaacagaattaacttctacaagaaaacttacaaacaaccccatctccagacaaaggaagagcaacggaagaaacgcgagcaagaacgaaaggagaagaaagcaaaggttttgggaatgcgaaggggcctcattttggctgaagattaataattttttaacatcttgtaaatattcctgtattctcaacttttttccttttgtaaattttttttttttgctgtcatccccactttagtcacgagatctttttctgctaactgttcatagtctgtgtagtgtccatgggttcttcatgtgctatgatctctgaaaagacgttatcaccttaaagctcaaattctttgggatggtttttacttaagtccattaacaattcaggtttctaacgagacccatcctaaaattctgtttctagatttttaatgtcaagttcccaagttccccctgctggttctaatattaacagaactgcagtcttctgctagccaatagcatttacctgatggcagctagttatgcaagcttcaggagaatttgaacaataacaagaatagggtaagctgggatagaaaggccacctcttcactctctatagaatatagtaacctttatgaaacggggccatatagtttggttatgacatcaatattttacctaggtgaaattgtttaggcttatgtaccttcgttcaaatatcctcatgtaattgccatctgtcactcactatattcacaaaaataaaactctacaactcattctaacattgcttacttaaaagctacatagccctatcgaaatgcgaggattaatgctttaatgcttttagagacagggtctcactgtgttgcccaggctggtctcaaactccaccaaatgtacttcttattcattttatggaaaagactaggctttgcttagtatcatgtccatgtttccttcacctcagtggagcttctgagttttatactgctcaagatcgtcataaataaaattttttctcattgtcaaaaaaaaattctttg

SEQ ID NO: 440651 - DNA, 2416 bp, Homo sapiens
gaaatcagcctttctattggtcagggttagaaaccccgcctttgaggcattttcaaccaatggaagcgcggcattcttcatttaaactgtctataaatttctgcctagtcaaagttaagagtggcgccagggatttgaaccgcgctgacgaagtttggtgatccatcttccgagtatcgccgggatttcgaatcgcgatgatcatcccctctctagaggagctggactccctcaagtacagtgacctgcagaacttagccaagagtctgggtctccgggccaacctgagggcaaccaagttgttaaaagccttgaaaggctacattaaacatgaggcaagaaaaggaaatgagaatcaggatgaaagtcaaacttctgcatcctcttgtgatgagactgagatacagatcagcaaccaggaagaagctgagagacagccacttggccatgtcaccaaaacaaggagaaggtgcaagactgtccgtgtggaccctgactcacagcagaatcattcagagataaaaataagtaatcccactgaattccagaatcatgaaaagcaggaaagccaggatctcagagctactgcaaaagttccttctccaccagacgagcaccaagaagctgagaatgctgtttcctcaggtaaacgtggaataaatggtaacagagattcaaaggtaccttcagaaggaaagaaatctctctacacagatgagtcatccaaacctggaaaaaataaaagaactgcaatcactactccaaactttaagaagcttcatgaagctcattttaaggaaatggagtccattgatcaatatattgagagaaaaaagaaacattttgaagaacacaattccatgaatgaactgaagcagcagcccatcaataagggaggggtcaggactccagtacctccaagaggaagactctctgtggcttctactcccatcagccaacgacgctcgcaaggccggtcttgtggccctgcaagtcagagtaccttgggtctgaaggggtcactcaagcgctctgctatctctgcagctaaaacgggtgtcaggttttcagctgctactaaagataatgagcataagcgttcactgaccaagactccagccagaaagtctgcacatgtgaccgtgtctgggggcaccccaaaaggcgaggctgtgcttgggacacacaaattaaagaccatcacggggaattctgctgctgttattaccccattcaagttgacaactgaggcaacgcagactccagtctccaataagaaaccagtgtttgatcttaaagcaagtttgtctcgtcccctcaactatgaaccacacaaaggaaagctaaaaccatgggggcaatctaaagaaaataattatctaaatcaacatgtcaacagaattaacttctacaagaaaacttacaaacaaccccatctccagacaaaggaagagcaacggaagaaacgcgagcaagaacgaaaggagaagaaagcaaaggttttgggaatgcgaaggggcctcattttggctgaagattaataattttttaacatcttgtaaatattcctgtattctcaacttttttccttttgtaaattttttttttttgctgtcatccccactttagtcacgagatctttttctgctaactgttcatagtctgtgtagtgtccatgggttcttcatgtgctatgatctctgaaaagacgttatcaccttaaagctcaaattctttgggatggtttttacttaagtccattaacaattcaggtttctaacgagacccatcctaaaattctgtttctagatttttaatgtcaagttcccaagttccccctgctggttctaatattaacagaactgcagtcttctgctagccaatagcatttacctgatggcagctagttatgcaagcttcaggagaatttgaacaataacaagaatagggtaagctgggatagaaaggccacctcttcactctctatagaatatagtaacctttatgaaacggggccatatagtttggttatgacatcaatattttacctaggtgaaattgtttaggcttatgtaccttcgttcaaatatcctcatgtaattgccatctgtcactcactatattcacaaaaataaaactctacaactcattctaacattgcttacttaaaagctacatagccctatcgaaatgcgaggattaatgctttaatgcttttagagacagggtctcactgtgttgcccaggctggtctcaaactccaccaaatgtacttcttattcattttatggaaaagactaggctttgcttagtatcatgtccatgtttccttcacctcagtggagcttctgagttttatactgctcaagatcgtcataaataaaattttttctcattgtcaaaaaaaaattctttg

SEQ ID NO: 440652 - DNA, 1647 bp, Homo sapiens
  misc_feature (1432)..(1432): n is a, c, g, or t
gaaatcagcctttctattggtcagggttagaaaccccgcctttgaggcattttcaaccaatggaagcgcggcattcttcatttaaactgtctataaatttctgcctagtcaaagttaagagtggcgccagggatttgaaccgcgctgacgaagtttggtgatccatcttccgagtatcgccgggatttcgaatcgcgatgatcatcccctctctagaggagctggactccctcaagtacagtgacctgcagaacttagccaagagtctgggtctccgggccaacctgagggcaaccaagttgttaaaagccttgaaaggctacattaaacatgaggcaagaaaaggaaatgagaatcaggatgaaagtcaaacttctgcatcctcttgtgatgagactgagatacagatcagcaaccaggaagaagctgagagacagccacttggccatgtcaccaaaacaaggagaaggtgcaagactgtccgtgtggaccctgactcacagcagaatcattcagagataaaaataagtaatcccactgaattccagaatcatgaaaagcaggaaagccaggatctcagagctactgcaaaagttccttctccaccagacgagcaccaagaagctgagaatgctgtttcctcaggtaacagagattcaaaggtaccttcagaaggaaagaaatctctctacacagatgagtcatccaaacctggaaaaaataaaagaactgcaatcactactccaaactttaagaagcttcatgaagctcattttaaggaaatggagtccattgatcaatatattgagagaaaaaagaaacattttgaagaacacaattccatgaatgaactgaagcagcagcccatcaataagggaggggtcaggactccagtacctccaagaggaagactctctgtggcttctactcccatcagccaacgacgctcgcaaggccggtcttgtggccctgcaagtcagagtaccttgggtctgaaggggtcactcaagcgctctgctatctctgcagctaaaacgggtgtcaggttttcagctgctactaaagataatgagcataagcgttcactgaccaagactccagccagaaagtctgcacatgtgaccgtgtctgggggcaccccaaaaggcgaggctgtgcttgggacacacaaattaaagaccatcacggggaattctgctgctgttattaccccattcaagttgacaactgaggcaacgcagactccagtctccaataagaaaccagtgtttgatcttaaagcaagtttgtctcgtcccctcaactatgaaccacacaaaggaaagctaaaaccatgggggcaatctaaagaaaataattatctaaatcaacatgtcaacagaattaacttctacaagaaaacttacaaacaaccccatctccagacaaagangagccacggaagaacgcgagcagaacgaaggggagcaaggccagcgttgggaaatgggaacgggctcatatgggtgcaaatacatatctttaactctgttagtattcgggatccacacctttctcttgtgaaatcccatgcggcgatccccttttcgagagatttcgcgaacgccaaatgtgtagtgcacggtctcagcgtactctaaagagtat

SEQ ID NO: 440653 - DNA, 2299 bp, Homo sapiens
gaaatcagcctttctattggtcagggttagaaaccccgcctttgaggcattttcaaccaatggaagcgcggcattcttcatttaaactgtctataaatttctgcctagtcaaagttaagagtggcgccagggatttgaaccgcgctgacgaagtttggtgatccatcttccgagtatcgccgggatttcgaatcgcgatgatcatcccctctctagaggagctggactccctcaagtacagtgacctgcagaacttagccaagagtctgggtctccgggccaacctgagggcaaccaagttgttaaaagccttgaaaggctacattaaacatgaggcaagaaaaggaaatgagaatcaggatgaaagtcaaacttctgcatcctcttgtgatgagactgagatacagatcagcaaccaggaagaagctgagagacagccacttggccatgtcaccaaaacaaggagaaggtgcaagactgtccgtgtggaccctgactcacagaatcatgaaaagcaggaaagccaggatctcagagctactgcaaaagttccttctccaccagacgagcaccaagaagctgagaatgctgtttcctcaggtaacagagattcaaaggtaccttcagaaggaaagaaatctctctacacagatgagtcatccaaacctggaaaaaataaagaaatggagtccattgatcaatatattgagagaaaaaagaaacattttgaagaacacaattccatgaatgaactgaagcagcagcccatcaataagggaggggtcaggactccagtacctccaagaggaagactctctgtggcttctactcccatcagccaacgacgctcgcaaggccggtcttgtggccctgcaagtcagagtaccttgggtctgaaggggtcactcaagcgctctgctatctctgcagctaaaacgggtgtcaggttttcagctgctactaaagataatgagcataagcgttcactgaccaagactccagccagaaagtctgcacatgtgaccgtgtctgggggcaccccaaaaggcgaggctgtgcttgggacacacaaattaaagaccatcacggggaattctgctgctgttattaccccattcaagttgacaactgaggcaacgcagactccagtctccaataagaaaccagtgtttgatcttaaagcaagtttgtctcgtcccctcaactatgaaccacacaaaggaaagctaaaaccatgggggcaatctaaagaaaataattatctaaatcaacatgtcaacagaattaacttctacaagaaaacttacaaacaaccccatctccagacaaaggaagagcaacggaagaaacgcgagcaagaacgaaaggagaagaaagcaaaggttttgggaatgcgaaggggcctcattttggctgaagattaataattttttaacatcttgtaaatattcctgtattctcaacttttttccttttgtaaattttttttttttgctgtcatccccactttagtcacgagatctttttctgctaactgttcatagtctgtgtagtgtccatgggttcttcatgtgctatgatctctgaaaagacgttatcaccttaaagctcaaattctttgggatggtttttacttaagtccattaacaattcaggtttctaacgagacccatcctaaaattctgtttctagatttttaatgtcaagttcccaagttccccctgctggttctaatattaacagaactgcagtcttctgctagccaatagcatttacctgatggcagctagttatgcaagcttcaggagaatttgaacaataacaagaatagggtaagctgggatagaaaggccacctcttcactctctatagaatatagtaacctttatgaaacggggccatatagtttggttatgacatcaatattttacctaggtgaaattgtttaggcttatgtaccttcgttcaaatatcctcatgtaattgccatctgtcactcactatattcacaaaaataaaactctacaactcattctaacattgcttacttaaaagctacatagccctatcgaaatgcgaggattaatgctttaatgcttttagagacagggtctcactgtgttgcccaggctggtctcaaactccaccaaatgtacttcttattcattttatggaaaagactaggctttgcttagtatcatgtccatgtttccttcacctcagtggagcttctgagttttatactgctcaagatcgtcataaataaaattttttctcattgtcaaaaaaaaattctttg

SEQ ID NO: 440654 - DNA, 1597 bp, Homo sapiens
ccaaggcagggagagcagaaaagacaagaacatattttacaaataatgttagttgatatgtgatttaatttagcattagccttttaggaatatgtctcttctgcaaaagaggttcgttcctatgacaattattaattgaggcccttttcactgcttgctaatagtcaagtggttttatttataagctagacacaagttactcttgccacagtactcatgtcttgtactctgctgtcctatttaggttttcagctgctactaaagataatgagcataagcgttcactgaccaagactccagccagaaagtctgcacatgtgaccgtgtctgggggcaccccaaaaggcgaggctgtgcttgggacacacaaattaaagaccatcacggggaattctgctgctgttattaccccattcaagttgacaactgaggcaacgcagactccagtctccaataagaaaccagtgtttgatcttaaagcaagtttgtctcgtcccctcaactatgaaccacacaaaggaaagctaaaaccatgggggcaatctaaagaaaataattatctaaatcaacatgtcaacagaattaacttctacaagaaaacttacaaacaaccccatctccagacaaaggaagagcaacggaagaaacgcgagcaagaacgaaaggagaagaaagcaaaggttttgggaatgcgaaggggcctcattttggctgaagattaataattttttaacatcttgtaaatattcctgtattctcaacttttttccttttgtaaattttttttttttgctgtcatccccactttagtcacgagatctttttctgctaactgttcatagtctgtgtagtgtccatgggttcttcatgtgctatgatctctgaaaagacgttatcaccttaaagctcaaattctttgggatggtttttacttaagtccattaacaattcaggtttctaacgagacccatcctaaaattctgtttctagatttttaatgtcaagttcccaagttccccctgctggttctaatattaacagaactgcagtcttctgctagccaatagcatttacctgatggcagctagttatgcaagcttcaggagaatttgaacaataacaagaatagggtaagctgggatagaaaggccacctcttcactctctatagaatatagtaacctttatgaaacggggccatatagtttggttatgacatcaatattttacctaggtgaaattgtttaggcttatgtaccttcgttcaaatatcctcatgtaattgccatctgtcactcactatattcacaaaaataaaactctacaactcattctaacattgcttacttaaaagctacatagccctatcgaaatgcgaggattaatgctttaatgcttttagagacagggtctcactgtgttgcccaggctggtctcaaactccaccaaatgtacttcttattcattttatggaaaagactaggctttgcttagtatcatgtccatgtttccttcacctcagtggagcttctgagttttatactgctcaagatcgtcataaataaaattttttctcattgtcaaaaaaaaattctttg

SEQ ID NO: 440655 - DNA, 2132 bp, Homo sapiens
gaaatcagcctttctattggtcagggttagaaaccccgcctttgaggcattttcaaccaatggaagcgcggcattcttcatttaaactgtctataaatttctgcctagtcaaagttaagagtggcgccagggatttgaaccgcgctgacgaagtttggtgatccatcttccgagtatcgccgggatttcgaatcgcgatgatcatcccctctctagaggagctggactccctcaagtacagtgacctgcagaacttagccaagagtctgggtctccgggccaacctgagggcaaccaagttgttaaaagccttgaaaggctacattaaacatgaggcaagaaaaggaaatgagaatcaggatgaaagtcaaacttctgcatcctcttgtgatgagactgagatacagatcagcaaccaggaagaagctgagagacagccacttggccatgtcaccaaaacaaggagaaggtgcaagactgtccgtgtggaccctgactcacagcagaatcattcagagataaaaataagtaatcccactgaattccagaatcatgaaaagcaggaaagccaggatctcagagctactgcaaaagttccttctccaccagacgagcaccaagaagctgagaatgctgtttcctcaggtaacagagattcaaaggtaccttcagaaggaaagaaatctctctacacagatgagtcatccaaacctggaaaaaataaaagaactgcaatcactactccaaactttaagaagcttcatgaagctcattttaaggaaatggagtccattgatcaatatattgagagaaaaaagaaacattttgaagaacacaattccatgaatgaactgaagcagcagcccatcaataagggaggggtcaggactccagtacctccaagaggaagactctctgtggcttctactcccatcagccaacgacgctcgcaaggccggtcttgtggccctgcaagtcagagtaccttgggtctgaaggggtcactcaagcgctctgctatctctgcagctaaaacgggtgtcaggttttcagctgctactaaagataatgagcataagcgttcactgaccaagactccagccagaaagtctgcacatgtgaccgtgtctgggggcaccccaaaaggcgaggctgtgcttgggacacacaaattaaagaccatcacggggaattctgctgctgttattaccccattcaagttgacaactgaggcaacgcagactccagtctccaataagaaaccagtgtttgatcttaaagcaagtttgtctcgtcccctcaactatgaaccacacaaaggaaagctaaaaccatgggggcaatctaaagaaaataattatctaaatcaacatgtcaacagaattaacttctacaagaaaacttacaaacaaccccatctccagacaaaggaagagcaacggaagaaacgcgagcaagaacgaaaggagaagaaagcaaaggttttgggaatgcgaaggggcctcattttggctgaagattaataattttttaacatcttgtaaatattcctgtattctcaacttttttccttttgtaaattttttttttttgctgtcatccccactttagtcacgagatctttttctgctaactgttcatagtctgtgtagtgtccatgggttcttcatgtgctatgatctctgaaaagacgttatcaccttaaagctcaaattctttgggatggtttttacttaagtccattaacaattcaggtttctaacgagacccatcctaaaattctgtttctagatttttaatgtcaagttcccaagttccccctgctggttctaatattaacagaactgcagtcttctgctagccaatagcatttacctgatggcagctagttatgcaagcttcaggagaatttgaacaataacaagaatagggtaagctgggatagaaaggccacctcttcactctctatagaatatagtaacctttatgaaacggggccatatagtttggttatgacatcaatattttacctaggtgaaattgtttaggcttatgtaccttcgttcaaatatcctcatgtaattgccatctgtcactcactatattcacaaaaataaaactctacaactcat

SEQ ID NO: 440656 - DNA, 2360 bp, Homo sapiens
  misc_feature (277)..(277): n is a, c, g, or t
  misc_feature (279)..(285): n is a, c, g, or t
  misc_feature (298)..(298): n is a, c, g, or t
  misc_feature (303)..(303): n is a, c, g, or t
gaaatcagcctttctattggtcagggttagaaaccccgcctttgaggcattttcaaccaatggaagcgcggcattcttcatttaaactgtctataaatttctgcctagtcaaagttaagagtggcgccagggatttgaaccgcgctgacgaagtttggtgatccatcttccgagtatcgccgggatttcgaatcgcgatgatcatcccctctctagaggagctggactccctcaaaaaaaagaaaaaaaaaaaaaaaaaaaaaaaaaataatagaanannnnnnnaaaaaaaaaaaanaaaanaaaaaaaaaaaagccttgaaaggctacattaaacatgaggcaagaaaaggaaatgagaatcaggatgaaagtcaaacttctgcatcctcttgtgatgagactgagatacagatcagcaaccaggaagaagctgagagacagccacttggccatgtcaccaaaacaaggagaaggtgcaagactgtccgtgtggaccctgactcacagaatcatgaaaagcaggaaagccaggatctcagagctactgcaaaagttccttctccaccagacgagcaccaagaagctgagaatgctgtttcctcaggtaacagagattcaaaggtaccttcagaaggaaagaaatctctctacacagatgagtcatccaaacctggaaaaaataaaagaactgcaatcactactccaaactttaagaagcttcatgaagctcattttaaggaaatggagtccattgatcaatatattgagagaaaaaagaaacattttgaagaacacaattccatgaatgaactgaagcagcagcccatcaataagggaggggtcaggactccagtacctccaagaggaagactctctgtggcttctactcccatcagccaacgacgctcgcaaggccggtcttgtggccctgcaagtcagagtaccttgggtctgaaggggtcactcaagcgctctgctatctctgcagctaaaacgggtgtcaggttttcagctgctactaaagataatgagcataagcgttcactgaccaagactccagccagaaagtctgcacatgtgaccgtgtctgggggcaccccaaaaggcgaggctgtgcttgggacacacaaattaaagaccatcacggggaattctgctgctgttattaccccattcaagttgacaactgaggcaacgcagactccagtctccaataagaaaccagtgtttgatcttaaagcaagtttgtctcgtcccctcaactatgaaccacacaaaggaaagctaaaaccatgggggcaatctaaagaaaataattatctaaatcaacatgtcaacagaattaacttctacaagaaaacttacaaacaaccccatctccagacaaaggaagagcaacggaagaaacgcgagcaagaacgaaaggagaagaaagcaaaggttttgggaatgcgaaggggcctcattttggctgaagattaataattttttaacatcttgtaaatattcctgtattctcaacttttttccttttgtaaattttttttttttgctgtcatccccactttagtcacgagatctttttctgctaactgttcatagtctgtgtagtgtccatgggttcttcatgtgctatgatctctgaaaagacgttatcaccttaaagctcaaattctttgggatggtttttacttaagtccattaacaattcaggtttctaacgagacccatcctaaaattctgtttctagatttttaatgtcaagttcccaagttccccctgctggttctaatattaacagaactgcagtcttctgctagccaatagcatttacctgatggcagctagttatgcaagcttcaggagaatttgaacaataacaagaatagggtaagctgggatagaaaggccacctcttcactctctatagaatatagtaacctttatgaaacggggccatatagtttggttatgacatcaatattttacctaggtgaaattgtttaggcttatgtaccttcgttcaaatatcctcatgtaattgccatctgtcactcactatattcacaaaaataaaactctacaactcattctaacattgcttacttaaaagctacatagccctatcgaaatgcgaggattaatgctttaatgcttttagagacagggtctcactgtgttgcccaggctggtctcaaactccaccaaatgtacttcttattcattttatggaaaagactaggctttgcttagtatcatgtccatgtttccttcacctcagtggagcttctgagttttatactgctcaagatcgtcataaataaaattttttctcattgtcaaaaaaaaattctttg

SEQ ID NO: 440657 - DNA, 2371 bp, Homo sapiens
gaaatcagcctttctattggtcagggttagaaaccccgcctttgaggcattttcaaccaatggaagcgcggcattcttcatttaaactgtctataaatttctgcctagtcaaagttaagagtggcgccagggatttgaaccgcgctgacgaagtttggtgatccatcttccgagtatcgccgggatttcgaatcgcgatgatcatcccctctctagaggagctggactccctcaagtacagtgacctgcagaacttagccaagagtctgggtctccgggccaacctgagggcaaccaagttgttaaaagccttgaaaggctacattaaacatgaggcaagaaaaggaaatgagaatcaggatgaaagtcaaacttctgcatcctcttgtgatgagactgagatacagatcagcaaccaggaagaagctgagagacagccacttggccatgtcaccaaaacaaggagaaggtgcaagactgtccgtgtggaccctgactcacagaatcatgaaaagcaggaaagccaggatctcagagctactgcaaaagttccttctccaccagacgagcaccaagaagctgagaatgctgtttcctcaggtaaacgtggaataaatggtaacagagattcaaaggtaccttcagaaggaaagaaatctctctacacagatgagtcatccaaacctggaaaaaataaaagaactgcaatcactactccaaactttaagaagcttcatgaagctcattttaaggaaatggagtccattgatcaatatattgagagaaaaaagaaacattttgaagaacacaattccatgaatgaactgaagcagcagcccatcaataagggaggggtcaggactccagtacctccaagaggaagactctctgtggcttctactcccatcagccaacgacgctcgcaaggccggtcttgtggccctgcaagtcagagtaccttgggtctgaaggggtcactcaagcgctctgctatctctgcagctaaaacgggtgtcaggttttcagctgctactaaagataatgagcataagcgttcactgaccaagactccagccagaaagtctgcacatgtgaccgtgtctgggggcaccccaaaaggcgaggctgtgcttgggacacacaaattaaagaccatcacggggaattctgctgctgttattaccccattcaagttgacaactgaggcaacgcagactccagtctccaataagaaaccagtgtttgatcttaaagcaagtttgtctcgtcccctcaactatgaaccacacaaaggaaagctaaaaccatgggggcaatctaaagaaaataattatctaaatcaacatgtcaacagaattaacttctacaagaaaacttacaaacaaccccatctccagacaaaggaagagcaacggaagaaacgcgagcaagaacgaaaggagaagaaagcaaaggttttgggaatgcgaaggggcctcattttggctgaagattaataattttttaacatcttgtaaatattcctgtattctcaacttttttccttttgtaaattttttttttttgctgtcatccccactttagtcacgagatctttttctgctaactgttcatagtctgtgtagtgtccatgggttcttcatgtgctatgatctctgaaaagacgttatcaccttaaagctcaaattctttgggatggtttttacttaagtccattaacaattcaggtttctaacgagacccatcctaaaattctgtttctagatttttaatgtcaagttcccaagttccccctgctggttctaatattaacagaactgcagtcttctgctagccaatagcatttacctgatggcagctagttatgcaagcttcaggagaatttgaacaataacaagaatagggtaagctgggatagaaaggccacctcttcactctctatagaatatagtaacctttatgaaacggggccatatagtttggttatgacatcaatattttacctaggtgaaattgtttaggcttatgtaccttcgttcaaatatcctcatgtaattgccatctgtcactcactatattcacaaaaataaaactctacaactcattctaacattgcttacttaaaagctacatagccctatcgaaatgcgaggattaatgctttaatgcttttagagacagggtctcactgtgttgcccaggctggtctcaaactccaccaaatgtacttcttattcattttatggaaaagactaggctttgcttagtatcatgtccatgtttccttcacctcagtggagcttctgagttttatactgctcaagatcgtcataaataaaattttttctcattgtcaaaaaaaaattctttg

SEQ ID NO: 440658 - DNA, 1974 bp, Homo sapiens
tacaggcgcccaccaccacgcccggctgacttttgtatttctagtagagatggggttgatagtttataagccaggatggtcttgatcttctgacctcgtgatccacccgcctcggctcccaaagtgctgggattacaggcgtgagctaccgtgcccggccacatatttcttaatgagaacttttttgaaatccttcattatttctgtgtctttggatttaggtaacagagattcaaaggtaccttcagaaggaaagaaatctctctacacagatgagtcatccaaacctggaaaaaataaaagaactgcaatcactactccaaactttaagaagcttcatgaagctcattttaaggaaatggagtccattgatcaatatattgagagaaaaaagaaacattttgaagaacacaattccatgaatgaactgaagcagcagcccatcaataagggaggggtcaggactccagtacctccaagaggaagactctctgtggcttctactcccatcagccaacgacgctcgcaaggccggtcttgtggccctgcaagtcagagtaccttgggtctgaaggggtcactcaagcgctctgctatctctgcagctaaaacgggtgtcaggttttcagctgctactaaagataatgagcataagcgttcactgaccaagactccagccagaaagtctgcacatgtgaccgtgtctgggggcaccccaaaaggcgaggctgtgcttgggacacacaaattaaagaccatcacggggaattctgctgctgttattaccccattcaagttgacaactgaggcaacgcagactccagtctccaataagaaaccagtgtttgatcttaaagcaagtttgtctcgtcccctcaactatgaaccacacaaaggaaagctaaaaccatgggggcaatctaaagaaaataattatctaaatcaacatgtcaacagaattaacttctacaagaaaacttacaaacaaccccatctccagacaaaggaagagcaacggaagaaacgcgagcaagaacgaaaggagaagaaagcaaaggttttgggaatgcgaaggggcctcattttggctgaagattaataattttttaacatcttgtaaatattcctgtattctcaacttttttccttttgtaaattttttttttttgctgtcatccccactttagtcacgagatctttttctgctaactgttcatagtctgtgtagtgtccatgggttcttcatgtgctatgatctctgaaaagacgttatcaccttaaagctcaaattctttgggatggtttttacttaagtccattaacaattcaggtttctaacgagacccatcctaaaattctgtttctagatttttaatgtcaagttcccaagttccccctgctggttctaatattaacagaactgcagtcttctgctagccaatagcatttacctgatggcagctagttatgcaagcttcaggagaatttgaacaataacaagaatagggtaagctgggatagaaaggccacctcttcactctctatagaatatagtaacctttatgaaacggggccatatagtttggttatgacatcaatattttacctaggtgaaattgtttaggcttatgtaccttcgttcaaatatcctcatgtaattgccatctgtcactcactatattcacaaaaataaaactctacaactcattctaacattgcttacttaaaagctacatagccctatcgaaatgcgaggattaatgctttaatgcttttagagacagggtctcactgtgttgcccaggctggtctcaaactccaccaaatgtacttcttattcattttatggaaaagactaggctttgcttagtatcatgtccatgtttccttcacctcagtggagcttctgagttttatactgctcaagatcgtcataaataaaattttttctcattgtcaaaaaaaaattctttg

SEQ ID NO: 440659 - DNA, 2308 bp, Homo sapiens
gaaatcagcctttctattggtcagggttagaaaccccgcctttgaggcattttcaaccaatggaagcgcggcattcttcatttaaactgtctataaatttctgcctagtcaaagttaagagtggcgccagggatttgaaccgcgctgacgaagtttggtgatccatcttccgagtatcgccgggatttcgaatcgcgatgatcatcccctctctagaggagctggactccctcaagtacagtgacctgcagaacttagccaagagtctgggtctccgggccaacctgagggcaaccaagttgttaaaagccttgaaaggctacattaaacatgaggcaagaaaaggaaatgagaatcaggatgaaagtcaaacttctgcatcctcttgtgatgagactgagatacagatcagcaaccaggaagaagctgagagacagccacttggccatgtcaccaaaacaaggagaaggtgcaagactgtccgtgtggaccctgactcacagaatcatgaaaagcaggaaagccaggatctcagagctactgcaaaagttccttctccaccagacgagcaccaagaagctgagaatgctgtttcctcaggtaacagagattcaaaggtaccttcagaaggaaagaaatctctctacacagatgagtcatccaaacctggaaaaaataaaagaactgcaatcactactccaaactttaagaagcttcatgaagctcattttaaggaaatggagtccattgatcaatatattgagagacagcagcccatcaataagggaggggtcaggactccagtacctccaagaggaagactctctgtggcttctactcccatcagccaacgacgctcgcaaggccggtcttgtggccctgcaagtcagagtaccttgggtctgaaggggtcactcaagcgctctgctatctctgcagctaaaacgggtgtcaggttttcagctgctactaaagataatgagcataagcgttcactgaccaagactccagccagaaagtctgcacatgtgaccgtgtctgggggcaccccaaaaggcgaggctgtgcttgggacacacaaattaaagaccatcacggggaattctgctgctgttattaccccattcaagttgacaactgaggcaacgcagactccagtctccaataagaaaccagtgtttgatcttaaagcaagtttgtctcgtcccctcaactatgaaccacacaaaggaaagctaaaaccatgggggcaatctaaagaaaataattatctaaatcaacatgtcaacagaattaacttctacaagaaaacttacaaacaaccccatctccagacaaaggaagagcaacggaagaaacgcgagcaagaacgaaaggagaagaaagcaaaggttttgggaatgcgaaggggcctcattttggctgaagattaataattttttaacatcttgtaaatattcctgtattctcaacttttttccttttgtaaattttttttttttgctgtcatccccactttagtcacgagatctttttctgctaactgttcatagtctgtgtagtgtccatgggttcttcatgtgctatgatctctgaaaagacgttatcaccttaaagctcaaattctttgggatggtttttacttaagtccattaacaattcaggtttctaacgagacccatcctaaaattctgtttctagatttttaatgtcaagttcccaagttccccctgctggttctaatattaacagaactgcagtcttctgctagccaatagcatttacctgatggcagctagttatgcaagcttcaggagaatttgaacaataacaagaatagggtaagctgggatagaaaggccacctcttcactctctatagaatatagtaacctttatgaaacggggccatatagtttggttatgacatcaatattttacctaggtgaaattgtttaggcttatgtaccttcgttcaaatatcctcatgtaattgccatctgtcactcactatattcacaaaaataaaactctacaactcattctaacattgcttacttaaaagctacatagccctatcgaaatgcgaggattaatgctttaatgcttttagagacagggtctcactgtgttgcccaggctggtctcaaactccaccaaatgtacttcttattcattttatggaaaagactaggctttgcttagtatcatgtccatgtttccttcacctcagtggagcttctgagttttatactgctcaagatcgtcataaataaaattttttctcattgtcaaaaaaaaattctttg

SEQ ID NO: 440660 - DNA, 1548 bp, Homo sapiens
  misc_feature (18)..(18): n is a, c, g, or t
  misc_feature (38)..(38): n is a, c, g, or t
aaaacctatacggggctntaagggttaagcgagggccncgggcggggtggttagaaagtcggccgagggaaaatggcgctgacgtgagcgcgaactcgcactgcccagagggtggccgccgcctaagctgcagccgccggagccgcagaaacaagaggccgagccgtgtcgaagatggaggagaaaccctcagggcccatcccagacatgctggccactgcagagcccagctccagtgagaccgacaaggaggtgttgtccccggctgtgccagctgcagccccttcctcctccatgtcggaggagccaggccctgagcaggcagccacaccgccagtgtgggaacgtggaggggctggagggatgcggcagggctcctccccagccccagacagctgccagcctggccccggacccagccctggcctgaccagcatagtctccgggaccagcgaggacctgcggcctcccagacgacgcccacctccagggaagcaaatcccttgctccagccctggctgctgcctcagttttcccagcgtccgtgacctggcacagcatctgcgaacccactgcccgcccacacagtccctggaaggcaagctcttccgctgctcagccctgagctgcaccgagaccttccccagcatgcaggagctggtggctcacagcaaactgcactacaaacccaatcgctacttcaagtgtgagaactgcctcctgcgcttccgcacgcaccgctcgctcttcaagcacctgcatgtttgcgcggagcatgcgcagagcccagccccgccgccacccccggccctggaccgagagccgcccgcgccggagcgccccccggaggttgaccccgcatcagcgccgggcctgccgttcccgctgctggaacccttcacgacccccgcccctgcccccaccggaccgttcctgccctacttgaaccctgcgccctttggcctaagccccccgcgcctgcgccccttcctggccgctgcacccgggccgccggcttccagcgccgccgtctggaaaaagagccaaggtgctggcagcagcccccgaagaccccagggcggctccgacgcgccctcagggcacgcggccccgagccgcatcgtgtgggagcacacacgcggccgctactcgtgcatgcagtgcgccttctccacggcctcgcggcccgccatgaccctgcacctggaggaccaccgccccggcgcccccgcggcccccgcggccgggccgccgcgccccgacgcccccgcgggtaaggccgaggaatgcgcgggtggagaggggggcgggggcccaaggcgctgaggctcaggcgcccccctcctctgccccacccagatccggccccgcttgcacccaaggtgtcgccgctgctgtcagagggggagcttccagtgttctcgcagctctgaatcccgccgctttgggggtgggccatgggatgtgggtagttttgtcatttggagggggctgcagggaaggggggctggggtggacaataaagaaggcgccatgagccagcctatg

SEQ ID NO: 440661 - DNA, 1462 bp, Homo sapiens
  misc_feature (18)..(18): n is a, c, g, or t
  misc_feature (38)..(38): n is a, c, g, or t
aaaacctatacggggctntaagggttaagcgagggccncgggcggggtggttagaaagtcggccgagggaaaatggcgctgacgtgagcgcgaactcgcactgcccagagggtggccgccgcctaagctgcagccgccggagccgcagaaacaagaggccgagccgtgtcgaagatggaggagaaaccctcagggcccatcccagacatgctggccactgcagagcccagctccagtgagaccgacaaggaggtgttgtccccggctgtgccagctgcagccccttcctcctccatgtcggaggagccaggccctgagcaggcagccacaccgccagtgtgggaacgtggaggggctggagggatgcggcagggctcctccccagccccagacagctgccagcctggccccggacccagccctggcctgaccagcatagtctccgggaccagcgaggacctgcggcctcccagacgacgcccacctccagggaagcaaatcccttgctccagccctggctgctgcctcagttttcccagcgtccgtgacctggcacagcatctgcgaacccactgcccgcccacacagtccctggaaggcaagctcttccgctgctcagccctgagctgcaccgagaccttccccagcatgcaggagctggtggctcacagcaaactgcactacaaacccaatcgctacttcaagtgtgagaactgcctcctgcgcttccgcacgcaccgctcgctcttcaagcacctgcatgtttgcgcggagcatgcgcagagcccagccccgccgccacccccggccctggaccgagagccgcccgcgccggagcgccccccggaggttgaccccgcatcagcgccgggcctgccgttcccgctgctggaacccttcacgacccccgcccctgcccccaccggaccgttcctgccctacttgaaccctgcgccctttggcctaagccccccgcgcctgcgccccttcctggccgctgcacccgggccgccggcttccagcgccgccgtctggaaaaagagccaaggtgctggcagcagcccccgaagaccccagggcggctccgacgcgccctcagggcacgcggccccgagccgcatcgtgtgggagcacacacgcggccgctactcgtgcatgcagtgcgccttctccacggcctcgcggcccgccatgaccctgcacctggaggaccaccgccccggcgcccccgcggcccccgcggccgggccgccgcgccccgacgcccccgcggatccggccccgcttgcacccaaggtgtcgccgctgctgtcagagggggagcttccagtgttctcgcagctctgaatcccgccgctttgggggtgggccatgggatgtgggtagttttgtcatttggagggggctgcagggaaggggggctggggtggacaataaagaaggcgccatgagccagcctatg

SEQ ID NO: 440662 - DNA, 1245 bp, Homo sapiens
  misc_feature (18)..(18): n is a, c, g, or t
  misc_feature (38)..(38): n is a, c, g, or t
aaaacctatacggggctntaagggttaagcgagggccncgggcggggtggttagaaagtcggccgagggaaaatggcgctgacgtgagcgcgaactcgcactgcccagagggtggccgccgcctaagctgcagccgccggagccgcagaaacaagaggccgagccgtgtcgaagatggaggagaaaccctcagggcccatcccagacatgctggccactgcagagcccagctccagtgagaccgacaaggaggtgttgtccccggctgtgccagctgcagccccttcctcctccatgtcggaggagccaggccctgagcaggcagccacaccgccagtgtgggaacgtggaggggctggagggatgcggcagggctcctccccagccccagacagctgccagcctggccccggacccagccctggcctgaccagcatagtctccgggaccagcgaggacctgcggcctcccagacgacgcccacctccagggaagcaaatcccttgctccagccctggctgctgcctcagttttcccagcgtccgtgacctggcacagcatctgcgaacccactgcccgcccacacagtccctggaaggcaagctcttccgctgctcagccctgagctgcaccgagaccttccccagcatgcaggagctggtggctcacagcaaactgcactacaaacccaatcgctacttcaagtgtgagaactgcctcctgcgcttccgcacgcaccgctcgctcttcaagcacctgcatgtttgcgcggagcatgcgcagagcccagccccgccgccacccccggccctggaccgagagccgcccgcgccggagcgccccccggaggttgaccccgcatcagcgccgggcctgccgttcccgctgctggaacccttcacgacccccgcccctgcccccaccggaccgttcctgccctacttgaaccctgcgccctttggcctaagccccccgcgcctgcgccccttcctggccgctgcacccgggccgccggcttccagcgccgccgtctggaaaaagagccaaggtgctggcagcagcccccgaagaccccagggcggctccgacgcgccctcaggtgcgtgcaggtgaccaccagggaggggtggaggggctttctttcctgcgccctgcggggtccggtggataccaggaggcagcagtgctcatccccttcccagggggcacaaatgccaccgtcccgaaatacaggatttttgcctt

SEQ ID NO: 440663 - DNA, 1235 bp, Homo sapiens
  misc_feature (18)..(18): n is a, c, g, or t
  misc_feature (38)..(38): n is a, c, g, or t
aaaacctatacggggctntaagggttaagcgagggccncgggcggggtggttagaaagtcggccgagggaaaatggcgctgacgtgagcgcgaactcgcactgcccagagggtggccgccgcctaagctgcagccgccggagccgcagaaacaagaggccgagccgtgtcgaagatgggaagcaaatcccttgctccagccctggctgctgcctcagttttcccagcgtccgtgacctggcacagcatctgcgaacccactgcccgcccacacagtccctggaaggcaagctcttccgctgctcagccctgagctgcaccgagaccttccccagcatgcaggagctggtggctcacagcaaactgcactacaaacccaatcgctacttcaagtgtgagaactgcctcctgcgcttccgcacgcaccgctcgctcttcaagcacctgcatgtttgcgcggagcatgcgcagagcccagccccgccgccacccccggccctggaccgagagccgcccgcgccggagcgccccccggaggttgaccccgcatcagcgccgggcctgccgttcccgctgctggaacccttcacgacccccgcccctgcccccaccggaccgttcctgccctacttgaaccctgcgccctttggcctaagccccccgcgcctgcgccccttcctggccgctgcacccgggccgccggcttccagcgccgccgtctggaaaaagagccaaggtgctggcagcagcccccgaagaccccagggcggctccgacgcgccctcagggcacgcggccccgagccgcatcgtgtgggagcacacacgcggccgctactcgtgcatgcagtgcgccttctccacggcctcgcggcccgccatgaccctgcacctggaggaccaccgccccggcgcccccgcggcccccgcggccgggccgccgcgccccgacgcccccgcgggtaaggccgaggaatgcgcgggtggagaggggggcgggggcccaaggcgctgaggctcaggcgcccccctcctctgccccacccagatccggccccgcttgcacccaaggtgtcgccgctgctgtcagagggggagcttccagtgttctcgcagctctgaatcccgccgctttgggggtgggccatgggatgtgggtagttttgtcatttggagggggctgcagggaaggggggctggggtggacaataaagaaggcgccatgagccagcctatg

SEQ ID NO: 440664 - DNA, 2421 bp, Homo sapiens
gcaggctgtacggtcgggattttggaaaatggcgctgacgtgagcgcgaactcgcactgcccagagggtggccgccgcctaagctgcagccgccggagccgcagaaacaagaggccgagccgtgtcgaagatggtgagcgcggcaccggggtcgcgggcgcggcggagctgcggggactggcggggagcggccctgtcgcgcctacagcctccggccgaccccgcccccacatccgggcacccgtccgccgctggctgtcactcggagagcgccctacttccgggcccggcccggaatggaccacgcccgtcaggctaggactccgcccctaaacttcttacatccgggcccccagcacctccaagattgtccacactgctcgaggccggccggtctcggtcctcagacaatccatgtctagctcctctagcatcttcccagtccatgcctgcccatagccccgcctccgtagccttggccccgcccactccctctaggccacgcttgtgtgcatactggggctcccacctatcctagttgaggagagcagatgtttctcccgtatgcataaggagctcaatccgggccagtgcagtggctgacgactctaatcccagcactttgggaggctgaggcaggaggatcacttgagaccaggggttcaagaccagtgagggcaacatggcgagaccccatctttataaaaagaaaaaaagagcttagtccacccttacgtattcccctatcctctcctgctggtgattccttaggatgggggccgactgggttgacccagagcccagaagggttctctccgcctcttccttccaccaggaggagaaaccctcagggcccatcccagacatgctggccactgcagagcccagctccagtgagaccgacaaggaggtgttgtccccggctgtgccagctgcagccccttcctcctccatgtcggaggagccaggccctgagcaggcagccacaccgccagtgtgggaacgtggaggggctggagggatgcggcagggctcctccccagccccagacagctgccagcctggccccggacccagccctggcctgaccagcatagtctccgggaccagcgaggacctgcggcctcccagacgacgcccacctccagggaagcaaatcccttgctccagccctggctgctgcctcagttttcccagcgtccgtgacctggcacagcatctgcgaacccactgcccgcccacacagtccctggaaggcaagctcttccgctgctcagccctgagctgcaccgagaccttccccagcatgcaggagctggtggctcacagcaaactgcactacaaacccaatcgctacttcaagtgagaccctgacctcttgagcccgccctcaactccctggatggggcggggcatacgtgggcgtggccccacccagccaggctttacctcccaagtggaaaaccggccgcctaacttaaaattgagacttctttccgggtttccccgggtttccccaggttcccacccgaagtggtcaggaagggtcgctgccacagttgtacaggagcggggaggtgtgagaactgcctcctgcgcttccgcacgcaccgctcgctcttcaagcacctgcatgtttgcgcggagcatgcgcagagcccagccccgccgccacccccggccctggaccgagagccgcccgcgccggagcgccccccggaggttgaccccgcatcagcgccgggcctgccgttcccgctgctggaacccttcacgacccccgcccctgcccccaccggaccgttcctgccctacttgaaccctgcgccctttggcctaagccccccgcgcctgcgccccttcctggccgctgcacccgggccgccggcttccagcgccgccgtctggaaaaagagccaaggtgctggcagcagcccccgaagaccccagggcggctccgacgcgccctcagggcacgcggccccgagccgcatcgtgtgggagcacacacgcggccgctactcgtgcatgcagtgcgccttctccacggcctcgcggcccgccatgaccctgcacctggaggaccaccgccccggcgcccccgcggcccccgcggccgggccgccgcgccccgacgcccccgcgggtaaggccgaggaatgcgcgggtggagaggggggcgggggcccaaggcgctgaggctcaggcgcccccctcctctgccccacccagatccggccccgcttgcacccaaggtgtcgccgctgctgtcagagggggagcttccagtgttctcgcagctctgaatcccgccgctttgggggtgggccatgggatgtgggtagttttgtcatttggagggggctgcagggaaggggggctggggtggacaataaagaaggcgccatgagccagcctatg

SEQ ID NO: 440665 - DNA, 1473 bp, Homo sapiens
  misc_feature (18)..(18): n is a, c, g, or t
  misc_feature (38)..(38): n is a, c, g, or t
aaaacctatacggggctntaagggttaagcgagggccncgggcggggtggttagaaagtcggccgagggaaaatggcgctgacgtgagcgcgaactcgcactgcccagagggtggccgccgcctaagctgcagccgccggagccgcagaaacaagaggccgagccgtgtcgaagatggaggagaaaccctcagggcccatcccagacatgctggccactgcagagcccagctccagtgagaccgacaaggaggtgttgtccccggctgtgccagctgcagccccttcctcctccatgtcggaggagccaggccctgagcaggcagccacaccgccagtgtgggaacgtggaggggctggagggatgcggcagggctcctccccagccccagacagctgccagcctggccccggacccagccctggcctgaccagcatagtctccgggaccagcgaggacctgcggcctcccagacgacgcccacctccagggaagcaaatcccttgctccagccctggctgctgcctcagttttcccagcgtccgtgacctggcacagcatctgcgaacccactgcccgcccacacagtccctggaaggcaagctcttccgctgctcagccctgagctgcaccgagaccttccccagcatgcaggagctggtggctcacagcaaactgcactacaaacccaatcgctacttcaagtgtgagaactgcctcctgcgcttccgcacgcaccgctcgctcttcaagcacctgcatgtttgcgcggagcatgcgcagagcccagccccgccgccacccccggccctggaccgagagccgcccgcgccggagcgccccccggaggttgaccccgcatcagcgccgggcctgccgttcccgctgctggaacccttcacgacccgccccttcctggccgctgcacccgggccgccggcttccagcgccgccgtctggaaaaagagccaaggtgctggcagcagcccccgaagaccccagggcggctccgacgcgccctcagggcacgcggccccgagccgcatcgtgtgggagcacacacgcggccgctactcgtgcatgcagtgcgccttctccacggcctcgcggcccgccatgaccctgcacctggaggaccaccgccccggcgcccccgcggcccccgcggccgggccgccgcgccccgacgcccccgcgggtaaggccgaggaatgcgcgggtggagaggggggcgggggcccaaggcgctgaggctcaggcgcccccctcctctgccccacccagatccggccccgcttgcacccaaggtgtcgccgctgctgtcagagggggagcttccagtgttctcgcagctctgaatcccgccgctttgggggtgggccatgggatgtgggtagttttgtcatttggagggggctgcagggaaggggggctggggtggacaataaagaaggcgccatgagccagcctatg

SEQ ID NO: 440666 - DNA, 1628 bp, Homo sapiens
  misc_feature (18)..(18): n is a, c, g, or t
  misc_feature (38)..(38): n is a, c, g, or t
aaaacctatacggggctntaagggttaagcgagggccncgggcggggtggttagaaagtcggccgagggaaaatggcgctgacgtgagcgcgaactcgcactgcccagagggtggccgccgcctaagctgcagccgccggagccgcagaaacaagaggccgagccgtgtcgaagatggaggagaaaccctcagggcccatcccagacatgctggccactgcagagcccagctccagtgagaccgacaaggaggtgttgtccccggctgtgccagctgcagccccttcctcctccatgtcggaggagccaggccctgagcaggcagccacaccgccagtgtgggaacgtggaggggctggagggatgcggcagggctcctccccagccccagacagctgccagcctggccccggacccagccctggcctgaccagcatagtctccgggaccagcgaggacctgcggcctcccagacgacgcccacctccagggaagcaaatcccttgctccagccctggctgctgcctcagttttcccagcgtccgtgacctggcacagcatctgcgaacccactgcccgcccacacagtccctggaaggcaagctcttccgctgctcagccctgagctgcaccgagaccttccccagcatgcaggagctggtggctcacagcaaactgcactacaaacccaatcgctacttcaagtgtgagaactgcctcctgcgcttccgcacgcaccgctcgctcttcaagcacctgcatgtttgcgcggagcatgcgcagagcccagccccgccgccacccccggccctggaccgagagccgcccgcgccggagcgccccccggaggttgaccccgcatcagcgccgggcctgccgttcccgctgctggaacccttcacgacccccgcccctgcccccaccggaccgttcctgccctacttgaaccctgcgccctttggcctaagccccccgcgcctgcgccccttcctggccgctgcacccgggccgccggcttccagcgccgccgtctggaaaaagagccaaggtgagtgtggggtcgggggcctccaggagggcgggctgggctcgccctgactctgaacttgacccgcccctttaccgcaggtgctggcagcagcccccgaagaccccagggcggctccgacgcgccctcagggcacgcggccccgagccgcatcgtgtgggagcacacacgcggccgctactcgtgcatgcagtgcgccttctccacggcctcgcggcccgccatgaccctgcacctggaggaccaccgccccggcgcccccgcggcccccgcggccgggccgccgcgccccgacgcccccgcgggtaaggccgaggaatgcgcgggtggagaggggggcgggggcccaaggcgctgaggctcaggcgcccccctcctctgccccacccagatccggccccgcttgcacccaaggtgtcgccgctgctgtcagagggggagcttccagtgttctcgcagctctgaatcccgccgctttgggggtgggccatgggatgtgggtagttttgtcatttggagggggctgcagggaaggggggctggggtggacaataaagaaggcgccatgagccagcctatg

SEQ ID NO: 440667 - DNA, 2225 bp, Homo sapiens
gcaggctgtacggtcgggattttggaaaatggcgctgacgtgagcgcgaactcgcactgcccagagggtggccgccgcctaagctgcagccgccggagccgcagaaacaagaggccgagccgtgtcgaagatggtgagcgcggcaccggggtcgcgggcgcggcggagctgcggggactggcggggagcggccctgtcgcgcctacagcctccggccgaccccgcccccacatccgggcacccgtccgccgctggctgtcactcggagagcgccctacttccgggcccggcccggaatggaccacgcccgtcaggctaggactccgcccctaaacttcttacatccgggcccccagcacctccaagattgtccacactgctcgaggccggccggtctcggtcctcagacaatccatgtctagctcctctagcatcttcccagtccatgcctgcccatagccccgcctccgtagccttggccccgcccactccctctaggccacgcttgtgtgcatactggggctcccacctatcctagttgaggagagcagatgtttctcccgtatgcataaggagctcaatccgggccagtgcagtggctgacgactctaatcccagcactttgggaggctgaggcaggaggatcacttgagaccaggggttcaagaccagtgagggcaacatggcgagaccccatctttataaaaagaaaaaaagagcttagtccacccttacgtattcccctatcctctcctgctggtgattccttaggatgggggccgactgggttgacccagagcccagaagggttctctccgcctcttccttccaccaggaggagaaaccctcagggcccatcccagacatgctggccactgcagagcccagctccagtgagaccgacaaggaggtgttgtccccggctgtgccagctgcagccccttcctcctccatgtcggaggagccaggccctgagcaggcagccacaccgccagtgtgggaacgtggaggggctggagggatgcggcagggctcctccccagccccagacagctgccagcctggccccggacccagccctggcctgaccagcatagtctccgggaccagcgaggacctgcggcctcccagacgacgcccacctccagggaagcaaatcccttgctccagccctggctgctgcctcagttttcccagcgtccgtgacctggcacagcatctgcgaacccactgcccgcccacacagtccctggaaggcaagctcttccgctgctcagccctgagctgcaccgagaccttccccagcatgcaggagctggtggctcacagcaaactgcactacaaacccaatcgctacttcaagtgagaccctgacctcttgagcccgccctcaactccctggatggggcggggcatacgtgggcgtggccccacccagccaggctttacctcccaagtggaaaaccggccgcctaacttaaaattgagacttctttccgggtttccccgggtttccccaggttcccacccgaagtggtcaggaagggtcgctgccgttcccgctgctggaacccttcacgacccccgcccctgcccccaccggaccgttcctgccctacttgaaccctgcgccctttggcctaagccccccgcgcctgcgccccttcctggccgctgcacccgggccgccggcttccagcgccgccgtctggaaaaagagccaaggtgctggcagcagcccccgaagaccccagggcggctccgacgcgccctcagggcacgcggccccgagccgcatcgtgtgggagcacacacgcggccgctactcgtgcatgcagtgcgccttctccacggcctcgcggcccgccatgaccctgcacctggaggaccaccgccccggcgcccccgcggcccccgcggccgggccgccgcgccccgacgcccccgcgggtaaggccgaggaatgcgcgggtggagaggggggcgggggcccaaggcgctgaggctcaggcgcccccctcctctgccccacccagatccggccccgcttgcacccaaggtgtcgccgctgctgtcagagggggagcttccagtgttctcgcagctctgaatcccgccgctttgggggtgggccatgggatgtgggtagttttgtcatttggagggggctgcagggaaggggggctggggtggacaataaagaaggcgccatgagccagcctatg

SEQ ID NO: 440668 - DNA, 2206 bp, Homo sapiens
gcaggctgtacggtcgggattttggaaaatggcgctgacgtgagcgcgaactcgcactgcccagagggtggccgccgcctaagctgcagccgccggagccgcagaaacaagaggccgagccgtgtcgaagatggtgagcgcggcaccggggtcgcgggcgcggcggagctgcggggactggcggggagcggccctgtcgcgcctacagcctccggccgaccccgcccccacatccgggcacccgtccgccgctggctgtcactcggagagcgccctacttccgggcccggcccggaatggaccacgcccgtcaggctaggactccgcccctaaacttcttacatccgggcccccagcacctccaagattgtccacactgctcgaggccggccggtctcggtcctcagacaatccatgtctagctcctctagcatcttcccagtccatgcctgcccatagccccgcctccgtagccttggccccgcccactccctctaggccacgcttgtgtgcatactggggctcccacctatcctagttgaggagagcagatgtttctcccgtatgcataaggagctcaatccgggccagtgcagtggctgacgactctaatcccagcactttgggaggctgaggcaggaggatcacttgagaccaggggttcaagaccagtgagggcaacatggcgagaccccatctttataaaaagaaaaaaagagcttagtccacccttacgtattcccctatcctctcctgctggtgattccttaggatgggggccgactgggttgacccagagcccagaagggttctctccgcctcttccttccaccaggaggagaaaccctcagggcccatcccagacatgctggccactgcagagcccagctccagtgagaccgacaaggaggtgttgtccccggctgtgccagctgcagccccttcctcctccatgtcggaggagccaggccctgagcaggcagccacaccgccagtgtgggaacgtggaggggctggagggatgcggcagggctcctccccagccccagacagctgccagcctggccccggacccagccctggcctgaccagcatagtctccgggaccagcgaggacctgcggcctcccagacgacgcccacctccagggaagcaaatcccttgctccagccctggctgctgcctcagttttcccagcgtccgtgacctggcacagcatctgcgaacccactgcccgcccacacagtccctggaaggcaagctcttccgctgctcagccctgagctgcaccgagaccttccccagcatgcaggagctggtggctcacagcaaactgcactacaaacccaatcgctacttcaagtgtgagaactgcctcctgcgcttccgcacgcaccgctcgctcttcaagcacctgcatgtttgcgcggagcatgcgcagagcccagccccgccgccacccccggccctggaccgagagccgcccgcgccggagcgccccccggaggttgaccccgcatcagcgccgggcctgccgttcccgctgctggaacccttcacgacccccgcccctgcccccaccggaccgttcctgccctacttgaaccctgcgccctttggcctaagccccccgcgcctgcgccccttcctggccgctgcacccgggccgccggcttccagcgccgccgtctggaaaaagagccaaggtgctggcagcagcccccgaagaccccagggcggctccgacgcgccctcagggcacgcggccccgagccgcatcgtgtgggagcacacacgcggccgctactcgtgcatgcagtgcgccttctccacggcctcgcggcccgccatgaccctgcacctggaggaccaccgccccggcgcccccgcggcccccgcggccgggccgccgcgccccgacgcccccgcgggtaaggccgaggaatgcgcgggtggagaggggggcgggggcccaaggcgctgaggctcaggcgcccccctcctctgccccacccagatccggccccgcttgcacccaaggtgtcgccgctgctgtcagagggggagcttccagtgttctcgcagctctgaatcccgccgctttgggggtgggccatgggatgtgggtagttttgtcatttggagggggctgcagggaaggggggctggggtggacaataaagaaggcgccatgagccagcctatg

SEQ ID NO: 440669 - DNA, 1729 bp, Homo sapiens
  misc_feature (18)..(18): n is a, c, g, or t
  misc_feature (38)..(38): n is a, c, g, or t
aaaacctatacggggctntaagggttaagcgagggccncgggcggggtggttagaaagtcggccgagggaaaatggcgctgacgtgagcgcgaactcgcactgcccagagggtggccgccgcctaagctgcagccgccggagccgcagaaacaagaggccgagccgtgtcgaagatggtgagcgcggcaccggggtcgcgggcgcggcggagctgcggggactggcggggagcggccctgtcgcgcctacagcctccggccgaccccgcccccacatccgggcacccgtccgccgctggctgtcactcggagagcgccctacttccgggcccggcccggaatggaccacgcccgtcaggaggagaaaccctcagggcccatcccagacatgctggccactgcagagcccagctccagtgagaccgacaaggaggtgttgtccccggctgtgccagctgcagccccttcctcctccatgtcggaggagccaggccctgagcaggcagccacaccgccagtgtgggaacgtggaggggctggagggatgcggcagggctcctccccagccccagacagctgccagcctggccccggacccagccctggcctgaccagcatagtctccgggaccagcgaggacctgcggcctcccagacgacgcccacctccagggaagcaaatcccttgctccagccctggctgctgcctcagttttcccagcgtccgtgacctggcacagcatctgcgaacccactgcccgcccacacagtccctggaaggcaagctcttccgctgctcagccctgagctgcaccgagaccttccccagcatgcaggagctggtggctcacagcaaactgcactacaaacccaatcgctacttcaagtgtgagaactgcctcctgcgcttccgcacgcaccgctcgctcttcaagcacctgcatgtttgcgcggagcatgcgcagagcccagccccgccgccacccccggccctggaccgagagccgcccgcgccggagcgccccccggaggttgaccccgcatcagcgccgggcctgccgttcccgctgctggaacccttcacgacccccgcccctgcccccaccggaccgttcctgccctacttgaaccctgcgccctttggcctaagccccccgcgcctgcgccccttcctggccgctgcacccgggccgccggcttccagcgccgccgtctggaaaaagagccaaggtgctggcagcagcccccgaagaccccagggcggctccgacgcgccctcagggcacgcggccccgagccgcatcgtgtgggagcacacacgcggccgctactcgtgcatgcagtgcgccttctccacggcctcgcggcccgccatgaccctgcacctggaggaccaccgccccggcgcccccgcggcccccgcggccgggccgccgcgccccgacgcccccgcgggtaaggccgaggaatgcgcgggtggagaggggggcgggggcccaaggcgctgaggctcaggcgcccccctcctctgccccacccagatccggccccgcttgcacccaaggtgtcgccgctgctgtcagagggggagcttccagtgttctcgcagctctgaatcccgccgctttgggggtgggccatgggatgtgggtagttttgtcatttggagggggctgcagggaaggggggctggggtggacaataaagaaggcgccatgagccagcctatg

SEQ ID NO: 440670 - DNA, 2009 bp, Homo sapiens
  misc_feature (18)..(18): n is a, c, g, or t
  misc_feature (38)..(38): n is a, c, g, or t
aaaacctatacggggctntaagggttaagcgagggccncgggcggggtggttagaaagtcggccgagggaaaatggcgctgacgtgagcgcgaactcgcactgcccagagggtggccgccgcctaagctgcagccgccggagccgcagaaacaagaggccgagccgtgtcgaagatggaggagaaaccctcagggcccatcccagacatgctggccactgcagagcccagctccagtgagaccgacaaggaggtgttgtccccggctgtgccagctgcagccccttcctcctccatgtcggaggagccaggccctgagcaggcagccacaccgccagtgtgggaacgtggaggggctggagggatgcggcagggctcctccccagccccagacagctgccagcctggccccggacccagccctggcctgaccagcatagtctccgggaccagcgaggacctgcggcctcccagacgacgcccacctccagggaagcaaatcccttgctccagccctggctgctgcctcagttttcccagcgtccgtgacctggcacagcatctgcgaacccactgcccgcccacacagtccctggaaggcaagctcttccgctgctcagccctgagctgcaccgagaccttccccagcatgcaggagctggtggctcacagcaaactgcactacaaacccaatcgctacttcaagtgtgagaactgcctcctgcgcttccgcacgcaccgctcgctcttcaagcacctgcatgtttgcgcggagcatgcgcagagcccagccccgccgccacccccggccctggaccgagagccgcccgcgccggagcgccccccggaggttgaccccgcatcagcgccgggcctgccgttcccgctgctggaacccttcacgacccccgcccctgcccccaccggaccgttcctgccctacttgaaccctgcgccctttggcctaagccccccgcgcctgcgccccttcctggccgctgcacccgggccgccggcttccagcgccgccgtctggaaaaagagccaaggtgctggcagcagcccccgaagaccccagggcggctccgacgcgccctcaggtgcgtgcaggtgaccaccagggaggggtggaggggctttctttcctgcgccctgcggggtccggtggataccaggaggcagcagtgctcatccccttcccagggggcacaaatgccaccgtcccgaaatacaggatttttgccttaaaaatgactggcacctgcgccttcatctgcgccggcgttcccgtataaaccttgcgcccctttcaccgttcacctcggagcgggcttctccccaacagtgaatctggggatgatagtaggggacgcggagaagccaagttgggtgcccccaactctaggggcagacagacccgggagaaactgaactaggcgcccggaagctgatggggggcgggaaaaagtcccacccaccctcgccggcgtcctccatccttggcgcacgggtcttctgggctgggggagcccgggactgacggggtcccgcctgcccgcagggcacgcggccccgagccgcatcgtgtgggagcacacacgcggccgctactcgtgcatgcagtgcgccttctccacggcctcgcggcccgccatgaccctgcacctggaggaccaccgccccggcgcccccgcggcccccgcggccgggccgccgcgccccgacgcccccgcgggtaaggccgaggaatgcgcgggtggagaggggggcgggggcccaaggcgctgaggctcaggcgcccccctcctctgccccacccagatccggccccgcttgcacccaaggtgtcgccgctgctgtcagagggggagcttccagtgttctcgcagctctgaatcccgccgctttgggggtgggccatgggatgtgggtagttttgtcatttggagggggctgcagggaaggggggctggggtggacaataaagaaggcgccatgagccagcctatg

SEQ ID NO: 440671 - DNA, 1500 bp, Homo sapiens
  misc_feature (18)..(18): n is a, c, g, or t
  misc_feature (38)..(38): n is a, c, g, or t
aaaacctatacggggctntaagggttaagcgagggccncgggcggggtggttagaaagtcggccgagggaaaatggcgctgacgtgagcgcgaactcgcactgcccagagggtggccgccgcctaagctgcagccgccggagccgcagaaacaagaggccgagccgtgtcgaagatggaggagaaaccctcagggcccatcccagacatgctggccactgcagagcccagctccagtgagaccgacaaggaggtgttgtccccggctgtgccagctgcagccccttcctcctccatgtcggaggagccaggccctgagcaggcagccacaccgccagtgtgggaacgtggaggggctggagggatgcggcagggctcctccccagccccagacagctgccagcctggccccggacccagccctggcctgaccagcatagtctccgggaccagcgaggacctgcggcctcccagacgacgcccacctccagggaagcaaatcccttgctccagccctggctgctgcctcagttttcccagcgtccgtgacctggcacagcatctgcgaacccactgcccgcccacacagtccctggaaggcaagctcttccgctgctcagccctgagctgcaccgagaccttccccagcatgcaggagctggtggctcacagcaaactgcactacaaacccaatcgctacttcaagtgtgagaactgcctcctgcgcttccgcacgcaccgctcgctcttcaagcacctgcatgtttgcgcggagcatgcgcagagcccagccccgccgccacccccggccctggaccgagagccgcccgcgccggagcgccccccggaggttgaccccgcatcagcgccgggcctgccgttcccgctgctggaacccttcacgacccccgcccctgcccccaccggaccgttccgccccttcctggccgctgcacccgggccgccggcttccagcgccgccgtctggaaaaagagccaaggtgctggcagcagcccccgaagaccccagggcggctccgacgcgccctcagggcacgcggccccgagccgcatcgtgtgggagcacacacgcggccgctactcgtgcatgcagtgcgccttctccacggcctcgcggcccgccatgaccctgcacctggaggaccaccgccccggcgcccccgcggcccccgcggccgggccgccgcgccccgacgcccccgcgggtaaggccgaggaatgcgcgggtggagaggggggcgggggcccaaggcgctgaggctcaggcgcccccctcctctgccccacccagatccggccccgcttgcacccaaggtgtcgccgctgctgtcagagggggagcttccagtgttctcgcagctctgaatcccgccgctttgggggtgggccatgggatgtgggtagttttgtcatttggagggggctgcagggaaggggggctggggtggacaataaagaaggcgccatgagccagcctatg

SEQ ID NO: 440672 - DNA, 891 bp, Homo sapiens
ggtccccctggaggcccagcccagcccaggcctctgcccacctccaggtgtgagaactgcctcctgcgcttccgcacgcaccgctcgctcttcaagcacctgcatgtttgcgcggagcatgcgcagagcccagccccgccgccacccccggccctggaccgagagccgcccgcgccggagcgccccccggaggttgaccccgcatcagcgccgggcctgccgttcccgctgctggaacccttcacgacccccgcccctgcccccaccggaccgttcctgccctacttgaaccctgcgccctttggcctaagccccccgcgcctgcgccccttcctggccgctgcacccgggccgccggcttccagcgccgccgtctggaaaaagagccaaggtgctggcagcagcccccgaagaccccagggcggctccgacgcgccctcagggcacgcggccccgagccgcatcgtgtgggagcacacacgcggccgctactcgtgcatgcagtgcgccttctccacggcctcgcggcccgccatgaccctgcacctggaggaccaccgccccggcgcccccgcggcccccgcggccgggccgccgcgccccgacgcccccgcgggtaaggccgaggaatgcgcgggtggagaggggggcgggggcccaaggcgctgaggctcaggcgcccccctcctctgccccacccagatccggccccgcttgcacccaaggtgtcgccgctgctgtcagagggggagcttccagtgttctcgcagctctgaatcccgccgctttgggggtgggccatgggatgtgggtagttttgtcatttggagggggctgcagggaaggggggctggggtggacaataaagaaggcgccatgagccagcctatg

SEQ ID NO: 440673 - DNA, 1324 bp, Homo sapiens
  misc_feature (559)..(559): n is a, c, g, or t
aaaaagtaatggtaatacatgtttcttgtgaagggaaaataaacaaggtccagttttattttactagatagcaaataaaaaaaaaaagagggattagtgatttcagtcttttagaaatggttggcatctctctgccttagttcttacctcacttgtaaaggattgagttcttccttaatgttttctcctggtatgagaatgtggttatattctttcttaggtaattgatatgaatctaacctagtttttttttttgtttttttttagttactttaagttgaaatgtaaaggagcagttggttctgtacatttccaagcttctctgtaataattgatcattacaatgatgaccctaaagcatcaggaaaatactgtatactatatgctcagagatatatatatgtatatatatatatatatttgatggagtctcactgtcgaccaggctggagtgcagtggtgtagtctaggctcactgcaacttctgcctccccgggtttaagtgattctcctgcgtcaccctcttgagtagctgggactacaggtgtgcaccaccacncccagctaatttttgtgtttttagtagagatggggtttcaccatgttggccaggctggtcttgaactcctgacttcaagtgatccactggccttggcctcccaagtctgggatttcaggtgtgagtcactgcacccggcctatttttctaaaaaaaaaaaaaaaaagaaaaaaaaatctggaaagagggagctgccttacatttcagtctatatttattagactcctaatgtacatttctctctcactttctttattttgaaaaacaaagtactattcagtaaagagcctgaaactgcttcagtccaagctgattttgaatgcataaagatttacttgttggattcagtaaaaaaggaataagaaaaacttactatatagtaatttttcctaggtatatgacctcaaaattgtgcttagatgccattgaaatagatgttcatgttttccattccactcaacaaatatcacttaaaaacagtacagttggtgatttcttacagaaatcataaatatgtactgcggagtgaaaaaaccaactacttaactatgatgaaatgggaacttttggttaaatttgtagggataggccaggtgcagtggctcatgcgtgtaatcccagaactttgggaagccaaggcgggcagatcacctgaggtcaggctggtcttgaactcctgacttcaagtgatccactggccttggcctccctagtctgggatttcaggtgtgagtcactgcacccggcctatttttctaaaaaaag

SEQ ID NO: 440674 - DNA, 1444 bp, Homo sapiens
attgacctcaaaattgtgcttagatgccattgaaatagatgttcatgttttccattccactcaacaaatatcacttaaaaacagtacagttggtgatttcttacagaaatcataaatatgtactgcggagtgaaaaaaccaactacttaactatgatgaaatgggaacttttggttaaatttgtagggataggccaggtgcagtggctcatgcgtgtaatcccagaactttgggaagccaaggctggtcttgaactcctgacttcaagtgatccactggccttggcctcccaagtctgggatttcaggtgtgagtcactgcacccggcctatttttctaaaaaaaaaaaaaaaaagaaaaaaaaatctggaaagagggagctgccttacatttcagtctatatttattagactcctaatgtacatttctctctcactttctttattttgaaaaacaaagtactattcagtaaagagcctgaaactgcttcagtccaagctgattttgaatgcataaagatttacttgttggattcagtaaaaaaggaataagaaaaacttactatatagtaatttttcctaggtatatgacctcaaaattgtgcttagatgccattgaaatagatgttcatgttttccattccactcaacaaatatcacttaaaaacagtacagttggtgatttcttacagaaatcataaatatgtactgcggagtgaaaaaaccaactacttaactatgatgaaatgggaacttttggttaaatttgtagggataggccaggtgcagtggctcatgcgtgtaatcccagaactttgggaagccaaggcgggcagatcacctgaggtcaggagttcgacaccagcctggccaacatggtgaaacccggtctctactaaaaatacaaagataagctgggcatgatggcggatgcctgtaatcccagctgctcgggaggctgaggcaggagaatcccttgaacccgggaggcgaaggttgcagtgagccgagttcacgccactgcattccagcctgggcgacagaacaagactccatctcaaaaaaaaaaaaaaaaaaaaaattacagggataaatttgcagtggtaacattttacacatatgcaaaaagtgctgtatctcaaacagtttaggtggaaatgagtatgatttgctttcagaatgtgtgttaggtgactcagaaagtgacttcaatgataaggaatgcactggtttcgaatatatgcataaagattttgaatgaaggtgttttgtgaaacgttaagtaaggtaggagaaaaatcagtattttgaaattatgatttattattttaagcctcctaaattaatttgcatttcagaagtaaacatctggtgtttggtctatatctctaaaagtgtatagtcaagttggtcagaaaacattgtttttatgttcttattagaaa

SEQ ID NO: 440675 - DNA, 1047 bp, Homo sapiens
gcacaggagggcgggctaaagaggtcgcggtcgcacgcgcagttggtccttagtactgcggccgtgtgggtgagttggctgccggtgagttgggtgccggtggagtcgtgttggtcctcagaatccccgcgtagccgctgcctcctcctaccctcgccatgtttcttacccggtctgagtacgacaggggcgtgaatactttttctcccgaaggaagattatttcaagtggaatatgccattgaggctatcaagcttggttctacagccattgggatccagacatcagagggtgtgtgcctagctgtggagaagagaattacttccccactgatggagcccagcagcattgagaaaattgtagagattgatgctcacataggttgtgccatgagtgggctaattgctgatgctaagactttaattgataaagccagagtggagacacagaaccactggttcacctacaatgagacaatgacagtggagagtgtgacccaagctgtgtccaatctggctttgcagtttggagaagaagatgcagatccaggtgccatgtctcgtccctttggagtagcattattatttggaggagttgatgagaaaggaccccagctgtttcatatggacccatctgggacctttgtacagtgtgatgctcgagcaattggctctgcttcagagggtgcccagagctccttgcaagaagtttaccacaagtctatgactttgaaagaagccatcaagtcttcactcatcatcctcaaacaagtaatggaggagaagctgaatgcaacaaacattgagctagccacagtgcagcctggccagaatttccacatgttcacaaaggaagaacttgaagaggttatcaaggacatttaaggaatcctgatcctcagaacttctctgggacaatttcagttctaataatgtccttaaattttatttccagctcctgttccttggaaaatctccattgtatgtgcattttttaaatgatgtctgtacataaaggcagttctgaaataaagaaaattttaaaata

SEQ ID NO: 440676 - DNA, 821 bp, Homo sapiens
gcacaggagggcgggctaaagaggtcgcggtcgcacgcgcagttggtccttagtactgcggccgtgtgggtgagttggctgccggtgagttgggtgccggtggagtcgtgttggtcctcagaatccccgcgtagccgctgcctcctcctaccctcgccatgtttcttacccggtctgagtacgacaggggcgtgaatactttttctcccgaaggaagattatttcaagtggaatatgccattgaggctatcaagcttggttctacagccattgggatccagacatcagagggtgtgtgcctagctgtggagaagagaattacttccccactgatggagcccagcagcattgagaaaattgtagagattgatgctcacataggttgtgccatgagtgggctaattgctgatgctaagactttaattgataaagccagagtggagacacagaaccactggttcacctacaatgagacaatgacagtggagagtgtgacccaagctgtgtccaatctggctttgcagtttggagaagaagatgcagatccaggtgccatgtctcgtccctttggagtagcattattatttggaggagttgatgagaaaggaccccagctgtttcatatggacccatctgggacctttgtacagtgtgatgctcgagcaattggctctgcttcagagggtgcccagagctccttgcaagaagtttaccacaaggctttgattttgaaaaaagcctcaagggtttccttattattcctaaacagtaagggggggggctgatgcacctttgtgttaccccacgggagccggcctttc

SEQ ID NO: 440677 - DNA, 729 bp, Homo sapiens
  misc_feature (623)..(623): n is a, c, g, or t
gcacaggagggcgggctaaagaggtcgcggtcgcacgcgcagttggtccttagtactgcggccgtgtgggtgagttggctgccggtgagttgggtgccggtggagtcgtgttggtcctcagaatccccgcgtagccgctgcctcctcctaccctcgccatgtttcttacccggtctgagtacgacaggggcgtgaatactttttctcccgaaggaagattatttcaagtggaatatgccattgaggctatcaagcttggttctacagccattgggatccagacatcagagggtgtgtgcctagctgtggagaagagaattacttccccactgatggagcccagcagcattgagaaaattgtagagattgatgctcacataggttgtgccatgagtgggctaattgctgatgctaagactttaattgataaagccagagtggagacacaggtaaaattggcattatctcccttattagaaggttgtaccatgctttgctcttcttctagaaccactggttcacctacaatgagacaatgacagtggagagtgtgacccaagctgtgtccaatctggctttgcagtttggagaagaagatgcagatccaggtgccatgtctcggnccctttgagaggcatattattttgaggaggtgtgagagaagagcccactgtttcatatgggaccatcttggaacttttgcagtgggtgcttcagctggtcttgttt

SEQ ID NO: 440678 - DNA, 635 bp, Homo sapiens
cacacacaagctcaacttttaagtatttaaatatacttcaaatatatttctaaaggagtctttaacagaaaaaagtactgactccatgtactttgctgctgcttttgtgatccctgttgaagtgacttcaagaagtgacaatgatgccaggcatttggttaagtatgatgtggtgagttaaccttaaaatagaaaatttggtcaataagcatttttattttggagccagagagctattttagggacctgctgcctggaaaggatatccttgggacagcagatcccttagttcctaatgaatagctgcatcaccaacacagcttctcctgaccatggtagggccatcagcagggtaactcagcccagcttattaacccttctgttttctttccagctagccacagtgcagcctggccagaatttccacatgttcacaaaggaagaacttgaagaggttatcaaggacatttaaggaatcctgatcctcagaacttctctgggacaatttcagttctaataatgtccttaaattttatttccagctcctgttccttggaaaatctccattgtatgtgcattttttaaatgatgtctgtacataaaggcagttctgaaataaagaaaattttaaaata

SEQ ID NO: 440679 - DNA, 532 bp, Homo sapiens
gtttgggggttttttttcctgaaaaaatgtattctacttatttgccatttacttgagttctggagatacttgtaatgcaccatactaagtaagatgtttgacatacttgctaaatacttttttcagtgagataaagggaaaatcttgaaggaaggacggattgtgcataattaataggcatcttcttgccttctttgtttcaagtctatgactttgaaagaagccatcaagtcttcactcatcatcctcaaacaagtaatggaggagaagctgaatgcaacaaacattgagctagccacagtgcagcctggccagaatttccacatgttcacaaaggaagaacttgaagaggttatcaaggacatttaaggaatcctgatcctcagaacttctctgggacaatttcagttctaataatgtccttaaattttatttccagctcctgttccttggaaaatctccattgtatgtgcattttttaaatgatgtctgtacataaaggcagttctgaaataaagaaaattttaaaata

SEQ ID NO: 440680 - DNA, 555 bp, Homo sapiens
gtttgggggttttttttcctgaaaaaatgtattctacttatttgccatttacttgagttctggagatacttgtaatgcaccatactaagtaagatgtttgacatacttgctaaatacttttttcagtgagataaagggaaaatcttgaaggaaggacggattgtgcataattaataggcatcttcttgccttctttgtttcaagtctatgactttgaaagaagccatcaagtcttcactcatcatcctcaaacaagtaatggaggagaagctgaatgcaacaaacattgagctagccacagtgcagcctggccagaatttccacatgttcacaaaggaagaacttgaagaggttatcaaggacatttaaggaatcctgatcctcagaacttctctgggacaatttcagttctaataatgtccttaaattttatttccagctcctgttccttggaaaatctccattgtatgtgcattttttaaatgatgtctgtacataaaggcagttctgaaataaagaaaattttaaaataatatttgttaatagactgttctc

SEQ ID NO: 440681 - DNA, 408 bp, Homo sapiens
cacacacaagctcaacttttaagtatttaaatatacttcaaatatatttctaaaggagtctttaacagaaaaaagtactgactccatgtactttgctgctgcttttgtgatccctgttgaagtgacttcaagaagtgacaatgatgccaggcatttggttaagtatgctagccacagtgcagcctggccagaatttccacatgttcacaaaggaagaacttgaagaggttatcaaggacatttaaggaatcctgatcctcagaacttctctgggacaatttcagttctaataatgtccttaaattttatttccagctcctgttccttggaaaatctccattgtatgtgcattttttaaatgatgtctgtacataaaggcagttctgaaataaagaaaattttaaaata

SEQ ID NO: 440682 - DNA, 690 bp, Homo sapiens
tatgggaagaggataaggaaaaatgcacattttcttggaaattggctgatagttttgaggcatgaacttaccaaaggaactggtaagtctattcagaatggatccaagttgattcaggattgaggcagaaaagtcatttgctctcatttcatcaatttgggaagactttctgggagtgaggcagaagtgttctatatataggttccattgccttgagaaactgttaatgtacaaaaaaatgctacagattgttgtgggcgaagtagagaataatgacaatgtgcgtattctgtagctatctgagctagttgtcaaggaacttgaattcagtgtctacatggctagtttttatgagtataattaataatttttttttaaattataggggcgtgaatactttttctcccgaaggaagattatttcaagtggaatatgccattgaggctatcaaggtatagtagcaagtagcataggtcctgaaatttcatggctacctaacattttgctggcagaacacttggagtaaatgtggtttaaccattcctttagaaaatgttcttatatccctttaagcaaccactgttaaccatttttataacagtttcaatcctattcctaatatctattttaaaactttttgagcagtaactgcttcataattatctaaatagcttttctcactgtgggggt

SEQ ID NO: 440683 - DNA, 1417 bp, Homo sapiens
gcacaggagggcgggctaaagaggtcgcggtcgcacgcgcagttggtccttagtactgcggccgtgtgggtgagttggctgccggtgagttgggtgccggtggagtcgtgttggtcctcagaatccccgcgtagccgctgcctcctcctaccctcgccatgtttcttacccggtctgagtacgacaggggcgtgaatactttttctcccgaaggaagattatttcaagtggaatatgccattgaggctatcaagcttggttctacagccattgggatccagacatcagagggtgtgtgcctagctgtggagaagagaattacttccccactgatggagcccagcagcattgagaaaattgtagagattgatgctcacataggttgtgccatgagtgggctaattgctgatgctaagactttaattgataaagccagagtggagacacagaaccactggttcacctacaatgagacaatgacagtggagagtgtgacccaagctgtgtccaatctggctttgcagtttggagaagaagatgcagatccaggtgccatgtctcgtccctttggagtagcattattatttggaggagttgatgagaaaggaccccagctgtttcatatggacccatctgggacctttgtacagtgtgatgctcgagcaattggctctgcttcagagggtgcccagagctccttgcaagaagtttaccacaagtctatgactttgaaagaagccatcaagtcttcactcatcatcctcaaacaagtaatggaggagaagctgaatgcaacaaacattgagctagccacagtgcagcctggccagaatttccacatgttcacaaaggaagaacttgaagaggttatcaaggacatttaaggaatcctgatcctcagaacttctctgggacaatttcagttctaataatgtccttaaattttatttccagctcctgttccttggaaaatctccattgtatgtgcattttttaaatgatgtctgtacataaaggcagttctgaaataaagaaaattttaaaataaaaaaaaaaaaaaaaaaaaaaaaaaaaaacacttggttggggggccttgggcccttggaggaagggtttaaagacacaatcggatgggagagggggcccccacgtagggtgcacagtggagacacattgggcaaaagaggggtcccacaaggagaaactcgggggccaagggccaacggcgccggagatctcaccccaattaaaaaaagcccgagggaagaacaacccaagcgaggcgcatcagggaaaaaaaatctcaaaaagtgaggagcaccagaaaagcaccatacggggactctaccacacaacagggaggcacaaagagaagaacccccaatcgaccaataaaaacgcccgcgtccggggggga

SEQ ID NO: 440684 - DNA, 1100 bp, Homo sapiens
gcacaggagggcgggctaaagaggtcgcggtcgcacgcgcagttggtccttagtactgcggccgtgtgggtgagttggctgccggtgagttgggtgccggtggagtcgtgttggtcctcagaatccccgcgtagccgctgcctcctcctaccctcgccatgtttcttacccggtctgagtacgacaggggcgtgaatactttttctcccgaaggaagattatttcaagtggaatatgccattgaggctatcaagcttggttctacagccattgggatccagacatcagagggtgtgtgcctagctgtggagaagagaattacttccccactgatggagcccagcagcattgagaaaattgtagagattgatgctcacataggttgtgccatgagtgggctaattgctgatgctaagactttaattgataaagccagagtggagacacagaaccactggttcacctacaatgagacaatgacagtggagagtgtgacccaagctgtgtccaatctggctttgcagtttggagaagaagatgcagatccaggtgccatgtctcgtccctttggagtagcattattatttggaggagttgatgagaaaggaccccagctgtttcatatggacccatctgggacctttgtacagtgtgatgctcgagcaattggctctgcttcagagggtgcccagagctccttgcaagaagtttaccacaagtctatgactttgaaagaagccatcaagtcttcactcatcatcctcaaacaagtaatggaggagaagctgaatgcaacaaacattgagctagccacagtgcagcctggccagaatttccacatgttcacaaaggaagaacttgaagaggttatcaaggacatttaaggaatcctgatcctcagaacttctctgggacaatttcagttctaataatgtccttaaattttatttccagctcctgttccttggaaaatctccattgtatgtgcattttttaaatgatgtctgtacataaaggcagttctgaaataaagaaaattttaaaataaataaaaaaaagggtagcggcagctttcctctttttttacactaaatataaaa

SEQ ID NO: 440685 - DNA, 936 bp, Homo sapiens
gcacaggagggcgggctaaagaggtcgcggtcgcacgcgcagttggtccttagtactgcggccgtgtgggtgagttgggcgtgaatactttttctcccgaaggaagattatttcaagtggaatatgccattgaggctatcaagcttggttctacagccattgggatccagacatcagagggtgtgtgcctagctgtggagaagagaattacttccccactgatggagcccagcagcattgagaaaattgtagagattgatgctcacataggttgtgccatgagtgggctaattgctgatgctaagactttaattgataaagccagagtggagacacagaaccactggttcacctacaatgagacaatgacagtggagagtgtgacccaagctgtgtccaatctggctttgcagtttggagaagaagatgcagatccaggtgccatgtctcgtccctttggagtagcattattatttggaggagttgatgagaaaggaccccagctgtttcatatggacccatctgggacctttgtacagtgtgatgctcgagcaattggctctgcttcagagggtgcccagagctccttgcaagaagtttaccacaagtctatgactttgaaagaagccatcaagtcttcactcatcatcctcaaacaagtaatggaggagaagctgaatgcaacaaacattgagctagccacagtgcagcctggccagaatttccacatgttcacaaaggaagaacttgaagaggttatcaaggacatttaaggaatcctgatcctcagaacttctctgggacaatttcagttctaataatgtccttaaattttatttccagctcctgttccttggaaaatctccattgtatgtgcattttttaaatgatgtctgtacataaaggcagttctgaaataaagaaaattttaaaata

SEQ ID NO: 440686 - DNA, 993 bp, Homo sapiens
gcacaggagggcgggctaaagaggtcgcggtcgcacgcgcagttggtccttagtactgcggccgtgtgggtgagttggctgccggtgagttgggtgccggtggagtcgtgttggtcctcagaatccccgcgtagccgctgcctcctcctaccctcgccatgtttcttacccggtctgagtacgacaggggcgtgaatactttttctcccgaaggaagattatttcaagtggaatatgccattgaggctatcaagcttggttctacagccattgggatccagacatcagagggtgtgtgcctagctgtggagaagagaattacttccccactgatggagcccagcagcattgaggatgctaagactttaattgataaagccagagtggagacacagaaccactggttcacctacaatgagacaatgacagtggagagtgtgacccaagctgtgtccaatctggctttgcagtttggagaagaagatgcagatccaggtgccatgtctcgtccctttggagtagcattattatttggaggagttgatgagaaaggaccccagctgtttcatatggacccatctgggacctttgtacagtgtgatgctcgagcaattggctctgcttcagagggtgcccagagctccttgcaagaagtttaccacaagtctatgactttgaaagaagccatcaagtcttcactcatcatcctcaaacaagtaatggaggagaagctgaatgcaacaaacattgagctagccacagtgcagcctggccagaatttccacatgttcacaaaggaagaacttgaagaggttatcaaggacatttaaggaatcctgatcctcagaacttctctgggacaatttcagttctaataatgtccttaaattttatttccagctcctgttccttggaaaatctccattgtatgtgcattttttaaatgatgtctgtacataaaggcagttctgaaataaagaaaattttaaaata

SEQ ID NO: 440687 - DNA, 699 bp, Homo sapiens
ttcagttttcaatcccagtttaaagggatgtgcgtagtgagatggtgggctgctttaatgtccttattagaaggttgtaccatgctttgctcttcttctagaaccactggttcacctacaatgagacaatgacagtggagagtgtgacccaagctgtgtccaatctggctttgcagtttggagaagaagatgcagatccaggtgccatgtctcgtccctttggagtagcattattatttggaggagttgatgagaaaggaccccagctgtttcatatggacccatctgggacctttgtacagtgtgatgctcgagcaattggctctgcttcagagggtgcccagagctccttgcaagaagtttaccacaagtctatgactttgaaagaagccatcaagtcttcactcatcatcctcaaacaagtaatggaggagaagctgaatgcaacaaacattgagctagccacagtgcagcctggccagaatttccacatgttcacaaaggaagaacttgaagaggttatcaaggacatttaaggaatcctgatcctcagaacttctctgggacaatttcagttctaataatgtccttaaattttatttccagctcctgttccttggaaaatctccattgtatgtgcattttttaaatgatgtctgtacataaaggcagttctgaaataaagaaaattttaaaata

SEQ ID NO: 440688 - DNA, 487 bp, Homo sapiens
gcacaggagggcgggctaaagaggtcgcggtcgcacgcgcagttggtccttagtactgcggccgtgtgggtgagttggctgccggtgagttgggtgccggtggagtcgtgttggtcctcagaatccccgcgtagccgctgcctcctcctaccctcgccatgtttcttacccggtctgagtacgacaggggcgtgaatactttttctcccgaaggaagattatttcaagtggaatatgccattgaggctatcaagcttggttctacagccattgggatccagacatcagagggtgtgtgcctagctgtggagaagagaattacttccccactgatggagcccagcagcattgagaaaattgtagagattgatgctcacatagattatctttgtattccttgttgcctctgcccacttttttggtctttaattcccctgccttggcttctgacatcattgtataatagtattacagggtgagtaattct

SEQ ID NO: 440689 - DNA, 514 bp, Homo sapiens
ctctataggatcccccactactggccatggctaggtttatagatagatgtggtgagttaaccttaaaatagaaaatttggtcaataagcatttttattttggagccagagagctattttagggacctgctgcctggaaaggatatccttgggacagcagatcccttagttcctaatgaatagctgcatcaccaacacagcttctcctgaccatggtagggccatcagcagggtaactcagcccagcttattaacccttctgttttctttccagctagccacagtgcagcctggccagaatttccacatgttcacaaaggaagaacttgaagaggttatcaaggacatttaaggaatcctgatcctcagaacttctctgggacaatttcagttctaataatgtccttaaattttatttccagctcctgttccttggaaaatctccattgtatgtgcattttttaaatgatgtctgtacataaaggcagttctgaaataaagaaaattttaaaata

SEQ ID NO: 440690 - DNA, 581 bp, Homo sapiens
cacacacaagctcaacttttaagtatttaaatatacttcaaatatatttctaaaggagtctttaacagaaaaaagtactgactccatgtactttgctgctgcttttgtgatccctgttgaagtgacttcaagaagtgacaatgatgccaggcatttggttaagtatgatgtggtgagttaaccttaaaatagctgctgcctggaaaggatatccttgggacagcagatcccttagttcctaatgaatagctgcatcaccaacacagcttctcctgaccatggtagggccatcagcagggtaactcagcccagcttattaacccttctgttttctttccagctagccacagtgcagcctggccagaatttccacatgttcacaaaggaagaacttgaagaggttatcaaggacatttaaggaatcctgatcctcagaacttctctgggacaatttcagttctaataatgtccttaaattttatttccagctcctgttccttggaaaatctccattgtatgtgcattttttaaatgatgtctgtacataaaggcagttctgaaataaagaaaattttaaaata

SEQ ID NO: 440691 - DNA, 1142 bp, Homo sapiens
gcacaggagggcgggctaaagaggtcgcggtcgcacgcgcagttggtccttagtactgcggccgtgtgggtgagttggctgccggtgagttgggtgccggtggagtcgtgttggtcctcagaatccccgcgtagccgctgcctcctcctaccctcgccatgtttcttacccggtctgagtacgacaggggcgtgaatactttttctcccgaaggaagattatttcaagtggaatatgccattgaggctatcaagcttggttctacagccattgggatccagacatcagagggtgtgtgcctagctgtggagaagagaattacttccccactgatggagcccagcagcattgagaaaattgtagagattgatgctcacataggttgtgccatgagtgggctaattgctgatgctaagactttaattgataaagccagagtggagacacagaaccactggttcacctacaatgagacaatgacagtggagagtgtgacccaagctgtgtccaatctggctttgcagtttggagaagaagatgcagatccaggtgccatgtctcgtccctttggagtagcattattatttggaggagttgatgagaaaggaccccagctgtttcatatggacccatctgggacctttgtacagtgtgatgctcgagcaattggctctgcttcagagggtgcccagagctccttgcaagaagtttaccacaagtctatgactttgaaagaagccatcaagtcttcactcatcatcctcaaacaagtaatggaggagaagctgaatgcaacaaacattgagctagccacagtgcagcctggccagaatttccacatgttcacaaaggaagaacttgaagaggttatcaaggacatttaaggaatcctgatcctcagaacttctctgggacaatttcagttctaataatgtccttaaattttatttccagctcctgttccttggaaaatctccattgtatgtgcattttttaaatgatgtctgtacataaaggcagttctgaaataaagaaaattttaaaataaaaaaaaggggggggtaaaaatctgaggggcaatacgacccgtttggaaaaggccaagagagaaagaagagaggggtaatggggaagaatgcgtt

SEQ ID NO: 440692 - DNA, 813 bp, Homo sapiens
gcacaggagggcgggctaaagaggtcgcggtcgcacgcgcagttggtccttagtactgcggccgtgtgggtgagttggctgccggtgagttgggtgccggtggagtcgtgttggtcctcagaatccccgcgtagccgctgcctcctcctaccctcgccatgtttcttacccggtctgagtacgacaggggcgtgaatactttttctcccgaaggaagattatttcaagtggaatatgccattgaggctatcaagcttggttctacagccattgggatccagacatcagagggtgtgtgcctagctgtggagaagagaattacttccccactgatggagcccagcagcattgagaaaattgtagagattgatgctcacataggttgtgccatgagtgggctaattgctgatgctaagactttaattgataaagccagagtggagacacagaaccactggttcacctacaatgagacaatgacagtggagagtgtgacccaagctgtgtccaatctggctttgcagtttggagaagaagatgcagatccaggtgccatgtctcgtccctttggagtagcattattatttggaggagttgatgagaaaggaccccagcttgtttataagtgcccatttggacctctgtacagaggggtggtcgagcattgggctttgttcaaaggtggccaaaggtcttgcaggaagttacccaagtctatgcttttaagaaggctcagtttttatcttatcctaaacagtattgggggggtggtgcgattggtttgcccagggggccggccgatttcctgttcgg

SEQ ID NO: 440693 - DNA, 1117 bp, Homo sapiens
gcacaggagggcgggctaaagaggtcgcggtcgcacgcgcagttggtccttagtactgcggccgtgtgggtgagttggctgccggtgagttgggtgccggtggagtcgtgttggtcctcagaatccccgcgtagccgctgcctcctcctaccctcgccatgtttcttacccggtctgagtacgacaggggcgtgaatactttttctcccgaaggaagattatttcaagtggaatatgccattgaggctatcaagcttggttctacagccattgggatccagacatcagagggtgtgtgcctagctgtggagaagagaattacttccccactgatggagcccagcagcattgagaaaattgtagagattgatgctcacataggttgtgccatgagtgggctaattgctgatgctaagactttaattgataaagccagagtggagacacagaaccactggttcacctacaatgagacaatgacagtggagagtgtgacccaagctgtgtccaatctggctttgcagtttggagaagaagatgcagatccaggtgccatgtctcgtccctttggagtagcattattatttggaggagttgatgagaaaggaccccagctgtttcatatggacccatctgggacctttgtacagtgtgatgctcgagcaattggctctgcttcagagggtgcccagagctccttgcaagaagtttaccacaagtctatgactttgaaagaagccatcaagtcttcactcatcatcctcaaacaagtaatggaggagaagctgaatgcaacaaacattgagctagccacagtgcagcctggccagaatttccacatgttcacaaaggaagaacttgaagaggttatcaaggacatttaaggaatcctgatcctcagaacttctctgggacaatttcagttctaataatgtccttaaattttatttccagctcctgttccttggaaaatctccattgtatgtgcattttttaaatgatgtctgtacataaaggcagttctgaaataaagaaaattttaaaataacaaaaaaaaaaatggccgcgtttacaagtcgtgatgggaaaccctgcggtacccacttatcgcttgagc

SEQ ID NO: 440694 - DNA, 1070 bp, Homo sapiens
gcacaggagggcgggctaaagaggtcgcggtcgcacgcgcagttggtccttagtactgcggccgtgtgggtgagttggctgccggtgagttgggtgccggtggagtcgtgttggtcctcagaatccccgcgtagccgctgcctcctcctaccctcgccatgtttcttacccggtctgagtacgacaggggcgtgaatactttttctcccgaaggaagattatttcaagtggaatatgccattgaggctatcaagcttggttctacagccattgggatccagacatcagagggtgtgtgcctagctgtggagaagagaattacttccccactgatggagcccagcagcattgagaaaattgtagagattgatgctcacataggttgtgccatgagtgggctaattgctgatgctaagactttaattgataaagccagagtggagacacagaaccactggttcacctacaatgagacaatgacagtggagagtgtgacccaagctgtgtccaatctggctttgcagtttggagaagaagatgcagatccaggtgccatgtctcgtccctttggagtagcattattatttggaggagttgatgagaaaggaccccagctgtttcatatggacccatctgggacctttgtacagtgtgatgctcgagcaattggctctgcttcagagggtgcccagagctccttgcaagaagtttaccacaagtctatgactttgaaagaagccatcaagtcttcactcatcatcctcaaacaagtaatggaggagaagctgaatgcaacaaacattgagctagccacagtgcagcctggccagaatttccacatgttcacaaaggaagaacttgaagaggttatcaaggacatttaaggaatcctgatcctcagaacttctctgggacaatttcagttctaataatgtccttaaattttatttccagctcctgttccttggaaaatctccattgtatgtgcattttttaaatgatgtctgtacataaaggcagttctgaaataaagaaaattttaaaataatatttgttaatagactgttctc

SEQ ID NO: 440695 - DNA, 980 bp, Homo sapiens
gcacaggagggcgggctaaagaggtcgcggtcgcacgcgcagttggtccttagtactgcggccgtgtgggtgagttggctgccggtgagttgggtgccggtggagtcgtgttggtcctcagaatccccgcgtagccgctgcctcctcctaccctcgccatgtttcttacccggtctgagtacgacagcttggttctacagccattgggatccagacatcagagggtgtgtgcctagctgtggagaagagaattacttccccactgatggagcccagcagcattgagaaaattgtagagattgatgctcacataggttgtgccatgagtgggctaattgctgatgctaagactttaattgataaagccagagtggagacacagaaccactggttcacctacaatgagacaatgacagtggagagtgtgacccaagctgtgtccaatctggctttgcagtttggagaagaagatgcagatccaggtgccatgtctcgtccctttggagtagcattattatttggaggagttgatgagaaaggaccccagctgtttcatatggacccatctgggacctttgtacagtgtgatgctcgagcaattggctctgcttcagagggtgcccagagctccttgcaagaagtttaccacaagtctatgactttgaaagaagccatcaagtcttcactcatcatcctcaaacaagtaatggaggagaagctgaatgcaacaaacattgagctagccacagtgcagcctggccagaatttccacatgttcacaaaggaagaacttgaagaggttatcaaggacatttaaggaatcctgatcctcagaacttctctgggacaatttcagttctaataatgtccttaaattttatttccagctcctgttccttggaaaatctccattgtatgtgcattttttaaatgatgtctgtacataaaggcagttctgaaataaagaaaattttaaaata

SEQ ID NO: 440696 - DNA, 885 bp, Homo sapiens
gcacaggagggcgggctaaagaggtcgcggtcgcacgcgcagttggtccttagtactgcggccgtgtgggtgagttggctgccggtgagttgggtgccggtggagtcgtgttggtcctcagaatccccgcgtagccgctgcctcctcctaccctcgccatgtttcttacccggtctgagtacgacaggggcgtgaatactttttctcccgaaggaagattatttcaagtggaatatgccattgaggctatcaagcttggttctacagccattgggatccagacatcagagggtgtgtgcctagctgtggagaagagaattacttccccactgatggagcccagcagcattgagaaaattgtagagattgatgctcacataggttgtgccatgagtgggctaattgctgatgctaagactttaattgataaagccagagtggagacacagaaccactggttcacctacaatgagacaatgacagtggagagtgtgacccaagctgtgtccaatctggctttgcagtttggagaagaagatgcagatccaggtgccatgtctcgtccctttggagtagcattattatttggaggagttgatgagaaaggaccccagctgtttcatatggacccatctgggacctttgtacagtgtgatgctcgagcaattggctctgcttcagagggtgcccagagctccttgcaagaagtttaccacaagtctatgactttgaaagaagccatcaagtcttcactcatcatcctcaaacaagtaatggaggagaagctgaatgcaacaaacattgagagatggggtcttgctgtgttgcccagactggtcttaaactcctgggctcaaggcaattctcctgcctcagcctactgag

SEQ ID NO: 440697 - DNA, 715 bp, Homo sapiens
gcacaggagggcgggctaaagaggtcgcggtcgcacgcgcagttggtccttagtactgcggccgtgtgggtgagttggctgccggtgagttgggtgccggtggagtcgtgttggtcctcagaatccccgcgtagccgctgcctcctcctaccctcgccatgtttcttacccggtctgagtacgacaggtccgtgcagctgggggacgtcgggtgggaattatgggtgggcaggcccgggacctggccgcgcggcctgggttctgccgtgtcatggggctccccaggaacccgagactggccggacctggggatgttatgccctcctcaggcgcccgccgtccttccccaagctagaccacatcggcggcacttgtcctaccgctgagtcacccctgggtcctaactcggtgcggaagcgagaagctccggctggtgcttggtaaagaaggcgtgaggagccggaactcctaccttgaacccggagaaggccaagggtcactctttgctccgttcatcttttcgtgcctagtatgactgccttgaacaaacaaacaaaaagttaaacgtgcttcctggaagaaaaagcaactggtttgtagtagggcatgctgcggtgtatagtttcttcagaagcgcgaaggcagtcgtagctttggctggatatattgtctggagtctgattttataggaactggaatttagaatggttttcaa

SEQ ID NO: 440698 - DNA, 914 bp, Homo sapiens
agcaattctcctgttcctgcctcccgagtagctgggattacaggacttggatgttgtgggtgatggtatgcagtgtcctccttcacctttgctttttgatccttcactaacccttgaagatcatttagtcaaagaaattgctgaagacacagtggatattttgggccagatgcagatggctggagatgggtgcagatcccagggatctcgaaattctgagaaagcctctgcaccattgtctcagagtggattggctactgcaaatgggaagccagaacccacttctattagttgatagtttggggaaccattttactttggtggatttaaatttctcgttcttcaaagaagtatttctgatcatctctcacaaaacacaggcaacccagactaccttgtttttcttctggattgagtattatagtcaaacgtaaagccaaattttgaggacgtggaccgtgggtttcttcccactcagggcaaggaagagaaagagagataatccctatcaaagcttctgggattatttgggactatacctaaaaggaaagtgacatctttgtaatgggatttcccaagtcatggatagaaatccacttaagtagctaggtgggagctgtctttgtgagtggtgtctttgagatactgatggccctaatatcggttatctctatctgaagacctgcagtttagcttttcttcacctctacttaattgggcagtctttaacccctttccctggtgaactctggctttttatcctctgagaaaacagcccacaggactgggtcctccttatccgtcttgcttttaacctatgtaaatttctgtggttgctatcttatgtaaaatatagtaaaaatttattgtatatagtttctattaaatgttaaagaaaatgttatgaaaatatc

SEQ ID NO: 440699 - DNA, 2300 bp, Homo sapiens
tagagaagggcgagcggcgcggcagagtgcggcgcagcgcagctcctgaggttttggttatgaacaggattcggattcacgtcttgccaaccaatcgggggaggatcactccagtgcccaggtctcaggaacctctgtcttgtgcattcactcatcgtccatgctctcaccctcgtctggaggggcaggagttttgcattaagcatatccttgaagacaagaatgcacccttcaagcagtgtagttatatatcgacgaagaatggaaaaagatgtcccaatgctgccccaaagccagagaagaaagatggggtgtccttctgtgctgaacatgtccgtaggaatgccctggcacttcatgctcaaatgaagaagaccaacccagggcctgtgggtgaaacactcctgtgccagctgagctcatatgctaagacagagctggggtctcagactccagaaagtagtcgcagtgaagccagccgaatactagatgaagacagctggagtgatggggagcaggaacccattactgtggatcagacatggagaggtgaccctgacagtgaagctgatagcatagacagtgatcaagaagatcccctaaaacatgctggtgtctacacagcagaagaagtggccctgattatgcgtgaaaagctaattcgtttgcagtcgttgtatattgatcagtttaaacgacttcagcatctgctcaaggagaagaagcgccgatacttacataatcgcaaagtggaacatgaagctctaggcagtagtctcctgactggcccagagggacttttggccaaagaacgagagaacttaaagcgattaaaatgtctgcgacgataccgccagcgctatggagtggaagccttactgcataggcagttgaaggaacggagaatgctggccacagatggtgctgcccaacaggcccataccactcgttccagtcagaggtgcttggcctttgtggatgatgttcgttgttccaatcagtctcttccaatgaccagacactgccttacccatatttgtcaggatacgaatcaggttctcttcaagtgctgccagggatctgaagaggtaccctgcaacaaacctgttcctgtaagcctctctgaggatccctgctgcccactgcatttccagttgcctcctcagatgtataagcccgagcaggtactgtctgtgccagacgatctggaagccggccccatggatctgtacttgagtgctgctgagcttcagcccactgagagtttacctctggagttcagtgatgacttggatgttgtgggtgatggtatgcagtgtcctccttcacctttgctttttgatccttcactaacccttgaagatcatttagtcaaagaaattgctgaagacacagtggatattttgggccagatgcagatggctggagatgggtgcagatcccagggatctcgaaattctgagaaagcctctgcaccattgtctcagagtggattggctactgcaaatgggaagccagaacccacttctattagttgatagtttggggaaccattttactttggtggatttaaatttctcgttcttcaaagaagtatttctgatcatctctcacaaaacacaggcaacccagactaccttgtttttcttctggattgagtattatagtcaaacgtaaagccaaattttgaggacgtggaccgtgggtttcttcccactcagggcaaggaagagaaagagagataatccctatcaaagcttctgggattatttgggactatacctaaaaggaaagtgacatctttgtaatgggatttcccaagtcatggatagaaatccacttaagtagctaggtgggagctgtctttgtgagtggtgtctttgagatactgatggccctaatatcggttatctctatctgaagacctgcagtttagcttttcttcacctctacttaattgggcagtctttaacccctttccctggtgaactctggctttttatcctctgagaaaacagcccacaggactgggtcctccttatccgtcttgcttttaacctatgtaaatttctgtggttgctatcttatgtaaaatatagtaaaaatttattgtatatagtttctattaaatgttaaagaaaatgttatgaaaatatcaaacagtcacctgaattgaatgcatgttttgtttgagaatatagtttctttttcgcggttttggggacctgtctctgatgggaaagggaagttgggacagatgatacttccatcccaagaagtaaataaatcttcagtagctc

SEQ ID NO: 440700 - DNA, 2157 bp, Homo sapiens
tagagaagggcgagcggcgcggcagagtgcggcgcagcgcagctcctgaggttttggttatgaacaggattcggattcacgtcttgccaaccaatcgggggaggatcactccagtgcccaggtctcaggaacctctgtcttgtgcattcactcatcgtccatgctctcaccctcgtctggaggggcaggagttttgcattaagcatatccttgaagacaagaatgcacccttcaagcagtgtagttatatatcgacgaagaatggaaaaagatgtcccaatgctgccccaaagccagagaagaaagatggggtgtccttctgtgctgaacatgtccgtaggaatgccctggcacttcatgctcaaatgaagaagaccaacccagggcctgtgggtgaaacactcctgtgccagctgagctcatatgctaagacagagctggggtctcagactccagaaagtagtcgcagtgaagccagccgaatactagatgaagacagctggagtgatggggagcaggaacccattactgtggatcagacatggagaggtgaccctgacagtgaagctgatagcatagacagtgatcaagaagatcccctaaaacatgctggtgtctacacagcagaagaagtggccctgattatgcgtgaaaagctaattcgtttgcagtcgttgtatattgatcagtttaaacgacttcagcatctgctcaaggagaagaagcgccgatacttacataatcgcaaagtggaacatgaagctctaggcagtagtctcctgactggcccagagggacttttggccaaagaacgagagaacttaaagcgattaaaatgtctgcgacgataccgccagcgctatggagtggaagccttactgcataggcagttgaaggaacggagaatgctggccacagatggtgctgcccaacaggcccataccactcgttccagtcagaggtgcttggcctttgtggatgatgttcgttgttccaatcagtctcttccaatgaccagacactgccttacccatatttgtcaggatacgaatcaggttctcttcaagtgctgccagggatctgaagaggtaccctgcaacaaacctgttcctgtaagcctctctgaggatccctgctgcccactgcatttccagttgcctcctcagatgtataagcccgagcaggtactgtctgtgccagacgatctggaagccggccccatggatctgtacttgagtgctgctgagcttcagcccactgagagtttacctctggagttcagtgatgacttggatgttgtgggtgatggtatgcagtgtcctccttcacctttgctttttgatccttcactaacccttgaagatcatttagtcaaagaaattgctgaagacacagtggatattttgggccagatgcagatggctggagatgggtgcagatcccagggatctcgaaattctgagaaagcctctgcaccattgtctcagagtggattggctactgcaaatgggaagccagaacccacttctattagttgatagtttggggaaccattttactttggtggatttaaatttctcgttcttcaaagaagtatttctgatcatctctcacaaaacacaggcaacccagactaccttgtttttcttctggattgagtattatagtcaaacgtaaagccaaattttgaggacgtggaccgtgggtttcttcccactcagggcaaggaagagaaagagagataatccctatcaaagcttctgggattatttgggactatacctaaaaggaaagtgacatctttgtaatgggatttcccaagtcatggatagaaatccacttaagtagctaggtgggagctgtctttgtgagtggtgtctttgagatactgatggccctaatatcggttatctctatctgaagacctgcagtttagcttttcttcacctctacttaattgggcagtctttaacccctttccctggtgaactctggctttttatcctctgagaaaacagcccacaggactgggtcctccttatccgtcttgcttttaacctatgtaaatttctgtggttgctatcttatgtaaaatatagtaaaaatttattgtatatagtttctattaaatgttaaagaaaatgttatgaaaatatc

SEQ ID NO: 440701 - DNA, 2233 bp, Homo sapiens
aagcagtgtcagagtcagtctcgcttcctgaggcttccaggagccaggatctccggtgactggagccgtcggacaaaatggcgctcgcataggcttccgaggccaggcccagtcgtgcgctctgaggttttggttatgaacaggattcggattcacgtcttgccaaccaatcgggggaggatcactccagtgcccaggtctcaggaacctctgtcttgtgcattcactcatcgtccatgctctcaccctcgtctggaggggcaggagttttgcattaagcatatccttgaagacaagaatgcacccttcaagcagtgtagttatatatcgacgaagaatggaaaaagatgtcccaatgctgccccaaagccagagaagaaagatggggtgtccttctgtgctgaacatgtccgtaggaatgccctggcacttcatgctcaaatgaagaagaccaacccagggcctgtgggtgaaacactcctgtgccagctgagctcatatgctaagacagagctggggtctcagactccagaaagtagtcgcagtgaagccagccgaatactagatgaagacagctggagtgatggggagcaggaacccattactgtggatcagacatggagaggtgaccctgacagtgaagctgatagcatagacagtgatcaagaagatcccctaaaacatgctggtgtctacacagcagaagaagtggccctgattatgcgtgaaaagctaattcgtttgcagtcgttgtatattgatcagtttaaacgacttcagcatctgctcaaggagaagaagcgccgatacttacataatcgcaaagtggaacatgaagctctaggcagtagtctcctgactggcccagagggacttttggccaaagaacgagagaacttaaagcgattaaaatgtctgcgacgataccgccagcgctatggagtggaagccttactgcataggcagttgaaggaacggagaatgctggccacagatggtgctgcccaacaggcccataccactcgttccagtcagaggtgcttggcctttgtggatgatgttcgttgttccaatcagtctcttccaatgaccagacactgccttacccatatttgtcaggatacgaatcaggttctcttcaagtgctgccagggatctgaagaggtaccctgcaacaaacctgttcctgtaagcctctctgaggatccctgctgcccactgcatttccagttgcctcctcagatgtataagcccgagcaggtactgtctgtgccagacgatctggaagccggccccatggatctgtacttgagtgctgctgagcttcagcccactgagagtttacctctggagttcagtgatgacttggatgttgtgggtgatggtatgcagtgtcctccttcacctttgctttttgatccttcactaacccttgaagatcatttagtcaaagaaattgctgaagacacagtggatattttgggccagatgcagatggctggagatgggtgcagatcccagggatctcgaaattctgagaaagcctctgcaccattgtctcagagtggattggctactgcaaatgggaagccagaacccacttctattagttgatagtttggggaaccattttactttggtggatttaaatttctcgttcttcaaagaagtatttctgatcatctctcacaaaacacaggcaacccagactaccttgtttttcttctggattgagtattatagtcaaacgtaaagccaaattttgaggacgtggaccgtgggtttcttcccactcagggcaaggaagagaaagagagataatccctatcaaagcttctgggattatttgggactatacctaaaaggaaagtgacatctttgtaatgggatttcccaagtcatggatagaaatccacttaagtagctaggtgggagctgtctttgtgagtggtgtctttgagatactgatggccctaatatcggttatctctatctgaagacctgcagtttagcttttcttcacctctacttaattgggcagtctttaacccctttccctggtgaactctggctttttatcctctgagaaaacagcccacaggactgggtcctccttatccgtcttgcttttaacctatgtaaatttctgtggttgctatcttatgtaaaatatagtaaaaatttattgtatatagtttctattaaatgttaaagaaaatgttatgaaaatatc

SEQ ID NO: 440702 - DNA, 2198 bp, Homo sapiens
tagagaagggcgagcggcgcggcagagtgcggcgcagcgcagctcctgaggttttggttatgaacaggattcggattcacgtcttgccaaccaatcgggggaggatcactccagtgcccaggtctcaggaacctctgtcttgtgcattcactcatcgtccatgctctcaccctcgtctggaggggcaggagttttgcattaagcatatccttgaagacaagaatgcacccttcaagcagtgtagttatatatcgacgaagaatggaaaaagatgtcccaatgctgccccaaagccagagaagaaagatggggtgtccttctgtgctgaacatgtccgtaggaatgccctggcacttcatgctcaaatgaagaagaccaacccagggcctgtgggtgaaacactcctgtgccagctgagctcatatgctaagacagagctggggtctcagactccagaaagtagtcgcagtgaagccagccgaatactagatgaagacagctggagtgatggggagcaggaacccattactgtggatcagacatggagaggtgaccctgacagtgaagctgatagcatagacagtgatcaagaagatcccctaaaacatgctggtgtctacacagcagaagaagtggccctgattatgcgtgaaaagctaattcgtttgcagtcgttgtatattgatcagtttaaacgacttcagcatctgctcaaggagaagaagcgccgatacttacataatcgcaaagtggaacatgaagctctaggcagtagtctcctgactggcccagagggacttttggccaaagaacgagagaacttaaagcgattaaaatgtctgcgacgataccgccagcgctatggagtggaagccttactgcataggcagttgaaggaacggagaatgctggccacagatggtgctgcccaacaggcccataccactcgttccagtcagaggtgcttggcctttgtggatgatgttcgttgttccaatcagtctcttccaatgaccagacactgccttacccatatttgtcaggatacgaatcaggttctcttcaagtgctgccagggatctgaagaggtaccctgcaacaaacctgttcctgtaagcctctctgaggatccctgctgcccactgcatttccagttgcctcctcagatgtataagcccgagcaggacttggatgttgtgggtgatggtatgcagtgtcctccttcacctttgctttttgatccttcactaacccttgaagatcatttagtcaaagaaattgctgaagacacagtggatattttgggccagatgcagatggctggagatgggtgcagatcccagggatctcgaaattctgagaaagcctctgcaccattgtctcagagtggattggctactgcaaatgggaagccagaacccacttctattagttgatagtttggggaaccattttactttggtggatttaaatttctcgttcttcaaagaagtatttctgatcatctctcacaaaacacaggcaacccagactaccttgtttttcttctggattgagtattatagtcaaacgtaaagccaaattttgaggacgtggaccgtgggtttcttcccactcagggcaaggaagagaaagagagataatccctatcaaagcttctgggattatttgggactatacctaaaaggaaagtgacatctttgtaatgggatttcccaagtcatggatagaaatccacttaagtagctaggtgggagctgtctttgtgagtggtgtctttgagatactgatggccctaatatcggttatctctatctgaagacctgcagtttagcttttcttcacctctacttaattgggcagtctttaacccctttccctggtgaactctggctttttatcctctgagaaaacagcccacaggactgggtcctccttatccgtcttgcttttaacctatgtaaatttctgtggttgctatcttatgtaaaatatagtaaaaatttattgtatatagtttctattaaatgttaaagaaaatgttatgaaaatatcaaacagtcacctgaattgaatgcatgttttgtttgagaatatagtttctttttcgcggttttggggacctgtctctgatgggaaagggaagttgggacagatgatacttccatcccaagaagtaaataaatcttcagtagctc

SEQ ID NO: 440703 - DNA, 2111 bp, Homo sapiens
tagagaagggcgagcggcgcggcagagtgcggcgcagcgcagctcctgaggttttggttatgaacaggattcggattcacgtcttgccaaccaatcgggggaggatcactccagtgcccagggtgtccttctgtgctgaacatgtccgtaggaatgccctggcacttcatgctcaaatgaagaagaccaacccagggcctgtgggtgaaacactcctgtgccagctgagctcatatgctaagacagagctggggtctcagactccagaaagtagtcgcagtgaagccagccgaatactagatgaagacagctggagtgatggggagcaggaacccattactgtggatcagacatggagaggtgaccctgacagtgaagctgatagcatagacagtgatcaagaagatcccctaaaacatgctggtgtctacacagcagaagaagtggccctgattatgcgtgaaaagctaattcgtttgcagtcgttgtatattgatcagtttaaacgacttcagcatctgctcaaggagaagaagcgccgatacttacataatcgcaaagtggaacatgaagctctaggcagtagtctcctgactggcccagagggacttttggccaaagaacgagagaacttaaagcgattaaaatgtctgcgacgataccgccagcgctatggagtggaagccttactgcataggcagttgaaggaacggagaatgctggccacagatggtgctgcccaacaggcccataccactcgttccagtcagaggtgcttggcctttgtggatgatgttcgttgttccaatcagtctcttccaatgaccagacactgccttacccatatttgtcaggatacgaatcaggttctcttcaagtgctgccagggatctgaagaggtaccctgcaacaaacctgttcctgtaagcctctctgaggatccctgctgcccactgcatttccagttgcctcctcagatgtataagcccgagcaggtactgtctgtgccagacgatctggaagccggccccatggatctgtacttgagtgctgctgagcttcagcccactgagagtttacctctggagttcagtgatgacttggatgttgtgggtgatggtatgcagtgtcctccttcacctttgctttttgatccttcactaacccttgaagatcatttagtcaaagaaattgctgaagacacagtggatattttgggccagatgcagatggctggagatgggtgcagatcccagggatctcgaaattctgagaaagcctctgcaccattgtctcagagtggattggctactgcaaatgggaagccagaacccacttctattagttgatagtttggggaaccattttactttggtggatttaaatttctcgttcttcaaagaagtatttctgatcatctctcacaaaacacaggcaacccagactaccttgtttttcttctggattgagtattatagtcaaacgtaaagccaaattttgaggacgtggaccgtgggtttcttcccactcagggcaaggaagagaaagagagataatccctatcaaagcttctgggattatttgggactatacctaaaaggaaagtgacatctttgtaatgggatttcccaagtcatggatagaaatccacttaagtagctaggtgggagctgtctttgtgagtggtgtctttgagatactgatggccctaatatcggttatctctatctgaagacctgcagtttagcttttcttcacctctacttaattgggcagtctttaacccctttccctggtgaactctggctttttatcctctgagaaaacagcccacaggactgggtcctccttatccgtcttgcttttaacctatgtaaatttctgtggttgctatcttatgtaaaatatagtaaaaatttattgtatatagtttctattaaatgttaaagaaaatgttatgaaaatatcaaacagtcacctgaattgaatgcatgttttgtttgagaatatagtttctttttcgcggttttggggacctgtctctgatgggaaagggaagttgggacagatgatacttccatcccaagaagtaaataaatcttcagtagctc

SEQ ID NO: 440704 - DNA, 1442 bp, Homo sapiens
cacaaggaaaaacaaataggctaggaggccgggtgaatcggacgagggaatgctggcacagatggtgctgccaacaggcccataccactcgttccagtcagaggtgcttggcctttgtggatgatgttcgttgttccaatcagtctcttccaatgaccagacactgccttacccatatttgtcaggatacgaatcaggttctcttcaagtgctgccagggatctgaagaggtaccctgcaacaaacctgttcctgtaagcctctctgaggatccctgctgcccactgcatttccagttgcctcctcagatgtataagcccgagcaggtactgtctgtgccagacgatctggaagccggccccatggatctgtacttgagtgctgctgagcttcagcccactgagagtttacctctggagttcagtgatgacttggatgttgtgggtgatggtatgcagtgtcctccttcacctttgctttttgatccttcactaacccttgaagatcatttagtcaaagaaattgctgaagacacagtggatattttgggccagatgcagatggctggagatgggtgcagatcccagggatctcgaaattctgagaaagcctctgcaccattgtctcagagtggattggctactgcaaatgggaagccagaacccacttctattagttgatagtttggggaaccattttactttggtggatttaaatttctcgttcttcaaagaagtatttctgatcatctctcacaaaacacaggcaacccagactaccttgtttttcttctggattgagtattatagtcaaacgtaaagccaaattttgaggacgtggaccgtgggtttcttcccactcagggcaaggaagagaaagagagataatccctatcaaagcttctgggattatttgggactatacctaaaaggaaagtgacatctttgtaatgggatttcccaagtcatggatagaaatccacttaagtagctaggtgggagctgtctttgtgagtggtgtctttgagatactgatggccctaatatcggttatctctatctgaagacctgcagtttagcttttcttcacctctacttaattgggcagtctttaacccctttccctggtgaactctggctttttatcctctgagaaaacagcccacaggactgggtcctccttatccgtcttgcttttaacctatgtaaatttctgtggttgctatcttatgtaaaatatagtaaaaatttattgtatatagtttctattaaatgttaaagaaaatgttatgaaaatatcaaacagtcacctgaattgaatgcatgttttgtttgagaatatagtttctttttcgcggttttggggacctgtctctgatgggaaagggaagttgggacagatgatacttccatcccaagaagtaaataaatcttcagtagctc

SEQ ID NO: 440705 - DNA, 1057 bp, Homo sapiens
agcaattctcctgttcctgcctcccgagtagctgggattacaggacttggatgttgtgggtgatggtatgcagtgtcctccttcacctttgctttttgatccttcactaacccttgaagatcatttagtcaaagaaattgctgaagacacagtggatattttgggccagatgcagatggctggagatgggtgcagatcccagggatctcgaaattctgagaaagcctctgcaccattgtctcagagtggattggctactgcaaatgggaagccagaacccacttctattagttgatagtttggggaaccattttactttggtggatttaaatttctcgttcttcaaagaagtatttctgatcatctctcacaaaacacaggcaacccagactaccttgtttttcttctggattgagtattatagtcaaacgtaaagccaaattttgaggacgtggaccgtgggtttcttcccactcagggcaaggaagagaaagagagataatccctatcaaagcttctgggattatttgggactatacctaaaaggaaagtgacatctttgtaatgggatttcccaagtcatggatagaaatccacttaagtagctaggtgggagctgtctttgtgagtggtgtctttgagatactgatggccctaatatcggttatctctatctgaagacctgcagtttagcttttcttcacctctacttaattgggcagtctttaacccctttccctggtgaactctggctttttatcctctgagaaaacagcccacaggactgggtcctccttatccgtcttgcttttaacctatgtaaatttctgtggttgctatcttatgtaaaatatagtaaaaatttattgtatatagtttctattaaatgttaaagaaaatgttatgaaaatatcaaacagtcacctgaattgaatgcatgttttgtttgagaatatagtttctttttcgcggttttggggacctgtctctgatgggaaagggaagttgggacagatgatacttccatcccaagaagtaaataaatcttcagtagctc

SEQ ID NO: 440706 - DNA, 205 bp, Homo sapiens
agacagcactcgactgaaagtgaaggacccagactctagttgtaggttaaccattcccttctttttacctcttttgccccatctgaaaggaaagcgggtggaggatgatggggggagtccttttttaggatattgtggtattaaatacataagagacttgtgaaagtcctttgaattccaataaaaaaaagttcttggccaggcg

SEQ ID NO: 440707 - DNA, 2026 bp, Homo sapiens
tagagaagggcgagcggcgcggcagagtgcggcgcagcgcagctcctgaggttttggttatgaacaggattcggattcacgtcttgccaaccaatcgggggaggatcactccagtgcccaggtctcaggaacctctgtcttgtgcattcactcatcgtccatgctctcaccctcgtctggaggggcaggagttttgcattaagcatatccttgaagacaagaatgcacccttcaagcagtgtagttatatatcgacgaagaatggaaaaagatgtcccaatgctgccccaaagccagagaagaaagatggggtgtccttctgtgctgaacatgtccgtaggaatgccctggcacttcatgctcaaatgaagaagaccaacccagggcctgtgggtgaaacactcctgtgccagctgagctcatatgctaagacagagctggggtctcagactccagaaagtagtcgcagtgaagccagccgaatactagacatgctggtgtctacacagcagaagaagtggccctgattatgcgtgaaaagctaattcgtttgcagtcgttgtatattgatcagtttaaacgacttcagcatctgctcaaggagaagaagcgccgatacttacataatcgcaaagtggaacatgaagctctaggcagtagtctcctgactggcccagagggacttttggccaaagaacgagagaacttaaagcgattaaaatgtctgcgacgataccgccagcgctatggagtggaagccttactgcataggcagttgaaggaacggagaatgctggccacagatggtgctgcccaacaggcccataccactcgttccagtcagaggtgcttggcctttgtggatgatgttcgttgttccaatcagtctcttccaatgaccagacactgccttacccagaaagatgcgactgccattggtgacctgttaactctttactgtggtctaatggagacagcactcgactgaaagtgaaggacccagactctagttgacttggatgttgtgggtgatggtatgcagtgtcctccttcacctttgctttttgatccttcactaacccttgaagatcatttagtcaaagaaattgctgaagacacagtggatattttgggccagatgcagatggctggagatgggtgcagatcccagggatctcgaaattctgagaaagcctctgcaccattgtctcagagtggattggctactgcaaatgggaagccagaacccacttctattagttgatagtttggggaaccattttactttggtggatttaaatttctcgttcttcaaagaagtatttctgatcatctctcacaaaacacaggcaacccagactaccttgtttttcttctggattgagtattatagtcaaacgtaaagccaaattttgaggacgtggaccgtgggtttcttcccactcagggcaaggaagagaaagagagataatccctatcaaagcttctgggattatttgggactatacctaaaaggaaagtgacatctttgtaatgggatttcccaagtcatggatagaaatccacttaagtagctaggtgggagctgtctttgtgagtggtgtctttgagatactgatggccctaatatcggttatctctatctgaagacctgcagtttagcttttcttcacctctacttaattgggcagtctttaacccctttccctggtgaactctggctttttatcctctgagaaaacagcccacaggactgggtcctccttatccgtcttgcttttaacctatgtaaatttctgtggttgctatcttatgtaaaatatagtaaaaatttattgtatatagtttctattaaatgttaaagaaaatgttatgaaaatatcaaacagtcacctgaattgaatgcatgttttgtttgagaatatagtttctttttcgcggttttggggacctgtctctgatgggaaagggaagttgggacagatgatacttccatcccaagaagtaaataaatcttcagtagctc

SEQ ID NO: 440708 - DNA, 2347 bp, Homo sapiens
aagcagtgtcagagtcagtctcgcttcctgaggcttccaggagccaggatctccggtgactggagccgtcggacaaaatggcgctcgcataggcttccgaggccaggcccagtcgtgcgctctgaggcaggccgggacaaaggcggcgtgcggggaggcggcgtggccgccgcgtggggctggtgttgtcgcttcccttcgtgctgcagctgtgcgagtcctgaagatacattcagcgtggttttggttatgaacaggattcggattcacgtcttgccaaccaatcgggggaggatcactccagtgcccaggtctcaggaacctctgtcttgtgcattcactcatcgtccatgctctcaccctcgtctggaggggcaggagttttgcattaagcatatccttgaagacaagaatgcacccttcaagcagtgtagttatatatcgacgaagaatggaaaaagatgtcccaatgctgccccaaagccagagaagaaagatggggtgtccttctgtgctgaacatgtccgtaggaatgccctggcacttcatgctcaaatgaagaagaccaacccagggcctgtgggtgaaacactcctgtgccagctgagctcatatgctaagacagagctggggtctcagactccagaaagtagtcgcagtgaagccagccgaatactagatgaagacagctggagtgatggggagcaggaacccattactgtggatcagacatggagaggtgaccctgacagtgaagctgatagcatagacagtgatcaagaagatcccctaaaacatgctggtgtctacacagcagaagaagtggccctgattatgcgtgaaaagctaattcgtttgcagtcgttgtatattgatcagtttaaacgacttcagcatctgctcaaggagaagaagcgccgatacttacataatcgcaaagtggaacatgaagctctaggcagtagtctcctgactggcccagagggacttttggccaaagaacgagagaacttaaagcgattaaaatgtctgcgacgataccgccagcgctatggagtggaagccttactgcataggcagttgaaggaacggagaatgctggccacagatggtgctgcccaacaggcccataccactcgttccagtcagaggtgcttggcctttgtggatgatgttcgttgttccaatcagtctcttccaatgaccagacactgccttacccatatttgtcaggatacgaatcaggttctcttcaagtgctgccagggatctgaagaggtaccctgcaacaaacctgttcctgtaagcctctctgaggatccctgctgcccactgcatttccagttgcctcctcagatgtataagcccgagcaggtactgtctgtgccagacgatctggaagccggccccatggatctgtacttgagtgctgctgagcttcagcccactgagagtttacctctggagttcagtgatgacttggatgttgtgggtgatggtatgcagtgtcctccttcacctttgctttttgatccttcactaacccttgaagatcatttagtcaaagaaattgctgaagacacagtggatattttgggccagatgcagatggctggagatgggtgcagatcccagggatctcgaaattctgagaaagcctctgcaccattgtctcagagtggattggctactgcaaatgggaagccagaacccacttctattagttgatagtttggggaaccattttactttggtggatttaaatttctcgttcttcaaagaagtatttctgatcatctctcacaaaacacaggcaacccagactaccttgtttttcttctggattgagtattatagtcaaacgtaaagccaaattttgaggacgtggaccgtgggtttcttcccactcagggcaaggaagagaaagagagataatccctatcaaagcttctgggattatttgggactatacctaaaaggaaagtgacatctttgtaatgggatttcccaagtcatggatagaaatccacttaagtagctaggtgggagctgtctttgtgagtggtgtctttgagatactgatggccctaatatcggttatctctatctgaagacctgcagtttagcttttcttcacctctacttaattgggcagtctttaacccctttccctggtgaactctggctttttatcctctgagaaaacagcccacaggactgggtcctccttatccgtcttgcttttaacctatgtaaatttctgtggttgctatcttatgtaaaatatagtaaaaatttattgtatatagtttctattaaatgttaaagaaaatgttatgaaaatatc

SEQ ID NO: 440709 - DNA, 2395 bp, Homo sapiens
tagagaagggcgagcggcgcggcagagtgcggcgcagcgcagctcctgaggttttggttatgaacaggattcggattcacgtcttgccaaccaatcgggggaggatcactccagtgcccaggtctcaggaacctctgtcttgtgcattcactcatcgtccatgctctcaccctcgtctggaggggcaggagttttgcattaagcatatccttgaagacaagaatgcacccttcaagcagtgtagttatatatcgacgaagaatggaaaaagatgtcccaatgctgccccaaagccagagaagaaagatggggtgtccttctgtgctgaacatgtccgtaggaatgccctggcacttcatgctcaaatgaagaagaccaacccagggcctgtgggtgaaacactcctgtgccagctgagctcatatgctaagacagagctggggtctcagactccagaaagtagtcgcagtgaagccagccgaatactagatgaagacagctggagtgatggggagcaggaacccattactgtggatcagacatggagaggtgaccctgacagtgaagctgatagcatagacagtgatcaagaagatcccctaaaacatgctggtgtctacacagcagaagaagtggccctgattatgcgtgaaaagctaattcgtttgcagtcgttgtatattgatcagtttaaacgacttcagcatctgctcaaggagaagaagcgccgatacttacataatcgcaaagtggaacatgaagctctaggcagtagtctcctgactggcccagagggacttttggccaaagaacgagagaacttaaagcgattaaaatgtctgcgacgataccgccagcgctatggagtggaagccttactgcataggcagttgaaggaacggagaatgctggccacagatggtgctgcccaacaggcccataccactcgttccagtcagaggtgcttggcctttgtggatgatgttcgttgttccaatcagtctcttccaatgaccagacactgccttacccagaaagatgcgactgccattggtgacctgttaactctttactgtggtctaatggagacagcactcgactgaaagtgaaggacccagactctagttatatttgtcaggatacgaatcaggttctcttcaagtgctgccagggatctgaagaggtaccctgcaacaaacctgttcctgtaagcctctctgaggatccctgctgcccactgcatttccagttgcctcctcagatgtataagcccgagcaggtactgtctgtgccagacgatctggaagccggccccatggatctgtacttgagtgctgctgagcttcagcccactgagagtttacctctggagttcagtgatgacttggatgttgtgggtgatggtatgcagtgtcctccttcacctttgctttttgatccttcactaacccttgaagatcatttagtcaaagaaattgctgaagacacagtggatattttgggccagatgcagatggctggagatgggtgcagatcccagggatctcgaaattctgagaaagcctctgcaccattgtctcagagtggattggctactgcaaatgggaagccagaacccacttctattagttgatagtttggggaaccattttactttggtggatttaaatttctcgttcttcaaagaagtatttctgatcatctctcacaaaacacaggcaacccagactaccttgtttttcttctggattgagtattatagtcaaacgtaaagccaaattttgaggacgtggaccgtgggtttcttcccactcagggcaaggaagagaaagagagataatccctatcaaagcttctgggattatttgggactatacctaaaaggaaagtgacatctttgtaatgggatttcccaagtcatggatagaaatccacttaagtagctaggtgggagctgtctttgtgagtggtgtctttgagatactgatggccctaatatcggttatctctatctgaagacctgcagtttagcttttcttcacctctacttaattgggcagtctttaacccctttccctggtgaactctggctttttatcctctgagaaaacagcccacaggactgggtcctccttatccgtcttgcttttaacctatgtaaatttctgtggttgctatcttatgtaaaatatagtaaaaatttattgtatatagtttctattaaatgttaaagaaaatgttatgaaaatatcaaacagtcacctgaattgaatgcatgttttgtttgagaatatagtttctttttcgcggttttggggacctgtctctgatgggaaagggaagttgggacagatgatacttccatcccaagaagtaaataaatcttcagtagctc

SEQ ID NO: 440710 - DNA, 2242 bp, Homo sapiens
  misc_feature (16)..(16): n is a, c, g, or t
  misc_feature (46)..(46): n is a, c, g, or t
ggtgacctagaggatnccattgccacgctcggttatgtccagcganttttttaatcttctgtagagacggggtctcactgtattgcctgggttggtctccaactcctggcctcaagtgatcctcctcccgtgcctcccaaagtgctgggattacaagggtgaaccacttcatccgtcctgttatttccctttaataaagtcaaatgagttgaccttgggccagttaaattcctctgacttgcatttttagaaatgaatgtaacggtcattttaattccctaaaaatgatttaaagattagggactgtgaacattattgaacactttcaagaaggaacttataaaatattaatgttttgtcccttcagggtgtccttctgtgctgaacatgtccgtaggaatgccctggcacttcatgctcaaatgaagaagaccaacccagggcctgtgggtgaaacactcctgtgccagctgagctcatatgctaagacagagctggggtctcagactccagaaagtagtcgcagtgaagccagccgaatactagacatgctggtgtctacacagcagaagaagtggccctgattatgcgtgaaaagctaattcgtttgcagtcgttgtatattgatcagtttaaacgacttcagcatctgctcaaggagaagaagcgccgatacttacataatcgcaaagtggaacatgaagctctaggcagtagtctcctgactggcccagagggacttttggccaaagaacgagagaacttaaagcgattaaaatgtctgcgacgataccgccagcgctatggagtggaagccttactgcataggcagttgaaggaacggagaatgctggccacagatggtgctgcccaacaggcccataccactcgttccagtcagaggtgcttggcctttgtggatgatgttcgttgttccaatcagtctcttccaatgaccagacactgccttacccatatttgtcaggatacgaatcaggttctcttcaagtgctgccagggatctgaagaggtaccctgcaacaaacctgttcctgtaagcctctctgaggatccctgctgcccactgcatttccagttgcctcctcagatgtataagcccgagcaggtactgtctgtgccagacgatctggaagccggccccatggatctgtacttgagtgctgctgagcttcagcccactgagagtttacctctggagttcagtgatgacttggatgttgtgggtgatggtatgcagtgtcctccttcacctttgctttttgatccttcactaacccttgaagatcatttagtcaaagaaattgctgaagacacagtggatattttgggccagatgcagatggctggagatgggtgcagatcccagggatctcgaaattctgagaaagcctctgcaccattgtctcagagtggattggctactgcaaatgggaagccagaacccacttctattagttgatagtttggggaaccattttactttggtggatttaaatttctcgttcttcaaagaagtatttctgatcatctctcacaaaacacaggcaacccagactaccttgtttttcttctggattgagtattatagtcaaacgtaaagccaaattttgaggacgtggaccgtgggtttcttcccactcagggcaaggaagagaaagagagataatccctatcaaagcttctgggattatttgggactatacctaaaaggaaagtgacatctttgtaatgggatttcccaagtcatggatagaaatccacttaagtagctaggtgggagctgtctttgtgagtggtgtctttgagatactgatggccctaatatcggttatctctatctgaagacctgcagtttagcttttcttcacctctacttaattgggcagtctttaacccctttccctggtgaactctggctttttatcctctgagaaaacagcccacaggactgggtcctccttatccgtcttgcttttaacctatgtaaatttctgtggttgctatcttatgtaaaatatagtaaaaatttattgtatatagtttctattaaatgttaaagaaaatgttatgaaaatatcaaacagtcacctgaattgaatgcatgttttgtttgagaatatagtttctttttcgcggttttggggacctgtctctgatgggaaagggaagttgggacagatgatacttccatcccaagaagtaaataaatcttcagtagctc

SEQ ID NO: 440711 - DNA, 2473 bp, Homo sapiens
ctctcttgcctgccgccatgtgcctttcgccttctgccgtgattgtgaggcctccccagccatatggaagttcaggatgtctgcccgtggcccggctatcggcatcgacctgggcaccacctattcgtgcgtcggggtcttccaacatggcaaggtggagatcatcgccaacgaccagggcaatcgcaccacccccagctacgtggccttcacggacaccgagcgcctcatcggcgacgccgccaagaaccaggtggccatgaaccccaccaacaccatcttcgacgccaagaggctgattggacggaaattcgaggatgccacagtgcagtcggatatgaaacactggccgttccgggtggtgagcgagggaggcaagcccaaagtgcaagtagagtacaagggggagaccaagaccttcttcccagaggagatatcctccatggtcctcacgaagatgaaggagatcgcggaagcctacctggggggcaaggtgcacagcgcggtcataacggtcccggcctatttcaacgactcgcagcgccaggccaccaaggacgcaggcaccatcacggggctcaatgtgctgcgcatcatcaacgagcccacggcggcggccatcgcctacggcctggacaagaagggctgcgcgggcggcgagaagaacgtgctcatctttgacctgggcggtggcactttcgacgtgtccatcctgaccatcgaggatggcatcttcgaggtgaagtccacggccggggatacccacctgggcggtgaggacttcgacaaccgcatggtgagccacctggcggaggagttcaagcgcaagcacaagaaggacattgggcccaacaagcgcgccgtgaggcggctgcgcaccgcttgcgagcgcgccaagcgcaccctgagctcgtccacgcaggcgagcatcgagatcgactcgctctacgagggcgtggacttctatacgtccatcacgcgcgcccgcttcgaggagctcaatgccgacctctttcgcgggaccctggagccggtggagaaggcgctgcgcgacgccaagctggacaagggccagatccaggagatcgtgctggtgggcggctccactcgtatccccaagatccagaagctgctgcaggatttcttcaacggcaaggagctgaacaagagcatcaaccccgacgaggcggtggcctatggcgccgcggtgcaggcggccatcctcatcggcgacaaatcagagaatgtgcaggacctgctgctactcgacgtgaccccgttgtcgctgggcatcgagacagctggcggtgtcatgaccccactcatcaagaggaacaccacgatccccaccaagcagacgcagaccttcaccacctactcggacaaccagagcagcgtactggtgcaggtatacgagggcgaacgggccatgaccaaggacaataacctgctgggcaagttcgacctgaccgggattccccctgcgcctcgcggggtcccccaaatcgaggttaccttcgacattgacgccaatggcatccttaacgttaccgccgccgacaagagcaccggtaaggaaaacaaaatcaccatcaccaatgacaaaggtcgtctgagcaaggacgacattgaccggatggtgcaggaggcggagcggtacaaatcggaagatgaggcgaatcgcgaccgagtcgcggccaaaaacgccctggagtcctatacctacaacatcaagcagacggtggaagacgagaaactgaggggcaagattagcgagcaggacaaaaacaagatcctcgacaagtgtcaggaggtgatcaactggctcgaccgaaaccagatggcagagaaagatgagtatgaacacaagcagaaagagctcgaaagagtttgcaaccccatcatcagcaaactttaccaaggtggtcctggcggcggcagcggcggcggcggttcaggagcctccgggggacccaccatcgaagaagtggactaagcttgcactcaagtcagcgtaaacctctttgcctttctctctctctcttttttttttgtttgtttctttgaaatgtccttgtgccaagtacgagatctattgttggaagtctttggtatatgcaaatgaaaggagaggtgcaacaacttagtttaattataaaagttccaaagtttgttttttaaaaacattattcgaggtttctctttaatgcattttgcgtgtttgctgacttgagcatttttgattagttcgtgcatggagatttgtttgagatgagaaaccttaagtttgcacacctgttctgtagaagcttggaaacagtaaaatatataggagcttaaattgtttatttttatgtactactttaaaactaaactgaacattgcagtaatgttaaggacaggtatactttttgcaaacaaatgcataaatgcaaatgtaaagtaaagctgaaattgatctcaaaaaaaaaat

SEQ ID NO: 440712 - DNA, 2787 bp, Homo sapiens
tagcggagccagcagcaggaggcgcgcgaggcaccacggcctggcggccgagagtcagggaggaacctcatttacataacggccgcccctctgtctcctggcgggggccggagtcccgcccctcgtccaacttgaaatctgttgggtcacgggccagtcactccgacctaggcaagcctgtggtggagctggaagagtttgtgagggcggtcccgggagcggattgggtctgggagttcccagaggcggctataagaaccgggaactgggcgcggggagctgagttgctggtagtgcccgtggtgcttggttcgaggtggccgttagttgactccgcggagttcatctccctggttttcccgtcctaacgtcgctcgcctttcagtcaggatgtctgcccgtggcccggctatcggcatcgacctgggcaccacctattcgtgcgtcggggtcttccaacatggcaaggtggagatcatcgccaacgaccagggcaatcgcaccacccccagctacgtggccttcacggacaccgagcgcctcatcggcgacgccgccaagaaccaggtggccatgaaccccaccaacaccatcttcgacgccaagaggctgattggacggaaattcgaggatgccacagtgcagtcggatatgaaacactggccgttccgggtggtgagcgagggaggcaagcccaaagtgcaagtagagtacaagggggagaccaagaccttcttcccagaggagatatcctccatggtcctcacgaagatgaaggagatcgcggaagcctacctggggggcaaggtgcacagcgcggtcataacggtcccggcctatttcaacgactcgcagcgccaggccaccaaggacgcaggcaccatcacggggctcaatgtgctgcgcatcatcaacgagcccacggcggcggccatcgcctacggcctggacaagaagggctgcgcgggcggcgagaagaacgtgctcatctttgacctgggcggtggcactttcgacgtgtccatcctgaccatcgaggatggcatcttcgaggtgaagtccacggccggggatacccacctgggcggtgaggacttcgacaaccgcatggtgagccacctggcggaggagttcaagcgcaagcacaagaaggacattgggcccaacaagcgcgccgtgaggcggctgcgcaccgcttgcgagcgcgccaagcgcaccctgagctcgtccacgcaggcgagcatcgagatcgactcgctctacgagggcgtggacttctatacgtccatcacgcgcgcccgcttcgaggagctcaatgccgacctctttcgcgggaccctggagccggtggagaaggcgctgcgcgacgccaagctggacaagggccagatccaggagatcgtgctggtgggcggctccactcgtatccccaagatccagaagctgctgcaggatttcttcaacggcaaggagctgaacaagagcatcaaccccgacgaggcggtggcctatggcgccgcggtgcaggcggccatcctcatcggcgacaaatcagagaatgtgcaggacctgctgctactcgacgtgaccccgttgtcgctgggcatcgagacagctggcggtgtcatgaccccactcatcaagaggaacaccacgatccccaccaagcagacgcagaccttcaccacctactcggacaaccagagcagcgtactggtgcaggtatacgagggcgaacgggccatgaccaaggacaataacctgctgggcaagttcgacctgaccgggattccccctgcgcctcgcggggtcccccaaatcgaggttaccttcgacattgacgccaatggcatccttaacgttaccgccgccgacaagagcaccggtaaggaaaacaaaatcaccatcaccaatgacaaaggtcgtctgagcaaggacgacattgaccggatggtgcaggaggcggagcggtacaaatcggaagatgaggcgaatcgcgaccgagtcgcggccaaaaacgccctggagtcctatacctacaacatcaagcagacggtggaagacgagaaactgaggggcaagattagcgagcaggacaaaaacaagatcctcgacaagtgtcaggaggtgatcaactggctcgaccgaaaccagatggcagagaaagatgagtatgaacacaagcagaaagagctcgaaagagtttgcaaccccatcatcagcaaactttaccaaggtggtcctggcggcggcagcggcggcggcggttcaggagcctccgggggacccaccatcgaagaagtggactaagcttgcactcaagtcagcgtaaacctctttgcctttctctctctctcttttttttttgtttgtttctttgaaatgtccttgtgccaagtacgagatctattgttggaagtctttggtatatgcaaatgaaaggagaggtgcaacaacttagtttaattataaaagttccaaagtttgttttttaaaaacattattcgaggtttctctttaatgcattttgcgtgtttgctgacttgagcatttttgattagttcgtgcatggagatttgtttgagatgagaaaccttaagtttgcacacctgttctgtagaagcttggaaacagtaaaatatataggagcttaaattgtttatttttatgtactactttaaaactaaactgaacattgcagtaatgttaaggacaggtatactttttgcaaacaaatgcataaatgcaaatgtaaagtaaagctgaaattgatctcaaaaaaaaaat

SEQ ID NO: 440713 - DNA, 2708 bp, Homo sapiens
tagcggagccagcagcaggaggcgcgcgaggcaccacggcctggcggccgagagtcagggaggaacctcatttacataacggccgcccctctgtctcctggcgggggccggagtcccgcccctcgtccaacttgaaatctgttgggtcacgggccagtcactccgacctaggcaagcctgtggtggagctggaagagtttgtgagggcggtcccgggagcggattgggtctgggagttcccagaggcggctataagaaccgggaactgggcgcggggagctgagttgctggtagtgcccgtggtgcttggttcgaggtggccgttagttgactccgcggagttcatctccctggttttcccgtcctaacgtcgctcgcctttcagtcaggatgtctgcccgtggcccggctatcggcatcgacctgggcaccacctattcgtgcgtcggggtcttccaacatggcaaggtggagatcatcgccaacgaccagggcaatcgcaccacccccagctacgtggccttcacggacaccgagcgcctcatcggcgacgccgccaagaaccaggtggccatgaaccccaccaacaccatcttcgacgccaagaggctgattggacggaaattcgaggatgccacagtgcagtcggatatgaaacactggccgttccgggtggtgagcgagggaggcaagcccaaagtgcaagtagagtacaagggggagaccaagaccttcttcccagaggagatatcctccatggtcctcacgaagatgaaggagatcgcggaagcctacctggggggcaaggtgcacagcgcggtcataacggtcccggcctatttcaacgactcgcagcgccaggccaccaaggacgcaggcaccatcacggggctcaatgtgctgcgcatcatcaacgagcccacggtggcactttcgacgtgtccatcctgaccatcgaggatggcatcttcgaggtgaagtccacggccggggatacccacctgggcggtgaggacttcgacaaccgcatggtgagccacctggcggaggagttcaagcgcaagcacaagaaggacattgggcccaacaagcgcgccgtgaggcggctgcgcaccgcttgcgagcgcgccaagcgcaccctgagctcgtccacgcaggcgagcatcgagatcgactcgctctacgagggcgtggacttctatacgtccatcacgcgcgcccgcttcgaggagctcaatgccgacctctttcgcgggaccctggagccggtggagaaggcgctgcgcgacgccaagctggacaagggccagatccaggagatcgtgctggtgggcggctccactcgtatccccaagatccagaagctgctgcaggatttcttcaacggcaaggagctgaacaagagcatcaaccccgacgaggcggtggcctatggcgccgcggtgcaggcggccatcctcatcggcgacaaatcagagaatgtgcaggacctgctgctactcgacgtgaccccgttgtcgctgggcatcgagacagctggcggtgtcatgaccccactcatcaagaggaacaccacgatccccaccaagcagacgcagaccttcaccacctactcggacaaccagagcagcgtactggtgcaggtatacgagggcgaacgggccatgaccaaggacaataacctgctgggcaagttcgacctgaccgggattccccctgcgcctcgcggggtcccccaaatcgaggttaccttcgacattgacgccaatggcatccttaacgttaccgccgccgacaagagcaccggtaaggaaaacaaaatcaccatcaccaatgacaaaggtcgtctgagcaaggacgacattgaccggatggtgcaggaggcggagcggtacaaatcggaagatgaggcgaatcgcgaccgagtcgcggccaaaaacgccctggagtcctatacctacaacatcaagcagacggtggaagacgagaaactgaggggcaagattagcgagcaggacaaaaacaagatcctcgacaagtgtcaggaggtgatcaactggctcgaccgaaaccagatggcagagaaagatgagtatgaacacaagcagaaagagctcgaaagagtttgcaaccccatcatcagcaaactttaccaaggtggtcctggcggcggcagcggcggcggcggttcaggagcctccgggggacccaccatcgaagaagtggactaagcttgcactcaagtcagcgtaaacctctttgcctttctctctctctcttttttttttgtttgtttctttgaaatgtccttgtgccaagtacgagatctattgttggaagtctttggtatatgcaaatgaaaggagaggtgcaacaacttagtttaattataaaagttccaaagtttgttttttaaaaacattattcgaggtttctctttaatgcattttgcgtgtttgctgacttgagcatttttgattagttcgtgcatggagatttgtttgagatgagaaaccttaagtttgcacacctgttctgtagaagcttggaaacagtaaaatatataggagcttaaattgtttatttttatgtactactttaaaactaaactgaacattgcagtaatgttaaggacaggtatactttttgcaaacaaatgcataaatgcaaatgtaaagtaaagctgaaattgatctcaaaaaaaaaat

SEQ ID NO: 440714 - DNA, 478 bp, Homo sapiens
  misc_feature (56)..(56): n is a, c, g, or t
  misc_feature (154)..(154): n is a, c, g, or t
ttatggaggcttccagaacccaggtgaaggcctcgggaggcgagtcttgctggagntggagacaaagtctctgaaactggaacattcctgatctctccccacaccagaggccagcagacctctttcctgaggactttctgtttaaaggaggacngaggaggaggttggtgacagtcaggcctgggaggagcccacaaactggagcacagagacatggaacctagctacttcctgggaggtggggcggggactacggagaaggtgcagccaggctgtggcaaagggccccagtcacagccttggctgggaaggagggacgacagctgaaggtcgactaaaacaaagtctgttttcatgaaaaaaaaaatttaaaactaaactgaacattgcagtaatgttaaggacaggtatactttttgcaaacaaatgcataaatgcaaatgtaaagtaaagctgaaattgatctcaaaaaaaaaat

SEQ ID NO: 440715 - DNA, 2425 bp, Homo sapiens
ggaacgttcacggactgtcttggccccggtgtgcccccgggcttaatccgtgcctatcgacctgggcaccacctattcgtgcgtcggggtcttccaacatggcaaggtggagatcatcgccaacgaccagggcaatcgcaccacccccagctacgtggccttcacggacaccgagcgcctcatcggcgacgccgccaagaaccaggtggccatgaaccccaccaacaccatcttcgacgccaagaggctgattggacggaaattcgaggatgccacagtgcagtcggatatgaaacactggccgttccgggtggtgagcgagggaggcaagcccaaagtgcaagtagagtacaagggggagaccaagaccttcttcccagaggagatatcctccatggtcctcacgaagatgaaggagatcgcggaagcctacctggggggcaaggtgcacagcgcggtcataacggtcccggcctatttcaacgactcgcagcgccaggccaccaaggacgcaggcaccatcacggggctcaatgtgctgcgcatcatcaacgagcccacggcggcggccatcgcctacggcctggacaagaagggctgcgcgggcggcgagaagaacgtgctcatctttgacctgggcggtggcactttcgacgtgtccatcctgaccatcgaggatggcatcttcgaggtgaagtccacggccggggatacccacctgggcggtgaggacttcgacaaccgcatggtgagccacctggcggaggagttcaagcgcaagcacaagaaggacattgggcccaacaagcgcgccgtgaggcggctgcgcaccgcttgcgagcgcgccaagcgcaccctgagctcgtccacgcaggcgagcatcgagatcgactcgctctacgagggcgtggacttctatacgtccatcacgcgcgcccgcttcgaggagctcaatgccgacctctttcgcgggaccctggagccggtggagaaggcgctgcgcgacgccaagctggacaagggccagatccaggagatcgtgctggtgggcggctccactcgtatccccaagatccagaagctgctgcaggatttcttcaacggcaaggagctgaacaagagcatcaaccccgacgaggcggtggcctatggcgccgcggtgcaggcggccatcctcatcggcgacaaatcagagaatgtgcaggacctgctgctactcgacgtgaccccgttgtcgctgggcatcgagacagctggcggtgtcatgaccccactcatcaagaggaacaccacgatccccaccaagcagacgcagaccttcaccacctactcggacaaccagagcagcgtactggtgcaggtatacgagggcgaacgggccatgaccaaggacaataacctgctgggcaagttcgacctgaccgggattccccctgcgcctcgcggggtcccccaaatcgaggttaccttcgacattgacgccaatggcatccttaacgttaccgccgccgacaagagcaccggtaaggaaaacaaaatcaccatcaccaatgacaaaggtcgtctgagcaaggacgacattgaccggatggtgcaggaggcggagcggtacaaatcggaagatgaggcgaatcgcgaccgagtcgcggccaaaaacgccctggagtcctatacctacaacatcaagcagacggtggaagacgagaaactgaggggcaagattagcgagcaggacaaaaacaagatcctcgacaagtgtcaggaggtgatcaactggctcgaccgaaaccagatggcagagaaagatgagtatgaacacaagcagaaagagctcgaaagagtttgcaaccccatcatcagcaaactttaccaaggtggtcctggcggcggcagcggcggcggcggttcaggagcctccgggggacccaccatcgaagaagtggactaagcttgcactcaagtcagcgtaaacctctttgcctttctctctctctcttttttttttgtttgtttctttgaaatgtccttgtgccaagtacgagatctattgttggaagtctttggtatatgcaaatgaaaggagaggtgcaacaacttagtttaattataaaagttccaaagtttgttttttaaaaacattattcgaggtttctctttaatgcattttgcgtgtttgctgacttgagcatttttgattagttcgtgcatggagatttgtttgagatgagaaaccttaagtttgcacacctgttctgtagaagcttggaaacagtaaaatatataggagcttaaattgtttatttttatgtactactttaaaactaaactgaacattgcagtaatgttaaggacaggtatactttttgcaaacaaatgcataaatgcaaatgtaaagtaaagctgaaattgatctcaaaaaaaaaat

SEQ ID NO: 440716 - DNA, 538 bp, Homo sapiens
ccctgtctcactcccccacggagactcaatttactttccatgtccacatccccagtgcttgcggaagatatcccgctaagagagagacatgtcaaaggggctgctgctgttgctgctgctgagcatgggcgggacatgggcatccaaggagccgcttcggccacggtgccgccccatcaatgccaccctggctgtggagaaggagggctgccccgtgtgcatcaccgtcaacaccaccatctgtgccggctactgccccaccatgacccgcgtgctgcagggggtcctgccggccctgcctcaggtggtgtgcaactaccgcgatgtgcgcttcgagtccatccggctccctggctgcccgcgcggcgtgaaccccgtggtctcctacgccgtggctctcagctgtcaatgtgcactctgccgccgcagcaccactgactgcgggggtcccaaggaccaccccttgacctgtgatgacccccgcttccaggcctcctcttcctcaaaggcccctccccccagccttccaagcccatcc

SEQ ID NO: 440717 - DNA, 889 bp, Homo sapiens
ggcttcaatccagcactttgctcgggtcacggcctcctcctggctcccaggaccccaccataggcagaggcaggccttcctacaccctactccctgtgcctccaggctcgactagtccctagcactcgacgactgagtctctgagatcacttcaccgtggtctccgcctcacccttggcgctggaccagtgagaggagagggctggggcgctccgctgagccactcctgcgcccccctggccttgtctacctcttgccccccgaaggtttagtgtcgagctcaccccagcatcctacaacctcctggtggccttgccgcccccacaaccccgaggtataaagccaggtacacgaggcaggggacgcaccaaggatggagatgttccaggggctgctgctgttgctgctgctgagcatgggcggggacatgggcatccaaggagccgcttcggccacggtgccgccccatcaatgccaccctggctgtggagaaggagggctgccccgtgtgcatcaccgtcaacaccaccatctgtgccggctactgccccaccatgacccgcgtgctgcagggggtcctgccggccctgcctcaggtggtgtgcaactaccgcgatgtgcgcttcgagtccatccggctccctggctgcccgcgcggcgtgaaccccgtggtctcctacgccgtggctctcagctgtcaatgtgcactctgccgccgcagcaccactgactgcgggggtcccaaggaccaccccttgacctgtgatgacccccgcttccaggactcctcttcctcaaaggcccctccccccagccttccaagtccatcccgactcccggggccctcggacaccccgatcctcccacaataaaggcttctcaatccgca

SEQ ID NO: 440718 - DNA, 951 bp, Homo sapiens
  misc_feature (844)..(844): n is a, c, g, or t
  misc_feature (852)..(852): n is a, c, g, or t
  misc_feature (856)..(856): n is a, c, g, or t
  misc_feature (863)..(863): n is a, c, g, or t
  misc_feature (866)..(866): n is a, c, g, or t
  misc_feature (872)..(872): n is a, c, g, or t
ggcttcaatccagcactttgctcgggtcacggcctcctcctggctcccaggaccccaccataggcagaggcaggccttcctacaccctactccctgtgcctccaggctcgactagtccctagcactcgacgactgagtctctgagatcacttcaccgtggtctccgcctcacccttggcgctggaccagtgagaggagagggctggggcgctccgctgagccactcctgcgcccccctggccttgtctacctcttgccccccgaaggtttagtgtcgagctcaccccagcatcctacaacctcctggtggccttgccgcccccacaaccccgaggtataaagccaggtacacgaggcaggggacgcaccaaggatggagatgttccaggggctgctgctgttgctgctgctgagcatgggcggggacatgggcatccaaggagccgcttcggccacggtgccgccccatcaatgccaccctggctgtggagaaggagggctgccccgtgtgcatcaccgtcaacaccaccatctgtgccggctactgccccaccatgacccgcgtgctgcagggggtcctgccggccctgcctcaggtggtgtgcaactaccgcgatgtgcgcttcgagtccatccggctccctggctgcccgcgcggcgtgaaccccgtggtctcctacgccgtggctctcagctgtcaatgtgcactctgccgccgcagcaccactgactgcgggggtcccaaggaccaccccttgacctgtgatgacccccgcttccaggactcctcttcctcaaaggcccctccccccagccttccaagtccatcccgactcccgggctngaaccganctcnaataagnttncatcgnaaaaaaaaaaccgaggaataatcgtgcgacaaggaaaaaggaagggaataaatcacacaactttgaaagggaagcgacc

SEQ ID NO: 440719 - DNA, 681 bp, Homo sapiens
attttaaaaaaagcgactcgtgtagagctcctagaacatagcaggaatatcggcattgtggtgacagcaattgagacgttcaaaagcagcttccagagctcccagccgggagataccctggggctcttggtccgaggcttgaagcgggaggacttgcggcggggcctggtcatggtcaagccaggttccatcaagccccaccagaaggtggaggcccaggtttacatcctcagcaaggaggaaggtggccgccacaagccctttgtgtcccacttcatgcctgtcatgttctccctgacttgggacatggcctgtcggattatcctgcccccagagaaggagcttgccatgcccggggaggacctgaagttcaacctaatcttgcggcagccaatgatcttagagaaaggccagcgtttcaccctgcgagatggcaaccggactattggcaccggtctagtcaccaacacgctggccatgactgaggaggagaagaatatcaaatggggttgagtgtgcagatctctgctcagcttcccttgcgtttaaggcctgccctagccagggctccctcctgcttccagtaccctctcatggcataggctgcaacccagcagagggcagctagatggacatttcccctgctcggaagaacagcccgcgtgctggagcatacttttg

SEQ ID NO: 440720 - DNA, 1424 bp, Homo sapiens
attttaaaaaaagcgactcgtgtagagctcctagaacatagcaggaatatcggcattgtggtgacagcaattgagacgttcaaaagcagcttccagagctcccagccgggagataccctggggctcttggtccgaggcttgaagcgggaggacttgcggcggggcctggtcatggtcaagccaggttccatcaagccccaccagaaggtggaggcccaggtttacatcctcagcaaggaggaaggtggccgccacaagccctttgtgtcccacttcatgcctgtcatgttctccctgacttgggacatggcctgtcggattatcctgcccccagagaaggagcttgccatgcccggggaggacctgaagttcaacctaatcttgcggcagccaatgatcttagagaaaggccagcgtttcaccctgcgagatggcaaccggactattggcaccggtctagtcaccaacacgctggccatgactgaggaggagaagaatatcaaatggggttgagtgtgcagatctctgctcagcttcccttgcgtttaaggcctgccctagccagggctccctcctgcttccagtaccctctcatggcataggctgcaacccagcagagggcagctagatggacatttcccctgctcggaagggttggcctgcctggctggggaggtcagtaaactttgaatagtaagccaaaaaaaaaacacacacacccaaacaacacacacaaccgcgggggccctctcatccgcgggacgccgcacacaaacagggcgtctatcgaaacactgtgcgccaacctgtgggtccacatcacgcgtgtcacgtgtacaccgagagttttgttgctaaccaaagggctggaaacactagagccggtaccacaatataggacacccgatctaacatcccgcatacgcgccgactaacccgtgctatgattctgcaagtcacacgcaccaacaatcacaagaccacacacaccacccccgagccgccacgccatccacctagagcgaaacacacaccagcccgtaccagacccacacatcaacacaagaaggaacgcaaccgaacccgcacagcagagacacacaccccagagacacaacaccaactgatccccgaacacaaccaaacaacccaaccagacaaagagggaagccacgcagcctccgagagaacgtcacaggcgcagctggcgccagaagcggtgctaacgctgtcaccgaaaccagcagacgaccgacacaaggagaggcatgacagtacagcagagtctcggcccaccgacgccagcgagaagccacagcccgggcagggagcagcgagagcagcgctagcacggcccgcgccggcaacagtgtctgcaacagaagagcagcgggcagcccgcgccgcgaccgcggtacgtatca

SEQ ID NO: 440721 - DNA, 1833 bp, Homo sapiens
ggctgcctcctggtggtagcagccaatgacagccccatgccctagacccgagagcacttattactggccaaatagattggggtggagcatgtggtggtgtatgtgaacaaggctgatgctgtccaggactctgagatggtggagctggtggaactggagattcaggagctgttcactgagtttggctataaaggggaggagaccccagtcattgtaggctctactgtctgcccttgagggtcgggaccctgagttaggcctgaagtctgtgcagaagctactggatgctgtggacacttacatcccagtgcctgcccgggacctggagaagcctttcctgctgcctgtggaggcagtgtactccatgtctggccatggcaccatggtgacaggtatgctagagcatgacattttaaagaaaggagacaagcgtgagctcctaggacataataagaacatctgcactgtgctgacaggcattgagatgttccacaagagcctggagagggccgaggctggagataacctcggggccctggtccgaggcttgaagcgggaggacttgcggcggggcctggtcatggtcaagccaggttccatcaagccccaccagaaggtggaggcccaggtttacatcctcagcaaggaggaaggtggccgccacaagccctttgtgtcccacttcatgcctgtcatgttctccctgacttgggacatggcctgtcggattatcctgcccccagagaaggagcttgccatgcccggggaggacctgaagttcaacctaatcttgcggcagccaatgatcttagagaaaggccagcgtttcaccctgcgagatggcaaccggactattggcaccggtctagtcaccaacacgctggccatgactgaggaggagaagaatatcaaatggggttgagtgtgcagatctctgctcagcttcccttgcgtttaaggcctgccctagccagggctccctcctgcttccagtaccctctcatggcataggctgcaacccagcagagggcagctagatggacatttcccctgctcggaagggttggcctgcctggctggggaggtcagtaaactttgaatagtaagccaaaaaaaaaacacacacacccaaacaacacacacaaccgcgggggccctctcatccgcgggacgccgcacacaaacagggcgtctatcgaaacactgtgcgccaacctgtgggtccacatcacgcgtgtcacgtgtacaccgagagttttgttgctaaccaaagggctggaaacactagagccggtaccacaatataggacacccgatctaacatcccgcatacgcgccgactaacccgtgctatgattctgcaagtcacacgcaccaacaatcacaagaccacacacaccacccccgagccgccacgccatccacctagagcgaaacacacaccagcccgtaccagacccacacatcaacacaagaaggaacgcaaccgaacccgcacagcagagacacacaccccagagacacaacaccaactgatccccgaacacaaccaaacaacccaaccagacaaagagggaagccacgcagcctccgagagaacgtcacaggcgcagctggcgccagaagcggtgctaacgctgtcaccgaaaccagcagacgaccgacacaaggagaggcatgacagtacagcagagtctcggcccaccgacgccagcgagaagccacagcccgggcagggagcagcgagagcagcgctagcacggcccgcgccggcaacagtgtctgcaacagaagagcagcgggcagcccgcgccgcgaccgcggtacgtatca

SEQ ID NO: 440722 - DNA, 1819 bp, Homo sapiens
ccgcgttccgggcctcggagccgccttgaggaggatgagtccctggagctggttcctgctgcagaccctctgcctcctgcccacgggcgcagcttcgcggcgcggggcgcccggcaccgccaactgcgagctcaagccccaacaaagcgagctgaattccttcttgtggaccattaagcgagacccaccatcttacttctttggcacaatccatgtcccgtacacccgagtttgggacttcatccccgacaactctaaggaggctttcctgcagagcagcattgtgtactttgagttggatctcacagacccctataccatctcagctctcaccagctgtcagatgctgccacagggcgagaacctccaagatgtgctccccagggacatctactgccgcctcaagcgccacctggagtatgtcaagctcatgatgcccttgtggatgaccccagaccagcgcggcaaggggctctacgcagactacctcttcaatgctattgccggaaactgggagcgcaagaggcctgtctgggtgatgctcatggtcaactccctgactgaagtggacattaagtcccgtggagtgcctgtcttagacctgttccttgcccaggaggctgagcggctgaggaaacagactggggcagtggaaaaggtggaagagcagtgccatccattgaatgggttgaacttttcacaggtcatctttgctttgaaccagaccctcctgcagcaggaaagcctgcgagcaggcagtcttcagatcccctacacgacggaggatctcatcaaacactataactgcggggacctcagctccgtcatcctcagccatgacagctcccaggttcccaattttattaatgccacgctaccacctcaggagcgcatcactgctcaggagattgacagctacttacgccgggagctgatctacaagcggaatgagagaatagggaagcgggtgaaggcccttttggaggagttccctgacaaaggcttcttctttgcctttggagctggtcatttcatgggcaacaacacagtgctggatgttttgcggcgtgaaggctatgaggtagaacacgcccctgctggacgacccatccacaaagggaagagtaaaaagacctccacacggcccactctgtccaccatctttgctccaaaagtccctaccctggaagtaccggcaccagaagccgtatcctcagggcactcaacgctgcctccccttgtgtcccggcctggaagtgccgacacgcccagtgaggccgaacagaggttccggaagaagcggaggcggtcacagcggaggccgcgactccggcaattcagcgatctgtgggtccgcctggaggagagtgacatagtcccgcaactccaggtccctgtcctggacaggcacatctccactgaactgcggctccctcgccgtgggcattcccaccacagccagatggtggccagcagtgcctgcctgtctctctggactcctgtgttctgggtgctggtgctggctttccaaacagagacacccctcctgtaacgactggaagcaccaggctaagaacctgacccctcggacttgaagaatggccattcctgtactccacattctggtctagccttgttgggcccaatccagaagagactgctcttgaaaaagcggcccagtgttgattcttctctttccaaggaatgtgactttgggttatccaactttgggggcaggtgtacagttttgtaacatagtgagttgtgtgaaaataaattataaatgagttgtatgaaaataaatacctttttttgtata

SEQ ID NO: 440723 - DNA, 1497 bp, Homo sapiens
ccgcgttccgggcctcggagccgccttgaggaggatgagtccctggagctggttcctgctgcagaccctctgcctcctgcccacgggcgcagcttcgcggcgcggggcgcccggcaccgccaactgcgagctcaagccccaacaaagcgagctgaattccttcttgtggaccattaagcgagacccaccatcttacttctttggcacaatccatgtcccgtacacccgagtttgggacttcatccccgacaactctaaggaggctttcctgcagagcagcattgtgtactttgagttggatctcacagacccctataccatctcagctctcaccagctgtcagatgctgccacagggcgagaacctccaagatgtgctccccagggacatctactgccgcctcaagcgccacctggagtatgtcaagctcatgatgcccttgtggatgaccccagaccagcgcggcaaggggctctacgcagactacctcttcaatgctattgccggaaactgggagcgcaagaggcctgtctgggtgatgctcatggtcaactccctgactgaagtggacattaagtcccgtggagtgcctgtcttagacctgttccttgcccaggaggctgagcggctgaggaaacagactggggcagtggaaaaggtggaagagcagtgccatccattgaatgggttgaacttttcacaggtcatttcatgggcaacaacacagtgctggatgttttgcggcgtgaaggctatgaggtagaacacgcccctgctggacgacccatccacaaagggaagagtaaaaagacctccacacggcccactctgtccaccatctttgctccaaaagtccctaccctggaagtaccggcaccagaagccgtatcctcagggcactcaacgctgcctccccttgtgtcccggcctggaagtgccgacacgcccagtgaggccgaacagaggttccggaagaagcggaggcggtcacagcggaggccgcgactccggcaattcagcgatctgtgggtccgcctggaggagagtgacatagtcccgcaactccaggtccctgtcctggacaggcacatctccactgaactgcggctccctcgccgtgggcattcccaccacagccagatggtggccagcagtgcctgcctgtctctctggactcctgtgttctgggtgctggtgctggctttccaaacagagacacccctcctgtaacgactggaagcaccaggctaagaacctgacccctcggacttgaagaatggccattcctgtactccacattctggtctagccttgttgggcccaatccagaagagactgctcttgaaaaagcggcccagtgttgattcttctctttccaaggaatgtgactttgggttatccaactttgggggcaggtgtacagttttgtaacatagtgagttgtgtgaaaataaattataaatgagttgtatgaaaataaatacctttttttgtata

SEQ ID NO: 440724 - DNA, 2914 bp, Homo sapiens
ccgcgttccgggcctcggagccgccttgaggaggatgagtccctggagctggttcctgctgcagaccctctgcctcctgcccacgggcgcagcttcgcggcgcggggcgcccggcaccgccaactgcgagctcaagccccaacaaagcgagctgaattccttcttgtggaccattaagcgagacccaccatcttacttctttggcacaatccatgtcccgtacacccgagtttgggacttcatccccgacaactctaaggaggctttcctgcagagcagcattgtgtactttgagttggatctcacagacccctataccatctcagctctcaccagctgtcagatgctgccacagggcgagaacctccaagatgtgctccccagggacatctactgccgcctcaagcgccacctggagtatgtcaagctcatgatgcccttgtggatgaccccagaccagcgcggcaaggggctctacgcagactacctcttcaatgctattgccggaaactgggagcgcaagaggcctgtctgggtgatgctcatggtcaactccctgactgaagtggacattaagtcccgtggagtgcctgtcttagacctgttccttgcccaggaggctgagcggctgaggaaacagactggggcagtggaaaaggtggaagagcagtgccatccattgaatgggttgaacttttcacaggtcatctttgctttgaaccagaccctcctgcagcaggaaagcctgcgagcaggcagtcttcagatcccctacacgacggaggatctcatcaaacactataactgcggggacctcagctccgtcatcctcagccatgacagctcccaggttcccaattttattaatgccacgctaccacctcaggagcgcatcactgctcaggagattgacagctacttacgccgggagctgatctacaagcggaatgagagaatagggaagcgggtgaaggcccttttggaggagttccctgacaaaggcttcttctttgcctttggagctgcttcacagtagccttgaaaatcaggagccttgaactacagtagctgtgaaaactgtttgcctaatggttactggaggggacagaatgggttcaaagttcctccaaagctccatccttaaagaatcatcactatttgacatgtccaatagttccctgaaatttccattcccaagcttgtcttcatttgacctgactcagagcttgctctgtgtgaatagccctattcttagggtgtgtgttgaaaacaatcagtagcagctgtttaacatcatagttgctggaaatagcaatattaattgaagcttacaaggggctgcccaaaaaacttaaaagcaaaatcccatagggggtatagaaaagctctaaaatattcctagagagtcacatgcatgagaagagctgtgcacatgcccaggaaagacctgagaaggtcctaatctctcacctctggctgatcttgaggctctgtgtaagcagagtgtgaaagctaaggcaaagtcataaattgcctgttgaagcatcaaatacatgcccccaaactcacacagcccctctgcaaaggttgggaaacttgcaaggaatttaaggaaatctctgttcagtcattagccagccactaaactaactgagcagatccttcagtgatcacacacaacaaagaatacagactttacagacttagtcctagaaaatcactacacaaacagcaacaacaatgcacctgggactaagggagaggagatgagttccagagttggtatattatttaaatgtctagttttcaataaaaacaattataagacacagagcaaaactagaaagtatggcccatacccagggaaaaacaagcaaccaatagaagctgtccttgaggaagttaatatcttggacttactagaaaatgactttaacactagttattataaatatgttcaaaaaactaaaagaggccaggtgcggaggctcacgcctataatcccagcactttgggaggctgaagcaggtgggtcacctgaggtcaggagtttgagaccagcctgaccaatatggcaaaaccctatctctactaataatacaaaaattagccaggcgttgtggcgcacacctgtaatcccagctacttgggaggctgaagcaggagaactgcttgaaactgggaggaagaggttgcagtaagctgagatcacaccactgtactccagcctgggccacaagagtgaaactccatctccaaaaaaaaaaaaaaaaaaaaaaaccctaaaattaaccatatctaaagaattaaaggaaagtttgagaacaatatctcaccaatacagaatatcaataaaaatataaaaattattttaaaagaaccaaataggaattctggaatttaaagtgtaggaactgaaatgaaaaattcactacgggggctgaacagtagatttgaactggcagaagaagaatcaacatacatgaagataggttgattgagatgattcagtatgagaaagagaaaggaaaaggaatgaagaaaaatgaatagatcttcagatacctgtgagacaccctcaagtgtgccaatgtatacctaacgggagtcccagaagacaggagagaaaaaaagaaagaaataaaaagaatatttgaatttaaaattgcttgaaaatgtctcaaatttgatgaaaaatattactctgcacattcaacccatgaactataagttgtataaaatcaaaaagtttcacaccaaggcgtgtcatagccaaactgtcaaaagccaaagacacagaatcttgaaagcagtgagagcaaagcagacaagggatccccaataggattaacagcagatttctcatcagaagccatgcaagccagaaggctatgggagacatactcaaaatgct

SEQ ID NO: 440725 - DNA, 2356 bp, Homo sapiens
ggattaaggccctaataaaagaggtgtcatgcagccattcagttagcttgcccttctgtcttcttccatgtgaggatgcagcaagaaggccctcaccagaccaaaggccagtgccttgatctcggacttcccagcctccagaatggtcatctttgctttgaaccagaccctcctgcagcaggaaagcctgcgagcaggcagtcttcagatcccctacacgacggaggatctcatcaaacactataactgcggggacctcagctccgtcatcctcagccatgacagctcccaggttcccaattttattaatgccacgctaccacctcaggagcgcatcactgctcaggagattgacagctacttacgccgggagctgatctacaagcggaatgagagaatagggaagcgggtgaaggcccttttggaggagttccctgacaaaggcttcttctttgcctttggagctgcttcacagtagccttgaaaatcaggagccttgaactacagtagctgtgaaaactgtttgcctaatggttactggaggggacagaatgggttcaaagttcctccaaagctccatccttaaagaatcatcactatttgacatgtccaatagttccctgaaatttccattcccaagcttgtcttcatttgacctgactcagagcttgctctgtgtgaatagccctattcttagggtgtgtgttgaaaacaatcagtagcagctgtttaacatcatagttgctggaaatagcaatattaattgaagcttacaaggggctgcccaaaaaacttaaaagcaaaatcccatagggggtatagaaaagctctaaaatattcctagagagtcacatgcatgagaagagctgtgcacatgcccaggaaagacctgagaaggtcctaatctctcacctctggctgatcttgaggctctgtgtaagcagagtgtgaaagctaaggcaaagtcataaattgcctgttgaagcatcaaatacatgcccccaaactcacacagcccctctgcaaaggttgggaaacttgcaaggaatttaaggaaatctctgttcagtcattagccagccactaaactaactgagcagatccttcagtgatcacacacaacaaagaatacagactttacagacttagtcctagaaaatcactacacaaacagcaacaacaatgcacctgggactaagggagaggagatgagttccagagttggtatattatttaaatgtctagttttcaataaaaacaattataagacacagagcaaaactagaaagtatggcccatacccagggaaaaacaagcaaccaatagaagctgtccttgaggaagttaatatcttggacttactagaaaatgactttaacactagttattataaatatgttcaaaaaactaaaagaggccaggtgcggaggctcacgcctataatcccagcactttgggaggctgaagcaggtgggtcacctgaggtcaggagtttgagaccagcctgaccaatatggcaaaaccctatctctactaataatacaaaaattagccaggcgttgtggcgcacacctgtaatcccagctacttgggaggctgaagcaggagaactgcttgaaactgggaggaagaggttgcagtaagctgagatcacaccactgtactccagcctgggccacaagagtgaaactccatctccaaaaaaaaaaaaaaaaaaaaaaaccctaaaattaaccatatctaaagaattaaaggaaagtttgagaacaatatctcaccaatacagaatatcaataaaaatataaaaattattttaaaagaaccaaataggaattctggaatttaaagtgtaggaactgaaatgaaaaattcactacgggggctgaacagtagatttgaactggcagaagaagaatcaacatacatgaagataggttgattgagatgattcagtatgagaaagagaaaggaaaaggaatgaagaaaaatgaatagatcttcagatacctgtgagacaccctcaagtgtgccaatgtatacctaacgggagtcccagaagacaggagagaaaaaaagaaagaaataaaaagaatatttgaatttaaaattgcttgaaaatgtctcaaatttgatgaaaaatattactctgcacattcaacccatgaactataagttgtataaaatcaaaaagtttcacaccaaggcgtgtcatagccaaactgtcaaaagccaaagacacagaatcttgaaagcagtgagagcaaagcagacaagggatccccaataggattaacagcagatttctcatcagaagccatgcaagccagaaggctatgggagacatactcaaaatgct

SEQ ID NO: 440726 - DNA, 2306 bp, Homo sapiens
cggagtgactctgacacagaattctttgcagcctcaggaaatgaggatagaaatgccagaggctggacagtatgcagaaagatcatttgctgggctgggctttgtttcatatttttctgctaacttcataaacttaaacaagtcatgtcactcagtttctttaccagtaagatagggggttggagagaagcaattctgaaatggtggagtgagggcctccaaaaacctgttcttccatagcagcgataagaacactggaaaaaatggtcaaaatcaacttttccacagctctggaaattaattaaaggcttgcaacaatcctagaagtgtttatttaagaaaactggatgaattttgatagaagcagtgggctttgtggcattttaacttgttctgtttttatctcccttttcccagcttcacagtagccttgaaaatcaggagccttgaactacagtagctgtgaaaactgtttgcctaatggttactggaggggacagaatgggttcaaagttcctccaaagctccatccttaaagaatcatcactatttgacatgtccaatagttccctgaaatttccattcccaagcttgtcttcatttgacctgactcagagcttgctctgtgtgaatagccctattcttagggtgtgtgttgaaaacaatcagtagcagctgtttaacatcatagttgctggaaatagcaatattaattgaagcttacaaggggctgcccaaaaaacttaaaagcaaaatcccatagggggtatagaaaagctctaaaatattcctagagagtcacatgcatgagaagagctgtgcacatgcccaggaaagacctgagaaggtcctaatctctcacctctggctgatcttgaggctctgtgtaagcagagtgtgaaagctaaggcaaagtcataaattgcctgttgaagcatcaaatacatgcccccaaactcacacagcccctctgcaaaggttgggaaacttgcaaggaatttaaggaaatctctgttcagtcattagccagccactaaactaactgagcagatccttcagtgatcacacacaacaaagaatacagactttacagacttagtcctagaaaatcactacacaaacagcaacaacaatgcacctgggactaagggagaggagatgagttccagagttggtatattatttaaatgtctagttttcaataaaaacaattataagacacagagcaaaactagaaagtatggcccatacccagggaaaaacaagcaaccaatagaagctgtccttgaggaagttaatatcttggacttactagaaaatgactttaacactagttattataaatatgttcaaaaaactaaaagaggccaggtgcggaggctcacgcctataatcccagcactttgggaggctgaagcaggtgggtcacctgaggtcaggagtttgagaccagcctgaccaatatggcaaaaccctatctctactaataatacaaaaattagccaggcgttgtggcgcacacctgtaatcccagctacttgggaggctgaagcaggagaactgcttgaaactgggaggaagaggttgcagtaagctgagatcacaccactgtactccagcctgggccacaagagtgaaactccatctccaaaaaaaaaaaaaaaaaaaaaaaccctaaaattaaccatatctaaagaattaaaggaaagtttgagaacaatatctcaccaatacagaatatcaataaaaatataaaaattattttaaaagaaccaaataggaattctggaatttaaagtgtaggaactgaaatgaaaaattcactacgggggctgaacagtagatttgaactggcagaagaagaatcaacatacatgaagataggttgattgagatgattcagtatgagaaagagaaaggaaaaggaatgaagaaaaatgaatagatcttcagatacctgtgagacaccctcaagtgtgccaatgtatacctaacgggagtcccagaagacaggagagaaaaaaagaaagaaataaaaagaatatttgaatttaaaattgcttgaaaatgtctcaaatttgatgaaaaatattactctgcacattcaacccatgaactataagttgtataaaatcaaaaagtttcacaccaaggcgtgtcatagccaaactgtcaaaagccaaagacacagaatcttgaaagcagtgagagcaaagcagacaagggatccccaataggattaacagcagatttctcatcagaagccatgcaagccagaaggctatgggagacatactcaaaatgct

SEQ ID NO: 440727 - DNA, 893 bp, Homo sapiens
gcttggcagggtaatttcttggttctagggtgtgtgtttggggagtatgtttggtggtcctgagagctgcagcatttcaggttgtttttctcactgcaggtcatttcatgggcaacaacacagtgctggatgttttgcggcgtgaaggctatgaggtagaacacgcccctgctggacgacccatccacaaagggaagagtaaaaagacctccacacggcccactctgtccaccatctttgctccaaaagtccctaccctggaagtaccggcaccagaagccgtatcctcagggcactcaacgctgcctccccttgtgtcccggcctggaagtgccgacacgcccagtgaggccgaacagaggttccggaagaagcggaggcggtcacagcggaggccgcgactccggcaattcagcgatctgtgggtccgcctggaggagagtgacatagtcccgcaactccaggtccctgtcctggacaggcacatctccactgaactgcggctccctcgccgtgggcattcccaccacagccagatggtggccagcagtgcctgcctgtctctctggactcctgtgttctgggtgctggtgctggctttccaaacagagacacccctcctgtaacgactggaagcaccaggctaagaacctgacccctcggacttgaagaatggccattcctgtactccacattctggtctagccttgttgggcccaatccagaagagactgctcttgaaaaagcggcccagtgttgattcttctctttccaaggaatgtgactttgggttatccaactttgggggcaggtgtacagttttgtaacatagtgagttgtgtgaaaataaattataaatgagttgtatgaaaataaatacctttttttgtata

SEQ ID NO: 440728 - DNA, 789 bp, Homo sapiens
ccgcgttccgggcctcggagccgccttgaggaggatgagtccctggagctggttcctgctgcagaccctctgcctcctgcccacgggcgcagcttcgcggcgcggggcgcccggcaccgccaactgcgagctcaagccccaacaaagcgagctgaattccttcttgtggaccattaagcgagacccaccatcttacttctttggcacaatccatgtcccgtacacccgagtttgggacttcatccccgacaactctaaggaggctttcctgcagagcagcattgtgtactttgagttggatctcacagacccctataccatctcagctctcaccagctgtcagatgctgccacagggcgagaacctccaagatgtgctccccagggacatctactgccgcctcaagcgccacctggagtatgtcaagctcatgatgcccttgtggatgaccccagaccagcgcggcaaggggctctacgcagactacctcttcaatgctattgccggaaactgggagcgcaagaggcctgtctgggtgatgctcatggtcaactccctgactgaagtggacattaagtcccgtggagtgcctgtcttagacctgttccttgcccaggaggctgagcggctgaggaaacagactggggcagtggaaaaggtggaagagcagtgccatccattgaatgggttgaacttttcacagcatctttgctttgaaccacgaccctcctgccgcaggacaactccgcccagctctcttcagaacaccttcgggtacctctgaacgct

SEQ ID NO: 440729 - DNA, 2353 bp, Homo sapiens
tctgtttccaggtctggcggggggccgggctgcggtggcggcagcggtgggagatgccggggcggccggcggaggtccatgtggcgctctaggtgggatgccagcgtcctgaaggcggaggccctggccctcctcccctgcggcctgggcatggcattctcccagtcccacgtgatggccgctcggcggcaccagcacagccggctcatcatcgaggtggacgagtacagctccaaccccacccaggccttcaccttctacaacatcaaccagggccgcttccagccaccgcatgtgcagatggtggacccggtgcctcacgatgcccccaaacctccaggctacacccgcttcgtctgcgtctctgatacccactcgaggacggaccccatccagatgccgtacggcgacgtgctgatccacgctggggacttcactgagctggggctcccgagcgaggtgaagaagttcaacgagtggctgggcagcctgccctacgagtacaagatcgtgatcgcaggcaaccacgagctgacctttgaccaggagttcatggccgacctcatcaagcaggacttttactacttcccatctgtgtcgaagctgaagccggagaactatgagaatgtgcagtcgctgctgaccaactgcatctaccttcaggactcggaggtcaccgtgcggggcttccggatctatggctccccatggcagccctggttctacggctggggcttcaacctcccgcgaggccaagccctgctggagaaatggaacctcattcccgaaggcgtagacatcctgataacccatggaccaccactgggcttcctggactgggtccccaagaagatgcagcgggtgggctgtgtggagctgctcaacacggtgcagaggcgcgtccagccgcggttacatgtctttggccacatccacgaagggtatggtgtcatggcagatgggacgaccacctatgtgaatgcgtccgtatgcactgtgaactaccagcccgtgaacccgcccatagtcatcgacctccccacaccccggaactcctgactgctccccactgcccctgccctgcccgcccgtgtcagctccacaggcctggcccggccactgttccttccatgctgagttgcctggacgacccatctggctgcggggactggcctagcaggcaggtcagggccttggaacgactctttagccttctgtcacctggagttgggaccctgcgcatccccatcaggggttctgtgctcatttactttttctgcgtgtacatcctgcgtgtacctcgttaaaggacctactaagctcatggccctgtcatgtttgggaaatgactaaatcttcattcttctcccttggacgccctcctggtttgggaagctgctgctcttgaatgggttttggaagttacacaaaatctccctctaaccacgggtctgtgtggcggcatgcccctgggttggggtgggtgggaggattcgtgagctgcacacagacagtccctttctctcctcccaagtgagggaggagacaggcccaagggggaggccctccgagggagcatttagggacatctcaggaattcagaccgcacctggccaggcccacagctgtttgcctggcattgttcccccctttttcttcccataggcatttttgtttacttgaacaatgacctgagtgtcctaggcattcactcggagcctggatgatgggggctggttctacagaatgagccactggcattcgtgcccaggaccagtgagagcgttcccagtcatggggggatgacccttggtcccacggggaacacactgctctgtagaatgcggtagcctggatggagggtctgcaggcttaggctgcagcaggcctgccatgggtgtgaacccatgtccaggcacgcaccgacacacatgcacgcacgcacccctcttaattgaaccaagtgggtcctgtgtttctcttttctgccccgtagtgaggttctgttccttggatgcggcttcccttgcaccgttaggattctgtctggcatgcctgcagccgaggaagcccaggaccagccggccctgtgaattggagggtggcacagggaccgagcgggccccaggctccagcagccccaccttggacagcttctttttcttctttgaattaggactggagggggtggggccagggcggtggtgggaaccggtagggcctagatgaggggcaggcagtcaggcagaaatgggcaagttcagggtcagattctgtcgttatttaatattttgttcatcatggactttttctgcatttattttgatttttaacgttgccctcgtgccgaatt

SEQ ID NO: 440730 - DNA, 1149 bp, Homo sapiens
tctgtttccaggtctggcggggggccgggctgcggtggcggcagcggtgggagatgccggggcggccggcggaggtccatgtggcgctctaggtgggatgccagcgtcctgaaggcggaggccctggccctcctcccctgcggcctgggcatggcattctcccagtcccacgtgatggccgctcggcggcaccagcacagccggctcatcatcgaggtggacgagtacagctccaaccccacccaggccttcaccttctacaacatcaaccagggccgcttccagccaccgcatgtgcagatggtggacccggtgcctcacgatgcccccaaacctccaggctacacccgcttcgtctgcgtctctgatacccactcgaggacggaccccatccagatgccgtacggcgacgtgctgatccacgctggggacttcactgagctggggctcccgagcgaggtgaagaagttcaacgagtggctgggcagcctgccctacgagtacaagatcgtgatcgcaggcaaccacgagctgacctttgaccaggagttcatggccgacctcatcaagcaggacttttactacttcccatctgtgtcgaagctgaagccggagaactatgagaatgtgcagtcgctgctgaccaactgcatctaccttcaggactcggaggtcaccgtgcggggcttccggatctatggctccccatggcagcagcactgtatcgggttggctgaagctgagcgccgtggggtgcagggctccaggaatcccgtttggctgaaggggttcctgtagccagggatgtttatgaggtctctctgatgccccaggcgcaggacatgtgtgcgggtggagaaaagcaggccctttcagtgccagctccactcaatttctatgtggaccaagaacgataaacttaaaaaattttttttcctaaggtatcttcagaatatggtgtatttttatgtggaaaagaaaagttatgaaggcagctgttactttaagagaaaattcattaaaagtcctcgaggtatgaagatgacggcgtgcttctcaatcattttggcataacttgattgtggctgtaatttttttttttttttgtcaagcatgtcagacaataaagtctttgtaaaaagaaaaaaa

SEQ ID NO: 440731 - DNA, 4451 bp, Homo sapiens
cccgcggtttgtccgcgcctctgctaccccctgcgcaggcgctcaaggagctcttggactccaggttcccgcggctgggagaaaaggaggcggggatccgaagggggaaatgactctgaggcgcccggacgtcgctcggaagccaatcagagagcgtgacgtcagtttggcgcggagtttggcggccggggcttacagtggcgggagttggaggcgataacgatttgtgttgtgagaggcgcaagctgcgatttctgctgaacttggaggcatttctacgacttttctctcagctgaggcttttcctccgaccctgatgctcttcaattcggtgctccgccagccccagcttggcgtcctgagaaatggatggtcttcacaataccctcttcaatcccttctgactggttatcagtgcagtggtaatgatgaacacacttcttatggagaaacaggagtcccagttcctccttttggatgtaccttctcttctgctcccaatatggaacatgtactagcagttgccaatgaagaaggctttgttcgattgtataacacagaatcacaaagtttcagaaagaagtgcttcaaagaatggatggctcactggaatgccgtctttgacctggcctgggttcctggtgaacttaaacttgttacagcagcaggtgatcaaacagccaaattttgggacgtaaaagctggtgagctgattggaacatgcaaaggtcatcaatgcagcctcaagtcagttgccttttctaagtttgagaaagctgtattctgtacgggtggaagagatggcaacattatggtctgggataccaggtgcaacaaaaaagatgggttttataggcaagtgaatcaaatcagtggagctcacaatacctcagacaagcaaaccccttcaaaacccaagaagaaacagaattcaaaaggacttgctccttctgtggatttccagcaaagtgttactgtggtcctctttcaagacgagaataccttagtctcagcaggagctgtggatgggataatcaaagtatgggatttacgtaagaattatactgcttatcgacaagaacccatagcatccaagtctttcctgtacccaggtagcagcactcgaaaacttggatattcaagtctgattttggattccactggctctactttatttgctaattgcacagacgataacatctacatgtttaatatgactgggttgaagacttctccagtggctattttcaatggacaccagaactctaccttttatgtaaaatccagccttagtccagatgaccagtttttagtcagtggctcaagtgatgaagctgcctacatatggaaggtctccacaccctggcaacctcctactgtgctcctgggtcattctcaagaggtcacgtctgtgtgctggtgtccatctgacttcacaaagattgctacctgttctgatgacaatacactaaaaatctggcgcttgaatagaggcttagaggagaaaccaggaggtgataaactttccacggtgggttgggcctctcagaagaaaaaagagtcaagacctggcctagtaacagtaacgagtagccagagtactcctgccaaagcccccagggtaaagtgcaatccatccaattcttccccgtcatccgcagcttgtgccccaagctgtgctggagacctccctcttccttcaaatactcctacgttctctattaaaacctctcctgccaaggcccggtctcccatcaacagaagaggctctgtctcctccgtctctcccaagccaccttcatctttcaagatgtcgattagaaactgggtgacccgaacaccttcctcatcaccacccatcactccacctgcttcggagaccaagatcatgtctccgagaaaagcccttattcctgtgagccagaagtcatcccaagcagaggcttgctctgagtctagaaatagagtaaagaggaggctagactcaagctgtctggagagtgtgaaacaaaagtgtgtgaagagttgtaactgtgtgactgagcttgatggccaagttgaaaatcttcatttggatctgtgctgccttgctggtaaccaggaagaccttagtaaggactctctaggtcctaccaaatcaagcaaaattgaaggagctggtaccagtatctcagagcctccgtctcctatcagtccgtatgcttcagaaagctgtggaacgctacctcttcctttgagaccttgtggagaagggtctgaaatggtaggcaaagagaatagttccccagagaataaaaactggttgttggccatggcagccaaacggaaggctgagaatccatctccacgaagtccgtcatcccagacacccaattccaggagacagagcggaaagacattgccaagcccggtcaccatcacgcccagctccatgaggaaaatctgcacatacttccatagaaagtcccaggaggacttctgtggtcctgaacactcaacagaattatagattctaatctgagtgagttactgagctttggtccactaaaacaagctgagctttggtccactaaaacaagatgaaaaatacaagagtgactctataactctggtctttaagaaagctgccttttcatttttagacaaaatcttttcaacgctgaaatgtacctaatctggttctactaccataatgtatatgcagcttcccgaggatgaatgctgtgtttaaatttcataaagtaaatttgtcactctagcattttgaatgaatagtcttcactttttaaattattcatcttctctataataatgacatcccagttcatggaggcaaaaaacaagtttcttgttatcctgaaactttctatgctcagtggaaagtatctgccagccacagcatgaggcctgtgaaggctgactgagaaatcctctgctgaagacccctggttctgttctgcctccaacatgtataattttatttgaaatacataatcttttcactatgcttttgtggggttttttttaagtatgtgtaaaaatgtgatgctcagataagtacatttatatcagttcagtgttaaaatgcagtctcttgagttaaagtcatctttattttaaatgcagtgataaatgtcaactcttcggagaaactaggagaacaacaacagaaagctgtgtttgtcttttttctctcaaatatatctcccgtatgagatttcaggtccccatgttttcaccaagcaatctgctatgtcagccaacccaacatcactttctacaggaggttatgatttttgccatttactagaggaagatgttttatgaaatcaatttggggtttgaattcaggtgcagtcatcagttctttaggggctgcaatgttttaaaaaaaataagtcatcagattttaagaaaaaagtgatgatttcttattgatatttttgtaacagaatatagctcttaactgaaaatccagaaccagaaacataaatcttgagtttcttttcatgtacataaaaagcaatagccttttagtatagatagccctgagccaaaaagtaatagaattttctctagatatttaatacagagagtgtatagactgactctaagttaataatgtgcaaaatatcttaaacatccctccccttattcaacaattatgtatcagtgatcttgaaccattgttttatatttttcacctttgtaacctcatggaaagaggctttacatactttctatgtactatttacttagaagggagcccccttccagtcatgaaacttcatttgttttatccatatcctgaggactgtgtagacttatgactgtgtagactttatgtcagttctgtgtagactttatgtcagtttttgtcattatttgaaaatctattctgacaactttttaattcctttgatcttataagttaaagctgtaacaactgaaattgcatggatcaagtaagcatagttttatccagggagaaaaataaaaggaagccatagaattgctctggtcaaaaccaagcacaccatagccttaactgaatatttaggaaatctgcctaatctgcttatatttggtgtttgttttttgactgttgggctttgggaagatgttatttatgaccaatatctgccagtaacgctgtttatctcacttgctttgaaagccaatgggggaaaaaaatccatgaaaaaaaaaagattgataaagtagatgattttgtttgtatccctacccatctcctggcagccctactgagtgaaattgggatacatttggctgtcagaaattataccgagtctactgggtataacatgtctcacttggaaagctagtacttttaaatgggtgccaaaggtcaactgtaatgagataattatccctgcctgtgtccatgtcagactttgagctgatcctgaataataaagccttttacctta

SEQ ID NO: 440732 - DNA, 4389 bp, Homo sapiens
cccgcggtttgtccgcgcctctgctaccccctgcgcaggcgctcaaggagctcttggactccaggttcccgcggctgggagaaaaggaggcggggatccgaagggggaaatgactctgaggcgcccggacgtcgctcggaagccaatcagagagcgtgacgtcagtttggcgcggagtttggcggccggggcttacagtggcgggagttggaggcgataacgatttgtgttgtgagaggcgcaagctgcgatttctgctgaacttggaggcatttctacgacttttctctcagctgaggcttttcctccgaccctgatgctcttcaattcggtgctccgccagccccagcttggcgtcctgagaaatggatggtcttcacaataccctcttcaatcccttctgactggttatcagtgcagtggtaatgatgaacacacttcttatggagaaacaggagtcccagttcctccttttggatgtaccttctcttctgctcccaatatggaacatgtactagcagttgccaatgaagaaggctttgttcgattgtataacacagaatcacaaagtttcagaaagaagtgcttcaaagaatggatggctcactggaatgccgtctttgacctggcctgggttcctggtgaacttaaacttgttacagcagcaggtgatcaaacagccaaattttgggacgtaaaagctggtgagctgattggaacatgcaaaggtcatcaatgcagcctcaagtcagttgccttttctaagtttgagaaagctgtattctgtacgggtggaagagatggcaacattatggtctgggataccaggtgcaacaaaaaagatgggttttataggcaagtgaatcaaatcagtggagctcacaatacctcagacaagcaaaccccttcaaaacccaagaagaaacagaattcaaaaggacttgctccttctgtggatttccagcaaagtgttactgtggtcctctttcaagacgagaataccttagtctcagcaggagctgtggatgggataatcaaagtatgggatttacgtaagaattatactgcttatcgacaagaacccatagcatccaagtctttcctgtacccaggtagcagcactcgaaaacttggatattcaagtctgattttggattccactggctctactttatttgctaattgcacagacgataacatctacatgtttaatatgactgggttgaagacttctccagtggctattttcaatggacaccagaactctaccttttatgtaaaatccagccttagtccagatgaccagtttttagtcagtggctcaagtgatgaagctgcctacatatggaaggtctccacaccctggcaacctcctactgtgctcctgggtcattctcaagaggtcacgtctgtgtgctggtgtccatctgacttcacaaagattgctacctgttctgatgacaatacactaaaaatctggcgcttgaatagaggcttagaggagaaaccaggaggtgataaactttccacggtgggttgggcctctcagaagaaaaaagagtcaagacctggcctagtaacagtaacgagtagccagagtactcctgccaaagcccccagggtaaagtgcaatccatccaattcttccccgtcatccgcagcttgtgccccaagctgtgctggagacctccctcttccttcaaatactcctacgttctctattaaaacctctcctgccaaggcccggtctcccatcaacagaagaggctctgtctcctccgtctctcccaagccaccttcatctttcaagatgtcgattagaaactgggtgacccgaacaccttcctcatcaccacccatcactccacctgcttcggagaccaagatcatgtctccgagaaaagcccttattcctgtgagccagaagtcatcccaagcagaggcttgctctgagtctagaaatagagtaaagaggaggctagactcaagctgtctggagagtgtgaaacaaaagtgtgtgaagagttgtaactgtgtgactgagcttgatggccaagttgaaaatcttcatttggatctgtgctgccttgctggtaaccaggaagaccttagtaaggactctctaggtcctaccaaatcaagcaaaattgaaggagctggtaccagtatctcagagcctccgtctcctatcagtccgtatgcttcagaaagctgtggaacgctacctcttcctttgagaccttgtggagaagggtctgaaatggtaggcaaagagaatagttccccagagaataaaaactggttgttggccatggcagccaaacggaaggctgagaatccatctccacgaagtccgtcatcccagacacccaattccaggagacagagcggaaagacattgccaagcccggtcaccatcacgcccagctccatgaggaaaatctgcacatacttccatagaaagtcccaggaggacttctgtggtcctgaacactcaacagaattatagattctaatctgagtgagttactgagctttggtccactaaaacaagctgagctttggtccactaaaacaagatgaaaaatacaagagtgactctataactctggtctttaagaaagctgccttttcatttttagacaaaatcttttcaacgctgaaatgtacctaatctggttctactaccataatgtatatgcagcttcccgaggatgaatgctgtgtttaaatttcataaagtaaatttgtcactctagcattttgaatgaatagtcttcactttttaaattattcatcttctctataataatgacatcccagttcatggaggcaaaaaacaagtttcttgttatcctgaaactttctatgctcagtggaaagtatctgccagccacagcatgaggcctgtgaaggctgactgagaaatcctctgctgaagacccctggttctgttctgcctccaacatgtataattttatttgaaatacataatcttttcactatgcttttgtggggttttttttaagtatgtgtaaaaatgtgatgctcagataagtacatttatatcagttcagtgttaaaatgcagtctcttgagttaaagtcatctttattttaaatgcagtgataaatgtcaactcttcggagaaactaggagaacaacaacagaaagctgtgtttgtcttttttctctcaaatatatctcccgtatgagatttcaggtccccatgttttcaccaagcaatctgctatgtcagccaacccaacatcactttctacaggaggttatgatttttgccatttactagaggaagatgttttatgaaatcaatttggggtttgaattcaggtgcagtcatcagttctttaggggctgcaatgttttaaaaaaaataagtcatcagattttaagaaaaaagtgatgatttcttattgatatttttgtaacagaatatagctcttaactgaaaatccagaaccagaaacataaatcttgagtttcttttcatgtacataaaaagcaatagccttttagtatagatagccctgagccaaaaagtaatagaattttctctagatatttaatacagagagtgtatagactgactctaagttaataatgtgcaaaatatcttaaacatccctccccttattcaacaattatgtatcagtgatcttgaaccattgttttatatttttcacctttgtaacctcatggaaagaggctttacatactttctatgtactatttacttagaagggagcccccttccagtcatgaaacttcatttgttttatccatatcctgaggactgtgtagacttatgatctattctgacaactttttaattcctttgatcttataagttaaagctgtaacaactgaaattgcatggatcaagtaagcatagttttatccagggagaaaaataaaaggaagccatagaattgctctggtcaaaaccaagcacaccatagccttaactgaatatttaggaaatctgcctaatctgcttatatttggtgtttgttttttgactgttgggctttgggaagatgttatttatgaccaatatctgccagtaacgctgtttatctcacttgctttgaaagccaatgggggaaaaaaatccatgaaaaaaaaaagattgataaagtagatgattttgtttgtatccctacccatctcctggcagccctactgagtgaaattgggatacatttggctgtcagaaattataccgagtctactgggtataacatgtctcacttggaaagctagtacttttaaatgggtgccaaaggtcaactgtaatgagataattatccctgcctgtgtccatgtcagactttgagctgatcctgaataataaagccttttacctta

SEQ ID NO: 440733 - DNA, 4592 bp, Homo sapiens
cccgcggtttgtccgcgcctctgctaccccctgcgcaggcgctcaaggagctcttggactccaggttcccgcggctgggagaaaaggaggcggggatccgaagggggaaatgactctgaggcgcccggacgtcgctcggaagccaatcagagagcgtgacgtcagtttggcgcggagtttggcggccggggcttacagtggcgggagttggaggcgataacgatttgtgttgtgagaggcgcaagctgcgatttctgctgaacttggaggcatttctacgacttttctctcagctgaggcttttcctccgaccctgatgctcttcaattcggtgctccgccagccccagcttggcgtcctgagaaatggatggtcttcacaataccctcttcaatcccttctgactggttatcagtgcagtggtaatgatgaacacacttcttatggagaaacaggagtcccagttcctccttttggatgtaccttctcttctgctcccaatatggaacatgtactagcagttgccaatgaagaaggctttgttcgattgtataacacagaatcacaaagtttcagaaagaagtgcttcaaagaatggatggctcactggaatgccgtctttgacctggcctgggttcctggtgaacttaaacttgttacagcagcaggtgatcaaacagccaaattttgggacgtaaaagctggtgagctgattggaacatgcaaaggtcatcaatgcagcctcaagtcagttgccttttctaagtttgagaaagctgtattctgtacgggtggaagagatggcaacattatggtctgggataccaggtgcaacaaaaaagatgggttttataggcaagtgaatcaaatcagtggagctcacaatacctcagacaagcaaaccccttcaaaacccaagaagaaacagaattcaaaaggacttgctccttctgtggatttccagcaaagtgttactgtggtcctctttcaagacgagaataccttagtctcagcaggagctgtggatgggataatcaaagtatgggatttacgtaagaattatactgcttatcgacaagaacccatagcatccaagtctttcctgtacccaggtagcagcactcgaaaacttggatattcaagtctgattttggattccactggctctactttatttgctaattgcacagacgataacatctacatgtttaatatgactgggttgaagacttctccagtggctattttcaatggacaccagaactctaccttttatgtaaaatccagccttagtccagatgaccagtttttagtcagtggctcaagtgatgaagctgcctacatatggaaggtctccacaccctggcaacctcctactgtgctcctgggtcattctcaagaggtcacgtctgtgtgctggtgtccatctgacttcacaaagattgctacctgttctgatgacaatacactaaaaatctggcgcttgaatagaggcttagaggagaaaccaggaggtgataaactttccacggtgggttgggcctctcagaagaaaaaagagtcaagacctggcctagtaacagtaacgagtagccagagtactcctgccaaagcccccagggtaaagtgcaatccatccaattcttccccgtcatccgcagcttgtgccccaagctgtgctggagacctccctcttccttcaaatactcctacgttctctattaaaacctctcctgccaaggcccggtctcccatcaacagaagaggctctgtctcctccgtctctcccaagccaccttcatctttcaagatgtcgattagaaactgggtgacccgaacaccttcctcatcaccacccatcactccacctgcttcggagaccaagatcatgtctccgagaaaagcccttattcctgtgagccagaagtcatcccaagcagaggcttgctctgagtctagaaatagagtaaagaggaggctagactcaagctgtctggagagtgtgaaacaaaagtgtgtgaagagttgtaactgtgtgactgagcttgatggccaagttgaaaatcttcatttggatctgtgctgccttgctggtaaccaggaagaccttagtaaggactctctaggtcctaccaaatcaagcaaaattgaaggagctggtaccagtatctcagagcctccgtctcctatcagtccgtatgcttcagaaagctgtggaacgctacctcttcctttgagaccttgtggagaagggtctgaaatggtaggcaaagagaatagttccccagagaataaaaactggttgttggccatggcagccaaacggaaggctgagaatccatctccacgaagtccgtcatcccagacacccaattccaggagacagagcggaaagacattgccaagcccggtcaccatcacgcccagctccatgaggaaaatctgcacatacttccatagaaagtcccaggaggacttctgtggtcctgaacactcaacagaattatagattctaatctgagtgagttactgagctttggtccactaaaacaagctgagctttggtccactaaaacaagatgaaaaatacaagagtgactctataactctggtctttaagaaagctgccttttcatttttagacaaaatcttttcaacgctgaaatgtacctaatctggttctactaccataatgtatatgcagcttcccgaggatgaatgctgtgtttaaatttcataaagtaaatttgtcactctagcattttgaatgaatagtcttcactttttaaattattcatcttctctataataatgacatcccagttcatggaggcaaaaaacaagtttcttgttatcctgaaactttctatgctcagtggaaagtatctgccagccacagcatgaggcctgtgaaggctgactgagaaatcctctgctgaagacccctggttctgttctgcctccaacatgtataattttatttgaaatacataatcttttcactatgcttttgtggggttttttttaagtatgtgtaaaaatgtgatgctcagataagtacatttatatcagttcagtgttaaaatgcagtctcttgagttaaagtcatctttattttaaatgcagtgataaatgtcaactcttcggagaaactaggagaacaacaacagaaagctgtgtttgtcttttttctctcaaatatatctcccgtatgagatttcaggtccccatgttttcaccaagcaatctgctatgtcagccaacccaacatcactttctacaggaggttatgatttttgccatttactagaggaagatgttttatgaaatcaatttggggtttgaattcaggtgcagtcatcagttctttaggggctgcaatgttttaaaaaaaataagtcatcagattttaagaaaaaagtgatgatttcttattgatatttttgtaacagaatatagctcttaactgaaaatccagaaccagaaacataaatcttgagtttcttttcatgtacataaaaagcaatagccttttagtatagatagccctgagccaaaaagtaatagaattttctctagatatttaatacagagagtgtatagactgactctaagttaataatgtgcaaaatatcttaaacatccctccccttattcaacaattatgtatcagtgatcttgaaccattgttttatatttttcacctttgtaacctcatggaaagaggctttacatactttctatgtactatttacttagaagggagcccccttccagtcatgaaacttcatttgttttatccatatcctgaggactgtgtagacttatgactgtgtagactttatgtcagtttttgtcattatttgaaaatctattctgacaactttttaattcctttgatcttataagttaaagctgtaacaactgaaattgcatggatcaagtaagcatagttttatccagggagaaaaataaaaggaagccatagaattgctctggtcaaaaccaagcacaccatagccttaactgaatatttaggaaatctgcctaatctgcttatatttggtgtttgttttttgactgttgggctttgggaagatgttatttatgaccaatatctgccagtaacgctgtttatctcacttgctttgaaagccaatgggggaaaaaaatccatgaaaaaaaaaagattgataaagtagatgattttgtttgtatccctacccatctcctggcagccctactgagtgaaattgggatacatttggctgtcagaaattataccgagtctactgggtataacatgtctcacttggaaagctagtacttttaaatgggtgccaaaggtcaactgtaatgagataattatccctgcctgtgtccatgtcagactttgagctgatcctgaataataaagccttttaccttatctgatgtccttttctgagctttttgcattacctagaagcagtctacaaaaaagaactatagtagtcaagaatcccttctacttgttcattaaaatgtttattcccaaagttataatctatttcaagctgaaagagcttttaataaaaaacatcttgcttgga

SEQ ID NO: 440734 - DNA, 3580 bp, Homo sapiens
ggtctatacattatcatctgttacgttctgtcagaattataagcctgatattggagacaacagtataagatactttaattgtttcccaatgaaatatccttactgtacctagttaatgtgccagaggagtgagattaaaagtcatttcacatgtagtgtagttgaagtagtttggggttggaagaaggtctataaaatatttatttgccatggttattaggataatcaaagtatgggatttacgtaagaattatactgcttatcgacaagaacccatagcatccaagtctttcctgtacccaggtagcagcactcgaaaacttggatattcaagtctgattttggattccactggctctactttatttgctaattgcacagacgataacatctacatgtttaatatgactgggttgaagacttctccagtggctattttcaatggacaccagaactctaccttttatgtaaaatccagccttagtccagatgaccagtttttagtcagtggctcaagtgatgaagctgcctacatatggaaggtctccacaccctggcaacctcctactgtgctcctgggtcattctcaagaggtcacgtctgtgtgctggtgtccatctgacttcacaaagattgctacctgttctgatgacaatacactaaaaatctggcgcttgaatagaggcttagaggagaaaccaggaggtgataaactttccacggtgggttgggcctctcagaagaaaaaagagtcaagacctggcctagtaacagtaacgagtagccagagtactcctgccaaagcccccagggtaaagtgcaatccatccaattcttccccgtcatccgcagcttgtgccccaagctgtgctggagacctccctcttccttcaaatactcctacgttctctattaaaacctctcctgccaaggcccggtctcccatcaacagaagaggctctgtctcctccgtctctcccaagccaccttcatctttcaagatgtcgattagaaactgggtgacccgaacaccttcctcatcaccacccatcactccacctgcttcggagaccaagatcatgtctccgagaaaagcccttattcctgtgagccagaagtcatcccaagcagaggcttgctctgagtctagaaatagagtaaagaggaggctagactcaagctgtctggagagtgtgaaacaaaagtgtgtgaagagttgtaactgtgtgactgagcttgatggccaagttgaaaatcttcatttggatctgtgctgccttgctggtaaccaggaagaccttagtaaggactctctaggtcctaccaaatcaagcaaaattgaaggagctggtaccagtatctcagagcctccgtctcctatcagtccgtatgcttcagaaagctgtggaacgctacctcttcctttgagaccttgtggagaagggtctgaaatggtaggcaaagagaatagttccccagagaataaaaactggttgttggccatggcagccaaacggaaggctgagaatccatctccacgaagtccgtcatcccagacacccaattccaggagacagagcggaaagacattgccaagcccggtcaccatcacgcccagctccatgaggaaaatctgcacatacttccatagaaagtcccaggaggacttctgtggtcctgaacactcaacagaattatagattctaatctgagtgagttactgagctttggtccactaaaacaagctgagctttggtccactaaaacaagatgaaaaatacaagagtgactctataactctggtctttaagaaagctgccttttcatttttagacaaaatcttttcaacgctgaaatgtacctaatctggttctactaccataatgtatatgcagcttcccgaggatgaatgctgtgtttaaatttcataaagtaaatttgtcactctagcattttgaatgaatagtcttcactttttaaattattcatcttctctataataatgacatcccagttcatggaggcaaaaaacaagtttcttgttatcctgaaactttctatgctcagtggaaagtatctgccagccacagcatgaggcctgtgaaggctgactgagaaatcctctgctgaagacccctggttctgttctgcctccaacatgtataattttatttgaaatacataatcttttcactatgcttttgtggggttttttttaagtatgtgtaaaaatgtgatgctcagataagtacatttatatcagttcagtgttaaaatgcagtctcttgagttaaagtcatctttattttaaatgcagtgataaatgtcaactcttcggagaaactaggagaacaacaacagaaagctgtgtttgtcttttttctctcaaatatatctcccgtatgagatttcaggtccccatgttttcaccaagcaatctgctatgtcagccaacccaacatcactttctacaggaggttatgatttttgccatttactagaggaagatgttttatgaaatcaatttggggtttgaattcaggtgcagtcatcagttctttaggggctgcaatgttttaaaaaaaataagtcatcagattttaagaaaaaagtgatgatttcttattgatatttttgtaacagaatatagctcttaactgaaaatccagaaccagaaacataaatcttgagtttcttttcatgtacataaaaagcaatagccttttagtatagatagccctgagccaaaaagtaatagaattttctctagatatttaatacagagagtgtatagactgactctaagttaataatgtgcaaaatatcttaaacatccctccccttattcaacaattatgtatcagtgatcttgaaccattgttttatatttttcacctttgtaacctcatggaaagaggctttacatactttctatgtactatttacttagaagggagcccccttccagtcatgaaacttcatttgttttatccatatcctgaggactgtgtagacttatgatctattctgacaactttttaattcctttgatcttataagttaaagctgtaacaactgaaattgcatggatcaagtaagcatagttttatccagggagaaaaataaaaggaagccatagaattgctctggtcaaaaccaagcacaccatagccttaactgaatatttaggaaatctgcctaatctgcttatatttggtgtttgttttttgactgttgggctttgggaagatgttatttatgaccaatatctgccagtaacgctgtttatctcacttgctttgaaagccaatgggggaaaaaaatccatgaaaaaaaaaagattgataaagtagatgattttgtttgtatccctacccatctcctggcagccctactgagtgaaattgggatacatttggctgtcagaaattataccgagtctactgggtataacatgtctcacttggaaagctagtacttttaaatgggtgccaaaggtcaactgtaatgagataattatccctgcctgtgtccatgtcagactttgagctgatcctgaataataaagccttttacctta

SEQ ID NO: 440735 - DNA, 3437 bp, Homo sapiens
cccgcggtttgtccgcgcctctgctaccccctgcgcaggcgctcaaggagctcttggactccaggttcccgcggctgggagaaaaggaggcggggatccgaagggggaaatgactctgaggcgcccggacgtcgctcggaagccaatcagagagcgtgacgtcagtttggcgcggagtttggcggccggggcttacagtggcgggagttggaggcgataacgatttgtgttgtgagaggcgcaagctgcgatttctgctgaacttggaggcatttctacgacttttctctcagctgaggcttttcctccgaccctgatgctcttcaattcggtgctccgccagccccagcttggcgtcctgagaaatggatggtcttcacaataccctcttcaatcccttctgactggttatcagtgcagtggtaatgatgaacacacttcttatggagaaacaggagtcccagttcctccttttggatgtaccttctcttctgctcccaatatggaacatgtactagcagttgccaatgaagaaggctttgttcgattgtataacacagaatcacaaagtttcagaaagaagtgcttcaaagaatggatggctcactggaatgccgtctttgacctggcctgggttcctggtgaacttaaacttgttacagcagcaggtgatcaaacagccaaattttgggacgtaaaagctggtgagctgattggaacatgcaaaggtcatcaatgcagcctcaagtcagttgccttttctaagtttgagaaagctgtattctgtacgggtggaagagatggcaacattatggtctgggataccaggtgcaacaaaaaagatgggttttataggcaagtgaatcaaatcagtggagctcacaatacctcagacaagcaaaccccttcaaaacccaagaagaaacagaattcaaaaggacttgctccttctgtggatttccagcaaagtgttactgtggtcctctttcaagacgagaataccttagtctcagcaggagctgtggatgggataatcaaagtatgggatttacgtaagaattatactgcttatcgacaagaacccatagcatccaagtctttcctgtacccaggtagcagcactcgaaaacttggatattcaagtctgattttggattccactggctctactttatttgctaattgcacagacgataacatctacatgtttaatatgactgggttgaagacttctccagtggctattttcaatggacaccagaactctaccttttatgtaaaatccagccttagtccagatgaccagtttttagtcagtggctcaagtgatgaagctgcctacatatggaaggtctccacaccctggcaacctcctactgtgctcctgggtcattctcaagaggtcacgtctgtgtgctggtgtccatctgacttcacaaagattgctacctgttctgatgacaatacactaaaaatctggcgcttgaatagaggcttagaggagaaaccaggaggtgataaactttccacggtgggttgggcctctcagaagaaaaaagagtcaagacctggcctagtaacagtaacgagtagccagagtactcctgccaaagcccccagggtaaagtgcaatccatccaattcttccccgtcatccgcagcttgtgccccaagctgtgctggagacctccctcttccttcaaatactcctacgttctctattaaaacctctcctgccaaggcccggtctcccatcaacagaagaggctctgtctcctccgtctctcccaagccaccttcatctttcaagatgtcgattagaaactgggtgacccgaacaccttcctcatcaccacccatcactccacctgcttcggagaccaagatcatgtctccgagaaaagcccttattcctgtgagccagaagtcatcccaagcagaggcttgctctgagtctagaaatagagtaaagaggaggctagactcaagctgtctggagagtgtgaaacaaaagtgtgtgaagagttgtaactgtgtgactgagcttgatggccaagttgaaaatcttcatttggatctgtgctgccttgctggtaaccaggaagaccttagtaaggactctctaggtcctaccaaatcaagcaaaattgaaggagctggtaccagtatctcagagcctccgtctcctatcagtccgtatgcttcagaaagctgtggaacgctacctcttcctttgagaccttgtggagaagggtctgaaatggtaggcaaagagaatagttccccagagaataaaaactggttgttggccatggcagccaaacggaaggctgagaatccatctccacgaagtccgtcatcccagacacccaattccaggagacagagcggaaagacattgccaagcccggtcaccatcacgcccagctccatgaggaaaatctgcacatacttccatagaaagtcccaggaggacttctgtggtcctgaacactcaacagaattatagattctaatctgagtgagttactgagctttggtccactaaaacaagctgagctttggtccactaaaacaagatgaaaaatacaagagtgactctataactctggtctttaagaaagctgccttttcatttttagacaaaatcttttcaacgctgaaatgtacctaatctggttctactaccataatgtatatgcagcttcccgaggatgaatgctgtgtttaaatttcataaagtaaatttgtcactctagcattttgaatgaatagtcttcactttttaaattattcatcttctctataataatgacatcccagttcatggaggcaaaaaacaagtttcttgttatcctgaaactttctatgctcagtggaaagtatctgccagccacagcatgaggcctgtgaaggctgactgagaaatcctctgctgaagacccctggttctgttctgcctccaacatgtataattttatttgaaatacataatcttttcactaaaaaaaaaaaaaaaaaaaaaaaagaaacaaaagaaaacaaagcaaggcaacgacgaaaagaaaggcaagaagacgcgcaggagcagcaccagagcggcgaggagcagaacccggcggggggcggcgggagagggggcacagcggagagcgtctcatcgccgctgcacccaaacttctatccctatccacggaccacagccaccacacacagcgcacgacacacaacaacaagcgcgatcagcccgccgacacgcacgctgagaaccacaccgactacatgacatgagaaaacgcctcatccgcggcacacaccacacactcgctcatcagcgtggaacaccacagacccaacacaacaaagcatcaaaagagcacacaacgcaaggaagcggtagcgagatgatcctgagcacgacgtgcacaacaacacaa

SEQ ID NO: 440736 - DNA, 3076 bp, Homo sapiens
cccgcggtttgtccgcgcctctgctaccccctgcgcaggcgctcaaggagctcttggactccaggttcccgcggctgggagaaaaggaggcggggatccgaagggggaaatgactctgaggcgcccggacgtcgctcggaagccaatcagagagcgtgacgtcagtttggcgcggagtttggcggccggggcttacagtggcgggagttggaggcgataacgatttgtgttgtgagaggcgcaagctgcgatttctgctgaacttggaggcatttctacgacttttctctcagctgaggcttttcctccgaccctgatgctcttcaattcgttccccgtcatccgcagcttgtgccccaagctgtgctggagacctccctcttccttcaaatactcctacgttctctattaaaacctctcctgccaaggcccggtctcccatcaacagaagaggctctgtctcctccgtctctcccaagccaccttcatctttcaagatgtcgattagaaactgggtgacccgaacaccttcctcatcaccacccatcactccacctgcttcggagaccaagatcatgtctccgagaaaagcccttattcctgtgagccagaagtcatcccaagcagaggcttgctctgagtctagaaatagagtaaagaggaggctagactcaagctgtctggagagtgtgaaacaaaagtgtgtgaagagttgtaactgtgtgactgagcttgatggccaagttgaaaatcttcatttggatctgtgctgccttgctggtaaccaggaagaccttagtaaggactctctaggtcctaccaaatcaagcaaaattgaaggagctggtaccagtatctcagagcctccgtctcctatcagtccgtatgcttcagaaagctgtggaacgctacctcttcctttgagaccttgtggagaagggtctgaaatggtaggcaaagagaatagttccccagagaataaaaactggttgttggccatggcagccaaacggaaggctgagaatccatctccacgaagtccgtcatcccagacacccaattccaggagacagagcggaaagacattgccaagcccggtcaccatcacgcccagctccatgaggaaaatctgcacatacttccatagaaagtcccaggaggacttctgtggtcctgaacactcaacagaattatagattctaatctgagtgagttactgagctttggtccactaaaacaagctgagctttggtccactaaaacaagatgaaaaatacaagagtgactctataactctggtctttaagaaagctgccttttcatttttagacaaaatcttttcaacgctgaaatgtacctaatctggttctactaccataatgtatatgcagcttcccgaggatgaatgctgtgtttaaatttcataaagtaaatttgtcactctagcattttgaatgaatagtcttcactttttaaattattcatcttctctataataatgacatcccagttcatggaggcaaaaaacaagtttcttgttatcctgaaactttctatgctcagtggaaagtatctgccagccacagcatgaggcctgtgaaggctgactgagaaatcctctgctgaagacccctggttctgttctgcctccaacatgtataattttatttgaaatacataatcttttcactatgcttttgtggggttttttttaagtatgtgtaaaaatgtgatgctcagataagtacatttatatcagttcagtgttaaaatgcagtctcttgagttaaagtcatctttattttaaatgcagtgataaatgtcaactcttcggagaaactaggagaacaacaacagaaagctgtgtttgtcttttttctctcaaatatatctcccgtatgagatttcaggtccccatgttttcaccaagcaatctgctatgtcagccaacccaacatcactttctacaggaggttatgatttttgccatttactagaggaagatgttttatgaaatcaatttggggtttgaattcaggtgcagtcatcagttctttaggggctgcaatgttttaaaaaaaataagtcatcagattttaagaaaaaagtgatgatttcttattgatatttttgtaacagaatatagctcttaactgaaaatccagaaccagaaacataaatcttgagtttcttttcatgtacataaaaagcaatagccttttagtatagatagccctgagccaaaaagtaatagaattttctctagatatttaatacagagagtgtatagactgactctaagttaataatgtgcaaaatatcttaaacatccctccccttattcaacaattatgtatcagtgatcttgaaccattgttttatatttttcacctttgtaacctcatggaaagaggctttacatactttctatgtactatttacttagaagggagcccccttccagtcatgaaacttcatttgttttatccatatcctgaggactgtgtagacttatgatctattctgacaactttttaattcctttgatcttataagttaaagctgtaacaactgaaattgcatggatcaagtaagcatagttttatccagggagaaaaataaaaggaagccatagaattgctctggtcaaaaccaagcacaccatagccttaactgaatatttaggaaatctgcctaatctgcttatatttggtgtttgttttttgactgttgggctttgggaagatgttatttatgaccaatatctgccagtaacgctgtttatctcacttgctttgaaagccaatgggggaaaaaaatccatgaaaaaaaaaagattgataaagtagatgattttgtttgtatccctacccatctcctggcagccctactgagtgaaattgggatacatttggctgtcagaaattataccgagtctactgggtataacatgtctcacttggaaagctagtacttttaaatgggtgccaaaggtcaactgtaatgagataattatccctgcctgtgtccatgtcagactttgagctgatcctgaataataaagccttttacctta

SEQ ID NO: 440737 - DNA, 1824 bp, Homo sapiens
aaaagaccagagttatagagtcactcttgtatttttcatcttgttttagtggaccaaagctcagcttgttttagtggacaaaatcttttcaacgctgaaatgtacctaatctggttctactaccataatgtatatgcagcttcccgaggatgaatgctgtgtttaaatttcataaagtaaatttgtcactctagcattttgaatgaatagtcttcactttttaaattattcatcttctctataataatgacatcccagttcatggaggcaaaaaacaagtttcttgttatcctgaaactttctatgctcagtggaaagtatctgccagccacagcatgaggcctgtgaaggctgactgagaaatcctctgctgaagacccctggttctgttctgcctccaacatgtataattttatttgaaatacataatcttttcactatgcttttgtggggttttttttaagtatgtgtaaaaatgtgatgctcagataagtacatttatatcagttcagtgttaaaatgcagtctcttgagttaaagtcatctttattttaaatgcagtgataaatgtcaactcttcggagaaactaggagaacaacaacagaaagctgtgtttgtcttttttctctcaaatatatctcccgtatgagatttcaggtccccatgttttcaccaagcaatctgctatgtcagccaacccaacatcactttctacaggaggttatgatttttgccatttactagaggaagatgttttatgaaatcaatttggggtttgaattcaggtgcagtcatcagttctttaggggctgcaatgttttaaaaaaaataagtcatcagattttaagaaaaaagtgatgatttcttattgatatttttgtaacagaatatagctcttaactgaaaatccagaaccagaaacataaatcttgagtttcttttcatgtacataaaaagcaatagccttttagtatagatagccctgagccaaaaagtaatagaattttctctagatatttaatacagagagtgtatagactgactctaagttaataatgtgcaaaatatcttaaacatccctccccttattcaacaattatgtatcagtgatcttgaaccattgttttatatttttcacctttgtaacctcatggaaagaggctttacatactttctatgtactatttacttagaagggagcccccttccagtcatgaaacttcatttgttttatccatatcctgaggactgtgtagacttatgatctattctgacaactttttaattcctttgatcttataagttaaagctgtaacaactgaaattgcatggatcaagtaagcatagttttatccagggagaaaaataaaaggaagccatagaattgctctggtcaaaaccaagcacaccatagccttaactgaatatttaggaaatctgcctaatctgcttatatttggtgtttgttttttgactgttgggctttgggaagatgttatttatgaccaatatctgccagtaacgctgtttatctcacttgctttgaaagccaatgggggaaaaaaatccatgaaaaaaaaaagattgataaagtagatgattttgtttgtatccctacccatctcctggcagccctactgagtgaaattgggatacatttggctgtcagaaattataccgagtctactgggtataacatgtctcacttggaaagctagtacttttaaatgggtgccaaaggtcaactgtaatgagataattatccctgcctgtgtccatgtcagactttgagctgatcctgaataataaagccttttacctta

SEQ ID NO: 440738 - DNA, 793 bp, Homo sapiens
ggcgaggggatggagttttgctcgttactcaggctggagtgcaatggcgcgatctcagctcaccacaacctccgcctcctaagttcaagtgattctcctttctcagcctccccttccagtcatgaaacttcatttgttttatccatatcctgaggactgtgtagacttatgacagttctgtgtagactttatgcctgtgtagactttatgtcagtttttgtcattatttgaaaatctattctgacaactttttaattcctttgatcttataagttaaagctgtaacaactgaaattgcatggatcaagtaagcatagttttatccagggagaaaaataaaaggaagccatagaattgctctggtcaaaaccaagcacaccatagccttaactgaatatttaggaaatctgcctaatctgcttatatttggtgtttgttttttgactgttgggctttgggaagatgttatttatgaccaatatctgccagtaacgctgtttatctcacttgctttgaaagccaatgggggaaaaaaatccatgaaaaaaaaaagattgataaagtagatgattttgtttgtatccctacccatctcctggcagccctactgagtgaaattgggatacatttggctgtcagaaattataccgagtctactgggtataacatgtctcacttggaaagctagtacttttaaatgggtgccaaaggtcaactgtaatgagataattatccctgcctgtgtccatgtcagactttgagctgatcctgaataataaagccttttacctta

SEQ ID NO: 440739 - DNA, 619 bp, Homo sapiens
cccgcggtttgtccgcgcctctgctaccccctgcgcaggcgctcaaggagctcttggactccaggttcccgcggctgggagaaaaggaggcggggatccgaagggggaaatgactctgaggcgcccggacgtcgctcggaagccaatcagagagcgtgacgtcagtttggcgcggagtttggcggccggggcttacagtggcgggagttggaggcgataacgatttgtgttgtgagaggcgcaagctgcgatttctgctgaacttggaggcatttctacgacttttctctcagctgaggcttttcctccgaccctgatgctcttcaattcggtgctccgccagccccagcttggcgtcctgagaaatggttgggccctaatgccttcttgtctggattgtaagaagtctcccagatggcctcctagtttgtctgtcttcggtttattctccacattgctgctaatgatccttctaaaatggaaatctgattactcttctgtgtatttttaaattgatatctaaaagtttttattataaacttaaacaaatgcaaagaatataatttctgaccatattgggaatattgacattttaaaaataaaaatgctatatcactca

SEQ ID NO: 440740 - DNA, 4552 bp, Homo sapiens
cccgcggtttgtccgcgcctctgctaccccctgcgcaggcgctcaaggagctcttggactccaggttcccgcggctgggagaaaaggaggcggggatccgaagggggaaatgactctgaggcgcccggacgtcgctcggaagccaatcagagagcgtgacgtcagtttggcgcggagtttggcggccggggcttacagtggcgggagttggaggcgataacgatttgtgttgtgagaggcgcaagctgcgatttctgctgaacttggaggcatttctacgacttttctctcagctgaggcttttcctccgaccctgatgctcttcaattcggtgctccgccagccccagcttggcgtcctgagaaatggatggtcttcacaataccctcttcaatcccttctgactggttatcagtgcagtggtaatgatgaacacacttcttatggagaaacaggagtcccagttcctccttttggatgtaccttctcttctgctcccaatatggaacatgtactagcagttgccaatgaagaaggctttgttcgattgtataacacagaatcacaaagtttcagaaagaagtgcttcaaagaatggatggctcactggaatgccgtctttgacctggcctgggttcctggtgaacttaaacttgttacagcagcaggtgatcaaacagccaaattttgggacgtaaaagctggtgagctgattggaacatgcaaaggtcatcaatgcagcctcaagtcagttgccttttctaagtttgagaaagctgtattctgtacgggtggaagagatggcaacattatggtctgggataccaggtgcaacaaaaaagatgggttttataggcaagtgaatcaaatcagtggagctcacaatacctcagacaagcaaaccccttcaaaacccaagaagaaacagaattcaaaaggacttgctccttctgtggatttccagcaaagtgttactgtggtcctctttcaagacgagaataccttagtctcagcaggagctgtggatgggataatcaaagtatgggatttacgtaagaattatactgcttatcgacaagaacccatagcatccaagtctttcctgtacccaggtagcagcactcgaaaacttggatattcaagtctgattttggattccactggctctactttatttgctaattgcacagacgataacatctacatgtttaatatgactgggttgaagacttctccagtggctattttcaatggacaccagaactctaccttttatgtaaaatccagccttagtccagatgaccagtttttagtcagtggctcaagtgatgaagctgcctacatatggaaggtctccacaccctggcaacctcctactgtgctcctgggtcattctcaagaggtcacgtctgtgtgctggtgtccatctgacttcacaaagattgctacctgttctgatgacaatacactaaaaatctggcgcttgaatagaggcttagaggagaaaccaggaggtgataaactttccacggtgggttgggcctctcagaagaaaaaagagtcaagacctggcctagtaacagtaacgagtagccagagtactcctgccaaagcccccagggtaaagtgcaatccatccaattcttccccgtcatccgcagcttgtgccccaagctgtgctggagacctccctcttccttcaaatactcctacgttctctattaaaacctctcctgccaaggcccggtctcccatcaacagaagaggctctgtctcctccgtctctcccaagccaccttcatctttcaagatgtcgattagaaactgggtgacccgaacaccttcctcatcaccacccatcactccacctgcttcggagaccaagatcatgtctccgagaaaagcccttattcctgtgagccagaagtcatcccaagcagaggcttgctctgagtctagaaatagagtaaagaggaggctagactcaagctgtctggagagtgtgaaacaaaagtgtgtgaagagttgtaactgtgtgactgagcttgatggccaagttgaaaatcttcatttggatctgtgctgccttgctggtaaccaggaagaccttagtaaggactctctaggtcctaccaaatcaagcaaaattgaaggagctggtaccagtatctcagagcctccgtctcctatcagtccgtatgcttcagaaagctgtggaacgctacctcttcctttgagaccttgtggagaagggtctgaaatggtaggcaaagagaatagttccccagagaataaaaactggttgttggccatggcagccaaacggaaggctgagaatccatctccacgaagtccgtcatcccagacacccaattccaggagacagagcggaaagacattgccaagcccggtcaccatcacgcccagctccatgaggaaaatctgcacatacttccatagaaagtcccaggaggacttctgtggtcctgaacactcaacagaattatagattctaatctgagtgagttactgagctttggtccactaaaacaagctgagctttggtccactaaaacaagatgaaaaatacaagagtgactctataactctggtctttaagaaagctgccttttcatttttagacaaaatcttttcaacgctgaaatgtacctaatctggttctactaccataatgtatatgcagcttcccgaggatgaatgctgtgtttaaatttcataaagtaaatttgtcactctagcattttgaatgaatagtcttcactttttaaattattcatcttctctataataatgacatcccagttcatggaggcaaaaaacaagtttcttgttatcctgaaactttctatgctcagtggaaagtatctgccagccacagcatgaggcctgtgaaggctgactgagaaatcctctgctgaagacccctggttctgttctgcctccaacatgtataattttatttgaaatacataatcttttcactatgcttttgtggggttttttttaagtatgtgtaaaaatgtgatgctcagataagtacatttatatcagttcagtgttaaaatgcagtctcttgagttaaagtcatctttattttaaatgcagtgataaatgtcaactcttcggagaaactaggagaacaacaacagaaagctgtgtttgtcttttttctctcaaatatatctcccgtatgagatttcaggtccccatgttttcaccaagcaatctgctatgtcagccaacccaacatcactttctacaggaggttatgatttttgccatttactagaggaagatgttttatgaaatcaatttggggtttgaattcaggtgcagtcatcagttctttaggggctgcaatgttttaaaaaaaataagtcatcagattttaagaaaaaagtgatgatttcttattgatatttttgtaacagaatatagctcttaactgaaaatccagaaccagaaacataaatcttgagtttcttttcatgtacataaaaagcaatagccttttagtatagatagccctgagccaaaaagtaatagaattttctctagatatttaatacagagagtgtatagactgactctaagttaataatgtgcaaaatatcttaaacatccctccccttattcaacaattatgtatcagtgatcttgaaccattgttttatatttttcacctttgtaacctcatggaaagaggctttacatactttctatgtactatttacttagaagggagcccccttccagtcatgaaacttcatttgttttatccatatcctgaggactgtgtagacttatgatctattctgacaactttttaattcctttgatcttataagttaaagctgtaacaactgaaattgcatggatcaagtaagcatagttttatccagggagaaaaataaaaggaagccatagaattgctctggtcaaaaccaagcacaccatagccttaactgaatatttaggaaatctgcctaatctgcttatatttggtgtttgttttttgactgttgggctttgggaagatgttatttatgaccaatatctgccagtaacgctgtttatctcacttgctttgaaagccaatgggggaaaaaaatccatgaaaaaaaaaagattgataaagtagatgattttgtttgtatccctacccatctcctggcagccctactgagtgaaattgggatacatttggctgtcagaaattataccgagtctactgggtataacatgtctcacttggaaagctagtacttttaaatgggtgccaaaggtcaactgtaatgagataattatccctgcctgtgtccatgtcagactttgagctgatcctgaataataaagccttttaccttatctgatgtccttttctgagctttttgcattacctagaagcagtctacaaaaaagaactatagtagtcaagaatcccttctacttgttcattaaaatgtttattcccaaagttataatctatttcaagctgaaagagcttttaataaaaaacatcttgcttgga

SEQ ID NO: 440741 - DNA, 4221 bp, Homo sapiens
cccgcggtttgtccgcgcctctgctaccccctgcgcaggcgctcaaggagctcttggactccaggttcccgcggctgggagaaaaggaggcggggatccgaagggggaaatgactctgaggcgcccggacgtcgctcggaagccaatcagagagcgtgacgtcagtttggcgcggagtttggcggccggggcttacagtggcgggagttggaggcgataacgatttgtgttgtgagaggcgcaagctgcgatttctgctgaacttggaggcatttctacgacttttctctcagctgaggcttttcctccgaccctgatgctcttcaattcggtgctccgccagccccagcttggcgtcctgagaaatgctcccaatatggaacatgtactagcagttgccaatgaagaaggctttgttcgattgtataacacagaatcacaaagtttcagaaagaagtgcttcaaagaatggatggctcactggaatgccgtctttgacctggcctgggttcctggtgaacttaaacttgttacagcagcaggtgatcaaacagccaaattttgggacgtaaaagctggtgagctgattggaacatgcaaaggtcatcaatgcagcctcaagtcagttgccttttctaagtttgagaaagctgtattctgtacgggtggaagagatggcaacattatggtctgggataccaggtgcaacaaaaaagatgggttttataggcaagtgaatcaaatcagtggagctcacaatacctcagacaagcaaaccccttcaaaacccaagaagaaacagaattcaaaaggacttgctccttctgtggatttccagcaaagtgttactgtggtcctctttcaagacgagaataccttagtctcagcaggagctgtggatgggatattcaagtctgattttggattccactggctctactttatttgctaattgcacagacgataacatctacatgtttaatatgactgggttgaagacttctccagtggctattttcaatggacaccagaactctaccttttatgtaaaatccagccttagtccagatgaccagtttttagtcagtggctcaagtgatgaagctgcctacatatggaaggtctccacaccctggcaacctcctactgtgctcctgggtcattctcaagaggtcacgtctgtgtgctggtgtccatctgacttcacaaagattgctacctgttctgatgacaatacactaaaaatctggcgcttgaatagaggcttagaggagaaaccaggaggtgataaactttccacggtgggttgggcctctcagaagaaaaaagagtcaagacctggcctagtaacagtaacgagtagccagagtactcctgccaaagcccccagggtaaagtgcaatccatccaattcttccccgtcatccgcagcttgtgccccaagctgtgctggagacctccctcttccttcaaatactcctacgttctctattaaaacctctcctgccaaggcccggtctcccatcaacagaagaggctctgtctcctccgtctctcccaagccaccttcatctttcaagatgtcgattagaaactgggtgacccgaacaccttcctcatcaccacccatcactccacctgcttcggagaccaagatcatgtctccgagaaaagcccttattcctgtgagccagaagtcatcccaagcagaggcttgctctgagtctagaaatagagtaaagaggaggctagactcaagctgtctggagagtgtgaaacaaaagtgtgtgaagagttgtaactgtgtgactgagcttgatggccaagttgaaaatcttcatttggatctgtgctgccttgctggtaaccaggaagaccttagtaaggactctctaggtcctaccaaatcaagcaaaattgaaggagctggtaccagtatctcagagcctccgtctcctatcagtccgtatgcttcagaaagctgtggaacgctacctcttcctttgagaccttgtggagaagggtctgaaatggtaggcaaagagaatagttccccagagaataaaaactggttgttggccatggcagccaaacggaaggctgagaatccatctccacgaagtccgtcatcccagacacccaattccaggagacagagcggaaagacattgccaagcccggtcaccatcacgcccagctccatgaggaaaatctgcacatacttccatagaaagtcccaggaggacttctgtggtcctgaacactcaacagaattatagattctaatctgagtgagttactgagctttggtccactaaaacaagctgagctttggtccactaaaacaagatgaaaaatacaagagtgactctataactctggtctttaagaaagctgccttttcatttttagacaaaatcttttcaacgctgaaatgtacctaatctggttctactaccataatgtatatgcagcttcccgaggatgaatgctgtgtttaaatttcataaagtaaatttgtcactctagcattttgaatgaatagtcttcactttttaaattattcatcttctctataataatgacatcccagttcatggaggcaaaaaacaagtttcttgttatcctgaaactttctatgctcagtggaaagtatctgccagccacagcatgaggcctgtgaaggctgactgagaaatcctctgctgaagacccctggttctgttctgcctccaacatgtataattttatttgaaatacataatcttttcactatgcttttgtggggttttttttaagtatgtgtaaaaatgtgatgctcagataagtacatttatatcagttcagtgttaaaatgcagtctcttgagttaaagtcatctttattttaaatgcagtgataaatgtcaactcttcggagaaactaggagaacaacaacagaaagctgtgtttgtcttttttctctcaaatatatctcccgtatgagatttcaggtccccatgttttcaccaagcaatctgctatgtcagccaacccaacatcactttctacaggaggttatgatttttgccatttactagaggaagatgttttatgaaatcaatttggggtttgaattcaggtgcagtcatcagttctttaggggctgcaatgttttaaaaaaaataagtcatcagattttaagaaaaaagtgatgatttcttattgatatttttgtaacagaatatagctcttaactgaaaatccagaaccagaaacataaatcttgagtttcttttcatgtacataaaaagcaatagccttttagtatagatagccctgagccaaaaagtaatagaattttctctagatatttaatacagagagtgtatagactgactctaagttaataatgtgcaaaatatcttaaacatccctccccttattcaacaattatgtatcagtgatcttgaaccattgttttatatttttcacctttgtaacctcatggaaagaggctttacatactttctatgtactatttacttagaagggagcccccttccagtcatgaaacttcatttgttttatccatatcctgaggactgtgtagacttatgactgtgtagactttatgtcagttctgtgtagactttatgtcagtttttgtcattatttgaaaatctattctgacaactttttaattcctttgatcttataagttaaagctgtaacaactgaaattgcatggatcaagtaagcatagttttatccagggagaaaaataaaaggaagccatagaattgctctggtcaaaaccaagcacaccatagccttaactgaatatttaggaaatctgcctaatctgcttatatttggtgtttgttttttgactgttgggctttgggaagatgttatttatgaccaatatctgccagtaacgctgtttatctcacttgctttgaaagccaatgggggaaaaaaatccatgaaaaaaaaaagattgataaagtagatgattttgtttgtatccctacccatctcctggcagccctactgagtgaaattgggatacatttggctgtcagaaattataccgagtctactgggtataacatgtctcacttggaaagctagtacttttaaatgggtgccaaaggtcaactgtaatgagataattatccctgcctgtgtccatgtcagactttgagctgatcctgaataataaagccttttacctta

SEQ ID NO: 440742 - DNA, 3050 bp, Homo sapiens
cccgcggtttgtccgcgcctctgctaccccctgcgcaggcgctcaaggagctcttggactccaggttcccgcggctgggagaaaaggaggcggggatccgaagggggaaatgactctgaggcgcccggacgtcgctcggaagccaatcagagagcgtgacgtcagtttggcgcggagtttggcggccggggcttacagtggcgggagttgaagaaaaaagagtcaagacctggcctagtaacagtaacgagtagccagagtactcctgccaaagcccccagggtaaagtgcaatccatccaattcttccccgtcatccgcagcttgtgccccaagctgtgctggagacctccctcttccttcaaatactcctacgttctctattaaaacctctcctgccaaggcccggtctcccatcaacagaagaggctctgtctcctccgtctctcccaagccaccttcatctttcaagatgtcgattagaaactgggtgacccgaacaccttcctcatcaccacccatcactccacctgcttcggagaccaagatcatgtctccgagaaaagcccttattcctgtgagccagaagtcatcccaagcagaggcttgctctgagtctagaaatagagtaaagaggaggctagactcaagctgtctggagagtgtgaaacaaaagtgtgtgaagagttgtaactgtgtgactgagcttgatggccaagttgaaaatcttcatttggatctgtgctgccttgctggtaaccaggaagaccttagtaaggactctctaggtcctaccaaatcaagcaaaattgaaggagctggtaccagtatctcagagcctccgtctcctatcagtccgtatgcttcagaaagctgtggaacgctacctcttcctttgagaccttgtggagaagggtctgaaatggtaggcaaagagaatagttccccagagaataaaaactggttgttggccatggcagccaaacggaaggctgagaatccatctccacgaagtccgtcatcccagacacccaattccaggagacagagcggaaagacattgccaagcccggtcaccatcacgcccagctccatgaggaaaatctgcacatacttccatagaaagtcccaggaggacttctgtggtcctgaacactcaacagaattatagattctaatctgagtgagttactgagctttggtccactaaaacaagctgagctttggtccactaaaacaagatgaaaaatacaagagtgactctataactctggtctttaagaaagctgccttttcatttttagacaaaatcttttcaacgctgaaatgtacctaatctggttctactaccataatgtatatgcagcttcccgaggatgaatgctgtgtttaaatttcataaagtaaatttgtcactctagcattttgaatgaatagtcttcactttttaaattattcatcttctctataataatgacatcccagttcatggaggcaaaaaacaagtttcttgttatcctgaaactttctatgctcagtggaaagtatctgccagccacagcatgaggcctgtgaaggctgactgagaaatcctctgctgaagacccctggttctgttctgcctccaacatgtataattttatttgaaatacataatcttttcactatgcttttgtggggttttttttaagtatgtgtaaaaatgtgatgctcagataagtacatttatatcagttcagtgttaaaatgcagtctcttgagttaaagtcatctttattttaaatgcagtgataaatgtcaactcttcggagaaactaggagaacaacaacagaaagctgtgtttgtcttttttctctcaaatatatctcccgtatgagatttcaggtccccatgttttcaccaagcaatctgctatgtcagccaacccaacatcactttctacaggaggttatgatttttgccatttactagaggaagatgttttatgaaatcaatttggggtttgaattcaggtgcagtcatcagttctttaggggctgcaatgttttaaaaaaaataagtcatcagattttaagaaaaaagtgatgatttcttattgatatttttgtaacagaatatagctcttaactgaaaatccagaaccagaaacataaatcttgagtttcttttcatgtacataaaaagcaatagccttttagtatagatagccctgagccaaaaagtaatagaattttctctagatatttaatacagagagtgtatagactgactctaagttaataatgtgcaaaatatcttaaacatccctccccttattcaacaattatgtatcagtgatcttgaaccattgttttatatttttcacctttgtaacctcatggaaagaggctttacatactttctatgtactatttacttagaagggagcccccttccagtcatgaaacttcatttgttttatccatatcctgaggactgtgtagacttatgatctattctgacaactttttaattcctttgatcttataagttaaagctgtaacaactgaaattgcatggatcaagtaagcatagttttatccagggagaaaaataaaaggaagccatagaattgctctggtcaaaaccaagcacaccatagccttaactgaatatttaggaaatctgcctaatctgcttatatttggtgtttgttttttgactgttgggctttgggaagatgttatttatgaccaatatctgccagtaacgctgtttatctcacttgctttgaaagccaatgggggaaaaaaatccatgaaaaaaaaaagattgataaagtagatgattttgtttgtatccctacccatctcctggcagccctactgagtgaaattgggatacatttggctgtcagaaattataccgagtctactgggtataacatgtctcacttggaaagctagtacttttaaatgggtgccaaaggtcaactgtaatgagataattatccctgcctgtgtccatgtcagactttgagctgatcctgaataataaagccttttacctta

SEQ ID NO: 440743 - DNA, 2456 bp, Homo sapiens
cccgcggtttgtccgcgcctctgctaccccctgcgcaggcgctcaaggagctcttggactccaggttcccgcggctgggagaaaaggaggcggggatccgaagggggaaatgactctgaggcgcccggacgtcgctcggaagccaatcagagagcgtgacgtcagtttggcgcggagtttggcggccggggcttacagtggcgggagttggaggcgataacgatttgtgttgtgagaggcgcaagctgcgatttctgctgaacttggaggcatttctacgacttttctctcagctgaggcttttcctccgaccctgatgctcttcaattcggtgctccgccagccccagcttggcgtcctgagaaatggatggtcttcacaataccctcttcaatcccttctgactggttatcagtgcagtggtaatgatgaacacacttcttatggagaaacaggagtcccagttcctccttttggatgtaccttctcttctgctcccaatatggaacatgtactagcagttgccaatgaagaaggctttgttcgattgtataacacagaatcacaaagtttcagaaagaagtgcttcaaagaatggatggctcactggaatgccgtctttgacctggcctgggttcctggtgaacttaaacttgttacagcagcaggtgatcaaacagccaaattttgggacgtaaaagctggtgagctgattggaacatgcaaaggtcatcaatgcagcctcaagtcagttgccttttctaagtttgagaaagctgtattctgtacgggtggaagagatggcaacattatggtctgggataccaggtgcaacaaaaaagatgggttttataggcaagtgaatcaaatcagtggagctcacaatacctcagacaagcaaaccccttcaaaacccaagaagaaacagaattcaaaaggacttgctccttctgtggatttccagcaaagtgttactgtggtcctctttcaagacgagaataccttagtctcagcaggagctgtggatgggataatcaaagtatgggatttacgtaagaattatactgcttatcgacaagaacccatagcatccaagtctttcctgtacccaggtagcagcactcgaaaacttggatattcaagtctgattttggattccactggctctactttatttgctaattgcacagacgataacatctacatgtttaatatgactgggttgaagacttctccagtggctattttcaatggacaccagaactctaccttttatgtaaaatccagccttagtccagatgaccagtttttagtcagtggctcaagtgatgaagctgcctacatatggaaggtctccacaccctggcaacctcctactgtgctcctgggtcattctcaagaggtcacgtctgtgtgctggtgtccatctgacttcacaaagattgctacctgttctgatgacaatacactaaaaatctggcgcttgaatagaggcttagaggagaaaccaggaggtgataaactttccacggtgggttgggcctctcagaagaaaaaagagtcaagacctggcctagtaacagtaacgagtagccagagtactcctgccaaagcccccagggtaaagtgcaatccatccaattcttccccgtcatccgcagcttgtgccccaagctgtgctggagacctccctcttccttcaaatactcctacgttctctattaaaacctctcctgccaaggcccggtctcccatcaacagaagaggctctgtctcctccgtctctcccaagccaccttcatctttcaagatgtcgattagaaactgggtgacccgaacaccttcctcatcaccacccatcactccacctgcttcggagaccaagatcatgtctccgagaaaagcccttattcctgtgagccagaagtcatcccaagcagaggcttgctctgagtctagaaatagagtaaagaggaggctagactcaagctgtctggagagtgtgaaacaaaagtgtgtgaagagttgtaactgtgtgactgagcttgatggccaagttgaaaatcttcatttggatctgtgctgccttgctggtaaccaggaagaccttagtaaggactctctaggtcctaccaaatcaagcaaaattgaaggagctggtaccagtatctcagagcctccgtctcctatcagtccgtatgcttcagaaagctgtggaacgctacctcttcctttgagaccttgtggagaagggtctgaaatggtaggcaaagagaatagttccccagagaataaaaactggttgttggccatggcagccaaacggaaggctgagaatccatctccacgaagtccgtcatcccagacacccaattccaggagacagagcggaaagacattgccaagcccgctgcagtctgcaaaggtcttcacaaatcagaatcaactggtaatta

SEQ ID NO: 440744 - DNA, 219 bp, Homo sapiens
actaaacatagcactgagaattctcctctttttacaaaaatgacagacttaagagagggcatggaacagattaagagaattaacatggagaggagagcagaggtataaaaggtatccaagaaaagtaaaacatacaaaggcaattcaaatcaaagtgagcactgcctatatacagacagaaagcgagtcctctatgaaaccatacttggcagaaagtac

SEQ ID NO: 440745 - DNA, 5420 bp, Homo sapiens
ccagtgcattaatcagtagaattaatcagtgcatgttcctagtctgtaactaaactctgtggaagattcccctgctttcctatagtaaaggtttacgactttttcttctatctttattaagcttgtcattttcttctttttgcatggttcttacaaattatttggtcaatttcattttcagaatgttgaaacacagaatgtgcttctctcctctgactcaattagctgtttttgtttttctacagatgattcttttattaggccagtaactttttggattgttggggattttgatagcccttctggacggcagttactgtatgatgccatcaaacatcagaaatccagtaacaatgttagaataagcatgatcaataatcctgccaaagagataagctatgagaacactcagatctccagagcaatctgggcagctctccaaactcagacttccaacgctgctaagaacttcatcaccaaaatggccaaggagggggctgcagaggccctggctgcaggagctgacattgcggagttctctgttgggggaatggatttcagtctttttaaagaggtctttgagtcttccaaaatggatttcattttgtctcatgccgtgtactgcagggatgttctgaagctgaagaagggacagagggcagtgatcagcaatggaaggatcattgggccactggaggatagtgagctctttaatcaagacgatttccacctcctcgaaaatatcatcttaaaaacctcaggacagaaaataaaatctcatattcaacagcttcgggtagaagaagatgtggcaagcgacttggtaatgaaggtggatgctcttctgtcagcgcaaccaaaaggagatccaagaatcgagtaccagttttttgaagacagacacagtgcaatcaaactgaggccgaaggaaggggagacatactttgatgttgtggctgtcgttgaccctgtcaccagagaagcacagagacttgctcctttgctcttggttttggctcagctgataaacatgaatctgagagtatttatgaactgccaatccaaactttctgacatgcctttaaaaagcttttaccgttatgtcttagaaccagagatttctttcacttcagacaatagttttgctaagggtccaatcgcaaaatttttggatatgcctcagtctccactgttcactctgaatttgaacacacctgagagctggatggtagaatctgtcagaacaccatatgatcttgataatatttatttagaagaggtggacagtgtagtggctgctgagtatgagctggaatacctgttactggaaggtcattgctacgacatcaccacaggccagcctccacggggactacagtttaccttaggaacttcagccaacccggtcattgtggacaccattgttatggccaatctgggctactttcagctgaaagccaacccaggagcttggatcctcagacttaggaagggacgctctgaagatatttatagaatttacagccacgatggcaccgattctccccctgatgctgatgaggtggttatcgtcctcaacaacttcaaaagcaaaattattaaagtgaaggttcagaagaaggcagatatggtgaacgaagacttgctgagtgatggaacgagtgagaatgaatctggattttgggattccttcaaatggggctttacaggacagaagactgaggaagtgaagcaagataaagatgacataattaatattttctccgttgcatctggtcatctctacgaaagatttcttcgcataatgatgctatccgtgctgaagaataccaagactcctgtgaaattctggttcttgaagaattacttgtcccccacatttaaggagtttataccttacatggcaaatgaatacaatttccagtatgagcttgttcagtacaaatggccccggtggcttcatcaacaaactgaaaaacagcgtatcatctggggttacaagatcctcttcctggatgtacttttcccactagttgttgacaagttcctgtttgtggatgctgatcagattgtacgaacagatctgaaagagttaagagatttcaatttggatggtgctccttatggttacactcctttctgtgacagccgaagagaaatggacggctacaggttctggaagtcagggtactgggccagtcatttagccgggcgaaagtatcatatcagtgcactatatgttgtggatctgaagaagtttaggaaaatagctgctggtgacagactcaggggacagtaccaaggtctgagtcaggaccctaacagcctttcaaatcttgatcaagatctgcccaataacatgattcatcaggtgccaattaaatccctccctcaagaatggctttggtgtgaaacgtggtgtgatgacgcctctaagaaaagggcaaaaaccattgatttgtgtaataatccgatgaccaaagagccgaaactggaagcagctgtgcggattgtcccggagtggcaggactacgaccaagagatcaaacagctacagatccgctttcagaaggagaaagaaacgggagcactgtacaaagagaagacaaaagaaccaagccgagaaggtcctcagaaacgtgaagaattatgatctctggagaaggacaggaaatcaccccatttgaaaaacagtttttataataaatgctagttttttctgatctgtctatacaactgctgataagccggctgggcaggagtgccacaccttttgattctgagcatttgattctgacttctgtactctggtggccactggatctttgggattaaagctctgttggatttgtacctcagaggaagaccaagtggctgatcctttggactctgtaaagagcattcttctagtcagagggtggaatggcagcagcaactggaagaaaatgagttttttggtgcccacacccaagagcacacacatgctgcactgtctcggaaagcagggccagctagagccaccatgttcttccttacctcagtttacctgcggcctgcgctgcactgcagatgcccaccctgccctgggtctggccggcggaagctctgtccaaggtccacacacctccaggtttacgccaacatccttgtgccctccccaccttctcttccaacgcattaggtgcattgtttaattgaaatccaaccaacaattgtgtgtcaaggctggtttggtgcagtggctgggcaaattaattttgggccaggatgggggtgggttgcagtgagggtagggaaaatgtcaggagtaggaaggttcgggggttaagggaagggaaggaagaccagaactggccatcctcttttataatccattagtagcaccatggctcatttgaaatgaaaatattacacttattccccacccaaccgcagtgaactttctaggtaattgttttgaaaacaatttttgtatctgtgaaagtctttgctttttctttccaccttctagaaaagtctgctaccagtttccttactgaatacagccatactcagcccctctcgcatccagcccgtcagggtcagggtcagggtcaggctccctcaagacgagcaccgcattgtctgccctcttttgcgtaggatttttctctcagacccaggggacattgccttggacttttctctacaaatgccctcagatgtaagaccagaaatgattctgcttgtggaactcgtggctttctgtcctattttccttttatgtgagccctgcaggttgcctttggcgcccacaccagttctgtcttcatgtcgctgcatcgtgaagccccatttgcctttagtccctgctttgtgtgtcttcacttccacagccagtgttgcccctcagggcatactttgctggtgaacgggctgtagagtcttgagtatgttattggcctaagtgggcatgaggccccagcatccgactccatctgccaggctgcagggcacagcagcactggcatagacaggcacgctctgtcttccaacgtgcaccagccttttcttacatattttgcctgtttttaaaaaatacgaggagagggtgcagatggatactgtgccctcaccctcctaagccaggtaatatattgatgtgcagacttttaagaaatcttagtcttatcacaaatatcaagtaatttattttttccattttcaaatgcaaaagttagcctaggaagcctcccagtcatcctgaaggaccttttgactttgcttttataattctgttaaaaattgaggaggggattaatgagtacaatgaaaacaaaacaaaacaaaaaattaagaagaggaaagctcaaaagaggataagagactgaaaaggcacctcagaatggctgctgtgggcagagtctgtgacatgactttccccgccctgcccctctgttcagagcagctggaaagatgggatcagtaagattaaaaaacttttgttcggccaggcgtggtggctcacacctgtaatcccagcactttgggaggctgaggcggacggatcatgaggtcaggagttcaagaccagcctggccaatatggtgaaaccccgtctctactaaaaatacaaaaattagccgggtgttgtggctcaccctctattcccagctactcgggaggcagagacaggagaatcgcctgaacccaggaggcagaggttgcagtgagctgagatcgtgccactgcactccagcctgggtgacagagcgagactccatctcagaaaacaaacaaacaaaaagaaacttttgttcaagctgcatcttcacattgaatgaaagcattcagacgggtgactgctgctgtccacaactgtgggcggaagtgtgccttttcccagtttctcgtccaggaggttgcatagcaaatactcaagtcactgggatatatgctttccaaatgctggcccccatagcacctttccccatgtctttctaccaagcctcttatgtttaatctgtgcagggaagacaagagtagaccatattctctgtgtgctgtgcatgtcctggtgtcactcattgcctcttatctgtcgccattctaatataagtcagcttaatagttgactctgaataatgcaaaacccagcttgcttccagaatggcctaggaccctcctcctcctgccagttttttttttttttttggttcatgtggcataatcatctttcaaaattaaccaaatgccccagaaaatgatgttaccactaaaatattttctccaagaaggcatactgtaacagaaaagataggtaagatatttttttcccaagaagtaagaattgattgtgctgaatgttcaaactctggaaactgttcacagtatgttgttcttagctgttatttatataaagtgaattattttctctctca

SEQ ID NO: 440746 - DNA, 4146 bp, Homo sapiens
tctcacacttatatttggcatagatgagtattttccactcgattgatccaaaagaggttcatgtctcctagtggggaagttacttctgctccatactttgtgactctcattgcctgtacctgctctttggaaatttgactgctccctgctcagtttacttcccgttgtgtaagttgcattctggtgcagcctgtgttcagtctcttcctaaaacaacactgtcggagagtgaacattctttttgtaggttggttttgtcagtcttgtggtctctccagggtgtgagggaagcttcataaccactcctgctgcagctcacccgctagggaaggatgggaagcgcagtctctttcctcttactttcaaaggccgtgtgtctgtatgagtgtttcaagtggtcttttttttacccttattgttataggggctttacaggacagaagactgaggaagtgaagcaagataaagatgacataattaatattttctccgttgcatctggtcatctctacgaaagatttcttcgcataatgatgctatccgtgctgaagaataccaagactcctgtgaaattctggttcttgaagaattacttgtcccccacatttaaggagtttataccttacatggcaaatgaatacaatttccagtatgagcttgttcagtacaaatggccccggtggcttcatcaacaaactgaaaaacagcgtatcatctggggttacaagatcctcttcctggatgtacttttcccactagttgttgacaagttcctgtttgtggatgctgatcagattgtacgaacagatctgaaagagttaagagatttcaatttggatggtgctccttatggttacactcctttctgtgacagccgaagagaaatggacggctacaggttctggaagtcagggtactgggccagtcatttagccgggcgaaagtatcatatcagtgcactatatgttgtggatctgaagaagtttaggaaaatagctgctggtgacagactcaggggacagtaccaaggtctgagtcaggaccctaacagcctttcaaatcttgatcaagatctgcccaataacatgattcatcaggtgccaattaaatccctccctcaagaatggctttggtgtgaaacgtggtgtgatgacgcctctaagaaaagggcaaaaaccattgatttgtgtaataatccgatgaccaaagagccgaaactggaagcagctgtgcggattgtcccggagtggcaggactacgaccaagagatcaaacagctacagatccgctttcagaaggagaaagaaacgggagcactgtacaaagagaagacaaaagaaccaagccgagaaggtcctcagaaacgtgaagaattatgatctctggagaaggacaggaaatcaccccatttgaaaaacagtttttataataaatgctagttttttctgatctgtctatacaactgctgataagccggctgggcaggagtgccacaccttttgattctgagcatttgattctgacttctgtactctggtggccactggatctttgggattaaagctctgttggatttgtacctcagaggaagaccaagtggctgatcctttggactctgtaaagagcattcttctagtcagagggtggaatggcagcagcaactggaagaaaatgagttttttggtgcccacacccaagagcacacacatgctgcactgtctcggaaagcagggccagctagagccaccatgttcttccttacctcagtttacctgcggcctgcgctgcactgcagatgcccaccctgccctgggtctggccggcggaagctctgtccaaggtccacacacctccaggtttacgccaacatccttgtgccctccccaccttctcttccaacgcattaggtgcattgtttaattgaaatccaaccaacaattgtgtgtcaaggctggtttggtgcagtggctgggcaaattaattttgggccaggatgggggtgggttgcagtgagggtagggaaaatgtcaggagtaggaaggttcgggggttaagggaagggaaggaagaccagaactggccatcctcttttataatccattagtagcaccatggctcatttgaaatgaaaatattacacttattccccacccaaccgcagtgaactttctaggtaattgttttgaaaacaatttttgtatctgtgaaagtctttgctttttctttccaccttctagaaaagtctgctaccagtttccttactgaatacagccatactcagcccctctcgcatccagcccgtcagggtcagggtcagggtcaggctccctcaagacgagcaccgcattgtctgccctcttttgcgtaggatttttctctcagacccaggggacattgccttggacttttctctacaaatgccctcagatgtaagaccagaaatgattctgcttgtggaactcgtggctttctgtcctattttccttttatgtgagccctgcaggttgcctttggcgcccacaccagttctgtcttcatgtcgctgcatcgtgaagccccatttgcctttagtccctgctttgtgtgtcttcacttccacagccagtgttgcccctcagggcatactttgctggtgaacgggctgtagagtcttgagtatgttattggcctaagtgggcatgaggccccagcatccgactccatctgccaggctgcagggcacagcagcactggcatagacaggcacgctctgtcttccaacgtgcaccagccttttcttacatattttgcctgtttttaaaaaatacgaggagagggtgcagatggatactgtgccctcaccctcctaagccaggtaatatattgatgtgcagacttttaagaaatcttagtcttatcacaaatatcaagtaatttattttttccattttcaaatgcaaaagttagcctaggaagcctcccagtcatcctgaaggaccttttgactttgcttttataattctgttaaaaattgaggaggggattaatgagtacaatgaaaacaaaacaaaacaaaaaattaagaagaggaaagctcaaaagaggataagagactgaaaaggcacctcagaatggctgctgtgggcagagtctgtgacatgactttccccgccctgcccctctgttcagagcagctggaaagatgggatcagtaagattaaaaaacttttgttcggccaggcgtggtggctcacacctgtaatcccagcactttgggaggctgaggcggacggatcatgaggtcaggagttcaagaccagcctggccaatatggtgaaaccccgtctctactaaaaatacaaaaattagccgggtgttgtggctcaccctctattcccagctactcgggaggcagagacaggagaatcgcctgaacccaggaggcagaggttgcagtgagctgagatcgtgccactgcactccagcctgggtgacagagcgagactccatctcagaaaacaaacaaacaaaaagaaacttttgttcaagctgcatcttcacattgaatgaaagcattcagacgggtgactgctgctgtccacaactgtgggcggaagtgtgccttttcccagtttctcgtccaggaggttgcatagcaaatactcaagtcactgggatatatgctttccaaatgctggcccccatagcacctttccccatgtctttctaccaagcctcttatgtttaatctgtgcagggaagacaagagtagaccatattctctgtgtgctgtgcatgtcctggtgtcactcattgcctcttatctgtcgccattctaatataagtcagcttaatagttgactctgaataatgcaaaacccagcttgcttccagaatggcctaggaccctcctcctcctgccagttttttttttttttttggttcatgtggcataatcatctttcaaaattaaccaaatgccccagaaaatgatgttaccactaaaatattttctccaagaaggcatactgtaacagaaaagataggtaagatatttttttcccaagaagtaagaattgattgtgctgaatgttcaaactctggaaactgttcacagtatgttgttcttagctgttatttatataaagtgaattattttctctctca

SEQ ID NO: 440747 - DNA, 4961 bp, Homo sapiens
ccagtgcattaatcagtagaattaatcagtgcatgttcctagtctgtaactaaactctgtggaagattcccctgctttcctatagtaaaggtttacgactttttcttctatctttattaagcttgtcattttcttctttttgcatggttcttacaaattatttggtcaatttcattttcagaatgttgaaacacagaatgtgcttctctcctctgactcaattagctgtttttgtttttctacagatgattcttttattaggccagtaactttttggattgttggggattttgatagcccttctggacggcagttactgtatgatgccatcaaacatcagaaatccagtaacaatgttagaataagcatgatcaataatcctgccaaagagataagctatgagaacactcagatctccagagcaatctgggcagctctccaaactcagacttccaacgctgctaagaacttcatcaccaaaatggccaaggagggggctgcagaggccctggctgcaggagctgacattgcggagttctctgttgggggaatggatttcagtctttttaaagaggtctttgagtcttccaaaatggatttcattttgtctcatgccgtgtactgcagggatgttctgaagctgaagaagggacagagggcagtgatcagcaatggaaggatcattgggccactggaggatagtgagctctttaatcaagacgatttccacctcctcgaaaatatcatcttaaaaacctcaggacagaaaataaaatctcatattcaacagcttcgggtagaagaagatgtggcaagcgacttggtaatgaaggtggatgctcttctgtcagcgcaaccaaaaggagatccaagaatcgagtaccagttttttgaagacagacacagtgcaatcaaactgaggccgaaggaaggggagacatactttgatgttgtggctgtcgttgaccctgtcaccagagaagcacagagacttgctcctttgctcttggttttggctcagctgataaacatgaatctgagagtatttatgaactgccaatccaaactttctgacatgcctttaaaaagcttttaccgttatgtcttagaaccagagatttctttcacttcagacaatagttttgctaagggtccaatcgcaaaatttttggatatgcctcagtctccactgttcactctgaatttgaacacacctgagagctggatggtagaatctgtcagaacaccatatgatcttgataatatttatttagaagaggtggacagtgtagtggctgctgagtatgagctggaatacctgttactggaaggtcattgctacgacatcaccacaggccagcctccacggggactacagtttaccttaggaacttcagccaacccggtcattgtggacaccattgttatggccaatctgggctactttcagctgaaagccaacccaggagcttggatcctcagacttaggaagggacgctctgaagatatttatagaatttacagccacgatggcaccgattctccccctgatgctgatgaggtggttatcgtcctcaacaacttcaaaagcaaaattattaaagtgaaggttcagaagaaggcagatatggtgaacgaagacttgctgagtgatggaacgagtgagaatgaatctggattttgggattccttcaaatggggctttacaggacagaagactgaggaagtgaagcaagataaagatgacataattaatattttctccgttgcatctggtcatctctacgaaagatttcttcgcataatgatgctatccgtgctgaagaataccaagactcctgtgaaattctggttcttgaagaattacttgtcccccacatttaaggatctgcccaataacatgattcatcaggtgccaattaaatccctccctcaagaatggctttggtgtgaaacgtggtgtgatgacgcctctaagaaaagggcaaaaaccattgatttgtgtaataatccgatgaccaaagagccgaaactggaagcagctgtgcggattgtcccggagtggcaggactacgaccaagagatcaaacagctacagatccgctttcagaaggagaaagaaacgggagcactgtacaaagagaagacaaaagaaccaagccgagaaggtcctcagaaacgtgaagaattatgatctctggagaaggacaggaaatcaccccatttgaaaaacagtttttataataaatgctagttttttctgatctgtctatacaactgctgataagccggctgggcaggagtgccacaccttttgattctgagcatttgattctgacttctgtactctggtggccactggatctttgggattaaagctctgttggatttgtacctcagaggaagaccaagtggctgatcctttggactctgtaaagagcattcttctagtcagagggtggaatggcagcagcaactggaagaaaatgagttttttggtgcccacacccaagagcacacacatgctgcactgtctcggaaagcagggccagctagagccaccatgttcttccttacctcagtttacctgcggcctgcgctgcactgcagatgcccaccctgccctgggtctggccggcggaagctctgtccaaggtccacacacctccaggtttacgccaacatccttgtgccctccccaccttctcttccaacgcattaggtgcattgtttaattgaaatccaaccaacaattgtgtgtcaaggctggtttggtgcagtggctgggcaaattaattttgggccaggatgggggtgggttgcagtgagggtagggaaaatgtcaggagtaggaaggttcgggggttaagggaagggaaggaagaccagaactggccatcctcttttataatccattagtagcaccatggctcatttgaaatgaaaatattacacttattccccacccaaccgcagtgaactttctaggtaattgttttgaaaacaatttttgtatctgtgaaagtctttgctttttctttccaccttctagaaaagtctgctaccagtttccttactgaatacagccatactcagcccctctcgcatccagcccgtcagggtcagggtcagggtcaggctccctcaagacgagcaccgcattgtctgccctcttttgcgtaggatttttctctcagacccaggggacattgccttggacttttctctacaaatgccctcagatgtaagaccagaaatgattctgcttgtggaactcgtggctttctgtcctattttccttttatgtgagccctgcaggttgcctttggcgcccacaccagttctgtcttcatgtcgctgcatcgtgaagccccatttgcctttagtccctgctttgtgtgtcttcacttccacagccagtgttgcccctcagggcatactttgctggtgaacgggctgtagagtcttgagtatgttattggcctaagtgggcatgaggccccagcatccgactccatctgccaggctgcagggcacagcagcactggcatagacaggcacgctctgtcttccaacgtgcaccagccttttcttacatattttgcctgtttttaaaaaatacgaggagagggtgcagatggatactgtgccctcaccctcctaagccaggtaatatattgatgtgcagacttttaagaaatcttagtcttatcacaaatatcaagtaatttattttttccattttcaaatgcaaaagttagcctaggaagcctcccagtcatcctgaaggaccttttgactttgcttttataattctgttaaaaattgaggaggggattaatgagtacaatgaaaacaaaacaaaacaaaaaattaagaagaggaaagctcaaaagaggataagagactgaaaaggcacctcagaatggctgctgtgggcagagtctgtgacatgactttccccgccctgcccctctgttcagagcagctggaaagatgggatcagtaagattaaaaaacttttgttcggccaggcgtggtggctcacacctgtaatcccagcactttgggaggctgaggcggacggatcatgaggtcaggagttcaagaccagcctggccaatatggtgaaaccccgtctctactaaaaatacaaaaattagccgggtgttgtggctcaccctctattcccagctactcgggaggcagagacaggagaatcgcctgaacccaggaggcagaggttgcagtgagctgagatcgtgccactgcactccagcctgggtgacagagcgagactccatctcagaaaacaaacaaacaaaaagaaacttttgttcaagctgcatcttcacattgaatgaaagcattcagacgggtgactgctgctgtccacaactgtgggcggaagtgtgccttttcccagtttctcgtccaggaggttgcatagcaaatactcaagtcactgggatatatgctttccaaatgctggcccccatagcacctttccccatgtctttctaccaagcctcttatgtttaatctgtgcagggaagacaagagtagaccatattctctgtgtgctgtgcatgtcctggtgtcactcattgcctcttatctgtcgccattctaatataagtcagcttaatagttgactctgaataatgcaaaacccagcttgcttccagaatggcctaggaccctcctcctcctgccagttttttttttttttttggttcatgtggcataatcatctttcaaaattaaccaaatgccccagaaaatgatgttaccactaaaatattttctccaagaaggcatactgtaacagaaaagataggtaagatatttttttcccaagaagtaagaattgattgtgctgaatgttcaaactctggaaactgttcacagtatgttgttcttagctgttatttatataaagtgaattattttctctctca

SEQ ID NO: 440748 - DNA, 7620 bp, Homo sapiens
ccagtgcattaatcagtagaattaatcagtgcatgttcctagtctgtaactaaactctgtggaagattcccctgctttcctatagtaaaggtttacgactttttcttctatctttattaagcttgtcattttcttctttttgcatggttcttacaaattatttggtcaatttcattttcagaatgttgaaacacagaatgtgcttctctcctctgactcaattagctgtttttgtttttctacagatgattcttttattaggccagtaactttttggattgttggggattttgatagcccttctggacggcagttactgtatgatgccatcaaacatcagaaatccagtaacaatgttagaataagcatgatcaataatcctgccaaagagataagctatgagaacactcagatctccagagcaatctgggcagctctccaaactcagacttccaacgctgctaagaacttcatcaccaaaatggccaaggagggggctgcagaggccctggctgcaggagctgacattgcggagttctctgttgggggaatggatttcagtctttttaaagaggtctttgagtcttccaaaatggatttcattttgtctcatgccgtgtactgcagggatgttctgaagctgaagaagggacagagggcagtgatcagcaatggaaggatcattgggccactggaggatagtgagctctttaatcaagacgatttccacctcctcgaaaatatcatcttaaaaacctcaggacagaaaataaaatctcatattcaacagcttcgggtagaagaagatgtggcaagcgacttggtaatgaaggtggatgctcttctgtcagcgcaaccaaaaggagatccaagaatcgagtaccagttttttgaagacagacacagtgcaatcaaactgaggccgaaggaaggggagacatactttgatgttgtggctgtcgttgaccctgtcaccagagaagcacagagacttgctcctttgctcttggttttggctcagctgataaacatgaatctgagagtatttatgaactgccaatccaaactttctgacatgcctttaaaaagcttttaccgttatgtcttagaaccagagatttctttcacttcagacaatagttttgctaagggtccaatcgcaaaatttttggatatgcctcagtctccactgttcactctgaatttgaacacacctgagagctggatggtagaatctgtcagaacaccatatgatcttgataatatttatttagaagaggtggacagtgtagtggctgctgagtatgagctggaatacctgttactggaaggtcattgctacgacatcaccacaggccagcctccacggggactacagtttaccttaggaacttcagccaacccggtcattgtggacaccattgttatggccaatctgggctactttcagctgaaagccaacccaggagcttggatcctcagacttaggaagggacgctctgaagatatttatagaatttacagccacgatggcaccgattctccccctgatgctgatgaggtggttatcgtcctcaacaacttcaaaagcaaaattattaaagtgaaggttcagaagaaggcagatatggtgaacgaagacttgctgagtgatggaacgagtgagaatgaatctggattttgggattccttcaaatggggctttacaggacagaagactgaggaagtgaagcaagataaagatgacataattaatattttctccgttgcatctggtcatctctacgaaagatttcttcgcataatgatgctatccgtgctgaagaataccaagactcctgtgaaattctggttcttgaagaattacttgtcccccacatttaaggagtttataccttacatggcaaatgaatacaatttccagtatgagcttgttcagtacaaatggccccggtggcttcatcaacaaactgaaaaacagcgtatcatctggggttacaagatcctcttcctggatgtacttttcccactagttgttgacaagttcctgtttgtggatgctgatcagattgtacgaacagatctgaaagagttaagagatttcaatttggatggtgctccttatggttacactcctttctgtgacagccgaagagaaatggacggctacaggttctggaagtcagggtactgggccagtcatttagccgggcgaaagtatcatatcagtgcactatatgttgtggatctgaagaagtttaggaaaatagctgctggtgacagactcaggggacagtaccaaggtctgagtcaggaccctaacagcctttcaaatcttgatcaagatctgcccaataacatgattcatcaggtgccaattaaatccctccctcaagaatggctttggtgtgaaacgtggtgtgatgacgcctctaagaaaagggcaaaaaccattgatttgtgtaataatccgatgaccaaagagccgaaactggaagcagctgtgcggattgtcccggagtggcaggactacgaccaagagatcaaacagctacagatccgctttcagaaggagaaagaaacgggagcactgtacaaagagaagacaaaagaaccaagccgagaaggtcctcagaaacgtgaagaattatgatctctggagaaggacaggaaatcaccccatttgaaaaacagtttttataataaatgctagttttttctgatctgtctatacaactgctgataagccggctgggcaggagtgccacaccttttgattctgagcatttgattctgacttctgtactctggtggccactggatctttgggattaaagctctgttggatttgtacctcagaggaagaccaagtggctgatcctttggactctgtaaagagcattcttctagtcagagggtggaatggcagcagcaactggaagaaaatgagttttttggtgcccacacccaagagcacacacatgctgcactgtctcggaaagcagggccagctagagccaccatgttcttccttacctcagtttacctgcggcctgcgctgcactgcagatgcccaccctgccctgggtctggccggcggaagctctgtccaaggtccacacacctccaggtttacgccaacatccttgtgccctccccaccttctcttccaacgcattaggtgcattgtttaattgaaatccaaccaacaattgtgtgtcaaggctggtttggtgcagtggctgggcaaattaattttgggccaggatgggggtgggttgcagtgagggtagggaaaatgtcaggagtaggaaggttcgggggttaagggaagggaaggaagaccagaactggccatcctcttttataatccattagtagcaccatggctcatttgaaatgaaaatattacacttattccccacccaaccgcagtgaactttctaggtaattgttttgaaaacaatttttgtatctgtgaaagtctttgctttttctttccaccttctagaaaagtctgctaccagtttccttactgaatacagccatactcagcccctctcgcatccagcccgtcagggtcagggtcagggtcaggctccctcaagacgagcaccgcattgtctgccctcttttgcgtaggatttttctctcagacccaggggacattgccttggacttttctctacaaatgccctcagatgtaagaccagaaatgattctgcttgtggaactcgtggctttctgtcctattttccttttatgtgagccctgcaggttgcctttggcgcccacaccagttctgtcttcatgtcgctgcatcgtgaagccccatttgcctttagtccctgctttgtgtgtcttcacttccacagccagtgttgcccctcagggcatactttgctggtgaacgggctgtagagtcttgagtatgttattggcctaagtgggcatgaggccccagcatccgactccatctgccaggctgcagggcacagcagcactggcatagacaggcacgctctgtcttccaacgtgcaccagccttttcttacatattttgcctgtttttaaaaaatacgaggagagggtgcagatggatactgtgccctcaccctcctaagccaggtaatatattgatgtgcagacttttaagaaatcttagtcttatcacaaatatcaagtaatttattttttccattttcaaatgcaaaagttagcctaggaagcctcccagtcatcctgaaggaccttttgactttgcttttataattctgttaaaaattgaggaggggattaatgagtacaatgaaaacaaaacaaaacaaaaaattaagaagaggaaagctcaaaagaggataagagactgaaaaggcacctcagaatggctgctgtgggcagagtctgtgacatgactttccccgccctgcccctctgttcagagcagctggaaagatgggatcagtaagattaaaaaacttttgttcggccaggcgtggtggctcacacctgtaatcccagcactttgggaggctgaggcggacggatcatgaggtcaggagttcaagaccagcctggccaatatggtgaaaccccgtctctactaaaaatacaaaaattagccgggtgttgtggctcaccctctattcccagctactcgggaggcagagacaggagaatcgcctgaacccaggaggcagaggttgcagtgagctgagatcgtgccactgcactccagcctgggtgacagagcgagactccatctcagaaaacaaacaaacaaaaagaaacttttgttcaagctgcatcttcacattgaatgaaagcattcagacgggtgactgctgctgtccacaactgtgggcggaagtgtgccttttcccagtttctcgtccaggaggttgcatagcaaatactcaagtcactgggatatatgctttccaaatgctggcccccatagcacctttccccatgtctttctaccaagcctcttatgtttaatctgtgcagggaagacaagagtagaccatattctctgtgtgctgtgcatgtcctggtgtcactcattgcctcttatctgtcgccattctaatataagtcagcttaatagttgactctgaataatgcaaaacccagcttgcttccagaatggcctaggaccctcctcctcctgccagttttttttttttttttggttcatgtggcataatcatctttcaaaattaaccaaatgccccagaaaatgatgttaccactaaaatattttctccaagaaggcatactgtaacagaaaagataggtaagatatttttttcccaagaagtaagaattgattgtgctgaatgttcaaactctggaaactgttcacagtatgttgttcttagctgttatttatataaagtgaattattttctctctcaatcatgccatagtggagacttttgtttgtgagtaagtgacagagtaatatgaaataatgtgatatgtcagagtgacatgcagcatcccggcctcccaaagtgctgggattgcaggcgtgaccactatgtccggtcaagccctcgtgttctgaaccttgtcaaggctctgcctgaatgagttttcatctgattgtggggaccaagtccctgagtagagggccaagagctagggacagggggaagagactggcccaggtggtagggaggaaagaactcccagagtttcctttagccaggaaacctgctctactgaccccgtgacttggacagtcagacatcaccctgagagtgacaagtgtaaaatgactcccttcctcccccgccctccggaagtatatttagatacttgaaagcagtccttttctaaaatggccttacctatgtggcctgaacgattaaaagaaagaactcagagttacaagggaaaaagaaaaagagttacaagggaattgtagtctttttctgaatagaatattagtactgtggtattgcatttcatgggaatggaaatgtattggtaaagctacctgatggaagctttctcttggtaacaaaaatggagggtgtattatgtgcagttatttaaatatatgtattccattgttgcgtggtttttttcccccctcaagacagagatttgctcttgttgcccagggtggagtacaatggtgtgaccttggctcactgcaacctctgcctcctgggttcaggtgattctcctgcctcagccttccgagtagctgggattacaggtgtgcgccaccacacccggctaatttttgctttttttttttttgagacagaatctcgctctgttgctcaggctggagtggagtgcagtggcacaatctcagctcactgcagcctctgcctcccgggttcaagagattctcctgactcaacctcctgagtagctgggattacaggtgcctgccactatgcctagctaatttttgtagtttttagtagtagacggggtcttcgcatgtgtggccagggtggtctcgaactcctgacctcaagtgatccacccgcatcggccccccaaagtgctgggattataggcgtgaaccaccgcgcctgtcccattgttgtgtaattttaataattagttttttaagtacttgattttatgggcacatttttgtgggatgattggagttaatcaaataaagcttgtcatgtgtgtagtttggtaagataacttctttaaattcatgttttctctgccttgaggtagtgagggaaagatcttaatcagtattttggtaattaactgattgaattcaagcaaatgagacatcatgaacttcagtggttattgatatttcagggtatatacctgaaatgcctagaggatacagatttctcatttcattctttggtctttcatttctctatatacagaaatgaaatgacacttctgggaggcagtagaagcaggaagtcaatgaattgagtagagggtcccattccctcaggctgtcattgatcagtgacaatttataatgaaggttaaactctgtggtcggtatttgcaagcgccgggcgtggtggctcacgcctgtaatcctagcaccttgggaggccaaggcaggcggatcacccgaggtcaggagtttgaggatttgcaagcaaaaggtcctctcctgagtctttcccagatacccagcagtgcagaggctagctgtggaaggttgcagtgggacaggaatgtattgtatgccttgccttacttgtcaccattgagatttccagagaaatgggcataacgtctcttaacaacaacagcagaaagcaaaatacattaacttaaggttgacaacaaaagattatcaagtaccatgttttccaaccaaccagttattcgtggtaataataaaataaaggtgggaaaatgttataatttttaaggaaactgtgtactttaaaaatcttctttatgaatatccaatgttactgtaatcctgctccattaaatgcagcattgttgtcaggtgctgcctcttgcttgggaacagcattgggcttttaaatgtctgcagaatctctgcgttcgaagggaattgagaatgaacttcctggtactgtaatgaaaataaggtctgctcaacacagtaaacgtttcctctcttcttta

SEQ ID NO: 440749 - DNA, 6086 bp, Homo sapiens
ccagtgcattaatcagtagaattaatcagtgcatgttcctagtctgtaactaaactctgtggaagattcccctgctttcctatagtaaaggtttacgactttttcttctatctttattaagcttgtcattttcttctttttgcatggttcttacaaattatttggtcaatttcattttcagaatgttgaaacacagaatgtgcttctctcctctgactcaattagctgtttttgtttttctacagatgattcttttattaggccagtaactttttggattgttggggattttgatagcccttctggacggcagttactgtatgatgccatcaaacatcagaaatccagtaacaatgttagaataagcatgatcaataatcctgccaaagagataagctatgagaacactcagatctccagagcaatctgggcagctctccaaactcagacttccaacgctgctaagaacttcatcaccaaaatggccaaggagggggctgcagaggccctggctgcaggagctgacattgcggagttctctgttgggggaatggatttcagtctttttaaagaggtctttgagtcttccaaaatggatttcattttgtctcatgccgtgtactgcagggatgttctgaagctgaagaagggacagagggcagtgatcagcaatggaaggatcattgggccactggaggatagtgagctctttaatcaagacgatttccacctcctcgaaaatatcatcttaaaaacctcaggacagaaaataaaatctcatattcaacagcttcgggtagaagaagatgtggcaagcgacttggtaatgaaggtggatgctcttctgtcagcgcaaccaaaaggagatccaagaatcgagtaccagttttttgaagacagacacagtgcaatcaaactgaggccgaaggaaggggagacatactttgatgttgtggctgtcgttgaccctgtcaccagagaagcacagagacttgctcctttgctcttggttttggctcagctgataaacatgaatctgagagtatttatgaactgccaatccaaactttctgacatgcctttaaaaagcttttaccgttatgtcttagaaccagagatttctttcacttcagacaatagttttgctaagggtccaatcgcaaaatttttggatatgcctcagtctccactgttcactctgaatttgaacacacctgagagctggatggtagaatctgtcagaacaccatatgatcttgataatatttatttagaagaggtggacagtgtagtggctgctgagtatgagctggaatacctgttactggaaggtcattgctacgacatcaccacaggccagcctccacggggactacagtttaccttaggaacttcagccaacccggtcattgtggacaccattgttatggccaatctgggctactttcagctgaaagccaacccaggagcttggatcctcagacttaggaagggacgctctgaagatatttatagaatttacagccacgatggcaccgattctccccctgatgctgatgaggtggttatcgtcctcaacaacttcaaaagcaaaattattaaagtgaaggttcagaagaaggcagatatggtgaacgaagacttgctgagtgatggaacgagtgagaatgaatctggattttgggattccttcaaatggggctttacaggacagaagactgaggaagtgaagcaagataaagatgacataattaatattttctccgttgcatctggtcatctctacgaaagatttcttcgcataatgatgctatccgtgctgaagaataccaagactcctgtgaaattctggttcttgaagaattacttgtcccccacatttaaggagtttataccttacatggcaaatgaatacaatttccagtatgagcttgttcagtacaaatggccccggtggcttcatcaacaaactgaaaaacagcgtatcatctggggttacaagatcctcttcctggatgtacttttcccactagttgttgacaagttcctgtttgtggatgctgatcagattgtacgaacagatctgaaagagttaagagatttcaatttggatggtgctccttatggttacactcctttctgtgacagccgaagagaaatggacggctacaggttctggaagtcagggtactgggccagtcatttagccgggcgaaagtatcatatcagtgcactatatgttgtggatctgaagaagtttaggaaaatagctgctggtgacagactcaggggacagtaccaaggtctgagtcaggaccctaacagcctttcaaatcttgatcaagatctgcccaataacatgattcatcaggtgccaattaaatccctccctcaagaatggctttggtgtgaaacgtggtgtgatgacgcctctaagaaaagggcaaaaaccattgatttgtgtaataatccgatgaccaaagagccgaaactggaagcagctgtgcggattgtcccggagtggcaggactacgaccaagagatcaaacagctacagatccgctttcagaaggagaaagaaacgggagcactgtacaaagagaagacaaaagaaccaagccgagaaggtcctcagaaacgtgaagaattatgatctctggagaaggacaggaaatcaccccatttgaaaaacagtttttataataaatgctagttttttctgatctgtctatacaactgctgataagccggctgggcaggagtgccacaccttttgattctgagcatttgattctgacttctgtactctggtggccactggatctttgggattaaagctctgttggatttgtacctcagaggaagaccaagtggctgatcctttggactctgtaaagagcattcttctagtcagagggtggaatggcagcagcaactggaagaaaatgagttttttggtgcccacacccaagagcacacacatgctgcactgtctcggaaagcagggccagctagagccaccatgttcttccttacctcagtttacctgcggcctgcgctgcactgcagatgcccaccctgccctgggtctggccggcggaagctctgtccaaggtccacacacctccaggtttacgccaacatccttgtgccctccccaccttctcttccaacgcattaggtgcattgtttaattgaaatccaaccaacaattgtgtgtcaaggctggtttggtgcagtggctgggcaaattaattttgggccaggatgggggtgggttgcagtgagggtagggaaaatgtcaggagtaggaaggttcgggggttaagggaagggaaggaagaccagaactggccatcctcttttataatccattagtagcaccatggctcatttgaaatgaaaatattacacttattccccacccaaccgcagtgaactttctaggtaattgttttgaaaacaatttttgtatctgtgaaagtctttgctttttctttccaccttctagaaaagtctgctaccagtttccttactgaatacagccatactcagcccctctcgcatccagcccgtcagggtcagggtcagggtcaggctccctcaagacgagcaccgcattgtctgccctcttttgcgtaggatttttctctcagacccaggggacattgccttggacttttctctacaaatgccctcagatgtaagaccagaaatgattctgcttgtggaactcgtggctttctgtcctattttccttttatgtgagccctgcaggttgcctttggcgcccacaccagttctgtcttcatgtcgctgcatcgtgaagccccatttgcctttagtccctgctttgtgtgtcttcacttccacagccagtgttgcccctcagggcatactttgctggtgaacgggctgtagagtcttgagtatgttattggcctaagtgggcatgaggccccagcatccgactccatctgccaggctgcagggcacagcagcactggcatagacaggcacgctctgtcttccaacgtgcaccagccttttcttacatattttgcctgtttttaaaaaatacgaggagagggtgcagatggatactgtgccctcaccctcctaagccaggtaatatattgatgtgcagacttttaagaaatcttagtcttatcacaaatatcaagtaatttattttttccattttcaaatgcaaaagttagcctaggaagcctcccagtcatcctgaaggaccttttgactttgcttttataattctgttaaaaattgaggaggggattaatgagtacaatgaaaacaaaacaaaacaaaaaattaagaagaggaaagctcaaaagaggataagagactgaaaaggcacctcagaatggctgctgtgggcagagtctgtgacatgactttccccgccctgcccctctgttcagagcagctggaaagatgggatcagtaagattaaaaaacttttgttcggccaggcgtggtggctcacacctgtaatcccagcactttgggaggctgaggcggacggatcatgaggtcaggagttcaagaccagcctggccaatatggtgaaaccccgtctctactaaaaatacaaaaattagccgggtgttgtggctcaccctctattcccagctactcgggaggcagagacaggagaatcgcctgaacccaggaggcagaggttgcagtgagctgagatcgtgccactgcactccagcctgggtgacagagcgagactccatctcagaaaacaaacaaacaaaaagaaacttttgttcaagctgcatcttcacattgaatgaaagcattcagacgggtgactgctgctgtccacaactgtgggcggaagtgtgccttttcccagtttctcgtccaggaggttgcatagcaaatactcaagtcactgggatatatgctttccaaatgctggcccccatagcacctttccccatgtctttctaccaagcctcttatgtttaatctgtgcagggaagacaagagtagaccatattctctgtgtgctgtgcatgtcctggtgtcactcattgcctcttatctgtcgccattctaatataagtcagcttaatagttgactctgaataatgcaaaacccagcttgcttccagaatggcctaggaccctcctcctcctgccagttttttttttttttttggttcatgtggcataatcatctttcaaaattaaccaaatgccccagaaaatgatgttaccactaaaatattttctccaagaaggcatactgtaacagaaaagataggtaagatatttttttcccaagaagtaagaattgattgtgctgaatgttcaaactctggaaactgttcacagtatgttgttcttagctgttatttatataaagtgaattattttctctctcaatcatgccatagtggagacttttgtttgtgagtaagtgacagagtaatatgaaataatgtgatatgtcagagtgacatgcagcatcctgagcctgtttttatgttctgtgtacagtggcatttgattgagatcaaagcctgtcacagcctgctgctgggggtgtggggatatgccagagtcctgtgtttggttttagaagtttactgaatgtttcccacatggagaataatggatggcatgttagtttctttaagagtggtaaagttgtacatctgtcattgttgcatttcgaattgaacacatagatgcttgcctgtctgcttgggtgaatgcctcttgggagagcgaagattacgtgcatgatgtatgttaagaaacagtttccggtcaggcacagtggcttacacctgtaatcccagcactttgggaagccgaggcgggcggattatgaggtcaagagatagagaccatcctggccaacacggtgaaaccccgtctctactaaaaatacaaaaattagctgggcatggtggcacacacctgtagtcccagctactcgggaggctgaggcaggagaatcacttgaacccgggaggtggaggttgcagtgagccgagatcatgccactgcactccagcctggcaatagagcgagactccgtctca

SEQ ID NO: 440750 - DNA, 6777 bp, Homo sapiens
ccagtgcattaatcagtagaattaatcagtgcatgttcctagtctgtaactaaactctgtggaagattcccctgctttcctatagtaaaggtttacgactttttcttctatctttattaagcttgtcattttcttctttttgcatggttcttacaaattatttggtcaatttcattttcagaatgttgaaacacagaatgtgcttctctcctctgactcaattagctgtttttgtttttctacagatgattcttttattaggccagtaactttttggattgttggggattttgatagcccttctggacggcagttactgtatgatgccatcaaacatcagaaatccagtaacaatgttagaataagcatgatcaataatcctgccaaagagataagctatgagaacactcagatctccagagcaatctgggcagctctccaaactcagacttccaacgctgctaagaacttcatcaccaaaatggccaaggagggggctgcagaggccctggctgcaggagctgacattgcggagttctctgttgggggaatggatttcagtctttttaaagaggtctttgagtcttccaaaatggatttcattttgtctcatgccgtgtactgcagggatgttctgaagctgaagaagggacagagggcagtgatcagcaatggaaggatcattgggccactggaggatagtgagctctttaatcaagacgatttccacctcctcgaaaatatcatcttaaaaacctcaggacagaaaataaaatctcatattcaacagcttcgggtagaagaagatgtggcaagcgacttggtaatgaaggtggatgctcttctgtcagcgcaaccaaaaggagatccaagaatcgagtaccagttttttgaagacagacacagtgcaatcaaactgaggccgaaggaaggggagacatactttgatgttgtggctgtcgttgaccctgtcaccagagaagcacagagacttgctcctttgctcttggttttggctcagctgataaacatgaatctgagagtatttatgaactgccaatccaaactttctgacatgcctttaaaaagcttttaccgttatgtcttagaaccagagatttctttcacttcagacaatagttttgctaagggtccaatcgcaaaatttttggatatgcctcagtctccactgttcactctgaatttgaacacacctgagagctggatggtagaatctgtcagaacaccatatgatcttgataatatttatttagaagaggtggacagtgtagtggctgctgagtatgagctggaatacctgttactggaaggtcattgctacgacatcaccacaggccagcctccacggggactacagtttaccttaggaacttcagccaacccggtcattgtggacaccattgttatggccaatctgggctactttcagctgaaagccaacccaggagcttggatcctcagacttaggaagggacgctctgaagatatttatagaatttacagccacgatggcaccgattctccccctgatgctgatgaggtggttatcgtcctcaacaacttcaaaagcaaaattattaaagtgaaggttcagaagaaggcagatatggtgaacgaagacttgctgagtgatggaacgagtgagaatgaatctggattttgggattccttcaaatggggctttacaggacagaagactgaggaagtgaagcaagataaagatgacataattaatattttctccgttgcatctggtcatctctacgaaagatttcttcgcataatgatgctatccgtgctgaagaataccaagactcctgtgaaattctggttcttgaagaattacttgtcccccacatttaaggagtttataccttacatggcaaatgaatacaatttccagtatgagcttgttcagtacaaatggccccggtggcttcatcaacaaactgaaaaacagcgtatcatctggggttacaagatcctcttcctggatgtacttttcccactagttgttgacaagttcctgtttgtggatgctgatcagattgtacgaacagatctgaaagagttaagagatttcaatttggatggtgctccttatggttacactcctttctgtgacagccgaagagaaatggacggctacaggttctggaagtcagggtactgggccagtcatttagccgggcgaaagtatcatatcagtgcactatatgttgtggatctgaagaagtttaggaaaatagctgctggtgacagactcaggggacagtaccaaggtctgagtcaggaccctaacagcctttcaaatcttgatcaagatctgcccaataacatgattcatcaggtgccaattaaatccctccctcaagaatggctttggtgtgaaacgtggtgtgatgacgcctctaagaaaagggcaaaaaccattgatttgtgtaataatccgatgaccaaagagccgaaactggaagcagctgtgcggattgtcccggagtggcaggactacgaccaagagatcaaacagctacagatccgctttcagaaggagaaagaaacgggagcactgtacaaagagaagacaaaagaaccaagccgagaaggtcctcagaaacgtgaagaattatgatctctggagaaggacaggaaatcaccccatttgaaaaacagtttttataataaatgctagttttttctgatctgtctatacaactgctgataagccggctgggcaggagtgccacaccttttgattctgagcatttgattctgacttctgtactctggtggccactggatctttgggattaaagctctgttggatttgtacctcagaggaagaccaagtggctgatcctttggactctgtaaagagcattcttctagtcagagggtggaatggcagcagcaactggaagaaaatgagttttttggtgcccacacccaagagcacacacatgctgcactgtctcggaaagcagggccagctagagccaccatgttcttccttacctcagtttacctgcggcctgcgctgcactgcagatgcccaccctgccctgggtctggccggcggaagctctgtccaaggtccacacacctccaggtttacgccaacatccttgtgccctccccaccttctcttccaacgcattaggtgcattgtttaattgaaatccaaccaacaattgtgtgtcaaggctggtttggtgcagtggctgggcaaattaattttgggccaggatgggggtgggttgcagtgagggtagggaaaatgtcaggagtaggaaggttcgggggttaagggaagggaaggaagaccagaactggccatcctcttttataatccattagtagcaccatggctcatttgaaatgaaaatattacacttattccccacccaaccgcagtgaactttctaggtaattgttttgaaaacaatttttgtatctgtgaaagtctttgctttttctttccaccttctagaaaagtctgctaccagtttccttactgaatacagccatactcagcccctctcgcatccagcccgtcagggtcagggtcagggtcaggctccctcaagacgagcaccgcattgtctgccctcttttgcgtaggatttttctctcagacccaggggacattgccttggacttttctctacaaatgccctcagatgtaagaccagaaatgattctgcttgtggaactcgtggctttctgtcctattttccttttatgtgagccctgcaggttgcctttggcgcccacaccagttctgtcttcatgtcgctgcatcgtgaagccccatttgcctttagtccctgctttgtgtgtcttcacttccacagccagtgttgcccctcagggcatactttgctggtgaacgggctgtagagtcttgagtatgttattggcctaagtgggcatgaggccccagcatccgactccatctgccaggctgcagggcacagcagcactggcatagacaggcacgctctgtcttccaacgtgcaccagccttttcttacatattttgcctgtttttaaaaaatacgaggagagggtgcagatggatactgtgccctcaccctcctaagccaggtaatatattgatgtgcagacttttaagaaatcttagtcttatcacaaatatcaagtaatttattttttccattttcaaatgcaaaagttagcctaggaagcctcccagtcatcctgaaggaccttttgactttgcttttataattctgttaaaaattgaggaggggattaatgagtacaatgaaaacaaaacaaaacaaaaaattaagaagaggaaagctcaaaagaggataagagactgaaaaggcacctcagaatggctgctgtgggcagagtctgtgacatgactttccccgccctgcccctctgttcagagcagctggaaagatgggatcagtaagattaaaaaacttttgttcggccaggcgtggtggctcacacctgtaatcccagcactttgggaggctgaggcggacggatcatgaggtcaggagttcaagaccagcctggccaatatggtgaaaccccgtctctactaaaaatacaaaaattagccgggtgttgtggctcaccctctattcccagctactcgggaggcagagacaggagaatcgcctgaacccaggaggcagaggttgcagtgagctgagatcgtgccactgcactccagcctgggtgacagagcgagactccatctcagaaaacaaacaaacaaaaagaaacttttgttcaagctgcatcttcacattgaatgaaagcattcagacgggtgactgctgctgtccacaactgtgggcggaagtgtgccttttcccagtttctcgtccaggaggttgcatagcaaatactcaagtcactgggatatatgctttccaaatgctggcccccatagcacctttccccatgtctttctaccaagcctcttatgtttaatctgtgcagggaagacaagagtagaccatattctctgtgtgctgtgcatgtcctggtgtcactcattgcctcttatctgtcgccattctaatataagtcagcttaatagttgactctgaataatgcaaaacccagcttgcttccagaatggcctaggaccctcctcctcctgccagttttttttttttttttggttcatgtggcataatcatctttcaaaattaaccaaatgccccagaaaatgatgttaccactaaaatattttctccaagaaggcatactgtaacagaaaagataggtaagatatttttttcccaagaagtaagaattgattgtgctgaatgttcaaactctggaaactgttcacagtatgttgttcttagctgttatttatataaagtgaattattttctctctcaatcatgccatagtggagacttttgtttgtgagtaagtgacagagtaatatgaaataatgtgatatgtcagagtgacatgcagcatcccggcctcccaaagtgctgggattgcaggcgtgaccactatgtccggtcaagccctcgtgttctgaaccttgtcaaggctctgcctgaatgagttttcatctgattgtggggaccaagtccctgagtagagggccaagagctagggacagggggaagagactggcccaggtggtagggaggaaagaactcccagagtttcctttagccaggaaacctgctctactgaccccgtgacttggacagtcagacatcaccctgagagtgacaagtgtaaaatgactcccttcctcccccgccctccggaagtatatttagatacttgaaagcagtccttttctaaaatggccttacctatgtggcctgaacgattaaaagaaagaactcagagttacaagggaaaaagaaaaagagttacaagggaattgtagtctttttctgaatagaatattagtactgtggtattgcatttcatgggaatggaaatgtattggtaaagctacctgatggaagctttctcttggtaacaaaaatggagggtgtattatgtgcagttatttaaatatatgtattccattgttgcgtggtttttttcccccctcaagacagagatttgctcttgttgcccagggtggagtacaatggtgtgaccttggctcactgcaacctctgcctcctgggttcaggtgattctcctgcctcagccttccgagtagctgggattacaggtgtgcgccaccacacccggctaatttttgctttttttttttttgagacagaatctcgctctgttgctcaggctgagatcgtgccactgcactccagcctggggtgacagagcgagactccatctcagaaaacaaacaaacaaaaagaaactttggttcaagctgcatcttcacttggattgcaacgctttcagacgggtgactggctgctgtccacaactgtggccggaagtgtgccttttcccagtttctcgtccagggggtgtgcatagcaaatactcaacgtccctgggatatttgctttccaagtgctggcccccataggacctttccccatgtcttttctaccagggcctcttgtgttaatcgtgtgcggggacacagggttgcccttattttctgtgtgggtgggctggcgtggggtcacaccatggcctttatctgtgggctccatttaggcacgctaaaggtggtctgaatatgggacccgttggtccaatggctaggcctcctccgcgcgtatttggcgcagggcgacttctcga

SEQ ID NO: 440751 - DNA, 6280 bp, Homo sapiens
ccagtgcattaatcagtagaattaatcagtgcatgttcctagtctgtaactaaactctgtggaagattcccctgctttcctatagtaaaggtttacgactttttcttctatctttattaagcttgtcattttcttctttttgcatggttcttacaaattatttggtcaatttcattttcagaatgttgaaacacagaatgtgcttctctcctctgactcaattagctgtttttgtttttctacagatgattcttttattaggccagtaactttttggattgttggggattttgatagcccttctggacggcagttactgtatgatgccatcaaacatcagaaatccagtaacaatgttagaataagcatgatcaataatcctgccaaagagataagctatgagaacactcagatctccagagcaatctgggcagctctccaaactcagacttccaacgctgctaagaacttcatcaccaaaatggccaaggagggggctgcagaggccctggctgcaggagctgacattgcggagttctctgttgggggaatggatttcagtctttttaaagaggtctttgagtcttccaaaatggatttcattttgtctcatgccgtgtactgcagggatgttctgaagctgaagaagggacagagggcagtgatcagcaatggaaggatcattgggccactggaggatagtgagctctttaatcaagacgatttccacctcctcgaaaatatcatcttaaaaacctcaggacagaaaataaaatctcatattcaacagcttcgggtagaagaagatgtggcaagcgacttggtaatgaaggtggatgctcttctgtcagcgcaaccaaaaggagatccaagaatcgagtaccagttttttgaagacagacacagtgcaatcaaactgaggccgaaggaaggggagacatactttgatgttgtggctgtcgttgaccctgtcaccagagaagcacagagacttgctcctttgctcttggttttggctcagctgataaacatgaatctgagagtatttatgaactgccaatccaaactttctgacatgcctttaaaaagcttttaccgttatgtcttagaaccagagatttctttcacttcagacaatagttttgctaagggtccaatcgcaaaatttttggatatgcctcagtctccactgttcactctgaatttgaacacacctgagagctggatggtagaatctgtcagaacaccatatgatcttgataatatttatttagaagaggtggacagtgtagtggctgctgagtatgagctggaatacctgttactggaaggtcattgctacgacatcaccacaggccagcctccacggggactacagtttaccttaggaacttcagccaacccggtcattgtggacaccattgttatggccaatctgggctactttcagctgaaagccaacccaggagcttggatcctcagacttaggaagggacgctctgaagatatttatagaatttacagccacgatggcaccgattctccccctgatgctgatgaggtggttatcgtcctcaacaacttcaaaagcaaaattattaaagtgaaggttcagaagaaggcagatatggtgaacgaagacttgctgagtgatggaacgagtgagaatgaatctggattttgggattccttcaaatggggctttacaggacagaagactgaggaagtgaagcaagataaagatgacataattaatattttctccgttgcatctggtcatctctacgaaagatttcttcgcataatgatgctatccgtgctgaagaataccaagactcctgtgaaattctggttcttgaagaattacttgtcccccacatttaaggagtttataccttacatggcaaatgaatacaatttccagtatgagcttgttcagtacaaatggccccggtggcttcatcaacaaactgaaaaacagcgtatcatctggggttacaagatcctcttcctggatgtacttttcccactagttgttgacaagttcctgtttgtggatgctgatcagattgtacgaacagatctgaaagagttaagagatttcaatttggatggtgctccttatggttacactcctttctgtgacagccgaagagaaatggacggctacaggttctggaagtcagggtactgggccagtcatttagccgggcgaaagtatcatatcagtgcactatatgttgtggatctgaagaagtttaggaaaatagctgctggtgacagactcaggggacagtaccaaggtctgagtcaggaccctaacagcctttcaaatcttgatcaagatctgcccaataacatgattcatcaggtgccaattaaatccctccctcaagaatggctttggtgtgaaacgtggtgtgatgacgcctctaagaaaagggcaaaaaccattgatttgtgtaataatccgatgaccaaagagccgaaactggaagcagctgtgcggattgtcccggagtggcaggactacgaccaagagatcaaacagctacagatccgctttcagaaggagaaagaaacgggagcactgtacaaagagaagacaaaagaaccaagccgagaaggtcctcagaaacgtgaagaattatgatctctggagaaggacaggaaatcaccccatttgaaaaacagtttttataataaatgctagttttttctgatctgtctatacaactgctgataagccggctgggcaggagtgccacaccttttgattctgagcatttgattctgacttctgtactctggtggccactggatctttgggattaaagctctgttggatttgtacctcagaggaagaccaagtggctgatcctttggactctgtaaagagcattcttctagtcagagggtggaatggcagcagcaactggaagaaaatgagttttttggtgcccacacccaagagcacacacatgctgcactgtctcggaaagcagggccagctagagccaccatgttcttccttacctcagtttacctgcggcctgcgctgcactgcagatgcccaccctgccctgggtctggccggcggaagctctgtccaaggtccacacacctccaggtttacgccaacatccttgtgccctccccaccttctcttccaacgcattaggtgcattgtttaattgaaatccaaccaacaattgtgtgtcaaggctggtttggtgcagtggctgggcaaattaattttgggccaggatgggggtgggttgcagtgagggtagggaaaatgtcaggagtaggaaggttcgggggttaagggaagggaaggaagaccagaactggccatcctcttttataatccattagtagcaccatggctcatttgaaatgaaaatattacacttattccccacccaaccgcagtgaactttctaggtaattgttttgaaaacaatttttgtatctgtgaaagtctttgctttttctttccaccttctagaaaagtctgctaccagtttccttactgaatacagccatactcagcccctctcgcatccagcccgtcagggtcagggtcagggtcaggctccctcaagacgagcaccgcattgtctgccctcttttgcgtaggatttttctctcagacccaggggacattgccttggacttttctctacaaatgccctcagatgtaagaccagaaatgattctgcttgtggaactcgtggctttctgtcctattttccttttatgtgagccctgcaggttgcctttggcgcccacaccagttctgtcttcatgtcgctgcatcgtgaagccccatttgcctttagtccctgctttgtgtgtcttcacttccacagccagtgttgcccctcagggcatactttgctggtgaacgggctgtagagtcttgagtatgttattggcctaagtgggcatgaggccccagcatccgactccatctgccaggctgcagggcacagcagcactggcatagacaggcacgctctgtcttccaacgtgcaccagccttttcttacatattttgcctgtttttaaaaaatacgaggagagggtgcagatggatactgtgccctcaccctcctaagccaggtaatatattgatgtgcagacttttaagaaatcttagtcttatcacaaatatcaagtaatttattttttccattttcaaatgcaaaagttagcctaggaagcctcccagtcatcctgaaggaccttttgactttgcttttataattctgttaaaaattgaggaggggattaatgagtacaatgaaaacaaaacaaaacaaaaaattaagaagaggaaagctcaaaagaggataagagactgaaaaggcacctcagaatggctgctgtgggcagagtctgtgacatgactttccccgccctgcccctctgttcagagcagctggaaagatgggatcagtaagattaaaaaacttttgttcggccaggcgtggtggctcacacctgtaatcccagcactttgggaggctgaggcggacggatcatgaggtcaggagttcaagaccagcctggccaatatggtgaaaccccgtctctactaaaaatacaaaaattagccgggtgttgtggctcaccctctattcccagctactcgggaggcagagacaggagaatcgcctgaacccaggaggcagaggttgcagtgagctgagatcgtgccactgcactccagcctgggtgacagagcgagactccatctcagaaaacaaacaaacaaaaagaaacttttgttcaagctgcatcttcacattgaatgaaagcattcagacgggtgactgctgctgtccacaactgtgggcggaagtgtgccttttcccagtttctcgtccaggaggttgcatagcaaatactcaagtcactgggatatatgctttccaaatgctggcccccatagcacctttccccatgtctttctaccaagcctcttatgtttaatctgtgcagggaagacaagagtagaccatattctctgtgtgctgtgcatgtcctggtgtcactcattgcctcttatctgtcgccattctaatataagtcagcttaatagttgactctgaataatgcaaaacccagcttgcttccagaatggcctaggaccctcctcctcctgccagttttttttttttttttggttcatgtggcataatcatctttcaaaattaaccaaatgccccagaaaatgatgttaccactaaaatattttctccaagaaggcatactgtaacagaaaagataggtaagatatttttttcccaagaagtaagaattgattgtgctgaatgttcaaactctggaaactgttcacagtatgttgttcttagctgttatttatataaagtgaattattttctctctcaatcatgccatagtggagacttttgtttgtgagtaagtgacagagtaatatgaaataatgtgatatgtcagagtgacatgcagcatcccggcctcccaaagtgctgggattgcaggcgtgaccactatgtccggtcaagccctcgtgttctgaaccttgtcaaggctctgcctgaatgagttttcatctgattgtggggaccaagtccctgagtagagggccaagagctagggacagggggaagagactggcccaggtggtagggaggaaagaactcccagagtttcctttagccaggaaacctgctctactgaccccgtgacttggacagtcagacatcaccctgagagtgacaagtgtaaaatgactcccttcctcccccgccctccggaagtatatttagatacttgaaagcagtccttttctaaaatggccttacctatgtggcctgaacgattaaaagaaagaactcagagttacaagggaaaaagaaaaagagttacaagggaattgtagtctttttctgaatagaatattagtactgtggtattgcatttcatgggaatggaaatgtattggtaaagctacctgatggaagctttctcttggtaacaaaaatggagggtgtattatgtgcagttatttaaatatatgtattccattgttgcgtggtttttttcccccctcaagacagagatttgctcttgttgcccagggtggagtacaatggtgtgactgtgatagtgccattgcactccagcctgggtgacagagtgagaccctgtctcaaaaaaacaaaatcaaaacaacccataaaccaaggtgttgaaatcattcaataaaaatgttaaaataattata

SEQ ID NO: 440752 - DNA, 5300 bp, Homo sapiens
tcacttttcctgccttccattagccactcacacattctttgtagatgtaaatacagctttacatagcccactaccatattgcttctgtgtaataatccgatgaccaaagagccgaaactggaagcagctgtgcggattgtcccggagtggcaggactacgaccaagagatcaaacagctacagatccgctttcagaaggagaaagaaacgggagcactgtacaaagagaagacaaaagaaccaagccgagaaggtcctcagaaacgtgaagaattatgatctctggagaaggacaggaaatcaccccatttgaaaaacagtttttataataaatgctagttttttctgatctgtctatacaactgctgataagccggctgggcaggagtgccacaccttttgattctgagcatttgattctgacttctgtactctggtggccactggatctttgggattaaagctctgttggatttgtacctcagaggaagaccaagtggctgatcctttggactctgtaaagagcattcttctagtcagagggtggaatggcagcagcaactggaagaaaatgagttttttggtgcccacacccaagagcacacacatgctgcactgtctcggaaagcagggccagctagagccaccatgttcttccttacctcagtttacctgcggcctgcgctgcactgcagatgcccaccctgccctgggtctggccggcggaagctctgtccaaggtccacacacctccaggtttacgccaacatccttgtgccctccccaccttctcttccaacgcattaggtgcattgtttaattgaaatccaaccaacaattgtgtgtcaaggctggtttggtgcagtggctgggcaaattaattttgggccaggatgggggtgggttgcagtgagggtagggaaaatgtcaggagtaggaaggttcgggggttaagggaagggaaggaagaccagaactggccatcctcttttataatccattagtagcaccatggctcatttgaaatgaaaatattacacttattccccacccaaccgcagtgaactttctaggtaattgttttgaaaacaatttttgtatctgtgaaagtctttgctttttctttccaccttctagaaaagtctgctaccagtttccttactgaatacagccatactcagcccctctcgcatccagcccgtcagggtcagggtcagggtcaggctccctcaagacgagcaccgcattgtctgccctcttttgcgtaggatttttctctcagacccaggggacattgccttggacttttctctacaaatgccctcagatgtaagaccagaaatgattctgcttgtggaactcgtggctttctgtcctattttccttttatgtgagccctgcaggttgcctttggcgcccacaccagttctgtcttcatgtcgctgcatcgtgaagccccatttgcctttagtccctgctttgtgtgtcttcacttccacagccagtgttgcccctcagggcatactttgctggtgaacgggctgtagagtcttgagtatgttattggcctaagtgggcatgaggccccagcatccgactccatctgccaggctgcagggcacagcagcactggcatagacaggcacgctctgtcttccaacgtgcaccagccttttcttacatattttgcctgtttttaaaaaatacgaggagagggtgcagatggatactgtgccctcaccctcctaagccaggtaatatattgatgtgcagacttttaagaaatcttagtcttatcacaaatatcaagtaatttattttttccattttcaaatgcaaaagttagcctaggaagcctcccagtcatcctgaaggaccttttgactttgcttttataattctgttaaaaattgaggaggggattaatgagtacaatgaaaacaaaacaaaacaaaaaattaagaagaggaaagctcaaaagaggataagagactgaaaaggcacctcagaatggctgctgtgggcagagtctgtgacatgactttccccgccctgcccctctgttcagagcagctggaaagatgggatcagtaagattaaaaaacttttgttcggccaggcgtggtggctcacacctgtaatcccagcactttgggaggctgaggcggacggatcatgaggtcaggagttcaagaccagcctggccaatatggtgaaaccccgtctctactaaaaatacaaaaattagccgggtgttgtggctcaccctctattcccagctactcgggaggcagagacaggagaatcgcctgaacccaggaggcagaggttgcagtgagctgagatcgtgccactgcactccagcctgggtgacagagcgagactccatctcagaaaacaaacaaacaaaaagaaacttttgttcaagctgcatcttcacattgaatgaaagcattcagacgggtgactgctgctgtccacaactgtgggcggaagtgtgccttttcccagtttctcgtccaggaggttgcatagcaaatactcaagtcactgggatatatgctttccaaatgctggcccccatagcacctttccccatgtctttctaccaagcctcttatgtttaatctgtgcagggaagacaagagtagaccatattctctgtgtgctgtgcatgtcctggtgtcactcattgcctcttatctgtcgccattctaatataagtcagcttaatagttgactctgaataatgcaaaacccagcttgcttccagaatggcctaggaccctcctcctcctgccagttttttttttttttttggttcatgtggcataatcatctttcaaaattaaccaaatgccccagaaaatgatgttaccactaaaatattttctccaagaaggcatactgtaacagaaaagataggtaagatatttttttcccaagaagtaagaattgattgtgctgaatgttcaaactctggaaactgttcacagtatgttgttcttagctgttatttatataaagtgaattattttctctctcaatcatgccatagtggagacttttgtttgtgagtaagtgacagagtaatatgaaataatgtgatatgtcagagtgacatgcagcatcccggcctcccaaagtgctgggattgcaggcgtgaccactatgtccggtcaagccctcgtgttctgaaccttgtcaaggctctgcctgaatgagttttcatctgattgtggggaccaagtccctgagtagagggccaagagctagggacagggggaagagactggcccaggtggtagggaggaaagaactcccagagtttcctttagccaggaaacctgctctactgaccccgtgacttggacagtcagacatcaccctgagagtgacaagtgtaaaatgactcccttcctcccccgccctccggaagtatatttagatacttgaaagcagtccttttctaaaatggccttacctatgtggcctgaacgattaaaagaaagaactcagagttacaagggaaaaagaaaaagagttacaagggaattgtagtctttttctgaatagaatattagtactgtggtattgcatttcatgggaatggaaatgtattggtaaagctacctgatggaagctttctcttggtaacaaaaatggagggtgtattatgtgcagttatttaaatatatgtattccattgttgcgtggtttttttcccccctcaagacagagatttgctcttgttgcccagggtggagtacaatggtgtgaccttggctcactgcaacctctgcctcctgggttcaggtgattctcctgcctcagccttccgagtagctgggattacaggtgtgcgccaccacacccggctaatttttgctttttttttttttgagacagaatctcgctctgttgctcaggctggagtggagtgcagtggcacaatctcagctcactgcagcctctgcctcccgggttcaagagattctcctgactcaacctcctgagtagctgggattacaggtgcctgccactatgcctagctaatttttgtagtttttagtagtagacggggtcttcgcatgtgtggccagggtggtctcgaactcctgacctcaagtgatccacccgcatcggccccccaaagtgctgggattataggcgtgaaccaccgcgcctgtcccattgttgtgtaattttaataattagttttttaagtacttgattttatgggcacatttttgtgggatgattggagttaatcaaataaagcttgtcatgtgtgtagtttggtaagataacttctttaaattcatgttttctctgccttgaggtagtgagggaaagatcttaatcagtattttggtaattaactgattgaattcaagcaaatgagacatcatgaacttcagtggttattgatatttcagggtatatacctgaaatgcctagaggatacagatttctcatttcattctttggtctttcatttctctatatacagaaatgaaatgacacttctgggaggcagtagaagcaggaagtcaatgaattgagtagagggtcccattccctcaggctgtcattgatcagtgacaatttataaaaacaaactgcaaagtctgtggcaagtggctgcctgcttcctagaaggagcccatgaaggttaaactctgtggtcggtatttgcaagcgccgggcgtggtggctcacgcctgtaatcctagcaccttgggaggccaaggcaggcggatcacccgaggtcaggagtttgaggatttgcaagcaaaaggtcctctcctgagtctttcccagatacccagcagtgcagaggctagctgtggaaggttgcagtgggacaggaatgtattgtatgccttgccttacttgtcaccattgagatttccagagaaatgggcataacgtctcttaacaacaacagcagaaagcaaaatacattaacttaaggttgacaacaaaagattatcaagtaccatgttttccaaccaaccagttattcgtggtaataataaaataaaggtgggaaaatgttataatttttaaggaaactgtgtactttaaaaatcttctttatgaatatccaatgttactgtaatcctgctccattaaatgcagcattgttgtcaggtgctgcctcttgcttgggaacagcattgggcttttaaatgtctgcagaatctctgcgttcgaagggaattgagaatgaacttcctggtactgtaatgaaaataaggtctgctcaacacagtaaacgtttcctctcttcttta

SEQ ID NO: 440753 - DNA, 3200 bp, Homo sapiens
cgtacggatgtggcctgaagattaaaagaaagaactcagagttacaagggaaaaagaaaaagagttacaagggaatggtagtctttttctgaatagaatattagtactgtggtatggcatttcatgggaatggaaatgtatgggtaaagctacctgatggaagctttctctgggtaacaaaaatggagggtgtattatgtgcagttatttaaatatatgtattccatggttgcagtgagctgagatcgtgccactgcactccagcctgggtgacagagcgagactccatctcagaaaacaaacaaacaaaaagaaacttttgttcaagctgcatcttcacattgaatgaaagcattcagacgggtgactgctgctgtccacaactgtgggcggaagtgtgccttttcccagtttctcgtccaggaggttgcatagcaaatactcaagtcactgggatatatgctttccaaatgctggcccccatagcacctttccccatgtctttctaccaagcctcttatgtttaatctgtgcagggaagacaagagtagaccatattctctgtgtgctgtgcatgtcctggtgtcactcattgcctcttatctgtcgccattctaatataagtcagcttaatagttgactctgaataatgcaaaacccagcttgcttccagaatggcctaggaccctcctcctcctgccagttttttttttttttttggttcatgtggcataatcatctttcaaaattaaccaaatgccccagaaaatgatgttaccactaaaatattttctccaagaaggcatactgtaacagaaaagataggtaagatatttttttcccaagaagtaagaattgattgtgctgaatgttcaaactctggaaactgttcacagtatgttgttcttagctgttatttatataaagtgaattattttctctctcaatcatgccatagtggagacttttgtttgtgagtaagtgacagagtaatatgaaataatgtgatatgtcagagtgacatgcagcatcccggcctcccaaagtgctgggattgcaggcgtgaccactatgtccggtcaagccctcgtgttctgaaccttgtcaaggctctgcctgaatgagttttcatctgattgtggggaccaagtccctgagtagagggccaagagctagggacagggggaagagactggcccaggtggtagggaggaaagaactcccagagtttcctttagccaggaaacctgctctactgaccccgtgacttggacagtcagacatcaccctgagagtgacaagtgtaaaatgactcccttcctcccccgccctccggaagtatatttagatacttgaaagcagtccttttctaaaatggccttacctatgtggcctgaacgattaaaagaaagaactcagagttacaagggaaaaagaaaaagagttacaagggaattgtagtctttttctgaatagaatattagtactgtggtattgcatttcatgggaatggaaatgtattggtaaagctacctgatggaagctttctcttggtaacaaaaatggagggtgtattatgtgcagttatttaaatatatgtattccattgttgcgtggtttttttcccccctcaagacagagatttgctcttgttgcccagggtggagtacaatggtgtgaccttggctcactgcaacctctgcctcctgggttcaggtgattctcctgcctcagccttccgagtagctgggattacaggtgtgcgccaccacacccggctaatttttgctttttttttttttgagacagaatctcgctctgttgctcaggctggagtggagtgcagtggcacaatctcagctcactgcagcctctgcctcccgggttcaagagattctcctgactcaacctcctgagtagctgggattacaggtgcctgccactatgcctagctaatttttgtagtttttagtagtagacggggtcttcgcatgtgtggccagggtggtctcgaactcctgacctcaagtgatccacccgcatcggccccccaaagtgctgggattataggcgtgaaccaccgcgcctgtcccattgttgtgtaattttaataattagttttttaagtacttgattttatgggcacatttttgtgggatgattggagttaatcaaataaagcttgtcatgtgtgtagtttggtaagataacttctttaaattcatgttttctctgccttgaggtagtgagggaaagatcttaatcagtattttggtaattaactgattgaattcaagcaaatgagacatcatgaacttcagtggttattgatatttcagggtatatacctgaaatgcctagaggatacagatttctcatttcattctttggtctttcatttctctatatacagaaatgaaatgacacttctgggaggcagtagaagcaggaagtcaatgaattgagtagagggtcccattccctcaggctgtcattgatcagtgacaatttataaaaacaaactgcaaagtctgtggcaagtggctgcctgcttcctagaaggagcccatgaaggttaaactctgtggtcggtatttgcaagcgccgggcgtggtggctcacgcctgtaatcctagcaccttgggaggccaaggcaggcggatcacccgaggtcaggagtttgaggatttgcaagcaaaaggtcctctcctgagtctttcccagatacccagcagtgcagaggctagctgtggaaggttgcagtgggacaggaatgtattgtatgccttgccttacttgtcaccattgagatttccagagaaatgggcataacgtctcttaacaacaacagcagaaagcaaaatacattaacttaaggttgacaacaaaagattatcaagtaccatgttttccaaccaaccagttattcgtggtaataataaaataaaggtgggaaaatgttataatttttaaggaaactgtgtactttaaaaatcttctttatgaatatccaatgttactgtaatcctgctccattaaatgcagcattgttgtcaggtgctgcctcttgcttgggaacagcattgggcttttaaatgtctgcagaatctctgcgttcgaagggaattgagaatgaacttcctggtactgtaatgaaaataaggtctgctcaacacagtaaacgtttcctctcttcttta

SEQ ID NO: 440754 - DNA, 2722 bp, Homo sapiens
ccagtgcattaatcagtagaattaatcagtgcatgttcctagtctgtaactaaactctgtggaagattcccctgctttcctatagtaaaggtttacgactttttcttctatctttattaagcttgtcattttcttctttttgcatggttcttacaaattatttggtcaatttcattttcagaatgttgaaacacagaatgtgcttctctcctctgactcaattagctgtttttgtttttctacagatgattcttttattaggccagtaactttttggattgttggggattttgatagcccttctggacggcagttactgtatgatgccatcaaacatcagaaatccagtaacaatgttagaataagcatgatcaataatcctgccaaagagataagctatgagaacactcagatctccagagcaatctgggcagctctccaaactcagacttccaacgctgctaagaacttcatcaccaaaatggccaaggagggggctgcagaggccctggctgcaggagctgacattgcggagttctctgttgggggaatggatttcagtctttttaaagaggtctttgagtcttccaaaatggatttcattttgtctcatgccgtgtactgcagggatgttctgaagctgaagaagggacagagggcagtgatcagcaatggaaggatcattgggccactggaggatagtgagctctttaatcaagacgatttccacctcctcgaaaatatcatcttaaaaacctcaggacagaaaataaaatctcatattcaacagcttcgggtagaagaagatgtggcaagcgacttggtaatgaaggtggatgctcttctgtcagcgcaaccaaaaggagatccaagaatcgagtaccagttttttgaagacagacacagtgcaatcaaactgaggccgaaggaaggggagacatactttgatgttgtggctgtcgttgaccctgtcaccagagaagcacagagacttgctcctttgctcttggttttggctcagctgataaacatgaatctgagagtatttatgaactgccaatccaaactttctgacatgcctttaaaaagcttttaccgttatgtcttagaaccagagatttctttcacttcagacaatagttttgctaagggtccaatcgcaaaatttttggatatgcctcagtctccactgttcactctgaatttgaacacacctgagagctggatggtagaatctgtcagaacaccatatgatcttgataatatttatttagaagaggtggacagtgtagtggctgctgagtatgagctggaatacctgttactggaaggtcattgctacgacatcaccacaggccagcctccacggggactacagtttaccttaggaacttcagccaacccggtcattgtggacaccattgttatggccaatctgggctactttcagctgaaagccaacccaggagcttggatcctcagacttaggaagggacgctctgaagatatttatagaatttacagccacgatggcaccgattctccccctgatgctgatgaggtggttatcgtcctcaacaacttcaaaagcaaaattattaaagtgaaggttcagaagaaggcagatatggtgaacgaagacttgctgagtgatggaacgagtgagaatgaatctggattttgggattccttcaaatggggctttacaggacagaagactgaggaagtgaagcaagataaagatgacataattaatattttctccgttgcatctggtcatctctacgaaagatttcttcgcataatgatgctatccgtgctgaagaataccaagactcctgtgaaattctggttcttgaagaattacttgtcccccacatttaaggagtttataccttacatggcaaatgaatacaatttccagtatgagcttgttcagtacaaatggccccggtggcttcatcaacaaactgaaaaacagcgtatcatctggggttacaagatcctcttcctggatgtacttttcccactagttgttgacaagttcctgtttgtggatgctgatcagattgtacgaacagatctgaaagagttaagagatttcaatttggatggtgctccttatggttacactcctttctgtgacagccgaagagaaatggacggctacaggttctggaagtcagggtactgggccagtcatttagccgggcgaaagtatcatatcagtgcactatatgttgtggatctgaagaagtttaggaaaatagctgctggtgacagactcaggggacagtaccaaggtctgagtcaggaccctaacagcctttcaaatcttgatcaagatctgcccaataacatgattcatcaggtgccaattaaatccctccctcaagaatggctttggtgtgaaacgtggtgtgatgacgcctctaagaaaagggcaaaaaccattgatttgtgtaataatccgatgaccaaagagccgaaactggaagcagctgtgcggattgtcccggagtggcaggactacgaccaagagatcaaacagctacagatccgctttcagaaggagaaagaaacgggagcactgtacaaagagaagacaaaagaaccaagccgagaaggtcctcagaaacgtgaagaattatgatctctggagaaggacaggaaatcaccccatttgaaaaacagtttttataataaatgctagttttttctg

SEQ ID NO: 440755 - DNA, 2661 bp, Homo sapiens
ccagtgcattaatcagtagaattaatcagtgcatgttcctagtctgtaactaaactctgtggaagattcccctgctttcctatagtaaaggtttacgactttttcttctatctttattaagcttgtcattttcttctttttgcatggttcttacaaattatttggtcaatttcattttcagaatgttgaaacacagaatgtgcttctctcctctgactcaattagctgtttttgtttttctacagatgattcttttattaggccagtaactttttggattgttggggattttgatagcccttctggacggcagttactgtatgatgccatcaaacatcagaaatccagtaacaatgttagaataagcatgatcaataatcctgccaaagagataagctatgagaacactcagatctccagagcaatctgggcagctctccaaactcagacttccaacgctgctaagaacttcatcaccaaaatggccaaggagggggctgcagaggccctggctgcaggagctgacattgcggagttctctgttgggggaatggatttcagtctttttaaagaggtctttgagtcttccaaaatggatttcattttgtctcatgccgtgtactgcagggatgttctgaagctgaagaagggacagagggcagtgatcagcaatggaaggatcattgggccactggaggatagtgagctctttaatcaagacgatttccacctcctcgaaaatatcatcttaaaaacctcaggacagaaaataaaatctcatattcaacagcttcgggtagaagaagatgtggcaagcgacttggtaatgaaggtggatgctcttctgtcagcgcaaccaaaaggagatccaagaatcgagtaccagttttttgaagacagacacagtgcaatcaaactgaggccgaaggaaggggagacatactttgatgttgtggctgtcgttgaccctgtcaccagagaagcacagagacttgctcctttgctcttggttttggctcagctgataaacatgaatctgagagtatttatgaactgccaatccaaactttctgacatgcctttaaaaagcttttaccgttatgtcttagaaccagagatttctttcacttcagacaatagttttgctaagggtccaatcgcaaaatttttggatatgcctcagtctccactgttcactctgaatttgaacacacctgagagctggatggtagaatctgtcagaacaccatatgatcttgataatatttatttagaagaggtggacagtgtagtggctgctgagtatgagctggaatacctgttactggaaggtcattgctacgacatcaccacaggccagcctccacggggactacagtttaccttaggaacttcagccaacccggtcattgtggacaccattgttatggccaatctgggctactttcagctgaaagccaacccaggagcttggatcctcagacttaggaagggacgctctgaagatatttatagaatttacagccacgatggcaccgattctccccctgatgctgatgaggtggttatcgtcctcaacaacttcaaaagcaaaattattaaagtgaaggttcagaagaaggcagatatggtgaacgaagacttgctgagtgatggaacgagtgagaatgaatctggattttgggattccttcaaatggggctttacaggacagaagactgaggaagtgaagcaagataaagatgacataattaatattttctccgttgcatctggtcatctctacgaaagatttcttcgcataatgatgctatccgtgctgaagaataccaagactcctgtgaaattctggttcttgaagaattacttgtcccccacatttaaggagtttataccttacatggcaaatgaatacaatttccagtatgagcttgttcagtacaaatggccccggtggcttcatcaacaaactgaaaaacagcgtatcatctggggttacaagatcctcttcctggatgtacttttcccactagttgttgacaagttcctgtttgtggatgctgatcagattgtacgaacagatctgaaagagttaagagatttcaatttggatggtgctccttatggttacactcctttctgtgacagccgaagagaaatggacggctacaggttctggaagtcagggtactgggccagtcatttagccgggcgaaagtatcatatcagtgcactatatgttgtggatctgaagaagtttaggaaaatagctgctggtgacagactcaggggacagtaccaaggtctgagtcaggaccctaacagcctttcaaatcttgatcaagatctgcccaataacatgattcatcaggtgccaattaaatccctccctcaagaatggctttggtgtgaaacgtggtgtgatgacgcctctaagaaaagggcaaaaaccattgatttgtgtaataatccgatgaccaaagagccgaaactggaagcagctgtgcggattgtcccggagtggcaggactacgaccaagagatcaaacagctacagatccgctttcagaaggagaaagaaacgggagcactgtacaaagagaagacaaaagaaccaagccgagaaggtcctcagacaccgtcgaaggggatcaaccgggc

SEQ ID NO: 440756 - DNA, 2844 bp, Homo sapiens
ccagtgcattaatcagtagaattaatcagtgcatgttcctagtctgtaactaaactctgtggaagattcccctgctttcctatagtaaaggtttacgactttttcttctatctttattaagcttgtcattttcttctttttgcatggttcttacaaattatttggtcaatttcattttcagaatgttgaaacacagaatgtgcttctctcctctgactcaattagctgtttttgtttttctacagatgattcttttattaggccagtaactttttggattgttggggattttgatagcccttctggacggcagttactgtatgatgccatcaaacatcagaaatccagtaacaatgttagaataagcatgatcaataatcctgccaaagagataagctatgagaacactcagatctccagagcaatctgggcagctctccaaactcagacttccaacgctgctaagaacttcatcaccaaaatggccaaggagggggctgcagaggccctggctgcaggagctgacattgcggagttctctgttgggggaatggatttcagtctttttaaagaggtctttgagtcttccaaaatggatttcattttgtctcatgccgtgtactgcagggatgttctgaagctgaagaagggacagagggcagtgatcagcaatggaaggatcattgggccactggaggatagtgagctctttaatcaagacgatttccacctcctcgaaaatatcatcttaaaaacctcaggacagaaaataaaatctcatattcaacagcttcgggtagaagaagatgtggcaagcgacttggtaatgaaggtggatgctcttctgtcagcgcaaccaaaaggagatccaagaatcgagtaccagttttttgaagacagacacagtgcaatcaaactgaggccgaaggaaggggagacatactttgatgttgtggctgtcgttgaccctgtcaccagagaagcacagagacttgctcctttgctcttggttttggctcagctgataaacatgaatctgagagtatttatgaactgccaatccaaactttctgacatgcctttaaaaagcttttaccgttatgtcttagaaccagagatttctttcacttcagacaatagttttgctaagggtccaatcgcaaaatttttggatatgcctcagtctccactgttcactctgaatttgaacacacctgagagctggatggtagaatctgtcagaacaccatatgatcttgataatatttatttagaagaggtggacagtgtagtggctgctgagtatgagctggaatacctgttactggaaggtcattgctacgacatcaccacaggccagcctccacggggactacagtttaccttaggaacttcagccaacccggtcattgtggacaccattgttatggccaatctgggctactttcagctgaaagccaacccaggagcttggatcctcagacttaggaagggacgctctgaagatatttatagaatttacagccacgatggcaccgattctccccctgatgctgatgaggtggttatcgtcctcaacaacttcaaaagcaaaattattaaagtgaaggttcagaagaaggcagatatggtgaacgaagacttgctgagtgatggaacgagtgagaatgaatctggattttgggattccttcaaatggggctttacaggacagaagactgaggaagtgaagcaagataaagatgacataattaatattttctccgttgcatctggtcatctctacgaaagatttcttcgcataatgatgctatccgtgctgaagaataccaagactcctgtgaaattctggttcttgaagaattacttgtcccccacatttaaggagtttataccttacatggcaaatgaatacaatttccagtatgagcttgttcagtacaaatggccccggtggcttcatcaacaaactgaaaaacagcgtatcatctggggttacaagatcctcttcctggatgtacttttcccactagttgttgacaagttcctgtttgtggatgctgatcagattgtacgaacagatctgaaagagttaagagatttcaatttggatggtgctccttatggttacactcctttctgtgacagccgaagagaaatggacggctacaggttctggaagtcagggtactgggccagtcatttagccgggcgaaagtatcatatcaggtactgaaaagaagcactcctaacactgttacggggttttccttaaaattgattttgtgtggttaaaattgtgaataggtaatacattggtatggttgaaaaataaaaatgataaaaaatacacagtggctgggtgcagtggctcatgccttaatcccagcactttgggatgccaaggcaggtggatcacctgaggtcaggatttcaagaccagcctggccaacatggcgaaaccccgtctctactaaaaatacaaaaattagctgggcatggtggtgggcgcctgtaatcccagctactcgggaggctaaggcaggagaattgcttgaacccaggaggcggaggttgcagtgagctgagatcacgccgctgcactccagcctggatgacagagtgagattccatctcaaaaaaaaaaaaaaaaaaaaaaaaccggggggatcaatggccggggggcgggaaaaaggagggtaagtggaaagtgggcccaggggccaattaggcgtggtcccgggacccaggcttccttggtacaacgggggcaagacctggcgggtcccccataatggcgaggcggaatcaattccggaaaacgccgggtaacctgggataatg

SEQ ID NO: 440757 - DNA, 204 bp, Homo sapiens
tacaatctgctgagtcactccttggcttccagtttatctctgtgccttgtaatttttccaaatggactttcacttttcctgccttccattagccactcacacattctttgtagatgtaaatacagctttacatagcccactaccatattgcttctggtagtatatcatttggttccttactattgttttcttgtccagttagga

SEQ ID NO: 440758 - DNA, 694 bp, Homo sapiens
cagagggcagtgatcagcaatggaagggtgaggatttgtcaagcttgacttcacattagatccgtgaacagtctttgcagcattctcctctgaagctagtaaactcttcagacagagccactcttttttcaaaggtgattggggcttatgaagtgccattgatgtttctgcctcctatttccaaggagctgtgctttttgacatagacaaatatccccatatggagccttcctgctgtcggtgagagtgtggtggctctcagaaagtcagtcagtatggactttgacacataaagtagcctttgttgtttttattcaggtagaattaatgaaaactactttacgattttattttactttgtccttgaggaattgataagtaaataactacaagtatttgctttgggcttcactttgtattatttcactgattttatctaaacatgtacctgtctcaggtctttaagatgttctggcgtatgaggtagcctgaggacgccagagggttccttaccagcttgctgagtgcaggcagccttccagagctaagcgcctgctcttctctccttcacagatcattgggccactggaggatagtgagctctttaatcaagacgatttccacctcctcgaaaatatcatcttaaaaacctcaggacagaaaataaaatctcatattcaacagcttcgggtag

SEQ ID NO: 440759 - DNA, 4910 bp, Homo sapiens
tgtctctggcactgtggcggactgaccacggcccgggcatgggctgcaagggagacgcgagcggtgcgtgtgccgcgggtgcgctgccggtgacaggagtttgctataaaatgggagttctggttgtactcactgttctgtggctgttctcctcagtaaaggccgactcaaaagccattacaacctctcttacaacaaaatggttttccactccattgttgttagaagccagtgagtttttagcagaagacagtcaagagaaattttggaattttgtagaagccagtcaaaatattggatcatcagatcatgacggtaccgattattcctactatcatgcaatattggaggctgcatttcagtttctgtcacccctccagcagaatttgtttaaattttgtctgtcccttcgttcttactcagctacaatccaagccttccagcagatagcagctgatgaacctccaccagaaggatgtaattcgtttttttcagtgcatggaaagaagacttgtgaatctgatacccttgaggctcttctactgacagcctctgaaagacccaaacctttattgttcaaaggagatcacagatatccctcgtctaatcctgaaagccctgtggtgattttctactctgagattggctctgaggaattttccaattttcaccgccagcttatatcaaaaagcaatgcaggcaaaatcaactatgtattcagacattatatatttaatcccaggaaggagcctgtttacctctctggctatggcgtggaattggccattaagagcactgagtacaaggccaaggatgatactcaggtgaaaggaactgaggtaaacaccacagtgattggtgaaaatgatcctattgatgaggttcaggggttcctctttggaaaattaagagatctgcaccccgacctggagggacagttgaaagaactcagaaagcatcttgtagagagcaccaatgaaatggcacctttaaaagtttggcagttgcaagatctcagtttccagactgctgctcgaatcttggcttctcctgttgagttggctttggttgtcatgaaggatcttagtcagaattttcctaccaaagccagagcaataacaaaaacagctgtgagctcagaacttagaaccgaagtggaagagaatcagaagtatttcaagggaactttaggattacaacctggagattcagccctcttcatcaatggacttcacatggatttagatacacaggatatattcagtctgtttgatgtgttgaggaatgaagctcgggtaatggagggtctgcatagattgggaatagaaggcctttctctgcataatgttttgaagctgaacatccagccctctgaggcagactatgccgtagacatccggagtcctgctatttcatgggtcaacaacctggaggttgatagcagatataattcgtggccttctagtttacaagagttgcttcgacccacctttcctggtgttattcggcagatcaggaaaaacttacataatatggttttcatagttgatcctgcacatgagaccacagcagagttgatgaacacagctgagatgttccttagtaatcatataccactaagaattggttttatctttgtggttaatgactctgaagatgttgatgggatgcaagatgctggagtggctgttcttagagcatataattatgttgcccaagaagtggatgattatcatgccttccagactctgacacatatctataacaaggtgaggactggagaaaaagtgaaagttgaacatgtggtcagtgtcctggagaagaaatatccgtatgtagaagtgaatagcattttggggattgattctgcttatgatcggaatcggaaggaagcaagaggctactatgagcagactggagttggacctctgcccgttgtgctgttcaatggaatgccctttgaaagggaacagctagaccctgatgagttagaaaccatcacaatgcataaaatcctggagaccaccaccttcttccaaagagcggtgtacttgggtgaactgccccatgatcaagatgtggtagagtatatcatgaatcagccaaatgttgttccacgaatcaattctaggattttgacagctgaacgagactacctggatttaacagcgagtaataacttctttgtggatgattatgctagatttactatcttggattcccaaggcaagactgctgctgtagccaatagtatgaactatctgacaaagaaaggaatgtcctccaaggaaatctatgatgattcttttattaggccagtaactttttggattgttggggattttgatagcccttctggacggcagttactgtatgatgccatcaaacatcagaaatccagtaacaatgttagaataagcatgatcaataatcctgccaaagagataagctatgagaacactcagatctccagagcaatctgggcagctctccaaactcagacttccaacgctgctaagaacttcatcaccaaaatggccaaggagggggctgcagaggccctggctgcaggagctgacattgcggagttctctgttgggggaatggatttcagtctttttaaagaggtctttgagtcttccaaaatggatttcattttgtctcatgccgtgtactgcagggatgttctgaagctgaagaagggacagagggcagtgatcagcaatggaaggatcattgggccactggaggatagtgagctctttaatcaagacgatttccacctcctcgaaaatatcatcttaaaaacctcaggacagaaaataaaatctcatattcaacagcttcgggtagaagaagatgtggcaagcgacttggtaatgaaggtggatgctcttctgtcagcgcaaccaaaaggagatccaagaatcgagtaccagttttttgaagacagacacagtgcaatcaaactgaggccgaaggaaggggagacatactttgatgttgtggctgtcgttgaccctgtcaccagagaagcacagagacttgctcctttgctcttggttttggctcagctgataaacatgaatctgagagtatttatgaactgccaatccaaactttctgacatgcctttaaaaagcttttaccgttatgtcttagaaccagagatttctttcacttcagacaatagttttgctaagggtccaatcgcaaaatttttggatatgcctcagtctccactgttcactctgaatttgaacacacctgagagctggatggtagaatctgtcagaacaccatatgatcttgataatatttatttagaagaggtggacagtgtagtggctgctgagtatgagctggaatacctgttactggaaggtcattgctacgacatcaccacaggccagcctccacggggactacagtttaccttaggaacttcagccaacccggtcattgtggacaccattgttatggccaatctgggctactttcagctgaaagccaacccaggagcttggatcctcagacttaggaagggacgctctgaagatatttatagaatttacagccacgatggcaccgattctccccctgatgctgatgaggtggttatcgtcctcaacaacttcaaaagcaaaattattaaagtgaaggttcagaagaaggcagatatggtgaacgaagacttgctgagtgatggaacgagtgagaatgaatctggattttgggattccttcaaatggggctttacaggacagaagactgaggaagtgaagcaagataaagatgacataattaatattttctccgttgcatctggtcatctctacgaaagatttcttcgcataatgatgctatccgtgctgaagaataccaagactcctgtgaaattctggttcttgaagaattacttgtcccccacatttaaggagtttataccttacatggcaaatgaatacaatttccagtatgagcttgttcagtacaaatggccccggtggcttcatcaacaaactgaaaaacagcgtatcatctggggttacaagatcctcttcctggatgtacttttcccactagttgttgacaagttcctgtttgtggatgctgatcagattgtacgaacagatctgaaagagttaagagatttcaatttggatggtgctccttatggttacactcctttctgtgacagccgaagagaaatggacggctacaggttctggaagtcagggtactgggccagtcatttagccgggcgaaagtatcatatcagtgcactatatgttgtggatctgaagaagtttaggaaaatagctgctggtgacagactcaggggacagtaccaaggtctgagtcaggaccctaacagcctttcaaatcttgatcaagatctgcccaataacatgattcatcaggtgccaattaaatccctccctcaagaatggctttggtgtgaaacgtggtgtgatgacgcctctaagaaaagggcaaaaaccattgatttgtgtaataatccgatgaccaaagagccgaaactggaagcagctgtgcggattgtcccggagtggcaggactacgaccaagagatcaaacagctacagatccgctttcagaaggagaaagaaacgggagcactgtacaaagagaagacaaaagaaccaagccgagaaggtcctcagaaacgtgaagaattatgatctctggagaaggacaggaaatcaccccatttgaaaaacagtttttataataaatgctagttttttctgatctgtctatacaactgctgataagccggctgggcaggagtgccacaccttttgattctgagcatttgattctgacttctgtactctggtggccactggatctttgggattaaagctctgttggatttgtacctc

SEQ ID NO: 440760 - DNA, 5305 bp, Homo sapiens
ccagtgcattaatcagtagaattaatcagtgcatgttcctagtctgtaactaaactctgtggaagattcccctgctttcctatagtaaaggtttacgactttttcttctatctttattaagcttgtcattttcttctttttgcatggttcttacaaattatttggtcaatttcattttcagaatgttgaaacacagaatgtgcttctctcctctgactcaattagctgtttttgtttttctacagatgattcttttattaggccagtaactttttggattgttggggattttgatagcccttctggacggcagttactgtatgatgccatcaaacatcagaaatccagtaacaatgttagaataagcatgatcaataatcctgccaaagagataagctatgagaacactcagatctccagagcaatctgggcagctctccaaactcagacttccaacgctgctaagaacttcatcaccaaaatggccaaggagggggctgcagaggccctggctgcaggagctgacattgcggagttctctgttgggggaatggatttcagtctttttaaagaggtctttgagtcttccaaaatggatttcattttgtctcatgccgtgtactgcagggatgttctgaagctgaagaagggacagagggcagtgatcagcaatggaaggatcattgggccactggaggatagtgagctctttaatcaagacgatttccacctcctcgaaaatatcatcttaaaaacctcaggacagaaaataaaatctcatattcaacagcttcgggtagaagaagatgtggcaagcgacttggtaatgaaggtggatgctcttctgtcagcgcaaccaaaaggagatccaagaatcgagtaccagttttttgaagacagacacagtgcaatcaaactgaggccgaaggaaggggagacatactttgatgttgtggctgtcgttgaccctgtcaccagagaagcacagagacttgctcctttgctcttggttttggctcagctgataaacatgaatctgagagtatttatgaactgccaatccaaactttctgacatgcctttaaaaagcttttaccgttatgtcttagaaccagagatttctttcacttcagacaatagttttgctaagggtccaatcgcaaaatttttggatatgcctcagtctccactgttcactctgaatttgaacacacctgagagctggatggtagaatctgtcagaacaccatatgatcttgataatatttatttagaagaggtggacagtgtagtggctgctgagtatgagctggaatacctgttactggaaggtcattgctacgacatcaccacaggccagcctccacggggactacagtttaccttaggaacttcagccaacccggtcattgtggacaccattgttatggccaatctgggctactttcagctgaaagccaacccaggagcttggatcctcagacttaggaagggacgctctgaagatatttatagaatttacagccacgatggcaccgattctccccctgatgctgatgaggtggttatcgtcctcaacaacttcaaaagcaaaattattaaagtgaaggttcagaagaaggcagatatggtgaacgaagacttgctgagtgatggaacgagtgagaatgaatctggattttgggattccttcaaatggggctttacaggacagaagactgaggaagtgaagcaagataaagatgacataattaatattttctccgttgcatctggtcatctctacgaaagatttcttcgcataatgatgctatccgtgctgaagaataccaagactcctgtgaaattctggttcttgaagaattacttgtcccccacatttaaggagtttataccttacatggcaaatgaatacaatttccagtatgagcttgttcagtacaaatggccccggtggcttcatcaacaaactgaaaaacagcgtatcatctggggttacaagatcctcttcctggatgtacttttcccactagttgttgacaagttcctgtttgtggatgctgatcagattgtacgaacagatctgaaagagttaagagatttcaatttggatggtgctccttatggttacactcctttctgtgacagccgaagagaaatggacggctacaggttctggaagtcagggtactgggccagtcatttagccgggcgaaagtatcatatcaggatctgcccaataacatgattcatcaggtgccaattaaatccctccctcaagaatggctttggtgtgaaacgtggtgtgatgacgcctctaagaaaagggcaaaaaccattgatttgtgtaataatccgatgaccaaagagccgaaactggaagcagctgtgcggattgtcccggagtggcaggactacgaccaagagatcaaacagctacagatccgctttcagaaggagaaagaaacgggagcactgtacaaagagaagacaaaagaaccaagccgagaaggtcctcagaaacgtgaagaattatgatctctggagaaggacaggaaatcaccccatttgaaaaacagtttttataataaatgctagttttttctgatctgtctatacaactgctgataagccggctgggcaggagtgccacaccttttgattctgagcatttgattctgacttctgtactctggtggccactggatctttgggattaaagctctgttggatttgtacctcagaggaagaccaagtggctgatcctttggactctgtaaagagcattcttctagtcagagggtggaatggcagcagcaactggaagaaaatgagttttttggtgcccacacccaagagcacacacatgctgcactgtctcggaaagcagggccagctagagccaccatgttcttccttacctcagtttacctgcggcctgcgctgcactgcagatgcccaccctgccctgggtctggccggcggaagctctgtccaaggtccacacacctccaggtttacgccaacatccttgtgccctccccaccttctcttccaacgcattaggtgcattgtttaattgaaatccaaccaacaattgtgtgtcaaggctggtttggtgcagtggctgggcaaattaattttgggccaggatgggggtgggttgcagtgagggtagggaaaatgtcaggagtaggaaggttcgggggttaagggaagggaaggaagaccagaactggccatcctcttttataatccattagtagcaccatggctcatttgaaatgaaaatattacacttattccccacccaaccgcagtgaactttctaggtaattgttttgaaaacaatttttgtatctgtgaaagtctttgctttttctttccaccttctagaaaagtctgctaccagtttccttactgaatacagccatactcagcccctctcgcatccagcccgtcagggtcagggtcagggtcaggctccctcaagacgagcaccgcattgtctgccctcttttgcgtaggatttttctctcagacccaggggacattgccttggacttttctctacaaatgccctcagatgtaagaccagaaatgattctgcttgtggaactcgtggctttctgtcctattttccttttatgtgagccctgcaggttgcctttggcgcccacaccagttctgtcttcatgtcgctgcatcgtgaagccccatttgcctttagtccctgctttgtgtgtcttcacttccacagccagtgttgcccctcagggcatactttgctggtgaacgggctgtagagtcttgagtatgttattggcctaagtgggcatgaggccccagcatccgactccatctgccaggctgcagggcacagcagcactggcatagacaggcacgctctgtcttccaacgtgcaccagccttttcttacatattttgcctgtttttaaaaaatacgaggagagggtgcagatggatactgtgccctcaccctcctaagccaggtaatatattgatgtgcagacttttaagaaatcttagtcttatcacaaatatcaagtaatttattttttccattttcaaatgcaaaagttagcctaggaagcctcccagtcatcctgaaggaccttttgactttgcttttataattctgttaaaaattgaggaggggattaatgagtacaatgaaaacaaaacaaaacaaaaaattaagaagaggaaagctcaaaagaggataagagactgaaaaggcacctcagaatggctgctgtgggcagagtctgtgacatgactttccccgccctgcccctctgttcagagcagctggaaagatgggatcagtaagattaaaaaacttttgttcggccaggcgtggtggctcacacctgtaatcccagcactttgggaggctgaggcggacggatcatgaggtcaggagttcaagaccagcctggccaatatggtgaaaccccgtctctactaaaaatacaaaaattagccgggtgttgtggctcaccctctattcccagctactcgggaggcagagacaggagaatcgcctgaacccaggaggcagaggttgcagtgagctgagatcgtgccactgcactccagcctgggtgacagagcgagactccatctcagaaaacaaacaaacaaaaagaaacttttgttcaagctgcatcttcacattgaatgaaagcattcagacgggtgactgctgctgtccacaactgtgggcggaagtgtgccttttcccagtttctcgtccaggaggttgcatagcaaatactcaagtcactgggatatatgctttccaaatgctggcccccatagcacctttccccatgtctttctaccaagcctcttatgtttaatctgtgcagggaagacaagagtagaccatattctctgtgtgctgtgcatgtcctggtgtcactcattgcctcttatctgtcgccattctaatataagtcagcttaatagttgactctgaataatgcaaaacccagcttgcttccagaatggcctaggaccctcctcctcctgccagttttttttttttttttggttcatgtggcataatcatctttcaaaattaaccaaatgccccagaaaatgatgttaccactaaaatattttctccaagaaggcatactgtaacagaaaagataggtaagatatttttttcccaagaagtaagaattgattgtgctgaatgttcaaactctggaaactgttcacagtatgttgttcttagctgttatttatataaagtgaattattttctctctca

SEQ ID NO: 440761 - DNA, 7674 bp, Homo sapiens
ccagtgcattaatcagtagaattaatcagtgcatgttcctagtctgtaactaaactctgtggaagattcccctgctttcctatagtaaaggtttacgactttttcttctatctttattaagcttgtcattttcttctttttgcatggttcttacaaattatttggtcaatttcattttcagaatgttgaaacacagaatgtgcttctctcctctgactcaattagctgtttttgtttttctacagatgattcttttattaggccagtaactttttggattgttggggattttgatagcccttctggacggcagttactgtatgatgccatcaaacatcagaaatccagtaacaatgttagaataagcatgatcaataatcctgccaaagagataagctatgagaacactcagatctccagagcaatctgggcagctctccaaactcagacttccaacgctgctaagaacttcatcaccaaaatggccaaggagggggctgcagaggccctggctgcaggagctgacattgcggagttctctgttgggggaatggatttcagtctttttaaagaggtctttgagtcttccaaaatggatttcattttgtctcatgccgtgtactgcagggatgttctgaagctgaagaagggacagagggcagtgatcagcaatggaaggatcattgggccactggaggatagtgagctctttaatcaagacgatttccacctcctcgaaaatatcatcttaaaaacctcaggacagaaaataaaatctcatattcaacagcttcgggtagaagaagatgtggcaagcgacttggtaatgaaggtggatgctcttctgtcagcgcaaccaaaaggagatccaagaatcgagtaccagttttttgaagacagacacagtgcaatcaaactgaggccgaaggaaggggagacatactttgatgttgtggctgtcgttgaccctgtcaccagagaagcacagagacttgctcctttgctcttggttttggctcagctgataaacatgaatctgagagtatttatgaactgccaatccaaactttctgacatgcctttaaaaagcttttaccgttatgtcttagaaccagagatttctttcacttcagacaatagttttgctaagggtccaatcgcaaaatttttggatatgcctcagtctccactgttcactctgaatttgaacacacctgagagctggatggtagaatctgtcagaacaccatatgatcttgataatatttatttagaagaggtggacagtgtagtggctgctgagtatgagctggaatacctgttactggaaggtcattgctacgacatcaccacaggccagcctccacggggactacagtttaccttaggaacttcagccaacccggtcattgtggacaccattgttatggccaatctgggctactttcagctgaaagccaacccaggagcttggatcctcagacttaggaagggacgctctgaagatatttatagaatttacagccacgatggcaccgattctccccctgatgctgatgaggtggttatcgtcctcaacaacttcaaaagcaaaattattaaagtgaaggttcagaagaaggcagatatggtgaacgaagacttgctgagtgatggaacgagtgagaatgaatctggattttgggattccttcaaatggggctttacaggacagaagactgaggaagtgaagcaagataaagatgacataattaatattttctccgttgcatctggtcatctctacgaaagatttcttcgcataatgatgctatccgtgctgaagaataccaagactcctgtgaaattctggttcttgaagaattacttgtcccccacatttaaggagtttataccttacatggcaaatgaatacaatttccagtatgagcttgttcagtacaaatggccccggtggcttcatcaacaaactgaaaaacagcgtatcatctggggttacaagatcctcttcctggatgtacttttcccactagttgttgacaagttcctgtttgtggatgctgatcagattgtacgaacagatctgaaagagttaagagatttcaatttggatggtgctccttatggttacactcctttctgtgacagccgaagagaaatggacggctacaggttctggaagtcagggtactgggccagtcatttagccgggcgaaagtatcatatcagtgcactatatgttgtggatctgaagaagtttaggaaaatagctgctggtgacagactcaggggacagtaccaaggtctgagtcaggaccctaacagcctttcaaatcttgatcaagatctgcccaataacatgattcatcaggtgccaattaaatccctccctcaagaatggctttggtgtgaaacgtggtgtgatgacgcctctaagaaaagggcaaaaaccattgatttgtgtaataatccgatgaccaaagagccgaaactggaagcagctgtgcggattgtcccggagtggcaggactacgaccaagagatcaaacagctacagatccgctttcagaaggagaaagaaacgggagcactgtacaaagagaagacaaaagaaccaagccgagaaggtcctcagaaacgtgaagaattatgatctctggagaaggacaggaaatcaccccatttgaaaaacagtttttataataaatgctagttttttctgatctgtctatacaactgctgataagccggctgggcaggagtgccacaccttttgattctgagcatttgattctgacttctgtactctggtggccactggatctttgggattaaagctctgttggatttgtacctcagaggaagaccaagtggctgatcctttggactctgtaaagagcattcttctagtcagagggtggaatggcagcagcaactggaagaaaatgagttttttggtgcccacacccaagagcacacacatgctgcactgtctcggaaagcagggccagctagagccaccatgttcttccttacctcagtttacctgcggcctgcgctgcactgcagatgcccaccctgccctgggtctggccggcggaagctctgtccaaggtccacacacctccaggtttacgccaacatccttgtgccctccccaccttctcttccaacgcattaggtgcattgtttaattgaaatccaaccaacaattgtgtgtcaaggctggtttggtgcagtggctgggcaaattaattttgggccaggatgggggtgggttgcagtgagggtagggaaaatgtcaggagtaggaaggttcgggggttaagggaagggaaggaagaccagaactggccatcctcttttataatccattagtagcaccatggctcatttgaaatgaaaatattacacttattccccacccaaccgcagtgaactttctaggtaattgttttgaaaacaatttttgtatctgtgaaagtctttgctttttctttccaccttctagaaaagtctgctaccagtttccttactgaatacagccatactcagcccctctcgcatccagcccgtcagggtcagggtcagggtcaggctccctcaagacgagcaccgcattgtctgccctcttttgcgtaggatttttctctcagacccaggggacattgccttggacttttctctacaaatgccctcagatgtaagaccagaaatgattctgcttgtggaactcgtggctttctgtcctattttccttttatgtgagccctgcaggttgcctttggcgcccacaccagttctgtcttcatgtcgctgcatcgtgaagccccatttgcctttagtccctgctttgtgtgtcttcacttccacagccagtgttgcccctcagggcatactttgctggtgaacgggctgtagagtcttgagtatgttattggcctaagtgggcatgaggccccagcatccgactccatctgccaggctgcagggcacagcagcactggcatagacaggcacgctctgtcttccaacgtgcaccagccttttcttacatattttgcctgtttttaaaaaatacgaggagagggtgcagatggatactgtgccctcaccctcctaagccaggtaatatattgatgtgcagacttttaagaaatcttagtcttatcacaaatatcaagtaatttattttttccattttcaaatgcaaaagttagcctaggaagcctcccagtcatcctgaaggaccttttgactttgcttttataattctgttaaaaattgaggaggggattaatgagtacaatgaaaacaaaacaaaacaaaaaattaagaagaggaaagctcaaaagaggataagagactgaaaaggcacctcagaatggctgctgtgggcagagtctgtgacatgactttccccgccctgcccctctgttcagagcagctggaaagatgggatcagtaagattaaaaaacttttgttcggccaggcgtggtggctcacacctgtaatcccagcactttgggaggctgaggcggacggatcatgaggtcaggagttcaagaccagcctggccaatatggtgaaaccccgtctctactaaaaatacaaaaattagccgggtgttgtggctcaccctctattcccagctactcgggaggcagagacaggagaatcgcctgaacccaggaggcagaggttgcagtgagctgagatcgtgccactgcactccagcctgggtgacagagcgagactccatctcagaaaacaaacaaacaaaaagaaacttttgttcaagctgcatcttcacattgaatgaaagcattcagacgggtgactgctgctgtccacaactgtgggcggaagtgtgccttttcccagtttctcgtccaggaggttgcatagcaaatactcaagtcactgggatatatgctttccaaatgctggcccccatagcacctttccccatgtctttctaccaagcctcttatgtttaatctgtgcagggaagacaagagtagaccatattctctgtgtgctgtgcatgtcctggtgtcactcattgcctcttatctgtcgccattctaatataagtcagcttaatagttgactctgaataatgcaaaacccagcttgcttccagaatggcctaggaccctcctcctcctgccagttttttttttttttttggttcatgtggcataatcatctttcaaaattaaccaaatgccccagaaaatgatgttaccactaaaatattttctccaagaaggcatactgtaacagaaaagataggtaagatatttttttcccaagaagtaagaattgattgtgctgaatgttcaaactctggaaactgttcacagtatgttgttcttagctgttatttatataaagtgaattattttctctctcaatcatgccatagtggagacttttgtttgtgagtaagtgacagagtaatatgaaataatgtgatatgtcagagtgacatgcagcatcccggcctcccaaagtgctgggattgcaggcgtgaccactatgtccggtcaagccctcgtgttctgaaccttgtcaaggctctgcctgaatgagttttcatctgattgtggggaccaagtccctgagtagagggccaagagctagggacagggggaagagactggcccaggtggtagggaggaaagaactcccagagtttcctttagccaggaaacctgctctactgaccccgtgacttggacagtcagacatcaccctgagagtgacaagtgtaaaatgactcccttcctcccccgccctccggaagtatatttagatacttgaaagcagtccttttctaaaatggccttacctatgtggcctgaacgattaaaagaaagaactcagagttacaagggaaaaagaaaaagagttacaagggaattgtagtctttttctgaatagaatattagtactgtggtattgcatttcatgggaatggaaatgtattggtaaagctacctgatggaagctttctcttggtaacaaaaatggagggtgtattatgtgcagttatttaaatatatgtattccattgttgcgtggtttttttcccccctcaagacagagatttgctcttgttgcccagggtggagtacaatggtgtgaccttggctcactgcaacctctgcctcctgggttcaggtgattctcctgcctcagccttccgagtagctgggattacaggtgtgcgccaccacacccggctaatttttgctttttttttttttgagacagaatctcgctctgttgctcaggctggagtggagtgcagtggcacaatctcagctcactgcagcctctgcctcccgggttcaagagattctcctgactcaacctcctgagtagctgggattacaggtgcctgccactatgcctagctaatttttgtagtttttagtagtagacggggtcttcgcatgtgtggccagggtggtctcgaactcctgacctcaagtgatccacccgcatcggccccccaaagtgctgggattataggcgtgaaccaccgcgcctgtcccattgttgtgtaattttaataattagttttttaagtacttgattttatgggcacatttttgtgggatgattggagttaatcaaataaagcttgtcatgtgtgtagtttggtaagataacttctttaaattcatgttttctctgccttgaggtagtgagggaaagatcttaatcagtattttggtaattaactgattgaattcaagcaaatgagacatcatgaacttcagtggttattgatatttcagggtatatacctgaaatgcctagaggatacagatttctcatttcattctttggtctttcatttctctatatacagaaatgaaatgacacttctgggaggcagtagaagcaggaagtcaatgaattgagtagagggtcccattccctcaggctgtcattgatcagtgacaatttataaaaacaaactgcaaagtctgtggcaagtggctgcctgcttcctagaaggagcccatgaaggttaaactctgtggtcggtatttgcaagcgccgggcgtggtggctcacgcctgtaatcctagcaccttgggaggccaaggcaggcggatcacccgaggtcaggagtttgaggatttgcaagcaaaaggtcctctcctgagtctttcccagatacccagcagtgcagaggctagctgtggaaggttgcagtgggacaggaatgtattgtatgccttgccttacttgtcaccattgagatttccagagaaatgggcataacgtctcttaacaacaacagcagaaagcaaaatacattaacttaaggttgacaacaaaagattatcaagtaccatgttttccaaccaaccagttattcgtggtaataataaaataaaggtgggaaaatgttataatttttaaggaaactgtgtactttaaaaatcttctttatgaatatccaatgttactgtaatcctgctccattaaatgcagcattgttgtcaggtgctgcctcttgcttgggaacagcattgggcttttaaatgtctgcagaatctctgcgttcgaagggaattgagaatgaacttcctggtactgtaatgaaaataaggtctgctcaacacagtaaacgtttcctctcttcttta

SEQ ID NO: 440762 - DNA, 7579 bp, Homo sapiens
ccagtgcattaatcagtagaattaatcagtgcatgttcctagtctgtaactaaactctgtggaagattcccctgctttcctatagtaaaggtttacgactttttcttctatctttattaagcttgtcattttcttctttttgcatggttcttacaaattatttggtcaatttcattttcagaatgttgaaacacagaatgtgcttctctcctctgactcaattagctgtttttgtttttctacagatgattcttttattaggccagtaactttttggattgttggggattttgatagcccttctggacggcagttactgtatgatgccatcaaacatcagaaatccagtaacaatgttagaataagcatgatcaataatcctgccaaagagataagctatgagaacactcagatctccagagcaatctgggcagctctccaaactcagacttccaacgctgctaagaacttcatcaccaaaatggccaaggagggggctgcagaggccctggctgcaggagctgacattgcggagttctctgttgggggaatggatttcagtctttttaaagaggtctttgagtcttccaaaatggatttcattttgtctcatgccgtgtactgcagggatgttctgaagctgaagaagggacagagggcagtgatcagcaatggaaggatcattgggccactggaggatagtgagctctttaatcaagacgatttccacctcctcgaaaatatcatcttaaaaacctcaggacagaaaataaaatctcatattcaacagcttcgggtagaagaagatgtggcaagcgacttggtaatgaaggtggatgctcttctgtcagcgcaaccaaaaggagatccaagaatcgagtaccagttttttgaagacagacacagtgcaatcaaactgaggccgaaggaaggggagacatactttgatgttgtggctgtcgttgaccctgtcaccagagaagcacagagacttgctcctttgctcttggttttggctcagctgataaacatgaatctgagagtatttatgaactgccaatccaaactttctgacatgcctttaaaaagcttttaccgttatgtcttagaaccagagatttctttcacttcagacaatagttttgctaagggtccaatcgcaaaatttttggatatgcctcagtctccactgttcactctgaatttgaacacacctgagagctggatggtagaatctgtcagaacaccatatgatcttgataatatttatttagaagaggtggacagtgtagtggctgctgagtatgagctggaatacctgttactggaaggtcattgctacgacatcaccacaggccagcctccacggggactacagtttaccttaggaacttcagccaacccggtcattgtggacaccattgttatggccaatctgggctactttcagctgaaagccaacccaggagcttggatcctcagacttaggaagggacgctctgaagatatttatagaatttacagccacgatggcaccgattctccccctgatgctgatgaggtggttatcgtcctcaacaacttcaaaagcaaaattattaaagtgaaggttcagaagaaggcagatatggtgaacgaagacttgctgagtgatggaacgagtgagaatgaatctggattttgggattccttcaaatggggctttacaggacagaagactgaggaagtgaagcaagataaagatgacataattaatattttctccgttgcatctggtcatctctacgaaagatttcttcgcataatgatgctatccgtgctgaagaataccaagactcctgtgaaattctggttcttgaagaattacttgtcccccacatttaaggagtttataccttacatggcaaatgaatacaatttccagtatgagcttgttcagtacaaatggccccggtggcttcatcaacaaactgaaaaacagcgtatcatctggggttacaagatcctcttcctggatgtacttttcccactagttgttgacaagttcctgtttgtggatgctgatcagattgtacgaacagatctgaaagagttaagagatttcaatttggatggtgctccttatggttacactcctttctgtgacagccgaagagaaatggacggctacaggttctggaagtcagggtactgggccagtcatttagccgggcgaaagtatcatatcagtgcactatatgttgtggatctgaagaagtttaggaaaatagctgctggtgacagactcaggggacagtaccaaggtctgagtcaggaccctaacagcctttcaaatcttgatcaagatctgcccaataacatgattcatcaggtgccaattaaatccctccctcaagaatggctttggtgtgaaacgtggtgtgatgacgcctctaagaaaagggcaaaaaccattgatttgtgtaataatccgatgaccaaagagccgaaactggaagcagctgtgcggattgtcccggagtggcaggactacgaccaagagatcaaacagctacagatccgctttcagaaggagaaagaaacgggagcactgtacaaagagaagacaaaagaaccaagccgagaaggtcctcagaaacgtgaagaattatgatctctggagaaggacaggaaatcaccccatttgaaaaacagtttttataataaatgctagttttttctgatctgtctatacaactgctgataagccggctgggcaggagtgccacaccttttgattctgagcatttgattctgacttctgtactctggtggccactggatctttgggattaaagctctgttggatttgtacctcagaggaagaccaagtggctgatcctttggactctgtaaagagcattcttctagtcagagggtggaatggcagcagcaactggaagaaaatgagttttttggtgcccacacccaagagcacacacatgctgcactgtctcggaaagcagggccagctagagccaccatgttcttccttacctcagtttacctgcggcctgcgctgcactgcagatgcccaccctgccctgggtctggccggcggaagctctgtccaaggtccacacacctccaggtttacgccaacatccttgtgccctcccctgccctctccctgaaataaagaacagcttgacagaaaaaaaaaaaaaaaaaaaaaaaaaaaaaaaaaaaaaaaaactcgtgccgaattcggcacgagtggccatcctcttttataatccattagtagcaccatggctcatttgaaatgaaaatattacacttattccccacccaaccgcagtgaactttctaggtaattgttttgaaaacaatttttgtatctgtgaaagtctttgctttttctttccaccttctagaaaagtctgctaccagtttccttactgaatacagccatactcagcccctctcgcatccagcccgtcagggtcagggtcagggtcaggctccctcaagacgagcaccgcattgtctgccctcttttgcgtaggatttttctctcagacccaggggacattgccttggacttttctctacaaatgccctcagatgtaagaccagaaatgattctgcttgtggaactcgtggctttctgtcctattttccttttatgtgagccctgcaggttgcctttggcgcccacaccagttctgtcttcatgtcgctgcatcgtgaagccccatttgcctttagtccctgctttgtgtgtcttcacttccacagccagtgttgcccctcagggcatactttgctggtgaacgggctgtagagtcttgagtatgttattggcctaagtgggcatgaggccccagcatccgactccatctgccaggctgcagggcacagcagcactggcatagacaggcacgctctgtcttccaacgtgcaccagccttttcttacatattttgcctgtttttaaaaaatacgaggagagggtgcagatggatactgtgccctcaccctcctaagccaggtaatatattgatgtgcagacttttaagaaatcttagtcttatcacaaatatcaagtaatttattttttccattttcaaatgcaaaagttagcctaggaagcctcccagtcatcctgaaggaccttttgactttgcttttataattctgttaaaaattgaggaggggattaatgagtacaatgaaaacaaaacaaaacaaaaaattaagaagaggaaagctcaaaagaggataagagactgaaaaggcacctcagaatggctgctgtgggcagagtctgtgacatgactttccccgccctgcccctctgttcagagcagctggaaagatgggatcagtaagattaaaaaacttttgttcggccaggcgtggtggctcacacctgtaatcccagcactttgggaggctgaggcggacggatcatgaggtcaggagttcaagaccagcctggccaatatggtgaaaccccgtctctactaaaaatacaaaaattagccgggtgttgtggctcaccctctattcccagctactcgggaggcagagacaggagaatcgcctgaacccaggaggcagaggttgcagtgagctgagatcgtgccactgcactccagcctgggtgacagagcgagactccatctcagaaaacaaacaaacaaaaagaaacttttgttcaagctgcatcttcacattgaatgaaagcattcagacgggtgactgctgctgtccacaactgtgggcggaagtgtgccttttcccagtttctcgtccaggaggttgcatagcaaatactcaagtcactgggatatatgctttccaaatgctggcccccatagcacctttccccatgtctttctaccaagcctcttatgtttaatctgtgcagggaagacaagagtagaccatattctctgtgtgctgtgcatgtcctggtgtcactcattgcctcttatctgtcgccattctaatataagtcagcttaatagttgactctgaataatgcaaaacccagcttgcttccagaatggcctaggaccctcctcctcctgccagttttttttttttttttggttcatgtggcataatcatctttcaaaattaaccaaatgccccagaaaatgatgttaccactaaaatattttctccaagaaggcatactgtaacagaaaagataggtaagatatttttttcccaagaagtaagaattgattgtgctgaatgttcaaactctggaaactgttcacagtatgttgttcttagctgttatttatataaagtgaattattttctctctcaatcatgccatagtggagacttttgtttgtgagtaagtgacagagtaatatgaaataatgtgatatgtcagagtgacatgcagcatcccggcctcccaaagtgctgggattgcaggcgtgaccactatgtccggtcaagccctcgtgttctgaaccttgtcaaggctctgcctgaatgagttttcatctgattgtggggaccaagtccctgagtagagggccaagagctagggacagggggaagagactggcccaggtggtagggaggaaagaactcccagagtttcctttagccaggaaacctgctctactgaccccgtgacttggacagtcagacatcaccctgagagtgacaagtgtaaaatgactcccttcctcccccgccctccggaagtatatttagatacttgaaagcagtccttttctaaaatggccttacctatgtggcctgaacgattaaaagaaagaactcagagttacaagggaaaaagaaaaagagttacaagggaattgtagtctttttctgaatagaatattagtactgtggtattgcatttcatgggaatggaaatgtattggtaaagctacctgatggaagctttctcttggtaacaaaaatggagggtgtattatgtgcagttatttaaatatatgtattccattgttgcgtggtttttttcccccctcaagacagagatttgctcttgttgcccagggtggagtacaatggtgtgaccttggctcactgcaacctctgcctcctgggttcaggtgattctcctgcctcagccttccgagtagctgggattacaggtgtgcgccaccacacccggctaatttttgctttttttttttttgagacagaatctcgctctgttgctcaggctggagtggagtgcagtggcacaatctcagctcactgcagcctctgcctcccgggttcaagagattctcctgactcaacctcctgagtagctgggattacaggtgcctgccactatgcctagctaatttttgtagtttttagtagtagacggggtcttcgcatgtgtggccagggtggtctcgaactcctgacctcaagtgatccacccgcatcggccccccaaagtgctgggattataggcgtgaaccaccgcgcctgtcccattgttgtgtaattttaataattagttttttaagtacttgattttatgggcacatttttgtgggatgattggagttaatcaaataaagcttgtcatgtgtgtagtttggtaagataacttctttaaattcatgttttctctgccttgaggtagtgagggaaagatcttaatcagtattttggtaattaactgattgaattcaagcaaatgagacatcatgaacttcagtggttattgatatttcagggtatatacctgaaatgcctagaggatacagatttctcatttcattctttggtctttcatttctctatatacagaaatgaaatgacacttctgggaggcagtagaagcaggaagtcaatgaattgagtagagggtcccattccctcaggctgtcattgatcagtgacaatttataaaaacaaactgcaaagtctgtggcaagtggctgcctgcttcctagaaggagcccatgaaggttaaactctgtggtcggtatttgcaagcgccgggcgtggtggctcacgcctgtaatcctagcaccttgggaggccaaggcaggcggatcacccgaggtcaggagtttgaggatttgcaagcaaaaggtcctctcctgagtctttcccagatacccagcagtgcagaggctagctgtggaaggttgcagtgggacaggaatgtattgtatgccttgccttacttgtcaccattgagatttccagagaaatgggcataacgtctcttaacaacaacagcagaaagcaaaatacattaacttaaggttgacaacaaaagattatcaagtaccatgttttccaaccaaccagttattcgtggtaataataaaataaaggtgggaaaatgttataatttttaaggaaactgtgtactttaaaaatcttctttatgaatatccaatgttactgtaatcctgctccattaaatgcagcattgttgtcaggtgctgcctcttgcttgggaacagcattgggcttttaaatgtctgcagaatctctgcgttcgaagggaattgagaatgaacttcctggtactgtaatgaaaataaggtctgctcaacacagtaaacgtttcctctcttcttta

SEQ ID NO: 440763 - DNA, 6202 bp, Homo sapiens
ccagtgcattaatcagtagaattaatcagtgcatgttcctagtctgtaactaaactctgtggaagattcccctgctttcctatagtaaaggtttacgactttttcttctatctttattaagcttgtcattttcttctttttgcatggttcttacaaattatttggtcaatttcattttcagaatgttgaaacacagaatgtgcttctctcctctgactcaattagctgtttttgtttttctacagatgattcttttattaggccagtaactttttggattgttggggattttgatagcccttctggacggcagttactgtatgatgccatcaaacatcagaaatccagtaacaatgttagaataagcatgatcaataatcctgccaaagagataagctatgagaacactcagatctccagagcaatctgggcagctctccaaactcagacttccaacgctgctaagaacttcatcaccaaaatggccaaggagggggctgcagaggccctggctgcaggagctgacattgcggagttctctgttgggggaatggatttcagtctttttaaagaggtctttgagtcttccaaaatggatttcattttgtctcatgccgtgtactgcagggatgttctgaagctgaagaagggacagagggcagtgatcagcaatggaaggatcattgggccactggaggatagtgagctctttaatcaagacgatttccacctcctcgaaaatatcatcttaaaaacctcaggacagaaaataaaatctcatattcaacagcttcgggtagaagaagatgtggcaagcgacttggtaatgaaggtggatgctcttctgtcagcgcaaccaaaaggagatccaagaatcgagtaccagttttttgaagacagacacagtgcaatcaaactgaggccgaaggaaggggagacatactttgatgttgtggctgtcgttgaccctgtcaccagagaagcacagagacttgctcctttgctcttggttttggctcagctgataaacatgaatctgagagtatttatgaactgccaatccaaactttctgacatgcctttaaaaagcttttaccgttatgtcttagaaccagagatttctttcacttcagacaatagttttgctaagggtccaatcgcaaaatttttggatatgcctcagtctccactgttcactctgaatttgaacacacctgagagctggatggtagaatctgtcagaacaccatatgatcttgataatatttatttagaagaggtggacagtgtagtggctgctgagtatgagctggaatacctgttactggaaggtcattgctacgacatcaccacaggccagcctccacggggactacagtttaccttaggaacttcagccaacccggtcattgtggacaccattgttatggccaatctgggctactttcagctgaaagccaacccaggagcttggatcctcagacttaggaagggacgctctgaagatatttatagaatttacagccacgatggcaccgattctccccctgatgctgatgaggtggttatcgtcctcaacaacttcaaaagcaaaattattaaagtgaaggttcagaagaaggcagatatggtgaacgaagacttgctgagtgatggaacgagtgagaatgaatctggattttgggattccttcaaatggggctttacaggacagaagactgaggaagtgaagcaagataaagatgacataattaatattttctccgttgcatctggtcatctctacgaaagatttcttcgcataatgatgctatccgtgctgaagaataccaagactcctgtgaaattctggttcttgaagaattacttgtcccccacatttaaggagtttataccttacatggcaaatgaatacaatttccagtatgagcttgttcagtacaaatggccccggtggcttcatcaacaaactgaaaaacagcgtatcatctggggttacaagatcctcttcctggatgtacttttcccactagttgttgacaagttcctgtttgtggatgctgatcagattgtacgaacagatctgaaagagttaagagatttcaatttggatggtgctccttatggttacactcctttctgtgacagccgaagagaaatggacggctacaggttctggaagtcagggtactgggccagtcatttagccgggcgaaagtatcatatcagtgcactatatgttgtggatctgaagaagtttaggaaaatagctgctggtgacagactcaggggacagtaccaaggtctgagtcaggaccctaacagcctttcaaatcttgatcaagatctgcccaataacatgattcatcaggtgccaattaaatccctccctcaagaatggctttggtgtgaaacgtggtgtgatgacgcctctaagaaaagggcaaaaaccattgatttgtgtaataatccgatgaccaaagagccgaaactggaagcagctgtgcggattgtcccggagtggcaggactacgaccaagagatcaaacagctacagatccgctttcagaaggagaaagaaacgggagcactgtacaaagagaagacaaaagaaccaagccgagaaggtcctcagaaacgtgaagaattatgatctctggagaaggacaggaaatcaccccatttgaaaaacagtttttataataaatgctagttttttctgatctgtctatacaactgctgataagccggctgggcaggagtgccacaccttttgattctgagcatttgattctgacttctgtactctggtggccactggatctttgggattaaagctctgttggatttgtacctcagaggaagaccaagtggctgatcctttggactctgtaaagagcattcttctagtcagagggtggaatggcagcagcaactggaagaaaatgagttttttggtgcccacacccaagagcacacacatgctgcactgtctcggaaagcagggccagctagagccaccatgttcttccttacctcagtttacctgcggcctgcgctgcactgcagatgcccaccctgccctgggtctggccggcggaagctctgtccaaggtccacacacctccaggtttacgccaacatccttgtgccctccccaccttctcttccaacgcattaggtgcattgtttaattgaaatccaaccaacaattgtgtgtcaaggctggtttggtgcagtggctgggcaaattaattttgggccaggatgggggtgggttgcagtgagggtagggaaaatgtcaggagtaggaaggttcgggggttaagggaagggaaggaagaccagaactggccatcctcttttataatccattagtagcaccatggctcatttgaaatgaaaatattacacttattccccacccaaccgcagtgaactttctaggtaattgttttgaaaacaatttttgtatctgtgaaagtctttgctttttctttccaccttctagaaaagtctgctaccagtttccttactgaatacagccatactcagcccctctcgcatccagcccgtcagggtcagggtcagggtcaggctccctcaagacgagcaccgcattgtctgccctcttttgcgtaggatttttctctcagacccaggggacattgccttggacttttctctacaaatgccctcagatgtaagaccagaaatgattctgcttgtggaactcgtggctttctgtcctattttccttttatgtgagccctgcaggttgcctttggcgcccacaccagttctgtcttcatgtcgctgcatcgtgaagccccatttgcctttagtccctgctttgtgtgtcttcacttccacagccagtgttgcccctcagggcatactttgctggtgaacgggctgtagagtcttgagtatgttattggcctaagtgggcatgaggccccagcatccgactccatctgccaggctgcagggcacagcagcactggcatagacaggcacgctctgtcttccaacgtgcaccagccttttcttacatattttgcctgtttttaaaaaatacgaggagagggtgcagatggatactgtgccctcaccctcctaagccaggtaatatattgatgtgcagacttttaagaaatcttagtcttatcacaaatatcaagtaatttattttttccattttcaaatgcaaaagttagcctaggaagcctcccagtcatcctgaaggaccttttgactttgcttttataattctgttaaaaattgaggaggggattaatgagtacaatgaaaacaaaacaaaacaaaaaattaagaagaggaaagctcaaaagaggataagagactgaaaaggcacctcagaatggctgctgtgggcagagtctgtgacatgactttccccgccctgcccctctgttcagagcagctggaaagatgggatcagtaagattaaaaaacttttgttcggccaggcgtggtggctcacacctgtaatcccagcactttgggaggctgaggcggacggatcatgaggtcaggagttcaagaccagcctggccaatatggtgaaaccccgtctctactaaaaatacaaaaattagccgggtgttgtggctcaccctctattcccagctactcgggaggcagagacaggagaatcgcctgaacccaggaggcagaggttgcagtgagctgagatcgtgccactgcactccagcctgggtgacagagcgagactccatctcagaaaacaaacaaacaaaaagaaacttttgttcaagctgcatcttcacattgaatgaaagcattcagacgggtgactgctgctgtccacaactgtgggcggaagtgtgccttttcccagtttctcgtccaggaggttgcatagcaaatactcaagtcactgggatatatgctttccaaatgctggcccccatagcacctttccccatgtctttctaccaagcctcttatgtttaatctgtgcagggaagacaagagtagaccatattctctgtgtgctgtgcatgtcctggtgtcactcattgcctcttatctgtcgccattctaatataagtcagcttaatagttgactctgaataatgcaaaacccagcttgcttccagaatggcctaggaccctcctcctcctgccagttttttttttttttttggttcatgtggcataatcatctttcaaaattaaccaaatgccccagaaaatgatgttaccactaaaatattttctccaagaaggcatactgtaacagaaaagataggtaagatatttttttcccaagaagtaagaattgattgtgctgaatgttcaaactctggaaactgttcacagtatgttgttcttagctgttatttatataaagtgaattattttctctctcaatcatgccatagtggagacttttgtttgtgagtaagtgacagagtaatatgaaataatgtgatatgtcagagtgacatgcagcatcccggcctcccaaagtgctgggattgcaggcgtgaccactatgtccggtcaagccctcgtgttctgaaccttgtcaaggctctgcctgaatgagttttcatctgattgtggggaccaagtccctgagtagagggccaagagctagggacagggggaagagactggcccaggtggtagggaggaaagaactcccagagtttcctttagccaggaaacctgctctactgaccccgtgacttggacagtcagacatcaccctgagagtgacaagtgtaaaatgactcccttcctcccccgccctccggaagtatatttagatacttgaaagcagtccttttctaaaatggccttacctatgtggcctgaacgattaaaagaaagaactcagagttacaagggaaaaagaaaaagagttacaagggaattgtagtctttttctgaatagaatattagtactgtggtattgcatttcatgggaatggaaatgtattggtaaagctacctgatggaagctttctcttggtaacaaaaatggagggtgtattatgtgcagttatttaaatatatgtattccattgttgcgtggtttttttcccccctcaagacagagtgagaccctgtctcaaaaaaacaaaatcaaaacaacccataaaccaaggtgttgaaatcattcaataaaaatgttaaaataattata

SEQ ID NO: 440764 - DNA, 5879 bp, Homo sapiens
ccagtgcattaatcagtagaattaatcagtgcatgttcctagtctgtaactaaactctgtggaagattcccctgctttcctatagtaaaggtttacgactttttcttctatctttattaagcttgtcattttcttctttttgcatggttcttacaaattatttggtcaatttcattttcagaatgttgaaacacagaatgtgcttctctcctctgactcaattagctgtttttgtttttctacagatgattcttttattaggccagtaactttttggattgttggggattttgatagcccttctggacggcagttactgtatgatgccatcaaacatcagaaatccagtaacaatgttagaataagcatgatcaataatcctgccaaagagataagctatgagaacactcagatctccagagcaatctgggcagctctccaaactcagacttccaacgctgctaagaacttcatcaccaaaatggccaaggagggggctgcagaggccctggctgcaggagctgacattgcggagttctctgttgggggaatggatttcagtctttttaaagaggtctttgagtcttccaaaatggatttcattttgtctcatgccgtgtactgcagggatgttctgaagctgaagaagggacagagggcagtgatcagcaatggaaggatcattgggccactggaggatagtgagctctttaatcaagacgatttccacctcctcgaaaatatcatcttaaaaacctcaggacagaaaataaaatctcatattcaacagcttcgggtagaagaagatgtggcaagcgacttggtaatgaaggtggatgctcttctgtcagcgcaaccaaaaggagatccaagaatcgagtaccagttttttgaagacagacacagtgcaatcaaactgaggccgaaggaaggggagacatactttgatgttgtggctgtcgttgaccctgtcaccagagaagcacagagacttgctcctttgctcttggttttggctcagctgataaacatgaatctgagagtatttatgaactgccaatccaaactttctgacatgcctttaaaaagcttttaccgttatgtcttagaaccagagatttctttcacttcagacaatagttttgctaagggtccaatcgcaaaatttttggatatgcctcagtctccactgttcactctgaatttgaacacacctgagagctggatggtagaatctgtcagaacaccatatgatcttgataatatttatttagaagaggtggacagtgtagtggctgctgagtatgagctggaatacctgttactggaaggtcattgctacgacatcaccacaggccagcctccacggggactacagtttaccttaggaacttcagccaacccggtcattgtggacaccattgttatggccaatctgggctactttcagctgaaagccaacccaggagcttggatcctcagacttaggaagggacgctctgaagatatttatagaatttacagccacgatggcaccgattctccccctgatgctgatgaggtggttatcgtcctcaacaacttcaaaagcaaaattattaaagtgaaggttcagaagaaggcagatatggtgaacgaagacttgctgagtgatggaacgagtgagaatgaatctggattttgggattccttcaaatggggctttacaggacagaagactgaggaagtgaagcaagataaagatgacataattaatattttctccgttgcatctggtcatctctacgaaagatttcttcgcataatgatgctatccgtgctgaagaataccaagactcctgtgaaattctggttcttgaagaattacttgtcccccacatttaaggagtttataccttacatggcaaatgaatacaatttccagtatgagcttgttcagtacaaatggccccggtggcttcatcaacaaactgaaaaacagcgtatcatctggggttacaagatcctcttcctggatgtacttttcccactagttgttgacaagttcctgtttgtggatgctgatcagattgtacgaacagatctgaaagagttaagagatttcaatttggatggtgctccttatggttacactcctttctgtgacagccgaagagaaatggacggctacaggttctggaagtcagggtactgggccagtcatttagccgggcgaaagtatcatatcagtgcactatatgttgtggatctgaagaagtttaggaaaatagctgctggtgacagactcaggggacagtaccaaggtctgagtcaggaccctaacagcctttcaaatcttgatcaagatctgcccaataacatgattcatcaggtgccaattaaatccctccctcaagaatggctttggtgtgaaacgtggtgtgatgacgcctctaagaaaagggcaaaaaccattgatttgtgtaataatccgatgaccaaagagccgaaactggaagcagctgtgcggattgtcccggagtggcaggactacgaccaagagatcaaacagctacagatccgctttcagaaggagaaagaaacgggagcactgtacaaagagaagacaaaagaaccaagccgagaaggtcctcagaaacgtgaagaattatgatctctggagaaggacaggaaatcaccccatttgaaaaacagtttttataataaatgctagttttttctgatctgtctatacaactgctgataagccggctgggcaggagtgccacaccttttgattctgagcatttgattctgacttctgtactctggtggccactggatctttgggattaaagctctgttggatttgtacctcagaggaagaccaagtggctgatcctttggactctgtaaagagcattcttctagtcagagggtggaatggcagcagcaactggaagaaaatgagttttttggtgcccacacccaagagcacacacatgctgcactgtctcggaaagcagggccagctagagccaccatgttcttccttacctcagtttacctgcggcctgcgctgcactgcagatgcccaccctgccctgggtctggccggcggaagctctgtccaaggtccacacacctccaggtttacgccaacatccttgtgccctccccaccttctcttccaacgcattaggtgcattgtttaattgaaatccaaccaacaattgtgtgtcaaggctggtttggtgcagtggctgggcaaattaattttgggccaggatgggggtgggttgcagtgagggtagggaaaatgtcaggagtaggaaggttcgggggttaagggaagggaaggaagaccagaactggccatcctcttttataatccattagtagcaccatggctcatttgaaatgaaaatattacacttattccccacccaaccgcagtgaactttctaggtaattgttttgaaaacaatttttgtatctgtgaaagtctttgctttttctttccaccttctagaaaagtctgctaccagtttccttactgaatacagccatactcagcccctctcgcatccagcccgtcagggtcagggtcagggtcaggctccctcaagacgagcaccgcattgtctgccctcttttgcgtaggatttttctctcagacccaggggacattgccttggacttttctctacaaatgccctcagatgtaagaccagaaatgattctgcttgtggaactcgtggctttctgtcctattttccttttatgtgagccctgcaggttgcctttggcgcccacaccagttctgtcttcatgtcgctgcatcgtgaagccccatttgcctttagtccctgctttgtgtgtcttcacttccacagccagtgttgcccctcagggcatactttgctggtgaacgggctgtagagtcttgagtatgttattggcctaagtgggcatgaggccccagcatccgactccatctgccaggctgcagggcacagcagcactggcatagacaggcacgctctgtcttccaacgtgcaccagccttttcttacatattttgcctgtttttaaaaaatacgaggagagggtgcagatggatactgtgccctcaccctcctaagccaggtaatatattgatgtgcagacttttaagaaatcttagtcttatcacaaatatcaagtaatttattttttccattttcaaatgcaaaagttagcctaggaagcctcccagtcatcctgaaggaccttttgactttgcttttataattctgttaaaaattgaggaggggattaatgagtacaatgaaaacaaaacaaaacaaaaaattaagaagaggaaagctcaaaagaggataagagactgaaaaggcacctcagaatggctgctgtgggcagagtctgtgacatgactttccccgccctgcccctctgttcagagcagctggaaagatgggatcagtaagattaaaaaacttttgttcggccaggcgtggtggctcacacctgtaatcccagcactttgggaggctgaggcggacggatcatgaggtcaggagttcaagaccagcctggccaatatggtgaaaccccgtctctactaaaaatacaaaaattagccgggtgttgtggctcaccctctattcccagctactcgggaggcagagacaggagaatcgcctgaacccaggaggcagaggttgcagtgagctgagatcgtgccactgcactccagcctgggtgacagagcgagactccatctcagaaaacaaacaaacaaaaagaaacttttgttcaagctgcatcttcacattgaatgaaagcattcagacgggtgactgctgctgtccacaactgtgggcggaagtgtgccttttcccagtttctcgtccaggaggttgcatagcaaatactcaagtcactgggatatatgctttccaaatgctggcccccatagcacctttccccatgtctttctaccaagcctcttatgtttaatctgtgcagggaagacaagagtagaccatattctctgtgtgctgtgcatgtcctggtgtcactcattgcctcttatctgtcgccattctaatataagtcagcttaatagttgactctgaataatgcaaaacccagcttgcttccagaatggcctaggaccctcctcctcctgccagttttttttcttcttctattattaccaggggtcacatggtgggcataactcattctttcaaatttacccaatttggccccaagaaattggtttgttcccattaaactattcttctcccaaagaagggcatactggtgaccacgaaccaagatcggaacaatcattctttgtcccaagaaacgctaacaatggatgggcgcgcgacgtgttccaacacttcggtgaacctgcggtccaccaagatatgtcggtccctaaggccgggcacattcactactcaccggcgcacatattgtgcctctcctacacatcatgccatatgtggcaccttttggttgtggcgaccacacagtcgaccacgagctcactatggaccacaaggggacctacgtgcccagagctgagacatagcagcaccccaggaggccggacaaaacagccccggcgacaccacgggggacattggaattggagcaatcacaaggggcttgttacacaaatcttttatgacgtagcggatggagggggaattagtggccaaaagcaccgagatgtagagggatgcaagaagagttaactggagttggtttcaccacattgggggaaaaacagtgagtggagcatgttaagttcatttagagaagtcgaatcaagtggtggaaaattgtgcaagatggtggacttatcgaagtgagcagcatat

SEQ ID NO: 440765 - DNA, 3244 bp, Homo sapiens
ccagtgcattaatcagtagaattaatcagtgcatgttcctagtctgtaactaaactctgtggaagattcccctgctttcctatagtaaaggtttacgactttttcttctatctttattaagcttgtcattttcttctttttgcatggttcttacaaattatttggtcaatttcattttcagaatgttgaaacacagaatgtgcttctctcctctgactcaattagctgtttttgtttttctacagatgattcttttattaggccagtaactttttggattgttggggattttgatagcccttctggacggcagttactgtatgatgccatcaaacatcagaaatccagtaacaatgttagaataagcatgatcaataatcctgccaaagagataagctatgagaacactcagatctccagagcaatctgggcagctctccaaactcagacttccaacgctgctaagaacttcatcaccaaaatggccaaggagggggctgcagaggccctggctgcaggagctgacattgcggagttctctgttgggggaatggatttcagtctttttaaagaggtctttgagtcttccaaaatggatttcattttgtctcatgccgtgtactgcagggatgttctgaagctgaagaagggacagagggcagtgatcagcaatggaaggatcattgggccactggaggatagtgagctctttaatcaagacgatttccacctcctcgaaaatatcatcttaaaaacctcaggacagaaaataaaatctcatattcaacagcttcgggtagaagaagatgtggcaagcgacttggtaatgaaggtggatgctcttctgtcagcgcaaccaaaaggagatccaagaatcgagtaccagttttttgaagacagacacagtgcaatcaaactgaggccgaaggaaggggagacatactttgatgttgtggctgtcgttgaccctgtcaccagagaagcacagagacttgctcctttgctcttggttttggctcagctgataaacatgaatctgagagtatttatgaactgccaatccaaactttctgacatgcctttaaaaagcttttaccgttatgtcttagaaccagagatttctttcacttcagacaatagttttgctaagggtccaatcgcaaaatttttggatatgcctcagtctccactgttcactctgaatttgaacacacctgagagctggatggtagaatctgtcagaacaccatatgatcttgataatatttatttagaagaggtggacagtgtagtggctgctgagtatgagctggaatacctgttactggaaggtcattgctacgacatcaccacaggccagcctccacggggactacagtttaccttaggaacttcagccaacccggtcattgtggacaccattgttatggccaatctgggctactttcagctgaaagccaacccaggagcttggatcctcagacttaggaagggacgctctgaagatatttatagaatttacagccacgatggcaccgattctccccctgatgctgatgaggtggttatcgtcctcaacaacttcaaaagcaaaattattaaagtgaaggttcagaagaaggcagatatggtgaacgaagacttgctgagtgatggaacgagtgagaatgaatctggattttgggattccttcaaatggggctttacaggacagaagactgaggaagtgaagcaagataaagatgacataattaatattttctccgttgcatctggtcatctctacgaaagatttcttcgcataatgatgctatccgtgctgaagaataccaagactcctgtgaaattctggttcttgaagaattacttgtcccccacatttaaggagtttataccttacatggcaaatgaatacaatttccagtatgagcttgttcagtacaaatggccccggtggcttcatcaacaaactgaaaaacagcgtatcatctggggttacaagatcctcttcctggatgtacttttcccactagttgttgacaagttcctgtttgtggatgctgatcagattgtacgaacagatctgaaagagttaagagatttcaatttggatggtgctccttatggttacactcctttctgtgacagccgaagagaaatggacggctacaggttctggaagtcagggtactgggccagtcatttagccgggcgaaagtatcatatcagtgcactatatgttgtggatctgaagaagtttaggaaaatagctgctggtgacagactcaggggacagtaccaaggtctgagtcaggaccctaacagcctttcaaatcttgatcaagatctgcccaataacatgattcatcaggtgccaattaaatccctccctcaagaatggctttggtgtgaaacgtggtgtgatgacgcctctaagaaaagggcaaaaaccattgatttgtgtaataatccgatgaccaaagagccgaaactggaagcagctgtgcggattgtcccggagtggcaggactacgaccaagagatcaaacagctacagatccgctttcagaaggagaaagaaacgggagcactgtacaaagagaagacaaaagaaccaagccgagaaggtcctcagaaacgtgaagaattatgatctctggagaaggacaggaaatcaccccatttgaaaaacagtttttataataaatgctagttttttctgatctgtctatacaactgctgataagccggctgggcaggagtgccacaccttttgattctgagcatttgattctgacttctgtactctggtggccactggatctttgggattaaagctctgttggatttgtacctcagaggaagaccaagtggctgatcctttggactctgtaaagagcattcttctagtcagagggtggaatggcagcagcaactggaagaaaatgagttttttggtgcccacacccaagagcacacacatgctgcactgtctcggaaagcagggccagctagagccaccatgttcttccttacctcagtttacctgcggcctgcgctgcactgcagatgcccaccctgccctgggtctggccggcggaagctctgtccaaggtccacacacctccaggtttacgccaacatccttgtgccctccccaccttctcttccaacgcattaggtgcattgtttaattgaaatccaaccaacatgaccaaaaaccaaaagtgcattcaaccttacc

SEQ ID NO: 440766 - DNA, 2767 bp, Homo sapiens
ccagtgcattaatcagtagaattaatcagtgcatgttcctagtctgtaactaaactctgtggaagattcccctgctttcctatagtaaaggtttacgactttttcttctatctttattaagcttgtcattttcttctttttgcatggttcttacaaattatttggtcaatttcattttcagaatgttgaaacacagaatgtgcttctctcctctgactcaattagctgtttttgtttttctacagatgattcttttattaggccagtaactttttggattgttggggattttgatagcccttctggacggcagttactgtatgatgccatcaaacatcagaaatccagtaacaatgttagaataagcatgatcaataatcctgccaaagagataagctatgagaacactcagatctccagagcaatctgggcagctctccaaactcagacttccaacgctgctaagaacttcatcaccaaaatggccaaggagggggctgcagaggccctggctgcaggagctgacattgcggagttctctgttgggggaatggatttcagtctttttaaagaggtctttgagtcttccaaaatggatttcattttgtctcatgccgtgtactgcagggatgttctgaagctgaagaagggacagagggcagtgatcagcaatggaaggatcattgggccactggaggatagtgagctctttaatcaagacgatttccacctcctcgaaaatatcatcttaaaaacctcaggacagaaaataaaatctcatattcaacagcttcgggtagaagaagatgtggcaagcgacttggtaatgaaggtggatgctcttctgtcagcgcaaccaaaaggagatccaagaatcgagtaccagttttttgaagacagacacagtgcaatcaaactgaggccgaaggaaggggagacatactttgatgttgtggctgtcgttgaccctgtcaccagagaagcacagagacttgctcctttgctcttggttttggctcagctgataaacatgaatctgagagtatttatgaactgccaatccaaactttctgacatgcctttaaaaagcttttaccgttatgtcttagaaccagagatttctttcacttcagacaatagttttgctaagggtccaatcgcaaaatttttggatatgcctcagtctccactgttcactctgaatttgaacacacctgagagctggatggtagaatctgtcagaacaccatatgatcttgataatatttatttagaagaggtggacagtgtagtggctgctgagtatgagctggaatacctgttactggaaggtcattgctacgacatcaccacaggccagcctccacggggactacagtttaccttaggaacttcagccaacccggtcattgtggacaccattgttatggccaatctgggctactttcagctgaaagccaacccaggagcttggatcctcagacttaggaagggacgctctgaagatatttatagaatttacagccacgatggcaccgattctccccctgatgctgatgaggtggttatcgtcctcaacaacttcaaaagcaaaattattaaagtgaaggttcagaagaaggcagatatggtgaacgaagacttgctgagtgatggaacgagtgagaatgaatctggattttgggattccttcaaatggggctttacaggacagaagactgaggaagtgaagcaagataaagatgacataattaatattttctccgttgcatctggtcatctctacgaaagatttcttcgcataatgatgctatccgtgctgaagaataccaagactcctgtgaaattctggttcttgaagaattacttgtcccccacatttaaggagtttataccttacatggcaaatgaatacaatttccagtatgagcttgttcagtacaaatggccccggtggcttcatcaacaaactgaaaaacagcgtatcatctggggttacaagatcctcttcctggatgtacttttcccactagttgttgacaagttcctgtttgtggatgctgatcagattgtacgaacagatctgaaagagttaagagatttcaatttggatggtgctccttatggttacactcctttctgtgacagccgaagagaaatggacggctacaggttctggaagtcagggtactgggccagtcatttagccgggcgaaagtatcatatcagtgcactatatgttgtggatctgaagaagtttaggaaaatagctgctggtgacagactcaggggacagtaccaaggtctgagtcaggaccctaacagcctttcaaatcttgatcaagatctgcccaataacatgattcatcaggtgccaattaaatccctccctcaagaatggctttggtgtgaaacgtggtgtgatgacgcctctaagaaaagggcaaaaaccattgatttgtaatccgatgacccaagagccgaaactggaaacaccggtgtttccctttgtcttcttctttttaacattttaggttagagatattacttaaaaacagtgttaccaggaaaaagaactaaagacgactaactcttaaagataactttaatgagttgaaatgaatagcttaatttctatcaccacttcagaaatatatatagtttttatctgtttttactgtcttttttgttttgttttgtttttacaggcatcccaccatgcctggctaattttgtatttttagagacaaaggaatcaccggtccgc

SEQ ID NO: 440767 - DNA, 2786 bp, Homo sapiens
ccagtgcattaatcagtagaattaatcagtgcatgttcctagtctgtaactaaactctgtggaagattcccctgctttcctatagtaaaggtttacgactttttcttctatctttattaagcttgtcattttcttctttttgcatggttcttacaaattatttggtcaatttcattttcagaatgttgaaacacagaatgtgcttctctcctctgactcaattagctgtttttgtttttctacagatgattcttttattaggccagtaactttttggattgttggggattttgatagcccttctggacggcagttactgtatgatgccatcaaacatcagaaatccagtaacaatgttagaataagcatgatcaataatcctgccaaagagataagctatgagaacactcagatctccagagcaatctgggcagctctccaaactcagacttccaacgctgctaagaacttcatcaccaaaatggccaaggagggggctgcagaggccctggctgcaggagctgacattgcggagttctctgttgggggaatggatttcagtctttttaaagaggtctttgagtcttccaaaatggatttcattttgtctcatgccgtgtactgcagggatgttctgaagctgaagaagggacagagggcagtgatcagcaatggaaggatcattgggccactggaggatagtgagctctttaatcaagacgatttccacctcctcgaaaatatcatcttaaaaacctcaggacagaaaataaaatctcatattcaacagcttcgggtagaagaagatgtggcaagcgacttggtaatgaaggtggatgctcttctgtcagcgcaaccaaaaggagatccaagaatcgagtaccagttttttgaagacagacacagtgcaatcaaactgaggccgaaggaaggggagacatactttgatgttgtggctgtcgttgaccctgtcaccagagaagcacagagacttgctcctttgctcttggttttggctcagctgataaacatgaatctgagagtatttatgaactgccaatccaaactttctgacatgcctttaaaaagcttttaccgttatgtcttagaaccagagatttctttcacttcagacaatagttttgctaagggtccaatcgcaaaatttttggatatgcctcagtctccactgttcactctgaatttgaacacacctgagagctggatggtagaatctgtcagaacaccatatgatcttgataatatttatttagaagaggtggacagtgtagtggctgctgagtatgagctggaatacctgttactggaaggtcattgctacgacatcaccacaggccagcctccacggggactacagtttaccttaggaacttcagccaacccggtcattgtggacaccattgttatggccaatctgggctactttcagctgaaagccaacccaggagcttggatcctcagacttaggaagggacgctctgaagatatttatagaatttacagccacgatggcaccgattctccccctgatgctgatgaggtggttatcgtcctcaacaacttcaaaagcaaaattattaaagtgaaggttcagaagaaggcagatatggtgaacgaagacttgctgagtgatggaacgagtgagaatgaatctggattttgggattccttcaaatggggctttacaggacagaagactgaggaagtgaagcaagataaagatgacataattaatattttctccgttgcatctggtcatctctacgaaagatttcttcgcataatgatgctatccgtgctgaagaataccaagactcctgtgaaattctggttcttgaagaattacttgtcccccacatttaaggagtttataccttacatggcaaatgaatacaatttccagtatgagcttgttcagtacaaatggccccggtggcttcatcaacaaactgaaaaacagcgtatcatctggggttacaagatcctcttcctggatgtacttttcccactagttgttgacaagttcctgtttgtggatgctgatcagattgtacgaacagatctgaaagagttaagagatttcaatttggatggtgctccttatggttacactcctttctgtgacagccgaagagaaatggacggctacaggttctggaagtcagggtactgggccagtcatttagccgggcgaaagtatcatatcaggatctgcccaataacatgattcatcaggtgccaattaaatccctccctcaagaatggctttggtgtgaaacgtggtgtgatgacgcctctaagaaaagggcaaaaaccattgatttgtaagccgtatgtggtgtgcttctgcatgttcatccactggatgttgtaataatccgatgaccaaagagccgaaactggaagcagctgtgcggattgtcccggagtggcaggactacgaccaagagatcaaacagctacagatccgctttcagaaggagaaagaaacgggagcactgtacaaagagaagacaaaagaaccaagccgagaaggtcctcagaaacgtgaagaattatgatctctggagaaggacaggaaatcaccccatttgaaaaacagtttttataataaatgctagttttttctgatctgtctatacaactgctgataagccggctgggcaggagtgccacaccttttgattctgagcatttgattctgacttctgtactctggtggccactggatctttgggattaaagctctgttggatttgtacctc

SEQ ID NO: 440768 - DNA, 456 bp, Homo sapiens
ccatcaataggatcaatgactcccataaaaccctcagtaatagaagttctagtccattacaaagcaactcacacagtactatgataaccaatgtccataggtcccaatccaggactgctacaggccccccaaaactgacttgtaatccctgtgaatcccagacttgcaatcattcaccaccttagcaccccaatcaataaactctcatggactgaatcgatgacctcagatactgacatttccaacacttccaggcagaaccaacacgtcatttacaaggaaaagggatcacaatggcactagatttatttgcaacaacagaagccatgttagaagaaaactctacaaatcattgagacagaaggactgacatccaagaattctaaacctgccctagctagataccattcttttgtcagagcaaaagaaagacaattttagccgggcgcggtggct

SEQ ID NO: 440769 - DNA, 1498 bp, Homo sapiens
cctttccatagtattaagtatgtctttggcccacttgtagtttctcaagaaagcatgttgatacggacagcccctactctcatatatggtgtattgaccttaggcaagagatgtggtttctctgagctccagatatgtcatctataaaattggtgttaacaccgtttatctcatagggtgctaagaagattaaagtactgcccagagtaggcactcagtcaagttctctttcctctcctgatacctacccccatcctttcctctaggttgcatatagttctttactcccaaaggagatcacagtagatagaaaatcccatgaatgtccttgctcttcgttgttacctccctccccctctatcccccacacataatgccttagatattcagtaggttttattgattagaggtgaacttatttggaaggaataaaaagacaaagcaggagaatggtcaagaacatgagttttagagtgagacacttgagtttgaaatccagcccaaccatttactagttgtgtgacctctatcaagttatgcaacctctctgtgcctcagtttcctttttggcaaattggtgctaacacctcacaggactattgtaaggattaagttcatgtagataaagcacttaacacagcatccgacacatctcatcactcaataaattatcactgccctttgttactgtggttaacaaacacttgctgtaatttctctcttctaacttataggacaaacaaataatggaaatttttaacataagtatgtagagattgtggtaccacagtgataaactgatttttatgcttaagttaatgactctggtttatgtatgacaatttattcagtatgagaatctcagaaaactaatgtttttttctattccttaaccttcctaccctttttttggtaaagaaaattaccgaaaaaacaaaaaacaaaaaaaaaactacctctgtctatttatttattccattttaatctcatggcttgaaatctgaaaaattggagttgctgtaagagattggtggatgtctttttgccctcatggtgatgtattcttttacagcttttatcattgaccagaattttaaggcctgcttattttaaaaaacgaaaaccagtgttctttatgataataagcttaaaataatagaaatactttttaaaatagtatggggagagctcattgtcagtgaatatagatcattcttgttgatacccttctttgaatattctagtgtattaatataccattgtttatttaatcatgtcttattaatggactggctgttttcacatatttgatatatcaagtgtcttcacaacttgtgcttgcatattctttcccaaaatattgaaagtccatatatttccttgtacatttttaaagttgatatctaaatctttcattgtagttgcaaagcatgtaatttcttgggggaggggggctgtaaatattgacattttaaaataaaacttttaaatcagcctt

SEQ ID NO: 440770 - DNA, 1210 bp, Homo sapiens
tatggataaaggataataccgtttacacaatgaatattacttaactggcgggaaatactccctccccctctatcccccacacataatgccttagatattcagtaggttttattgattagaggtgaacttatttggaaggaataaaaagacaaagcaggagaatggtcaagaacatgagttttagagtgagacacttgagtttgaaatccagcccaaccatttactagttgtgtgacctctatcaagttatgcaacctctctgtgcctcagtttcctttttggcaaattggtgctaacacctcacaggactattgtaaggattaagttcatgtagataaagcacttaacacagcatccgacacatctcatcactcaataaattatcactgccctttgttactgtggttaacaaacacttgctgtaatttctctcttctaacttataggacaaacaaataatggaaatttttaacataagtatgtagagattgtggtaccacagtgataaactgatttttatgcttaagttaatgactctggtttatgtatgacaatttattcagtatgagaatctcagaaaactaatgtttttttctattccttaaccttcctaccctttttttggtaaagaaaattaccgaaaaaacaaaaaacaaaaaaaaaactacctctgtctatttatttattccattttaatctcatggcttgaaatctgaaaaattggagttgctgtaagagattggtggatgtctttttgccctcatggtgatgtattcttttacagcttttatcattgaccagaattttaaggcctgcttattttaaaaaacgaaaaccagtgttctttatgataataagcttaaaataatagaaatactttttaaaatagtatggggagagctcattgtcagtgaatatagatcattcttgttgatacccttctttgaatattctagtgtattaatataccattgtttatttaatcatgtcttattaatggactggctgttttcacatatttgatatatcaagtgtcttcacaacttgtgcttgcatattctttcccaaaatattgaaagtccatatatttccttgtacatttttaaagttgatatctaaatctttcattgtagttgcaaagcatgtaatttcttgggggaggggggctgtaaatattgacattttaaaataaaacttttaaatcagcctt

SEQ ID NO: 440771 - DNA, 4789 bp, Homo sapiens
cccgcggttggacgcggcgctcagttgccgggcgggggagggcgcgtccggtttttctcaggggacgttgaaattatttttgtaacgggagtcgggagaggacggggcgtgccccgacgtgcgcgcgcgtcgtcctccccggcgctcctccacagctcgctggctcccgccgcggaaaggcgtcatgccgcccaaaaccccccgaaaaacggccgccaccgccgccgctgccgccgcggaacccccggcaccgccgccgccgccccctcctgaggaggacccagagcaggacagcggcccggaggacctgcctctcgtcaggcttgagtttgaagaaacagaagaacctgattttactgcattatgtcagaaattaaagataccagatcatgtcagagagagagcttggttaacttgggagaaagtttcatctgtggatggagtattgggaggttatattcaaaagaaaaaggaactgtggggaatctgtatctttattgcagcagttgacctagatgagatgtcgttcacttttactgagctacagaaaaacatagaaatcagtgtccataaattctttaacttactaaaagaaattgataccagtaccaaagttgataatgctatgtcaagactgttgaagaagtatgatgtattgtttgcactcttcagcaaattggaaaggacatgtgaacttatatatttgacacaacccagcagttcgatatctactgaaataaattctgcattggtgctaaaagtttcttggatcacatttttattagctaaaggggaagtattacaaatggaagatgatctggtgatttcatttcagttaatgctatgtgtccttgactattttattaaactctcacctcccatgttgctcaaagaaccatataaaacagctgttatacccattaatggttcacctcgaacacccaggcgaggtcagaacaggagtgcacggatagcaaaacaactagaaaatgatacaagaattattgaagttctctgtaaagaacatgaatgtaatatagatgaggtgaaaaatgtttatttcaaaaattttataccttttatgaattctcttggacttgtaacatctaatggacttccagaggttgaaaatctttctaaacgatacgaagaaatttatcttaaaaataaagatctagatgcaagattatttttggatcatgataaaactcttcagactgattctatagacagttttgaaacacagagaacaccacgaaaaagtaaccttgatgaagaggtgaatgtaattcctccacacactccagttaggactgttatgaacactatccaacaattaatgatgattttaaattcagcaagtgatcaaccttcagaaaatctgatttcctattttaacaactgcacagtgaatccaaaagaaagtatactgaaaagagtgaaggatataggatacatctttaaagagaaatttgctaaagctgtgggacagggttgtgtcgaaattggatcacagcgatacaaacttggagttcgcttgtattaccgagtaatggaatccatgcttaaatcagaagaagaacgattatccattcaaaattttagcaaacttctgaatgacaacatttttcatatgtctttattggcgtgcgctcttgaggttgtaatggccacatatagcagaagtacatctcagaatcttgattctggaacagatttgtctttcccatggattctgaatgtgcttaatttaaaagcctttgatttttacaaagtgatcgaaagttttatcaaagcagaaggcaacttgacaagagaaatgataaaacatttagaacgatgtgaacatcgaatcatggaatcccttgcatggctctcagattcacctttatttgatcttattaaacaatcaaaggaccgagaaggaccaactgatcaccttgaatctgcttgtcctcttaatcttcctctccagaataatcacactgcagcagatatgtatctttctcctgtaagatctccaaagaaaaaaggttcaactacgcgtgtaaattctactgcaaatgcagagacacaagcaacctcagccttccagacccagaagccattgaaatctacctctctttcactgttttataaaaaagtgtatcggctagcctatctccggctaaatacactttgtgaacgccttctgtctgagcacccagaattagaacatatcatctggacccttttccagcacaccctgcagaatgagtatgaactcatgagagacaggcatttggaccaaattatgatgtgttccatgtatggcatatgcaaagtgaagaatatagaccttaaattcaaaatcattgtaacagcatacaaggatcttcctcatgctgttcaggagacattcaaacgtgttttgatcaaagaagaggagtatgattctattatagtattctataactcggtcttcatgcagagactgaaaacaaatattttgcagtatgcttccaccaggccccctaccttgtcaccaatacctcacattcctcgaagcccttacaagtttcctagttcacccttacggattcctggagggaacatctatatttcacccctgaagagtccatataaaatttcagaaggtctgccaacaccaacaaaaatgactccaagatcaagaatcttagtatcaattggtgaatcattcgggacttctgagaagttccagaaaataaatcagatggtatgtaacagcgaccgtgtgctcaaaagaagtgctgaaggaagcaaccctcctaaaccactgaaaaaactacgctttgatattgaaggatcagatgaagcagatggaagtaaacatctcccaggagagtccaaatttcagcagaaactggcagaaatgacttctactcgaacacgaatgcaaaagcagaaaatgaatgatagcatggatacctcaaacaaggaagagaaatgaggatctcaggaccttggtggacactgtgtacacctctggattcattgtctctcacagatgtgactgtataactttcccaggttctgtttatggccacatttaatatcttcagctctttttgtggatataaaatgtgcagatgcaattgtttgggtgattcctaagccacttgaaatgttagtcattgttatttatacaagattgaaaatcttgtgtaaatcctgccatttaaaaagttgtagcagattgtttcctcttccaaagtaaaattgctgtgctttatggatagtaagaatggccctagagtgggagtcctgataacccaggcctgtctgactactttgccttcttttgtagcatataggtgatgtttgctcttgtttttattaatttatatgtatatttttttaatttaacatgaacacccttagaaaatgtgtcctatctatcttccaaatgcaatttgattgactgcccattcaccaaaattatcctgaactcttctgcaaaaatggatattattagaaattagaaaaaaattactaattttacacattagattttattttactattggaatctgatatactgtgtgcttgttttataaaattttgcttttaattaaataaaagctggaagcaaagtataaccatatgatactatcatactactgaaacagatttcatacctcagaatgtaaaagaacttactgattattttcttcatccaacttatgtttttaaatgaggattattgatagtactcttggtttttataccattcagatcactgaatttataaagtacccatctagtacttgaaaaagtaaagtgttctgccagatcttaggtatagaggaccctaacacagtatatcccaagtgcactttctaatgtttctgggtcctgaagaattaagatacaaattaattttactccataaacagactgttaattataggagccttaatttttttttcatagagatttgtctaattgcatctcaaaattattctgccctccttaatttgggaaggtttgtgttttctctggaatggtacatgtcttccatgtatcttttgaactggcaattgtctatttatcttttatttttttaagtcagtatggtctaacactggcatgttcaaagccacattatttctagtccaaaattacaagtaatcaagggtcattatgggttaggcattaatgtttctatctgattttgtgcaaaagcttcaaattaaaacagctgcattagaaaaagaggcgcttctccccttcccctacacctaaaggtgtatttaaactatcttgtgtgattaacttatttagagatgctgtaacttaaaataggggatatttaaggtagcttcagctagcttttaggaaaatcactttgtctaactcagaattatttttaaaaagaaatctggtcttgttagaaaacaaaattttattttgtgctcatttaagtttcaaacttactattttgacagttattttgataacaatgacactagaaaacttgactccatttcatcattgtttctgcatgaatatcatacaaatcagttagtttttaggtcaagggcttactatttctgggtcttttgctactaagttcacattagaattagtgccagaattttaggaacttcagagatcgtgtattgagatttcttaaataatgcttcagatattattgctttattgcttttttgtattggttaaaactgtacatttaaaattgctatgttactattttctacaattaatagtttgtctattttaaaataaattagttgttaagagtctt

SEQ ID NO: 440772 - DNA, 636 bp, Homo sapiens
cccgcggttggacgcggcgctcagttgccgggcgggggagggcgcgtccggtttttctcaggggacgttgaaattatttttgtaacgggagtcgggagaggacggggcgtgccccgacgtgcgcgcgcgtcgtcctccccggcgctcctccacagctcgctggctcccgccgcggaaaggcgtcatgccgcccaaaaccccccgaaaaacggccgccaccgccgccgctgccgccgcggaacccccggcaccgccgccgccgccccctcctgaggaggacccagagcaggacagcggcccggaggacctgcctctcgtcaggcttgagtttgaagaaacagaagaacctgattttactgcattatgtcagaaattaaagataccagatcatgtcagagagagagcttggttaacttgggagaaagtttcatctgtggatggagtattggtactccgctcacctgttttcaaaccatggttgaccatgggaaactgaaactgtggaaagtgaaaccgtggatatggaatgactgatgtaatcacttcttattgtatagatgtatcaaaatatcacattgaacaccttaaatataaactttttcgtttgtcaattgtacctccataaagctggaaaaa

SEQ ID NO: 440773 - DNA, 502 bp, Homo sapiens
  misc_feature (502)..(502): n is a, c, g, or t
ggaggaagaatgtgagctgcatgggaaaagacaggaggatttacaaagagtgggtgtttaattggggatggaattaggtagttattctgatttttagatttttcatatcttttatttggtccaatgaagcagaaaatttaaatgaagttattacctttgcctgatttttgacacacctcaaactataacttgaggttgctaactatgaaacactggcatttaatgatttaaagtaaagaattctgtaatttgtagacttctgagaagttccagaaaataaatcagatggtatgtaacagcgaccgtgtgctcaaaagaagtgctgaaggaagcaaccctcctaaaccactgaaaaaactacgctttgatattgaaggatcagatgaagcagatggaagtaaacatctcccaggagagtccaaatttcagcagaaactggcagaaatgacttttactctaacacgattgcataagcagtgacctttgtggacactgcgtaccn

SEQ ID NO: 440774 - DNA, 4416 bp, Homo sapiens
gcagttcgatatctactgaaataaattctgcattggtgctaaaagtttcttggatcacatttttattagctaaagggaggttatattcaaaagaaaaaggaactgtggggaatctgtatctttattgcagcagttgacctagatgagatgtcgttcacttttactgagctacagaaaaacatagaaatcagtgtccataaattctttaacttactaaaagaaattgataccagtaccaaagttgataatgctatgtcaagactgttgaagaagtatgatgtattgtttgcactcttcagcaaattggaaaggacatgtgaacttatatatttgacacaacccagcagttcgatatctactgaaataaattctgcattggtgctaaaagtttcttggatcacatttttattagctaaaggggaagtattacaaatggaagatgatctggtgatttcatttcagttaatgctatgtgtccttgactattttattaaactctcacctcccatgttgctcaaagaaccatataaaacagctgttatacccattaatggttcacctcgaacacccaggcgaggtcagaacaggagtgcacggatagcaaaacaactagaaaatgatacaagaattattgaagttctctgtaaagaacatgaatgtaatatagatgaggtgaaaaatgtttatttcaaaaattttataccttttatgaattctcttggacttgtaacatctaatggacttccagaggttgaaaatctttctaaacgatacgaagaaatttatcttaaaaataaagatctagatgcaagattatttttggatcatgataaaactcttcagactgattctatagacagttttgaaacacagagaacaccacgaaaaagtaaccttgatgaagaggtgaatgtaattcctccacacactccagttaggactgttatgaacactatccaacaattaatgatgattttaaattcagcaagtgatcaaccttcagaaaatctgatttcctattttaacaactgcacagtgaatccaaaagaaagtatactgaaaagagtgaaggatataggatacatctttaaagagaaatttgctaaagctgtgggacagggttgtgtcgaaattggatcacagcgatacaaacttggagttcgcttgtattaccgagtaatggaatccatgcttaaatcagaagaagaacgattatccattcaaaattttagcaaacttctgaatgacaacatttttcatatgtctttattggcgtgcgctcttgaggttgtaatggccacatatagcagaagtacatctcagaatcttgattctggaacagatttgtctttcccatggattctgaatgtgcttaatttaaaagcctttgatttttacaaagtgatcgaaagttttatcaaagcagaaggcaacttgacaagagaaatgataaaacatttagaacgatgtgaacatcgaatcatggaatcccttgcatggctctcagattcacctttatttgatcttattaaacaatcaaaggaccgagaaggaccaactgatcaccttgaatctgcttgtcctcttaatcttcctctccagaataatcacactgcagcagatatgtatctttctcctgtaagatctccaaagaaaaaaggttcaactacgcgtgtaaattctactgcaaatgcagagacacaagcaacctcagccttccagacccagaagccattgaaatctacctctctttcactgttttataaaaaagtgtatcggctagcctatctccggctaaatacactttgtgaacgccttctgtctgagcacccagaattagaacatatcatctggacccttttccagcacaccctgcagaatgagtatgaactcatgagagacaggcatttggaccaaattatgatgtgttccatgtatggcatatgcaaagtgaagaatatagaccttaaattcaaaatcattgtaacagcatacaaggatcttcctcatgctgttcaggagacattcaaacgtgttttgatcaaagaagaggagtatgattctattatagtattctataactcggtcttcatgcagagactgaaaacaaatattttgcagtatgcttccaccaggccccctaccttgtcaccaatacctcacattcctcgaagcccttacaagtttcctagttcacccttacggattcctggagggaacatctatatttcacccctgaagagtccatataaaatttcagaaggtctgccaacaccaacaaaaatgactccaagatcaagaatcttagtatcaattggtgaatcattcgggacttctgagaagttccagaaaataaatcagatggtatgtaacagcgaccgtgtgctcaaaagaagtgctgaaggaagcaaccctcctaaaccactgaaaaaactacgctttgatattgaaggatcagatgaagcagatggaagtaaacatctcccaggagagtccaaatttcagcagaaactggcagaaatgacttctactcgaacacgaatgcaaaagcagaaaatgaatgatagcatggatacctcaaacaaggaagagaaatgaggatctcaggaccttggtggacactgtgtacacctctggattcattgtctctcacagatgtgactgtataactttcccaggttctgtttatggccacatttaatatcttcagctctttttgtggatataaaatgtgcagatgcaattgtttgggtgattcctaagccacttgaaatgttagtcattgttatttatacaagattgaaaatcttgtgtaaatcctgccatttaaaaagttgtagcagattgtttcctcttccaaagtaaaattgctgtgctttatggatagtaagaatggccctagagtgggagtcctgataacccaggcctgtctgactactttgccttcttttgtagcatataggtgatgtttgctcttgtttttattaatttatatgtatatttttttaatttaacatgaacacccttagaaaatgtgtcctatctatcttccaaatgcaatttgattgactgcccattcaccaaaattatcctgaactcttctgcaaaaatggatattattagaaattagaaaaaaattactaattttacacattagattttattttactattggaatctgatatactgtgtgcttgttttataaaattttgcttttaattaaataaaagctggaagcaaagtataaccatatgatactatcatactactgaaacagatttcatacctcagaatgtaaaagaacttactgattattttcttcatccaacttatgtttttaaatgaggattattgatagtactcttggtttttataccattcagatcactgaatttataaagtacccatctagtacttgaaaaagtaaagtgttctgccagatcttaggtatagaggaccctaacacagtatatcccaagtgcactttctaatgtttctgggtcctgaagaattaagatacaaattaattttactccataaacagactgttaattataggagccttaatttttttttcatagagatttgtctaattgcatctcaaaattattctgccctccttaatttgggaaggtttgtgttttctctggaatggtacatgtcttccatgtatcttttgaactggcaattgtctatttatcttttatttttttaagtcagtatggtctaacactggcatgttcaaagccacattatttctagtccaaaattacaagtaatcaagggtcattatgggttaggcattaatgtttctatctgattttgtgcaaaagcttcaaattaaaacagctgcattagaaaaagaggcgcttctccccttcccctacacctaaaggtgtatttaaactatcttgtgtgattaacttatttagagatgctgtaacttaaaataggggatatttaaggtagcttcagctagcttttaggaaaatcactttgtctaactcagaattatttttaaaaagaaatctggtcttgttagaaaacaaaattttattttgtgctcatttaagtttcaaacttactattttgacagttattttgataacaatgacactagaaaacttgactccatttcatcattgtttctgcatgaatatcatacaaatcagttagtttttaggtcaagggcttactatttctgggtcttttgctactaagttcacattagaattagtgccagaattttaggaacttcagagatcgtgtattgagatttcttaaataatgcttcagatattattgctttattgcttttttgtattggttaaaactgtacatttaaaattgctatgttactattttctacaattaatagtttgtctattttaaaataaattagttgttaagagtctt

SEQ ID NO: 440775 - DNA, 5522 bp, Homo sapiens
cccgcggttggacgcggcgctcagttgccgggcgggggagggcgcgtccggtttttctcaggggacgttgaaattatttttgtaacgggagtcgggagaggacggggcgtgccccgacgtgcgcgcgcgtcgtcctccccggcgctcctccacagctcgctggctcccgccgcggaaaggcgtcatgccgcccaaaaccccccgaaaaacggccgccaccgccgccgctgccgccgcggaacccccggcaccgccgccgccgccccctcctgaggaggacccagagcaggacagcggcccggaggacctgcctctcgtcaggcttgagtttgaagaaacagaagaacctgattttactgcattatgtcagaaattaaagataccagatcatgtcagagagagagcttggttaacttgggagaaagtttcatctgtggatggagtattgggaggttatattcaaaagaaaaaggaactgtggggaatctgtatctttattgcagcagttgacctagatgagatgtcgttcacttttactgagctacagaaaaacatagaaatcagtgtccataaattctttaacttactaaaagaaattgataccagtaccaaagttgataatgctatgtcaagactgttgaagaagtatgatgtattgtttgcactcttcagcaaattggaaaggacatgtgaacttatatatttgacacaacccagcagttcgatatctactgaaataaattctgcattggtgctaaaagtttcttggatcacatttttattagctaaaggggaagtattacaaatggaagatgatctggtgatttcatttcagttaatgctatgtgtccttgactattttattaaactctcacctcccatgttgctcaaagaaccatataaaacagctgttatacccattaatggttcacctcgaacacccaggcgaggtcagaacaggagtgcacggatagcaaaacaactagaaaatgatacaagaattattgaagttctctgtaaagaacatgaatgtaatatagatgaggtgaaaaatgtttatttcaaaaattttataccttttatgaattctcttggacttgtaacatctaatggacttccagaggttgaaaatctttctaaacgatacgaagaaatttatcttaaaaataaagatctagatgcaagattatttttggatcatgataaaactcttcagactgattctatagacagttttgaaacacagagaacaccacgaaaaagtaaccttgatgaagaggtgaatgtaattcctccacacactccagttaggactgttatgaacactatccaacaattaatgatgattttaaattcagcaagtgatcaaccttcagaaaatctgatttcctattttaacaactgcacagtgaatccaaaagaaagtatactgaaaagagtgaaggatataggatacatctttaaagagaaatttgctaaagctgtgggacagggttgtgtcgaaattggatcacagcgatacaaacttggagttcgcttgtattaccgagtaatggaatccatgcttaaatcagaagaagaacgattatccattcaaaattttagcaaacttctgaatgacaacatttttcatatgtctttattggcgtgcgctcttgaggttgtaatggccacatatagcagaagtacatctcagaatcttgattctggaacagatttgtctttcccatggattctgaatgtgcttaatttaaaagcctttgatttttacaaagtgatcgaaagttttatcaaagcagaaggcaacttgacaagagaaatgataaaacatttagaacgatgtgaacatcgaatcatggaatcccttgcatggctctcagattcacctttatttgatcttattaaacaatcaaaggaccgagaaggaccaactgatcaccttgaatctgcttgtcctcttaatcttcctctccagaataatcacactgcagcagatatgtatctttctcctgtaagatctccaaagaaaaaaggttcaactacgcgtgtaaattctactgcaaatgcagagacacaagcaacctcagccttccagacccagaagccattgaaatctacctctctttcactgttttataaaaaagtgtatcggctagcctatctccggctaaatacactttgtgaacgccttctgtctgagcacccagaattagaacatatcatctggacccttttccagcacaccctgcagaatgagtatgaactcatgagagacaggcatttggaccaaattatgatgtgttccatgtatggcatatgcaaagtgaagaatatagaccttaaattcaaaatcattgtaacagcatacaaggatcttcctcatgctgttcaggagacattcaaacgtgttttgatcaaagaagaggagtatgattctattatagtattctataactcggtcttcatgcagagactgaaaacaaatattttgcagtatgcttccaccaggccccctaccttgtcaccaatacctcacattcctcgaagcccttacaagtttcctagttcacccttacggattcctggagggaacatctatatttcacccctgaagagtccatataaaatttcagaaggtctgccaacaccaacaaaaatgactccaagatcaagaatcttagtatcaattggtgaatcattcgggacttctgagaagttccagaaaataaatcagatggtatgtaacagcgaccgtgtgctcaaaagaagtgctgaaggaagcaaccctcctaaaccactgaaaaaactacgctttgatattgaaggatcagatgaagcagatggaagtaaacatctcccaggagagtccaaatttcagcagaaactggcagaaatgacttctactcgaacacgaatgcaaaagcagaaaatgaatgatagcatggatacctcaaacaaggaagagaaatgaggatctcaggaccttggtggacactgtgtacacctctggattcattgtctctcacagatgtgactgtataactttcccaggttctgtttatggccacatttaatatcttcagctctttttgtggatataaaatgtgcagatgcaattgtttgggtgattcctaagccacttgaaatgttagtcattgttatttatacaagattgaaaatcttgtgtaaatcctgccatttaaaaagttgtagcagattgtttcctcttccaaagtaaaattgctgtgctttatggatagtaagaatggccctagagtgggagtcctgataacccaggcctgtctgactactttgccttcttttgtagcatataggtgatgtttgctcttgtttttattaatttatatgtatatttttttaatttaacatgaacacccttagaaaatgtgtcctatctatcttccaaatgcaatttgattgactgcccattcaccaaaattatcctgaactcttctgcaaaaatggatattattagaaattagaaaaaaattactaattttacacattagattttattttactattggaatctgatatactgtgtgcttgttttataaaattttgcttttaattaaataaaagctggaagcaaagtataaccatatgatactatcatactactgaaacagatttcatacctcagaatgtaaaagaacttactgattattttcttcatccaacttatgtttttaaatgaggattattgatagtactcttggtttttataccattcagatcactgaatttataaagtacccatctagtacttgaaaaagtaaagtgttctgccagatcttaggtatagaggaccctaacacagtatatcccaagtgcactttctaatgtttctgggtcctgaagaattaagatacaaattaattttactccataaacagactgttaattataggagccttaatttttttttcatagagatttgtctaattgcatctcaaaattattctgccctccttaatttgggaaggtttgtgttttctctggaatggtacatgtcttccatgtatcttttgaactggcaattgtctatttatcttttatttttttaagtcagtatggtctaacactggcatgttcaaagccacattatttctagtccaaaattacaagtaatcaagggtcattatgggttaggcattaatgtttctatctgattttgtgcaaaagcttcaaattaaaacagctgcattagaaaaagaggcgcttctccccttcccctacacctaaaggtgtatttaaactatcttgtgtgattaacttatttagagatgctgtaacttaaaataggggatatttaaggtagcttcagctagcttttaggaaaatcactttgtctaactcagaattatttttaaaaagaaatctggtcttgttagaaaacaaaattttattttgtgctcatttaagtttcaaacttactattttgacagttattttgataacaatgacactagaaaacttgactccatttcatcattgtttctgcatgaatatcatacaaatcagttagtttttaggtcaagggcttactatttctgggtcttttgctactaagttcacattagaattagtgccagaattttaggaacttcagagatcgtgtattgagatttcttaaataatgcttcagatattattgctttattgcttttttgtattggttaaaactgtacatttaaaattgctatgttactattttctacaattaatagtttgtctattttaaaataaattagttgttaagagtcttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaagaacacaaaaaaaaaaacacagcggagagaaaaaataaaaaaagaaaaacaacgaaaagagaaaaaaaaaaagaaaaaacacaacaagaaaacaaaaaggagaaaaaaaacacacgaaaagaaaaaaaagagaaaagaaaaaaaaagagaaaaaaaaaagaaaaaaaaagaaaaaaaaaagacgagagaaaaaaaaaagaaaaagagagaaggaaagaaaagaaaaagaaagagaaacgagaaaaaagagagagaagagaagaaaagaggaaaaaaggagagaaaagaaaaagaaaaagagaaagaaaaaaaaagagacaggacaaagagaagaaacaaaagaaaagaaaagtgaagaaaagaaagacggacgatgaaaagagaaagaaaaggacaaaggaaaggaaagagagaaaagaagaaaaaagaaagaagaaaagagtaggaaaggagaaggaagaaagaagagaagggagaagaaaagagaagcaagaagaggaagggcagagaagagagaagaaagaaagaaagagagagaaagaaagaggaaggtaagaacaagaaaaaaggagaagtgtagcgaaaatagaaaaagaa

SEQ ID NO: 440776 - DNA, 4744 bp, Homo sapiens
cccgcggttggacgcggcgctcagttgccgggcgggggagggcgcgtccggtttttctcaggggacgttgaaattatttttgtaacgggagtcgggagaggacggggcgtgccccgacgtgcgcgcgcgtcgtcctccccggcgctcctccacagctcgctggctcccgccgcggaaaggcgtcatgccgcccaaaaccccccgaaaaacggccgccaccgccgccgctgccgccgcggaacccccggcaccgccgccgccgccccctcctgaggaggacccagagcaggacagcggcccggaggacctgcctctcgtcaggcttgagtttgaagaaacagaagaacctgattttactgcattatgtcagaaattaaagataccagatcatgtcagagagagagcttggttaacttgggagaaagtttcatctgtggatggagtattgggaggttatattcaaaagaaaaaggaactgtggggaatctgtatctttattgcagcagttgacctagatgagatgtcgttcacttttactgagctacagaaaaacatagaaatcagtgtccataaattctttaacttactaaaagaaattgataccagtaccaaagttgataatgctatgtcaagactgttgaagaagtatgatgtattgtttgcactcttcagcaaattggaaaggacatgtgaacttatatatttgacacaacccagcagttcgatatctactgaaataaattctgcattggtgctaaaagtttcttggatcacatttttattagctaaaggggaagtattacaaatggaagatgatctggtgatttcatttcagttaatgctatgtgtccttgactattttattaaactctcacctcccatgttgctcaaagaaccatataaaacagctgttatacccattaatggttcacctcgaacacccaggcgaggtcagaacaggagtgcacggatagcaaaacaactagaaaatgatacaagaattattgaagttctctgtaaagaacatgaatgtaatatagatgaggtgaaaaatgtttatttcaaaaattttataccttttatgaattctcttggacttgtaacatctaatggacttccagaggttgaaaatctttctaaacgatacgaagaaatttatcttaaaaataaagatctagatgcaagattatttttggatcatgataaaactcttcagactgattctatagacagttttgaaacacagagaacaccacgaaaaagtaaccttgatgaagaggtgaatgtaattcctccacacactccagttaggactgttatgaacactatccaacaattaatgatgattttaaattcagcaagtgatcaaccttcagaaaatctgatttcctattttaacaactgcacagtgaatccaaaagaaagtatactgaaaagagtgaaggatataggatacatctttaaagagaaatttgctaaagctgtgggacagggttgtgtcgaaattggatcacagcgatacaaacttggagttcgcttgtattaccgagtaatggaatccatgcttaaatcagaagaagaacgattatccattcaaaattttagcaaacttctgaatgacaacatttttcatatgtctttattggcgtgcgctcttgaggttgtaatggccacatatagcagaagtacatctcagaatcttgattctggaacagatttgtctttcccatggattctgaatgtgcttaatttaaaagcctttgatttttacaaagtgatcgaaagttttatcaaagcagaaggcaacttgacaagagaaatgataaaacatttagaacgatgtgaacatcgaatcatggaatcccttgcatggctctcagattcacctttatttgatcttattaaacaatcaaaggaccgagaaggaccaactgatcaccttgaatctgcttgtcctcttaatcttcctctccagaataatcacactgcagcagatatgtatctttctcctgtaagatctccaaagaaaaaaggttcaactacgcgtgtaaattctactgcaaatgcagagacacaagcaacctcagccttccagacccagaagccattgaaatctacctctctttcactgttttataaaaaagtgtatcggctagcctatctccggctaaatacactttgtgaacgccttctgtctgagcacccagaattagaacatatcatctggacccttttccagcacaccctgcagaatgagtatgaactcatgagagacaggcatttggaccaaattatgatgtgttccatgtatggcatatgcaaagtgaagaatatagaccttaaattcaaaatcattgtaacagcatacaaggatcttcctcatgctgttcaggagacattcaaacgtgttttgatcaaagaagaggagtatgattctattatagtattctataactcggtcttcatgcagagactgaaaacaaatattttgcagtatgcttccaccaggccccctaccttgtcaccaatacctcacattcctcgaagcccttacaagtttcctagttcacccttacggattcctggagggaacatctatatttcacccctgaagagtccatataaaatttcagaaggtctgccaacaccaacaaaaatgactccaagatcaagaatcttagtatcaattggtgaatcattcgggacttctgagaagttccagaaaataaatcagatggtatgtaacagcgaccgtgtgctcaaaagaagtgctgaaggaagcaaccctcctaaaccactgaataaacatctcccaggagagtccaaatttcagcagaaactggcagaaatgacttctactcgaacacgaatgcaaaagcagaaaatgaatgatagcatggatacctcaaacaaggaagagaaatgaggatctcaggaccttggtggacactgtgtacacctctggattcattgtctctcacagatgtgactgtataactttcccaggttctgtttatggccacatttaatatcttcagctctttttgtggatataaaatgtgcagatgcaattgtttgggtgattcctaagccacttgaaatgttagtcattgttatttatacaagattgaaaatcttgtgtaaatcctgccatttaaaaagttgtagcagattgtttcctcttccaaagtaaaattgctgtgctttatggatagtaagaatggccctagagtgggagtcctgataacccaggcctgtctgactactttgccttcttttgtagcatataggtgatgtttgctcttgtttttattaatttatatgtatatttttttaatttaacatgaacacccttagaaaatgtgtcctatctatcttccaaatgcaatttgattgactgcccattcaccaaaattatcctgaactcttctgcaaaaatggatattattagaaattagaaaaaaattactaattttacacattagattttattttactattggaatctgatatactgtgtgcttgttttataaaattttgcttttaattaaataaaagctggaagcaaagtataaccatatgatactatcatactactgaaacagatttcatacctcagaatgtaaaagaacttactgattattttcttcatccaacttatgtttttaaatgaggattattgatagtactcttggtttttataccattcagatcactgaatttataaagtacccatctagtacttgaaaaagtaaagtgttctgccagatcttaggtatagaggaccctaacacagtatatcccaagtgcactttctaatgtttctgggtcctgaagaattaagatacaaattaattttactccataaacagactgttaattataggagccttaatttttttttcatagagatttgtctaattgcatctcaaaattattctgccctccttaatttgggaaggtttgtgttttctctggaatggtacatgtcttccatgtatcttttgaactggcaattgtctatttatcttttatttttttaagtcagtatggtctaacactggcatgttcaaagccacattatttctagtccaaaattacaagtaatcaagggtcattatgggttaggcattaatgtttctatctgattttgtgcaaaagcttcaaattaaaacagctgcattagaaaaagaggcgcttctccccttcccctacacctaaaggtgtatttaaactatcttgtgtgattaacttatttagagatgctgtaacttaaaataggggatatttaaggtagcttcagctagcttttaggaaaatcactttgtctaactcagaattatttttaaaaagaaatctggtcttgttagaaaacaaaattttattttgtgctcatttaagtttcaaacttactattttgacagttattttgataacaatgacactagaaaacttgactccatttcatcattgtttctgcatgaatatcatacaaatcagttagtttttaggtcaagggcttactatttctgggtcttttgctactaagttcacattagaattagtgccagaattttaggaacttcagagatcgtgtattgagatttcttaaataatgcttcagatattattgctttattgcttttttgtattggttaaaactgtacatttaaaattgctatgttactattttctacaattaatagtttgtctattttaaaataaattagttgttaagagtctt

SEQ ID NO: 440777 - DNA, 2340 bp, Homo sapiens
ggaggaagaatgtgagctgcatgggaaaagacaggaggatttacaaagagtgggtgtttaattggggatggaattaggtagttattctgatttttagatttttcatatcttttatttggtccaatgaagcagaaaatttaaatgaagttattacctttgcctgatttttgacacacctcaaactataacttgaggttgctaactatgaaacactggcatttaatgatttaaagtaaagaattctgtaatttgtagacttctgagaagttccagaaaataaatcagatggtatgtaacagcgaccgtgtgctcaaaagaagtgctgaaggaagcaaccctcctaaaccactgaaaaaactacgctttgatattgaaggatcagatgaagcagatggaagtaaacatctcccaggagagtccaaatttcagcagaaactggcagaaatgacttctactcgaacacgaatgcaaaagcagaaaatgaatgatagcatggatacctcaaacaaggaagagaaatgaggatctcaggaccttggtggacactgtgtacacctctggattcattgtctctcacagatgtgactgtataactttcccaggttctgtttatggccacatttaatatcttcagctctttttgtggatataaaatgtgcagatgcaattgtttgggtgattcctaagccacttgaaatgttagtcattgttatttatacaagattgaaaatcttgtgtaaatcctgccatttaaaaagttgtagcagattgtttcctcttccaaagtaaaattgctgtgctttatggatagtaagaatggccctagagtgggagtcctgataacccaggcctgtctgactactttgccttcttttgtagcatataggtgatgtttgctcttgtttttattaatttatatgtatatttttttaatttaacatgaacacccttagaaaatgtgtcctatctatcttccaaatgcaatttgattgactgcccattcaccaaaattatcctgaactcttctgcaaaaatggatattattagaaattagaaaaaaattactaattttacacattagattttattttactattggaatctgatatactgtgtgcttgttttataaaattttgcttttaattaaataaaagctggaagcaaagtataaccatatgatactatcatactactgaaacagatttcatacctcagaatgtaaaagaacttactgattattttcttcatccaacttatgtttttaaatgaggattattgatagtactcttggtttttataccattcagatcactgaatttataaagtacccatctagtacttgaaaaagtaaagtgttctgccagatcttaggtatagaggaccctaacacagtatatcccaagtgcactttctaatgtttctgggtcctgaagaattaagatacaaattaattttactccataaacagactgttaattataggagccttaatttttttttcatagagatttgtctaattgcatctcaaaattattctgccctccttaatttgggaaggtttgtgttttctctggaatggtacatgtcttccatgtatcttttgaactggcaattgtctatttatcttttatttttttaagtcagtatggtctaacactggcatgttcaaagccacattatttctagtccaaaattacaagtaatcaagggtcattatgggttaggcattaatgtttctatctgattttgtgcaaaagcttcaaattaaaacagctgcattagaaaaagaggcgcttctccccttcccctacacctaaaggtgtatttaaactatcttgtgtgattaacttatttagagatgctgtaacttaaaataggggatatttaaggtagcttcagctagcttttaggaaaatcactttgtctaactcagaattatttttaaaaagaaatctggtcttgttagaaaacaaaattttattttgtgctcatttaagtttcaaacttactattttgacagttattttgataacaatgacactagaaaacttgactccatttcatcattgtttctgcatgaatatcatacaaatcagttagtttttaggtcaagggcttactatttctgggtcttttgctactaagttcacattagaattagtgccagaattttaggaacttcagagatcgtgtattgagatttcttaaataatgcttcagatattattgctttattgcttttttgtattggttaaaactgtacatttaaaattgctatgttactattttctacaattaatagtttgtctattttaaaataaattagttgttaagagtctt

SEQ ID NO: 440778 - DNA, 2792 bp, Homo sapiens
tctccgtgattaaatcgttcgggaatccatcgtttcagtcaagctgtgatgcttgtactgttggtactgagcgacgatgctaccacagcctgccatgagccagaccctgatggaaatctacctctctttcactgttttataaaaaagtgtatcggctagcctatctccggctaaatacactttgtgaacgccttctgtctgagcacccagaattagaacatatcatctggacccttttccagcacaccctgcagaatgagtatgaactcatgagagacaggcatttggaccaaattatgatgtgttccatgtatggcatatgcaaagtgaagaatatagaccttaaattcaaaatcattgtaacagcatacaaggatcttcctcatgctgttcaggagacattcaaacgtgttttgatcaaagaagaggagtatgattctattatagtattctataactcggtcttcatgcagagactgaaaacaaatattttgcagtatgcttccaccaggccccctaccttgtcaccaatacctcacattcctcgaagcccttacaagtttcctagttcacccttacggattcctggagggaacatctatatttcacccctgaagagtccatataaaatttcagaaggtctgccaacaccaacaaaaatgactccaagatcaagaatcttagtatcaattggtgaatcattcgggacttctgagaagttccagaaaataaatcagatggtatgtaacagcgaccgtgtgctcaaaagaagtgctgaaggaagcaaccctcctaaaccactgaaaaaactacgctttgatattgaaggatcagatgaagcagatggaagtaaacatctcccaggagagtccaaatttcagcagaaactggcagaaatgacttctactcgaacacgaatgcaaaagcagaaaatgaatgatagcatggatacctcaaacaaggaagagaaatgaggatctcaggaccttggtggacactgtgtacacctctggattcattgtctctcacagatgtgactgtataactttcccaggttctgtttatggccacatttaatatcttcagctctttttgtggatataaaatgtgcagatgcaattgtttgggtgattcctaagccacttgaaatgttagtcattgttatttatacaagattgaaaatcttgtgtaaatcctgccatttaaaaagttgtagcagattgtttcctcttccaaagtaaaattgctgtgctttatggatagtaagaatggccctagagtgggagtcctgataacccaggcctgtctgactactttgccttcttttgtagcatataggtgatgtttgctcttgtttttattaatttatatgtatatttttttaatttaacatgaacacccttagaaaatgtgtcctatctatcttccaaatgcaatttgattgactgcccattcaccaaaattatcctgaactcttctgcaaaaatggatattattagaaattagaaaaaaattactaattttacacattagattttattttactattggaatctgatatactgtgtgcttgttttataaaattttgcttttaattaaataaaagctggaagcaaagtataaccatatgatactatcatactactgaaacagatttcatacctcagaatgtaaaagaacttactgattattttcttcatccaacttatgtttttaaatgaggattattgatagtactcttggtttttataccattcagatcactgaatttataaagtacccatctagtacttgaaaaagtaaagtgttctgccagatcttaggtatagaggaccctaacacagtatatcccaagtgcactttctaatgtttctgggtcctgaagaattaagatacaaattaattttactccataaacagactgttaattataggagccttaatttttttttcatagagatttgtctaattgcatctcaaaattattctgccctccttaatttgggaaggtttgtgttttctctggaatggtacatgtcttccatgtatcttttgaactggcaattgtctatttatcttttatttttttaagtcagtatggtctaacactggcatgttcaaagccacattatttctagtccaaaattacaagtaatcaagggtcattatgggttaggcattaatgtttctatctgattttgtgcaaaagcttcaaattaaaacagctgcattagaaaaagaggcgcttctccccttcccctacacctaaaggtgtatttaaactatcttgtgtgattaacttatttagagatgctgtaacttaaaataggggatatttaaggtagcttcagctagcttttaggaaaatcactttgtctaactcagaattatttttaaaaagaaatctggtcttgttagaaaacaaaattttattttgtgctcatttaagtttcaaacttactattttgacagttattttgataacaatgacactagaaaacttgactccatttcatcattgtttctgcatgaatatcatacaaatcagttagtttttaggtcaagggcttactatttctgggtcttttgctactaagttcacattagaattagtgccagaattttaggaacttcagagatcgtgtattgagatttcttaaataatgcttcagatattattgctttattgcttttttgtattggttaaaactgtacatttaaaattgctatgttactattttctacaattaatagtttgtctattttaaaataaattagttgttaagagtctt

SEQ ID NO: 440779 - DNA, 2736 bp, Homo sapiens
cccgcggttggacgcggcgctcagttgccgggcgggggagggcgcgtccggtttttctcaggggacgttgaaattatttttgtaacgggagtcgggagaggacggggcgtgccccgacgtgcgcgcgcgtcgtcctccccggcgctcctccacagctcgctggctcccgccgcggaaaggcgtcatgccgcccaaaaccccccgaaaaacggccgccaccgccgccgctgccgccgcggaacccccggcaccgccgccgccgccccctcctgaggaggacccagagcaggacagcggcccggaggacctgcctctcgtcaggcttgagtttgaagaaacagaagaacctgattttactgcattatgtcagaaattaaagataccagatcatgtcagagagagagcttggttaacttgggagaaagtttcatctgtggatggagtattgggaggttatattcaaaagaaaaaggaactgtggggaatctgtatctttattgcagcagttgacctagatgagatgtcgttcacttttactgagctacagaaaaacatagaaatcagtgtccataaattctttaacttactaaaagaaattgataccagtaccaaagttgataatgctatgtcaagactgttgaagaagtatgatgtattgtttgcactcttcagcaaattggaaaggacatgtgaacttatatatttgacacaacccagcagttcgatatctactgaaataaattctgcattggtgctaaaagtttcttggatcacatttttattagctaaaggggaagtattacaaatggaagatgatctggtgatttcatttcagttaatgctatgtgtccttgactattttattaaactctcacctcccatgttgctcaaagaaccatataaaacagctgttatacccattaatggttcacctcgaacacccaggcgaggtcagaacaggagtgcacggatagcaaaacaactagaaaatgatacaagaattattgaagttctctgtaaagaacatgaatgtaatatagatgaggtgaaaaatgtttatttcaaaaattttataccttttatgaattctcttggacttgtaacatctaatggacttccagaggttgaaaatctttctaaacgatacgaagaaatttatcttaaaaataaagatctagatgcaagattatttttggatcatgataaaactcttcagactgattctatagacagttttgaaacacagagaacaccacgaaaaagtaaccttgatgaagaggtgaatgtaattcctccacacactccagttaggactgttatgaacactatccaacaattaatgatgattttaaattcagcaagtgatcaaccttcagaaaatctgatttcctattttaacaactgcacagtgaatccaaaagaaagtatactgaaaagagtgaaggatataggatacatctttaaagagaaatttgctaaagctgtgggacagggttgtgtcgaaattggatcacagcgatacaaacttggagttcgcttgtattaccgagtaatggaatccatgcttaaatcagaagaagaacgattatccattcaaaattttagcaaacttctgaatgacaacatttttcatatgtctttattggcgtgcgctcttgaggttgtaatggccacatatagcagaagtacatctcagaatcttgattctggaacagatttgtctttcccatggattctgaatgtgcttaatttaaaagcctttgatttttacaaagtgatcgaaagttttatcaaagcagaaggcaacttgacaagagaaatgataaaacatttagaacgatgtgaacatcgaatcatggaatcccttgcatggctctcagattcacctttatttgatcttattaaacaatcaaaggaccgagaaggaccaactgatcaccttgaatctgcttgtcctcttaatcttcctctccagaataatcacactgcagcagatatgtatctttctcctgtaagatctccaaagaaaaaaggttcaactacgcgtgtaaattctactgcaaatgcagagacacaagcaacctcagccttccagacccagaagccattgaaatctacctctctttcactgttttataaaaaagtgtatcggctagcctatctccggctaaatacactttgtgaacgccttctgtctgagcacccagaattagaacatatcatctggacccttttccagcacaccctgcagaatgagtatgaactcatgagagacaggcatttggaccaaattatgatgtgttccatgtatggcatatgcaaagtgaagaatatagaccttaaattcaaaatcattgtaacagcatacaaggatcttcctcatgctgttcaggagacattcaaacgtgttttgatcaaagaagaggagtatgattctattatagtattctataactcggtcttcatgcagagactgaaaacaaatattttgcagtatgcttccaccaggccccctaccttgtcaccaatacctcacattcctcgaagcccttacaagtttcctagttcacccttacggattcctggagggaacatctatatttcacccctgaagagtccatataaaatttcagaaggtctgccaacaccaacaaaaatgactccaagatcaaggtgtgtgttttctctttagggaagtagtaaagaatgagagggggattattttgatccaagaat

SEQ ID NO: 440780 - DNA, 2014 bp, Homo sapiens
cccgcggttggacgcggcgctcagttgccgggcgggggagggcgcgtccggtttttctcaggggacgttgaaattatttttgtaacgggagtcgggagaggacggggcgtgccccgacgtgcgcgcgcgtcgtcctccccggcgctcctccacagctcgctggctcccgccgcggaaaggcgtcatgccgcccaaaaccccccgaaaaacggccgccaccgccgccgctgccgccgcggaacccccggcaccgccgccgccgccccctcctgaggaggacccagagcaggacagcggcccggaggacctgcctctcgtcaggcttgagtttgaagaaacagaagaacctgattttactgcattatgtcagaaattaaagataccagatcatgtcagagagagagcttggttaacttgggagaaagtttcatctgtggatggagtattgggaggttatattcaaaagaaaaaggaactgtggggaatctgtatctttattgcagcagttgacctagatgagatgtcgttcacttttactgagctacagaaaaacatagaaatcagtgtccataaattctttaacttactaaaagaaattgataccagtaccaaagttgataatgctatgtcaagactgttgaagaagtatgatgtattgtttgcactcttcagcaaattggaaaggacatgtgaacttatatatttgacacaacccagcagttcgatatctactgaaataaattctgcattggtgctaaaagtttcttggatcacatttttattagctaaaggggaagtattacaaatggaagatgatctggtgatttcatttcagttaatgctatgtgtccttgactattttattaaactctcacctcccatgttgctcaaagaaccatataaaacagctgttatacccattaatggttcacctcgaacacccaggcgaggtcagaacaggagtgcacggatagcaaaacaactagaaaatgatacaagaattattgaagttctctgtaaagaacatgaatgtaatatagatgaggtgaaaaatgtttatttcaaaaattttataccttttatgaattctcttggacttgtaacatctaatggacttccagaggttgaaaatctttctaaacgatacgaagaaatttatcttaaaaataaagatctagatgcaagattatttttggatcatgataaaactcttcagactgattctatagacagttttgaaacacagagaacaccacgaaaaagtaaccttgatgaagaggtgaatgtaattcctccacacactccagttaggactgttatgaacactatccaacaattaatgatgattttaaattcagcaagtgatcaaccttcagaaaatctgatttcctattttaacaactgcacagtgaatccaaaagaaagtatactgaaaagagtgaaggatataggatacatctttaaagagaaatttgctaaagctgtgggacagggttgtgtcgaaattggatcacagcgatacaaacttggagttcgcttgtattaccgagtaatggaatccatgcttaaatcagaagaagaacgattatccattcaaaattttagcaaacttctgaatgacaacatttttcatatgtctttattggcgtgcgctcttgaggttgtaatggccacatatagcagaagtacatctcagaatcttgattctggaacagatttgtctttcccatggattctgaatgtgcttaatttaaaagcctttgatttttacaaagtgatcgaaagttttatcaaagcagaaggcaacttgacaagagaaatgataaaacatttagaacgatgtgaacatcgaatcatggaatcccttgcatggctctcagtgatcctgccttatcctggagaaagaaatgttatgcaagaggccaagaagaagctaaacaaacaagccatgatggattcccatctcagcttattaccattgggacatgtcctttttgtccaatcacatttctac

SEQ ID NO: 440781 - DNA, 744 bp, Homo sapiens
cccgcggttggacgcggcgctcagttgccgggcgggggagggcgcgtccggtttttctcaggggacgttgaaattatttttgtaacgggagtcgggagaggacggggcgtgccccgacgtgcgcgcgcgtcgtcctccccggcgctcctccacagctcgctggctcccgccgcggaaaggcgtcatgccgcccaaaaccccccgaaaaacggccgccaccgccgccgctgccgccgcggaacccccggcaccgccgccgccgccccctcctgaggaggacccagagcaggacagcggcccggaggacctgcctctcgtcaggcttgagtttgaagaaacagaagaacctgattttactgcattatgtcagaaattaaagataccagatcatgtcagagagagagcttggttaacttgggagaaagtttcatctgtggatggagtattggtaaggattttcttaaaacgttttgaaatttttttttctcattttaaaaacaacttcaaatcactatacaaaaattgaaagatagaaaaatataaagacaataaaagctaataataattccattacccagaggaaatttacctctgctaacattaaaaatgtttgaggccgggcacggtggttcatgcctgtaatcctaccactttgggaggctgaggcaggtggattgcctgagctcaggagttcgagaccagcctgggcaacatggtgaaaccctgtctctactaaaatacaaa

SEQ ID NO: 440782 - DNA, 721 bp, Homo sapiens
cttaaattcaaaatcattgtaacagcatacaaggatcttcctcatgctgttcaggaggtaggtaattttccatagtaagtttttttgataaatccatatccataacataacataggtaattcatttgatctcatttattcattaatgagatcatatattctgtctgaccttattatgtaaattcacaaataaaaacttttatattatttatttgtaacttaaatagaattggaaagataagggtaattatgaaattacccatattcatagttttttataaagttaataaataatattttatccctgtaataagcaggtatttgtaataaacttgacatgagtcatagaacattagatattctttgaagttatttttattactttataggaaaagccagtataaatgcagccttgcaaatcaataatacaaatgttcagtataaacacattttgtgtttccggtttaccttccctttagagaaatagtagtagtaaaatatacttggtatgacacatttcatattgttctgtggaaagtgagttgaggggtatttttcccatttattattggagttttcaaaagtaatacaaaccaagtcatttttgtttgtatgtttgaagttattttctaaattcaatcattttaattgtatatatcagaggcatctgatataacctctgtgtttttccctaaaatttgagtgaaatctaactatcacta

SEQ ID NO: 440783 - DNA, 695 bp, Homo sapiens
atacaaaaattctttaatgaaatctgtgcctctgtgtgctgagagatgtaatgacatgtaaaggataattgtcagtgacttttttctttcaaggttgaaaatctttctaaacgatacgaagaaatttatcttaaaaataaagatctagatgcaagattatttttggatcatgataaaactcttcagactgattctatagacaggtattgcacatggtatatttgattgatttgctttagatataggttgatactgatataggtagattatatagtctttagcttagtgacctttagatatcatttataacaaattactttcaaatgtctttatacaaagaaaagtttaacagtattttaagcatataacttatctacaaatatagatttaatgtgaattgtgtgtcctataacagttacctttttgcagttaactgaatataattttttaaaatgtgcaccaaaagataatggctaaagtaattagtttcttcaaatagtggtctctaccttatttctatcctttcatatactattgcctgcctggtttatttaaaaaagtttatacaaaagtgtagtctctgttattatcatgtagaaacctaaaattggaatggttgagagtgattgttaaaatttttgactgatcataagtaaagttaattttgtgtctttagcatgaactcttttaatatg

SEQ ID NO: 440784 - DNA, 385 bp, Homo sapiens
tttactttccttcacagaagtgttttgctgctttgaagtatatttgacttaccatgcaagcaaatatttttcactgtgtggtatccttattttggaatgaccatgaaaaagataatcatatgtttaaatttgaagtgtaatgtttttctaagataaaataagatcttaaagtatttaataatgttctttttcacagtagtgttatgtgcaaactattgaaacaagtatgtactgaatcaatttgatttataagtatatgccaattatatgattattttcatttggtaggcttgagtttgaagaaacagaagaacctgattttactgcattatgtcagaaattaaagataccagatcatgtcagagagagagcttggttaacttgg

SEQ ID NO: 440785 - DNA, 4887 bp, Homo sapiens
cccgcggttggacgcggcgctcagttgccgggcgggggagggcgcgtccggtttttctcaggggacgttgaaattatttttgtaacgggagtcgggagaggacggggcgtgccccgacgtgcgcgcgcgtcgtcctccccggcgctcctccacagctcgctggctcccgccgcggaaaggcgtcatgccgcccaaaaccccccgaaaaacggccgccaccgccgccgctgccgccgcggaacccccggcaccgccgccgccgccccctcctgaggaggacccagagcaggacagcggcccggaggacctgcctctcgtcaggcttgagtttgaagaaacagaagaacctgattttactgcattatgtcagaaattaaagataccagatcatgtcagagagagagcttggttaacttgggagaaagtttcatctgtggatggagtattgggaggttatattcaaaagaaaaaggaactgtggggaatctgtatctttattgcagcagttgacctagatgagatgtcgttcacttttactgagctacagaaaaacatagaaatcagtgtccataaattctttaacttactaaaagaaattgataccagtaccaaagttgataatgctatgtcaagactgttgaagaagtatgatgtattgtttgcactcttcagcaaattggaaaggacatgtgaacttatatatttgacacaacccagcagttcgatatctactgaaataaattctgcattggtgctaaaagtttcttggatcacatttttattagctaaaggggaagtattacaaatggaagatgatctggtgatttcatttcagttaatgctatgtgtccttgactattttattaaactctcacctcccatgttgctcaaagaaccatataaaacagctgttatacccattaatggttcacctcgaacacccaggcgaggtcagaacaggagtgcacggatagcaaaacaactagaaaatgatacaagaattattgaagttctctgtaaagaacatgaatgtaatatagatgaggtgaaaaatgtttatttcaaaaattttataccttttatgaattctcttggacttgtaacatctaatggacttccagaggttgaaaatctttctaaacgatacgaagaaatttatcttaaaaataaagatctagatgcaagattatttttggatcatgataaaactcttcagactgattctatagacagttttgaaacacagagaacaccacgaaaaagtaaccttgatgaagaggtgaatgtaattcctccacacactccagttaggactgttatgaacactatccaacaattaatgatgattttaaattcagcaagtgatcaaccttcagaaaatctgatttcctattttaacaactgcacagtgaatccaaaagaaagtatactgaaaagagtgaaggatataggatacatctttaaagagaaatttgctaaagctgtgggacagggttgtgtcgaaattggatcacagcgatacaaacttggagttcgcttgtattaccgagtaatggaatccatgcttaaatcagaagaagaacgattatccattcaaaattttagcaaacttctgaatgacaacatttttcatatgtctttattggcgtgcgctcttgaggttgtaatggccacatatagcagaagtacatctcagaatcttgattctggaacagatttgtctttcccatggattctgaatgtgcttaatttaaaagcctttgatttttacaaagtgatcgaaagttttatcaaagcagaaggcaacttgacaagagaaatgataaaacatttagaacgatgtgaacatcgaatcatggaatcccttgcatggctctcagattcacctttatttgatcttattaaacaatcaaaggaccgagaaggaccaactgatcaccttgaatctgcttgtcctcttaatcttcctctccagaataatcacactgcagcagatatgtatctttctcctgtaagatctccaaagaaaaaaggttcaactacgcgtgtaaattctactgcaaatgcagagacacaagcaacctcagccttccagacccagaagccattgaaatctacctctctttcactgttttataaaaaagtgtatcggctagcctatctccggctaaatacactttgtgaacgccttctgtctgagcacccagaattagaacatatcatctggacccttttccagcacaccctgcagaatgagtatgaactcatgagagacaggcatttggaccaaattatgatgtgttccatgtatggcatatgcaaagtgaagaatatagaccttaaattcaaaatcattgtaacagcatacaaggatcttcctcatgctgttcaggagacattcaaacgtgttttgatcaaagaagaggagtatgattctattatagtattctataactcggtcttcatgcagagactgaaaacaaatattttgcagtatgcttccaccaggccccctaccttgtcaccaatacctcacattcctcgaagcccttacaagtttcctagttcacccttacggattcctggagggaacatctatatttcacccctgaagagtccatataaaatttcagaaggtctgccaacaccaacaaaaatgactccaagatcaagaatcttagtatcaattggtgaatcattcgggacttctgagaagttccagaaaataaatcagatggtatgtaacagcgaccgtgtgctcaaaagaagtgctgaaggaagcaaccctcctaaaccactgaaaaaactacgctttgatattgaaggatcagatgaagcagatggaagtaaacatctcccaggagagtccaaatttcagcagaaactggcagaaatgacttctactcgaacacgaatgcaaaagcagaaaatgaatgatagcatggatacctcaaacaaggaagagaaatgaggatctcaggaccttggtggacactgtgtacacctctggattcattgtctctcacagatgtgactgtataactttcccaggttctgtttatggccacatttaatatcttcagctctttttgtggatataaaatgtgcagatgcaattgtttgggtgattcctaagccacttgaaatgttagtcattgttatttatacaagattgaaaatcttgtgtaaatcctgccatttaaaaagttgtagcagattgtttcctcttccaaagtaaaattgctgtgctttatggatagtaagaatggccctagagtgggagtcctgataacccaggcctgtctgactactttgccttcttttgtagcatataggtgatgtttgctcttgtttttattaatttatatgtatatttttttaatttaacatgaacacccttagaaaatgtgtcctatctatcttccaaatgcaatttgattgactgcccattcaccaaaattatcctgaactcttctgcaaaaatggatattattagaaattagaaaaaaattactaattttacacattagattttattttactattggaatctgatatactgtgtgcttgttttataaaattttgcttttaattaaataaaagctggaagcaaagtataaccatatgatactatcatactactgaaacagatttcatacctcagaatgtaaaagaacttactgattattttcttcatccaacttatgtttttaaatgaggattattgatagtactcttggtttttataccattcagatcactgaatttataaagtacccatctagtacttgaaaaagtaaagtgttctgccagatcttaggtatagaggaccctaacacagtatatcccaagtgcactttctaatgtttctgggtcctgaagaattaagatacaaattaattttactccataaacagactgttaattataggagccttaatttttttttcatagagatttgtctaattgcatctcaaaattattctgccctccttaatttgggaaggtttgtgttttctctggaatggtacatgtcttccatgtatcttttgaactggcaattgtctatttatcttttatttttttaagtcagtatggtctaacactggcatgttcaaagccacattatttctagtccaaaattacaagtaatcaagggtcattatgggttaggcattaatgtttctatctgattttgtgcaaaagcttcaaattaaaacagctgcattagaaaaagaggcgcttctccccttcccctacacctaaaggtgtatttaaactatcttgtgtgattaacttatttagagatgctgtaacttaaaataggggatatttaaggtagcttcagctagcttttaggaaaatcactttgtctaactcagaattatttttaaaaagaaatctggtcttgttagaaaacaaaattttattttgtgctcatttaagtttcaaacttactattttgacagttattttgataacaatgacactagaaaacttgactccatttcatcattgtttctgcatgaatatcatacaaatcagttagtttttaggtcaagggcttactatttctgggtcttttgctactaagttcacattagaattagtgccagaattttaggaacttcagagatcgtgtattgagatttcttaaataatgcttcagatattattgctttattgcttttttgtattggttaaaactgtacatttaaaattgctatgttactattttctacaattaatagtttgtctattttaaaataaattagttgttaagagtcttaatggtctgatgttgtgttctttgtattaagtacactaatgttctcttttctgtctaggagaagatagatagaagataactctcctagtatctcatcc

SEQ ID NO: 440786 - DNA, 4319 bp, Homo sapiens
cccgcggttggacgcggcgctcagttgccgggcgggggagggcgcgtccggtttttctcaggggacgttgaaattatttttgtaacgggagtcgggagaggacggggcgtgccccgacgtgcgcgcgcgtcgtcctccccggcgctcctccacagctcgctggctcccgccgcggaaaggcgtcatgccgcccaaaaccccccgaaaaacggccgccaccgccgccgctgccgccgcggaacccccggcaccgccgccgccgccccctcctgaggaggacccagagcaggacagcggcccggaggacctgcctctcgtcaggggaagtattacaaatggaagatgatctggtgatttcatttcagttaatgctatgtgtccttgactattttattaaactctcacctcccatgttgctcaaagaaccatataaaacagctgttatacccattaatggttcacctcgaacacccaggcgaggtcagaacaggagtgcacggatagcaaaacaactagaaaatgatacaagaattattgaagttctctgtaaagaacatgaatgtaatatagatgaggtgaaaaatgtttatttcaaaaattttataccttttatgaattctcttggacttgtaacatctaatggacttccagaggttgaaaatctttctaaacgatacgaagaaatttatcttaaaaataaagatctagatgcaagattatttttggatcatgataaaactcttcagactgattctatagacagttttgaaacacagagaacaccacgaaaaagtaaccttgatgaagaggtgaatgtaattcctccacacactccagttaggactgttatgaacactatccaacaattaatgatgattttaaattcagcaagtgatcaaccttcagaaaatctgatttcctattttaacaactgcacagtgaatccaaaagaaagtatactgaaaagagtgaaggatataggatacatctttaaagagaaatttgctaaagctgtgggacagggttgtgtcgaaattggatcacagcgatacaaacttggagttcgcttgtattaccgagtaatggaatccatgcttaaatcagaagaagaacgattatccattcaaaattttagcaaacttctgaatgacaacatttttcatatgtctttattggcgtgcgctcttgaggttgtaatggccacatatagcagaagtacatctcagaatcttgattctggaacagatttgtctttcccatggattctgaatgtgcttaatttaaaagcctttgatttttacaaagtgatcgaaagttttatcaaagcagaaggcaacttgacaagagaaatgataaaacatttagaacgatgtgaacatcgaatcatggaatcccttgcatggctctcagattcacctttatttgatcttattaaacaatcaaaggaccgagaaggaccaactgatcaccttgaatctgcttgtcctcttaatcttcctctccagaataatcacactgcagcagatatgtatctttctcctgtaagatctccaaagaaaaaaggttcaactacgcgtgtaaattctactgcaaatgcagagacacaagcaacctcagccttccagacccagaagccattgaaatctacctctctttcactgttttataaaaaagtgtatcggctagcctatctccggctaaatacactttgtgaacgccttctgtctgagcacccagaattagaacatatcatctggacccttttccagcacaccctgcagaatgagtatgaactcatgagagacaggcatttggaccaaattatgatgtgttccatgtatggcatatgcaaagtgaagaatatagaccttaaattcaaaatcattgtaacagcatacaaggatcttcctcatgctgttcaggagacattcaaacgtgttttgatcaaagaagaggagtatgattctattatagtattctataactcggtcttcatgcagagactgaaaacaaatattttgcagtatgcttccaccaggccccctaccttgtcaccaatacctcacattcctcgaagcccttacaagtttcctagttcacccttacggattcctggagggaacatctatatttcacccctgaagagtccatataaaatttcagaaggtctgccaacaccaacaaaaatgactccaagatcaagaatcttagtatcaattggtgaatcattcgggacttctgagaagttccagaaaataaatcagatggtatgtaacagcgaccgtgtgctcaaaagaagtgctgaaggaagcaaccctcctaaaccactgaaaaaactacgctttgatattgaaggatcagatgaagcagatggaagtaaacatctcccaggagagtccaaatttcagcagaaactggcagaaatgacttctactcgaacacgaatgcaaaagcagaaaatgaatgatagcatggatacctcaaacaaggaagagaaatgaggatctcaggaccttggtggacactgtgtacacctctggattcattgtctctcacagatgtgactgtataactttcccaggttctgtttatggccacatttaatatcttcagctctttttgtggatataaaatgtgcagatgcaattgtttgggtgattcctaagccacttgaaatgttagtcattgttatttatacaagattgaaaatcttgtgtaaatcctgccatttaaaaagttgtagcagattgtttcctcttccaaagtaaaattgctgtgctttatggatagtaagaatggccctagagtgggagtcctgataacccaggcctgtctgactactttgccttcttttgtagcatataggtgatgtttgctcttgtttttattaatttatatgtatatttttttaatttaacatgaacacccttagaaaatgtgtcctatctatcttccaaatgcaatttgattgactgcccattcaccaaaattatcctgaactcttctgcaaaaatggatattattagaaattagaaaaaaattactaattttacacattagattttattttactattggaatctgatatactgtgtgcttgttttataaaattttgcttttaattaaataaaagctggaagcaaagtataaccatatgatactatcatactactgaaacagatttcatacctcagaatgtaaaagaacttactgattattttcttcatccaacttatgtttttaaatgaggattattgatagtactcttggtttttataccattcagatcactgaatttataaagtacccatctagtacttgaaaaagtaaagtgttctgccagatcttaggtatagaggaccctaacacagtatatcccaagtgcactttctaatgtttctgggtcctgaagaattaagatacaaattaattttactccataaacagactgttaattataggagccttaatttttttttcatagagatttgtctaattgcatctcaaaattattctgccctccttaatttgggaaggtttgtgttttctctggaatggtacatgtcttccatgtatcttttgaactggcaattgtctatttatcttttatttttttaagtcagtatggtctaacactggcatgttcaaagccacattatttctagtccaaaattacaagtaatcaagggtcattatgggttaggcattaatgtttctatctgattttgtgcaaaagcttcaaattaaaacagctgcattagaaaaagaggcgcttctccccttcccctacacctaaaggtgtatttaaactatcttgtgtgattaacttatttagagatgctgtaacttaaaataggggatatttaaggtagcttcagctagcttttaggaaaatcactttgtctaactcagaattatttttaaaaagaaatctggtcttgttagaaaacaaaattttattttgtgctcatttaagtttcaaacttactattttgacagttattttgataacaatgacactagaaaacttgactccatttcatcattgtttctgcatgaatatcatacaaatcagttagtttttaggtcaagggcttactatttctgggtcttttgctactaagttcacattagaattagtgccagaattttaggaacttcagagatcgtgtattgagatttcttaaataatgcttcagatattattgctttattgcttttttgtattggttaaaactgtacatttaaaattgctatgttactattttctacaattaatagtttgtctattttaaaataaattagttgttaagagtctt

SEQ ID NO: 440787 - DNA, 5103 bp, Homo sapiens
cccgcggttggacgcggcgctcagttgccgggcgggggagggcgcgtccggtttttctcaggggacgttgaaattatttttgtaacgggagtcgggagaggacggggcgtgccccgacgtgcgcgcgcgtcgtcctccccggcgctcctccacagctcgctggctcccgccgcggaaaggcgtcatgccgcccaaaaccccccgaaaaacggccgccaccgccgccgctgccgccgcggaacccccggcaccgccgccgccgccccctcctgaggaggacccagagcaggacagcggcccggaggacctgcctctcgtcaggcttgagtttgaagaaacagaagaacctgattttactgcattatgtcagaaattaaagataccagatcatgtcagagagagagcttggttaacttgggagaaagtttcatctgtggatggagtattgggaggttatattcaaaagaaaaaggaactgtggggaatctgtatctttattgcagcagttgacctagatgagatgtcgttcacttttactgagctacagaaaaacatagaaatcagtgtccataaattctttaacttactaaaagaaattgataccagtaccaaagttgataatgctatgtcaagactgttgaagaagtatgatgtattgtttgcactcttcagcaaattggaaaggacatgtgaacttatatatttgacacaacccagcagttcgatatctactgaaataaattctgcattggtgctaaaagtttcttggatcacatttttattagctaaaggggaagtattacaaatggaagatgatctggtgatttcatttcagttaatgctatgtgtccttgactattttattaaactctcacctcccatgttgctcaaagaaccatataaaacagctgttatacccattaatggttcacctcgaacacccaggcgaggtcagaacaggagtgcacggatagcaaaacaactagaaaatgatacaagaattattgaagttctctgtaaagaacatgaatgtaatatagatgaggtgaaaaatgtttatttcaaaaattttataccttttatgaattctcttggacttgtaacatctaatggacttccagaggttgaaaatctttctaaacgatacgaagaaatttatcttaaaaataaagatctagatgcaagattatttttggatcatgataaaactcttcagactgattctatagacagttttgaaacacagagaacaccacgaaaaagtaaccttgatgaagaggtgaatgtaattcctccacacactccagttaggactgttatgaacactatccaacaattaatgatgattttaaattcagcaagtgatcaaccttcagaaaatctgatttcctattttaacaactgcacagtgaatccaaaagaaagtatactgaaaagagtgaaggatataggatacatctttaaagagaaatttgctaaagctgtgggacagggttgtgtcgaaattggatcacagcgatacaaacttggagttcgcttgtattaccgagtaatggaatccatgcttaaatcagaagaagaacgattatccattcaaaattttagcaaacttctgaatgacaacatttttcatatgtctttattggcgtgcgctcttgaggttgtaatggccacatatagcagaagtacatctcagaatcttgattctggaacagatttgtctttcccatggattctgaatgtgcttaatttaaaagcctttgatttttacaaagtgatcgaaagttttatcaaagcagaaggcaacttgacaagagaaatgataaaacatttagaacgatgtgaacatcgaatcatggaatcccttgcatggctctcagattcacctttatttgatcttattaaacaatcaaaggaccgagaaggaccaactgatcaccttgaatctgcttgtcctcttaatcttcctctccagaataatcacactgcagcagatatgtatctttctcctgtaagatctccaaagaaaaaaggttcaactacgcgtgtaaattctactgcaaatgcagagacacaagcaacctcagccttccagacccagaagccattgaaatctacctctctttcactgttttataaaaaagtgtatcggctagcctatctccggctaaatacactttgtgaacgccttctgtctgagcacccagaattagaacatatcatctggacccttttccagcacaccctgcagaatgagtatgaactcatgagagacaggcatttggaccaaattatgatgtgttccatgtatggcatatgcaaagtgaagaatatagaccttaaattcaaaatcattgtaacagcatacaaggatcttcctcatgctgttcaggagacattcaaacgtgttttgatcaaagaagaggagtatgattctattatagtattctataactcggtcttcatgcagagactgaaaacaaatattttgcagtatgcttccaccaggccccctaccttgtcaccaatacctcacattcctcgaagcccttacaagtttcctagttcacccttacggattcctggagggaacatctatatttcacccctgaagagtccatataaaatttcagaaggtctgccaacaccaacaaaaatgactccaagatcaagaatcttagtatcaattggtgaatcattcgggacttctgagaagttccagaaaataaatcagatggtatgtaacagcgaccgtgtgctcaaaagaagtgctgaaggaagcaaccctcctaaaccactgaaaaaactacgctttgatattgaaggatcagatgaagcagatggaagtaaacatctcccaggagagtccaaatttcagcagaaactggcagaaatgacttctactcgaacacgaatgcaaaagcagaaaatgaatgatagcatggatacctcaaacaaggaagagaaatgaggatctcaggaccttggtggacactgtgtacacctctggattcattgtctctcacagatgtgactgtataactttcccaggttctgtttatggccacatttaatatcttcagctctttttgtggatataaaatgtgcagatgcaattgtttgggtgattcctaagccacttgaaatgttagtcattgttatttatacaagattgaaaatcttgtgtaaatcctgccatttaaaaagttgtagcagattgtttcctcttccaaagtaaaattgctgtgctttatggatagtaagaatggccctagagtgggagtcctgataacccaggcctgtctgactactttgccttcttttgtagcatataggtgatgtttgctcttgtttttattaatttatatgtatatttttttaatttaacatgaacacccttagaaaatgtgtcctatctatcttccaaatgcaatttgattgactgcccattcaccaaaattatcctgaactcttctgcaaaaatggatattattagaaattagaaaaaaattactaattttacacattagattttattttactattggaatctgatatactgtgtgcttgttttataaaattttgcttttaattaaataaaagctggaagcaaagtataaccatatgatactatcatactactgaaacagatttcatacctcagaatgtaaaagaacttactgattattttcttcatccaacttatgtttttaaatgaggattattgatagtactcttggtttttataccattcagatcactgaatttataaagtacccatctagtacttgaaaaagtaaagtgttctgccagatcttaggtatagaggaccctaacacagtatatcccaagtgcactttctaatgtttctgggtcctgaagaattaagatacaaattaattttactccataaacagactgttaattataggagccttaatttttttttcatagagatttgtctaattgcatctcaaaattattctgccctccttaatttgggaaggtttgtgttttctctggaatggtacatgtcttccatgtatcttttgaactggcaattgtctatttatcttttatttttttaagtcagtatggtctaacactggcatgttcaaagccacattatttctagtccaaaattacaagtaatcaagggtcattatgggttaggcattaatgtttctatctgattttgtgcaaaagcttcaaattaaaacagctgcattagaaaaagaggcgcttctccccttcccctacacctaaaggtgtatttaaactatcttgtgtgattaacttatttagagatgctgtaacttaaaataggggatatttaaggtagcttcagctagcttttaggaaaatcactttgtctaactcagaattatttttaaaaagaaatctggtcttgttagaaaacaaaattttattttgtgctcatttaagtttcaaacttactattttgacagttattttgataacaatgacactagaaaacttgactccatttcatcattgtttctgcatgaatatcatacaaatcagttagtttttaggtcaagggcttactatttctgggtcttttgctactaagttcacattagaattagtgccagaattttaggaacttcagagatcgtgtattgagatttcttaaataatgcttcagatattattgctttattgcttttttgtattggttaaaactgtacatttaaaattgctatgttactattttctacaattaatagtttgtctattttaaaataaattagttgttaagagtcttaaaaaaaaaaaaaaaaaaaaaaaaaaaatttgtggggggcttggggccctgagaaaaaggttcttctagaaccattccggttggggcgcgcgcgggggcgcccagtagggtaagtagacctcggggccaaaagcggggtcccaaggagaaacccgggcgcaaatgcaataggggctgggattctcccccaaattaaaaaaggcccggggggcaaccgcgacgcgttcgtgaaaaaatcccaaagggagtccggaggccaataccgggccctttcacccgggggccccaggagaaccccgattataatttgccga

SEQ ID NO: 440788 - DNA, 3309 bp, Homo sapiens
aaattagagtcctgccttggaacaggttaaaggagggcaagagaaggtccgaggcctgcccctgaggcctaccacaccaaacgttataacaacacaacagtttttatatattttcagttttgcataatatgaagttaaagacttaagtaaattgagtaaatagtagtttttttttttttaatttcacagatcaatagagttaactcctgagttatatgcatacaaccccaaagttgtttgctgtctggagctgtgcctacacccgcctggcatattcttgagacattggagctaggaagttggaaattgatagaaaattttgtcacttgtaacagagctaaagcaatatggattatggtggaccctatcacttggaatactttcctgaaagcaacacaggattcacctttatttgatcttattaaacaatcaaaggaccgagaaggaccaactgatcaccttgaatctgcttgtcctcttaatcttcctctccagaataatcacactgcagcagatatgtatctttctcctgtaagatctccaaagaaaaaaggttcaactacgcgtgtaaattctactgcaaatgcagagacacaagcaacctcagccttccagacccagaagccattgaaatctacctctctttcactgttttataaaaaagtgtatcggctagcctatctccggctaaatacactttgtgaacgccttctgtctgagcacccagaattagaacatatcatctggacccttttccagcacaccctgcagaatgagtatgaactcatgagagacaggcatttggaccaaattatgatgtgttccatgtatggcatatgcaaagtgaagaatatagaccttaaattcaaaatcattgtaacagcatacaaggatcttcctcatgctgttcaggagacattcaaacgtgttttgatcaaagaagaggagtatgattctattatagtattctataactcggtcttcatgcagagactgaaaacaaatattttgcagtatgcttccaccaggccccctaccttgtcaccaatacctcacattcctcgaagcccttacaagtttcctagttcacccttacggattcctggagggaacatctatatttcacccctgaagagtccatataaaatttcagaaggtctgccaacaccaacaaaaatgactccaagatcaagaatcttagtatcaattggtgaatcattcgggacttctgagaagttccagaaaataaatcagatggtatgtaacagcgaccgtgtgctcaaaagaagtgctgaaggaagcaaccctcctaaaccactgaaaaaactacgctttgatattgaaggatcagatgaagcagatggaagtaaacatctcccaggagagtccaaatttcagcagaaactggcagaaatgacttctactcgaacacgaatgcaaaagcagaaaatgaatgatagcatggatacctcaaacaaggaagagaaatgaggatctcaggaccttggtggacactgtgtacacctctggattcattgtctctcacagatgtgactgtataactttcccaggttctgtttatggccacatttaatatcttcagctctttttgtggatataaaatgtgcagatgcaattgtttgggtgattcctaagccacttgaaatgttagtcattgttatttatacaagattgaaaatcttgtgtaaatcctgccatttaaaaagttgtagcagattgtttcctcttccaaagtaaaattgctgtgctttatggatagtaagaatggccctagagtgggagtcctgataacccaggcctgtctgactactttgccttcttttgtagcatataggtgatgtttgctcttgtttttattaatttatatgtatatttttttaatttaacatgaacacccttagaaaatgtgtcctatctatcttccaaatgcaatttgattgactgcccattcaccaaaattatcctgaactcttctgcaaaaatggatattattagaaattagaaaaaaattactaattttacacattagattttattttactattggaatctgatatactgtgtgcttgttttataaaattttgcttttaattaaataaaagctggaagcaaagtataaccatatgatactatcatactactgaaacagatttcatacctcagaatgtaaaagaacttactgattattttcttcatccaacttatgtttttaaatgaggattattgatagtactcttggtttttataccattcagatcactgaatttataaagtacccatctagtacttgaaaaagtaaagtgttctgccagatcttaggtatagaggaccctaacacagtatatcccaagtgcactttctaatgtttctgggtcctgaagaattaagatacaaattaattttactccataaacagactgttaattataggagccttaatttttttttcatagagatttgtctaattgcatctcaaaattattctgccctccttaatttgggaaggtttgtgttttctctggaatggtacatgtcttccatgtatcttttgaactggcaattgtctatttatcttttatttttttaagtcagtatggtctaacactggcatgttcaaagccacattatttctagtccaaaattacaagtaatcaagggtcattatgggttaggcattaatgtttctatctgattttgtgcaaaagcttcaaattaaaacagctgcattagaaaaagaggcgcttctccccttcccctacacctaaaggtgtatttaaactatcttgtgtgattaacttatttagagatgctgtaacttaaaataggggatatttaaggtagcttcagctagcttttaggaaaatcactttgtctaactcagaattatttttaaaaagaaatctggtcttgttagaaaacaaaattttattttgtgctcatttaagtttcaaacttactattttgacagttattttgataacaatgacactagaaaacttgactccatttcatcattgtttctgcatgaatatcatacaaatcagttagtttttaggtcaagggcttactatttctgggtcttttgctactaagttcacattagaattagtgccagaattttaggaacttcagagatcgtgtattgagatttcttaaataatgcttcagatattattgctttattgcttttttgtattggttaaaactgtacatttaaaattgctatgttactattttctacaattaatagtttgtctattttaaaataaattagttgttaagagtctt

SEQ ID NO: 440789 - DNA, 5468 bp, Homo sapiens
cccgcggttggacgcggcgctcagttgccgggcgggggagggcgcgtccggtttttctcaggggacgttgaaattatttttgtaacgggagtcgggagaggacggggcgtgccccgacgtgcgcgcgcgtcgtcctccccggcgctcctccacagctcgctggctcccgccgcggaaaggcgtcatgccgcccaaaaccccccgaaaaacggccgccaccgccgccgctgccgccgcggaacccccggcaccgccgccgccgccccctcctgaggaggacccagagcaggacagcggcccggaggacctgcctctcgtcaggcttgagtttgaagaaacagaagaacctgattttactgcattatgtcagaaattaaagataccagatcatgtcagagagagagcttggttaacttgggagaaagtttcatctgtggatggagtattgggaggttatattcaaaagaaaaaggaactgtggggaatctgtatctttattgcagcagttgacctagatgagatgtcgttcacttttactgagctacagaaaaacatagaaatcagtgtccataaattctttaacttactaaaagaaattgataccagtaccaaagttgataatgctatgtcaagactgttgaagaagtatgatgtattgtttgcactcttcagcaaattggaaaggacatgtgaacttatatatttgacacaacccagcagttcgatatctactgaaataaattctgcattggtgctaaaagtttcttggatcacatttttattagctaaaggggaagtattacaaatggaagatgatctggtgatttcatttcagttaatgctatgtgtccttgactattttattaaactctcacctcccatgttgctcaaagaaccatataaaacagctgttatacccattaatggttcacctcgaacacccaggcgaggtcagaacaggagtgcacggatagcaaaacaactagaaaatgatacaagaattattgaagttctctgtaaagaacatgaatgtaatatagatgaggtgaaaaatgtttatttcaaaaattttataccttttatgaattctcttggacttgtaacatctaatggacttccagaggttgaaaatctttctaaacgatacgaagaaatttatcttaaaaataaagatctagatgcaagattatttttggatcatgataaaactcttcagactgattctatagacagttttgaaacacagagaacaccacgaaaaagtaaccttgatgaagaggtgaatgtaattcctccacacactccagttaggactgttatgaacactatccaacaattaatgatgattttaaattcagcaagtgatcaaccttcagaaaatctgatttcctattttaacaactgcacagtgaatccaaaagaaagtatactgaaaagagtgaaggatataggatacatctttaaagagaaatttgctaaagctgtgggacagggttgtgtcgaaattggatcacagcgatacaaacttggagttcgcttgtattaccgagtaatggaatccatgcttaaatcagaagaagaacgattatccattcaaaattttagcaaacttctgaatgacaacatttttcatatgtctttattggcgtgcgctcttgaggttgtaatggccacatatagcagaagtacatctcagaatcttgattctggaacagatttgtctttcccatggattctgaatgtgcttaatttaaaagcctttgatttttacaaagtgatcgaaagttttatcaaagcagaaggcaacttgacaagagaaatgataaaacatttagaacgatgtgaacatcgaatcatggaatcccttgcatggctctcagattcacctttatttgatcttattaaacaatcaaaggaccgagaaggaccaactgatcaccttgaatctgcttgtcctcttaatcttcctctccagaataatcacactgcagcagatatgtatctttctcctgtaagatctccaaagaaaaaaggttcaactacgcgtgtaaattctactgcaaatgcagagacacaagcaacctcagccttccagacccagaagccattgaaatctacctctctttcactgttttataaaaaagtgtatcggctagcctatctccggctaaatacactttgtgaacgccttctgtctgagcacccagaattagaacatatcatctggacccttttccagcacaccctgcagaatgagtatgaactcatgagagacaggcatttggaccaaattatgatgtgttccatgtatggcatatgcaaagtgaagaatatagaccttaaattcaaaatcattgtaacagcatacaaggatcttcctcatgctgttcaggagacattcaaacgtgttttgatcaaagaagaggagtatgattctattatagtattctataactcggtcttcatgcagagactgaaaacaaatattttgcagtatgcttccaccaggccccctaccttgtcaccaatacctcacattcctcgaagcccttacaagtttcctagttcacccttacggattcctggagggaacatctatatttcacccctgaagagtccatataaaatttcagaaggtctgccaacaccaacaaaaatgactccaagatcaagaatcttagtatcaattggtgaatcattcgggacttctgagaagttccagaaaataaatcagatggtatgtaacagcgaccgtgtgctcaaaagaagtgctgaaggaagcaaccctcctaaaccactgaaaaaactacgctttgatattgaaggatcagatgaagcagatggaagtaaacatctcccaggagagtccaaatttcagcagaaactggcagaaatgacttctactcgaacacgaatgcaaaagcagaaaatgaatgatagcatggatacctcaaacaaggaagagaaatgaggatctcaggaccttggtggacactgtgtacacctctggattcattgtctctcacagatgtgactgtataactttcccaggttctgtttatggccacatttaatatcttcagctctttttgtggatataaaatgtgcagatgcaattgtttgggtgattcctaagccacttgaaatgttagtcattgttatttatacaagattgaaaatcttgtgtaaatcctgccatttaaaaagttgtagcagattgtttcctcttccaaagtaaaattgctgtgctttatggatagtaagaatggccctagagtgggagtcctgataacccaggcctgtctgactactttgccttcttttgtagcatataggtgatgtttgctcttgtttttattaatttatatgtatatttttttaatttaacatgaacacccttagaaaatgtgtcctatctatcttccaaatgcaatttgattgactgcccattcaccaaaattatcctgaactcttctgcaaaaatggatattattagaaattagaaaaaaattactaattttacacattagattttattttactattggaatctgatatactgtgtgcttgttttataaaattttgcttttaattaaataaaagctggaagcaaagtataaccatatgatactatcatactactgaaacagatttcatacctcagaatgtaaaagaacttactgattattttcttcatccaacttatgtttttaaatgaggattattgatagtactcttggtttttataccattcagatcactgaatttataaagtacccatctagtacttgaaaaagtaaagtgttctgccagatcttaggtatagaggaccctaacacagtatatcccaagtgcactttctaatgtttctgggtcctgaagaattaagatacaaattaattttactccataaacagactgttaattataggagccttaatttttttttcatagagatttgtctaattgcatctcaaaattattctgccctccttaatttgggaaggtttgtgttttctctggaatggtacatgtcttccatgtatcttttgaactggcaattgtctatttatcttttatttttttaagtcagtatggtctaacactggcatgttcaaagccacattatttctagtccaaaattacaagtaatcaagggtcattatgggttaggcattaatgtttctatctgattttgtgcaaaagcttcaaattaaaacagctgcattagaaaaagaggcgcttctccccttcccctacacctaaaggtgtatttaaactatcttgtgtgattaacttatttagagatgctgtaacttaaaataggggatatttaaggtagcttcagctagcttttaggaaaatcactttgtctaactcagaattatttttaaaaagaaatctggtcttgttagaaaacaaaattttattttgtgctcatttaagtttcaaacttactattttgacagttattttgataacaatgacactagaatttttaggtcaagggcttactatttctgggtcttttgctactaagttcacattagaattagtgccagaattttaggaacttcagagatcgtgtattgagatttcttaaataatgcttcagatattattgctttattgcttttttgtattggttaaaactgtacatttaaaattgctatgttactattttctacaattaatagtttgtctattttaaaataaattagttgttaagagtcttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaagaacacaaaaaaaaaaacacagcggagagaaaaaataaaaaaagaaaaacaacgaaaagagaaaaaaaaaaagaaaaaacacaacaagaaaacaaaaaggagaaaaaaaacacacgaaaagaaaaaaaagagaaaagaaaaaaaaagagaaaaaaaaaagaaaaaaaaagaaaaaaaaaagacgagagaaaaaaaaaagaaaaagagagaaggaaagaaaagaaaaagaaagagaaacgagaaaaaagagagagaagagaagaaaagaggaaaaaaggagagaaaagaaaaagaaaaagagaaagaaaaaaaaagagacaggacaaagagaagaaacaaaagaaaagaaaagtgaagaaaagaaagacggacgatgaaaagagaaagaaaaggacaaaggaaaggaaagagagaaaagaagaaaaaagaaagaagaaaagagtaggaaaggagaaggaagaaagaagagaagggagaagaaaagagaagcaagaagaggaagggcagagaagagagaagaaagaaagaaagagagagaaagaaagaggaaggtaagaacaagaaaaaaggagaagtgtagcgaaaatagaaaaagaa

SEQ ID NO: 440790 - DNA, 1634 bp, Homo sapiens
cccgcggttggacgcggcgctcagttgccgggcgggggagggcgcgtccggtttttctcaggggacgttgaaattatttttgtaacgggagtcgggagaggacggggcgtgccccgacgtgcgcgcgcgtcgtcctccccggcgctcctccacagctcgctggctcccgccgcggaaaggcgtcatgccgcccaaaaccccccgaaaaacggccgccaccgccgccgctgccgccgcggaacccccggcaccgccgccgccgccccctcctgaggaggacccagagcaggacagcggcccggaggacctgcctctcgtcaggcttgagtttgaagaaacagaagaacctgattttactgcattatgtcagaaattaaagataccagatcatgtcagagagagagcttggttaacttgggagaaagtttcatctgtggatggagtattgggaggttatattcaaaagaaaaaggaactgtggggaatctgtatctttattgcagcagttgacctagatgagatgtcgttcacttttactgagctacagaaaaacatagaaatcagtgtccataaattctttaacttactaaaagaaattgataccagtaccaaagttgataatgctatgtcaagactgttgaagaagtatgatgtattgtttgcactcttcagcaaattggaaaggacatgtgaacttatatatttgacacaacccagcagttcgatatctactgaaataaattctgcattggtgctaaaagtttcttggatcacatttttattagctaaaggggaagtattacaaatggaagatgatctggtgatttcatttcagttaatgctatgtgtccttgactattttattaaactctcacctcccatgttgctcaaagaaccatataaaacagctgttatacccattaatggttcacctcgaacacccaggcgaggtcagaacaggagtgcacggatagcaaaacaactagaaaatgatacaagaattattgaagttctctgtaaagaacatgaatgtaatatagatgaggtgaaaaatgtttatttcaaaaattttataccttttatgaattctcttggacttgtaacatctaatggacttccagaggttgaaaatctttctaaacgatacgaagaaatttatcttaaaaataaagatctagatgcaagattatttttggatcatgataaaactcttcagactgattctatagacagttttgaaacacagagaacaccacgaaaaagtaaccttgatgaagaggtgaatgtaattcctccacacactccagttaggactgttatgaacactatccaacaattaatgatgattttaaattcagcaagtgatcaaccttcagaaaatctgatttcctattttaacaactgcacagtgaatccaaaagaaagtatactgaaaagagtgaaggatataggatacatctttaaagagaaatttgctaaagctgtgggacagggttgtgtcgaaattggatcacagcgatacaaacttggagttcgcttgtattaccgagtaatggaatccatgcttaaatcagaagaagaacgattatccattcaaattctagcaaacttctgcatcacgatacgatttcggg

SEQ ID NO: 440791 - DNA, 4518 bp, Homo sapiens
gggagctggtaggagtccctgtccacaggtcctggctaccctgggaagagacaagaagtaaatgaagaaagaggaagattccaggacctagatatgatttctgtggacacccttcactggtgactgaagtttctaaatagaaatttaaggcagatccagaggagacaaagacagagtatcccaggtgctggccatttcccacaacagaagaaaatgatcaatgcccaggaattgctgacactggaggatgttactgtggagttcacctgggaggagtggcagctcctgggcccttttcagaaggatttgtaccgggatgtgatgttggagatctacagcaacctgctatcaatgggttatcaagtcagcaaaccagatgcactctccaagttggaacgaggagaagaaccatggacaatggaagatgaaaggcacagtcgaatctgtccagaaaacaacgaagttgatgatcatctgcaggatcacttggaaaatcaaaggatgctgaagagtgtggaacaataccatgaacataatgcatttggaaatactgcctctcaaaccaaaagcctttgtcttttcagggaaaatcatgatacatttgagttatatataaaaactttgaaatcaaatttaagtttagtcaaccagaacaaaagctgtgaaattaacaactctactaaatttagtggagatgggaaatcatttcttcatggtaactatgaagaactttattctgcagctaaattctctgtaagtacaaaagccaatagcactaaatcccaagtcagtaagcatcagagaactcatgaaatagaaaaaaaccacgtatgcagtgaatgtgggaaagcgtttgtcaagaagtctcagctcactgatcatgagagagttcatacaggagaaaaaccttatggatgtactttgtgtgcaaaagtgttctccagaaagtccaggctaaatgaacatcaaagaattcataaaagagagaaatcttttatatgcagtgaatgtggaaaagtcttcactatgaagagccgtctgattgaacatcagcgaactcatactggagagaaaccctacatatgcaatgaatgtggaaaaggcttcccaggcaagcgtaatctcattgtacatcagcgaaatcatactggagagaaatcctatatatgtagtgaatgtggaaaaggcttcactgggaagagcatgcttattatacatcagcgaactcatacaggagagaagccctacatctgtagtgaatgtgggaaaggcttcaccacaaaacactatgtcatcatacatcaacgaaatcatacaggagagaaaccatatatatgcaatgaatgtgggaaaggcttcaccatgaagagccgtatgatcgaacatcaacgaactcatacaggagagaaaccctacatatgcagtgaatgtggaaaaggctttcccaggaagagtaatcttattgtacatcagagaaatcatacagtagagaagtcatatctatgtagtgaatgtggaaaaggttttactgtgaaaagcatgctcatcatacatcagcgaactcatacaggagagaagccctacacatgcagtgaatgtgggaaaggcttccccttgaagagtcggctgattgtacatcagcgaactcatactggagagaaaccttacaggtgcagtgaatgtgggaaaggtttcattgtgaatagcggactgatgttacatcagcgaactcatactggagagaaaccgtacatatgcaatgaatgtggaaaaggttttgcctttaagagcaatcttgttgtacaccagcgaactcatactggagagaaaccctttatgtgcagtgaatgtggaaaaggcttcaccatgaaacgctatctcattgtacatcagcaaattcatacagaagagaaatcttgtatatgtagtgaatgtggaagaggctttgccaaggaaacagagcttgctttacataagcaagttcatactggagaaaaaccttatggatgtaatgaatgtggtaaaggcttcactatgaagagccgtctaattgttcatcaacgaactcatacaggagagaaaccctttgtatgcagtgaatgtagaaaagccttctcctcaaagagaaatctcattgtacatcagcgaactcataatggaaacaaaccctgacaatgcagtggacatgttcatgcctttgggaagaaaatctgccttgtacaacatcagagatttcacagtatagattttctacatgtgtactgagtatgaaaaatcatatttcaaaatccagtgttattcactaggatgaatgctatcaatgtcagaaaggcttcaacatgaattcaggctctgaattctttgatgtaccaatgtatagaaaattactcatctgagagagagtctgtggattgggggtaacctttcatttgtcaaccttcattaaaactatgacaacgtccacatgacaaatgtgtaaggtacatagtccttttgcagagaatctgaactgattacatacaaacaaattcatgcagagagaaaaccacgttagtaatgtgaactgattaaacagcagtgtgctcctagcatacatgcatataggcagtgtagagcagcctgttgctagattttcacccttggaagacaatgcaatttccaggagcgaattttaatgaatgcagagaatgcactagtgccttcggtgattaattacctcatattttatgtcacaataaacatgtaggaaataaacttgatacatccaatgcagaaaagtcttgaaaattttctaagtaactatgtcttgaaaagtatttactgagataaatcttacaaaggagtaggctaggaaagccttctatgggaagaaagaccctatctcttcagtgatcataatagatcatcaatgaacttacacatactagcagcattatcatgggaaagcctttgcccagaaataaaaccttaacagttggcagatatatttcatactggagaacaagtttcagatggcagtgaatacacgaggatttcagtgatacatgctgcctcatcatcattacttcatacagaaataaaacttatatgaagagtaactttaaaaaggatcaggaaattcatgaagtaaaaaagtctcatgaaaatgatacataatgccgggcatggtggcttgcacctgtaatcccagcactttgggaggccaaggtgggtggatcacttgaggtcgggagttcgagaccagcctgaccaacatggtgaggcccccctctctgctaaaaatacaaaattagccgagcatggtggctcacgcttgtaatcccagctactctggaggctgggctggagaatcacttgaacctgggaggcagaggtttcagtgagccaagattgcgccattgcattccagcctgggcaacaagagcgaaactctgcctcaaaaaaaaaaaaaaaaaaaaaaccatatttgaggactgtcacaaatctaaactcatgatacacttgatatctattctgtgacagcataccttgcatcatattatcaatgattccataattgtaaagcgggctgttcttatcactgattaaattttaatcctatatataacacaggtgttttctgtgccaatctggtgttatttattagttcttacatattataggccccaaatttatttttttcaatttactgataaatgtaattcagtatatttggatgtgtttatccaagttactaggtaccattatgtagtttacaaaaatgccttaaatgttatttttctaaaatttgttttgaaataattctagattcacaagagattacaaaatatacaaaagtttcctgagtattctttgcttagcatcatcaatgttatcttacataaccataataataaaaaccacggagttctgctcttgttgcccaggttggagtgtaatagcacgatcttggctcactgcaaccccgcctcccaggttcaagagattttcctgcctcagcctcctaagtagctgggattacaggcacccacgaccacgctcgactaatttttgtatttttggtagagacggggtttcactgtgttggccaggctggccttgaactctcgaccccgggcggtccacccgcctcagcctcccaaagtgctgggattacaggcatgagccaccacgcctggcctcctcttgctacctctttatactcacactgtcctcccaatatgacccatggtagccactgatcccattaccctaattttgttatttcaagaatgctattaaaatggaatcgtaaggtacgcaagctttgagatagggctttgttcactcagcaaattacccttaagatctatccaagttgttaggtgtctaaatagttttaatttttgttactgagttagtattcttttaaatggatgcaccagggtttgtgtatccattcactgttgatggacatttgggttgtttccagtgttttgctgttataaataaagatgctgtgactatttgtgtacccga

SEQ ID NO: 440792 - DNA, 335 bp, Homo sapiens
gaattcccgggtcgactactattactaaattcgcggccgcgtagacggtagccactgatcccattaccctaattttgttatttcaagaatgctattaaaatggaatcgtaaggtacgcaagctttgagatagggctttgttcactcagcaaattacccttaagatctatccaagttgttaggtgtctaaatagttttaatttttgttactgagttagtattcttttaaatggatgcaccagggtttgtgtatccattcactgttgatggacatttgggttgtttccagtgttttgctgttataaataaagatgctgtgactatttgtgtacccga

SEQ ID NO: 440793 - DNA, 5177 bp, Homo sapiens
ctgctgaataggtctattctcatagtatttctctatttggcttgactttatttatgtgaacactcctacccatagggcacttgtcaaaaaacaatcagcagcaattgtttaacactagagtgtttaggggagtgacagtgtgtgtctgcgtgatagatggaagtaataagagggcacaggggaaaggggccatacgcataagatgatggaacagagagcctggagggtggggtatagagagtgtaggggaagggagaaggcagacaggtaaaaggaaaaagaatgttaagtgttgttcagcctcaagactgacatgatgaaagtacctttattgtggtttttgtaaattagaatgcatgctttattattaaaaaaaacacaattgaaaatgttaaggaccttttcctccttgcttcttataagaaaccatcataagacataacttgtaataattctgtagaaatatacatatataaagatatatgtatatatatattttaaaatagtatgtttttattgcaaaatattcattagtgtcatcatatcatagccagatctacaaccccagagtaattcccatggttatgttacatggcaaaaaggactctgcattgtaattaagtttattaatcagctgactttagcattgggagattattctggattgcccaagcacttaagaataggagaaaccggagagatgcagcagcaatagtcagtggtttcaaatatgaaagggatttcacatactattgttggctttaaagataggaagtcgtgggggcaaggaaactctctaaaggaaattaatctggcaacaacctaaataattctagaaaaggattcttttccagagtcaagaacagagccaggtggttcttctcttctaaagacatttccatgggccagttccaccgcaagcttctcagagagaatatgttctgccgtacggacaccgaacgtcccctaagatggccgcccccatgatgctctcccctaagggctctggctccgttacctgcaacgcaccgctcgcttattttttgttctagtctctcttgcttcagtttttatacggcttctaaaacgcttcgcatttacaatagtgactgaggtgcccagaggtgactttaattttccattgagctgagacgtcacagccatcataaccgctaagaagggatgccgcgcctttgtggtaataatgggttctggcctttgagaagtttgcgccgttcactgtcccctgcgaggagaagactaacttatttctgttccgtgtctgttcagaggactttacccccacgccgtgtctgcctgtgtgaactcaagcctctgataagctctccattttctgccagggctgaggtgtctggaaatcggacagtttaagaggcctccgtccaccgcgtctcccggccgctgtgccttctgtacgtcacgtactcaaagatggccgcccccagagcggcgaggcgacgccggcgcggacgcgtctcctcctgaggaaaagccggaaggccgcattccgctctccatggaaacgcggctgaccgtctctggaggtttagagggggagggagttgggcgaggggcccagaagtggaagaagtttagggaagtaagttcagcttttaagaggtcgcggcgattccaaggagagtcagtccacaggtcctggctaccctgggaagagacaagaagtaaatgaagaaagaggaagattccaggacctagatatgatttctgtggacacccttcactggtgactgaagtttctaaatagaaatttaaggcagatccagaggagacaaagacagagtatcccaggtgctggccatttcccacaacagaagaaaatgatcaatgcccaggaattgctgacactggaggatgttactgtggagttcacctgggaggagtggcagctcctgggcccttttcagaaggatttgtaccgggatgtgatgttggagatctacagcaacctgctatcaatgggttatcaagtcagcaaaccagatgcactctccaagttggaacgaggagaagaaccatggacaatggaagatgaaaggcacagtcgaatctgtccagaaaacaacgaagttgatgatcatctgcaggatcacttggaaaatcaaaggatgctgaagagtgtggaacaataccatgaacataatgcatttggaaatactgcctctcaaaccaaaagcctttgtcttttcagggaaaatcatgatacatttgagttatatataaaaactttgaaatcaaatttaagtttagtcaaccagaacaaaagctgtgaaattaacaactctactaaatttagtggagatgggaaatcatttcttcatggtaactatgaagaactttattctgcagctaaattctctgtaagtacaaaagccaatagcactaaatcccaagtcagtaagcatcagagaactcatgaaatagaaaaaaaccacgtatgcagtgaatgtgggaaagcgtttgtcaagaagtctcagctcactgatcatgagagagttcatacaggagaaaaaccttatggatgtactttgtgtgcaaaagtgttctccagaaagtccaggctaaatgaacatcaaagaattcataaaagagagaaatcttttatatgcagtgaatgtggaaaagtcttcactatgaagagccgtctgattgaacatcagcgaactcatactggagagaaaccctacatatgcaatgaatgtggaaaaggcttcccaggcaagcgtaatctcattgtacatcagcgaaatcatactggagagaaatcctatatatgtagtgaatgtggaaaaggcttcactgggaagagcatgcttattatacatcagcgaactcatacaggagagaagccctacatctgtagtgaatgtgggaaaggcttcaccacaaaacactatgtcatcatacatcaacgaaatcatacaggagagaaaccatatatatgcaatgaatgtgggaaaggcttcaccatgaagagccgtatgatcgaacatcaacgaactcatacaggagagaaaccctacatatgcagtgaatgtggaaaaggctttcccaggaagagtaatcttattgtacatcagagaaatcatacagtagagaagtcatatctatgtagtgaatgtggaaaaggttttactgtgaaaagcatgctcatcatacatcagcgaactcatacaggagagaagccctacacatgcagtgaatgtgggaaaggcttccccttgaagagtcggctgattgtacatcagcgaactcatactggagagaaaccttacaggtgcagtgaatgtgggaaaggtttcattgtgaatagcggactgatgttacatcagcgaactcatactggagagaaaccgtacatatgcaatgaatgtggaaaaggttttgcctttaagagcaatcttgttgtacaccagcgaactcatactggagagaaaccctttatgtgcagtgaatgtggaaaaggcttcaccatgaaacgctatctcattgtacatcagcaaattcatacagaagagaaatcttgtatatgtagtgaatgtggaagaggctttgccaaggaaacagagcttgctttacataagcaagttcatactggagaaaaaccttatggatgtaatgaatgtggtaaaggcttcactatgaagagccgtctaattgttcatcaacgaactcatacaggagagaaaccctttgtatgcagtgaatgtagaaaagccttctcctcaaagagaaatctcattgtacatcagcgaactcataatggaaacaaaccctgacaatgcagtggacatgttcatgcctttgggaagaaaatctgccttgtacaacatcagagatttcacagtatagattttctacatgtgtactgagtatgaaaaatcatatttcaaaatccagtgttattcactaggatgaatgctatcaatgtcagaaaggcttcaacatgaattcaggctctgaattctttgatgtaccaatgtatagaaaattactcatctgagagagagtctgtggattgggggtaacctttcatttgtcaaccttcattaaaactatgacaacgtccacatgacaaatgtgtaaggtacatagtccttttgcagagaatctgaactgattacatacaaacaaattcatgcagagagaaaaccacgttagtaatgtgaactgattaaacagcagtgtgctcctagcatacatgcatataggcagtgtagagcagcctgttgctagattttcacccttggaagacaatgcaatttccaggagcgaattttaatgaatgcagagaatgcactagtgccttcggtgattaattacctcatattttatgtcacaataaacatgtaggaaataaacttgatacatccaatgcagaaaagtcttgaaaattttctaagtaactatgtcttgaaaagtatttactgagataaatcttacaaaggagtaggctaggaaagccttctatgggaagaaagaccctatctcttcagtgatcataatagatcatcaatgaacttacacatactagcagcattatcatgggaaagcctttgcccagaaataaaaccttaacagttggcagatatatttcatactggagaacaagtttcagatggcagtgaatacacgaggatttcagtgatacatgctgcctcatcatcattacttcatacagaaataaaacttatatgaagagtaactttaaaaaggatcaggaaattcatgaagtaaaaaagtctcatgaaaatgatacataattgctgggattacaggcatgagccaccacgcctggcctcctcttgctacctctttatactcacactgtcctcccaatatgacccatggtagccactgatcccattaccctaattttgttatttcaagaatgctattaaaatggaatcgtaaggtacgcaagctttgagatagggctttgttcactcagcaaattacccttaagatctatccaagttgttaggtgtctaaatagttttaatttttgttactgagttagtattcttttaaatggatgcaccagggtttgtgtatccattcactgttgatggacatttgggttgtttccagtgttttgctgttataaataaagatgctgtgactatttgtgtacccga

SEQ ID NO: 440794 - DNA, 2221 bp, Homo sapiens
ctgctgaataggtctattctcatagtatttctctatttggcttgactttatttatgtgaacactcctacccatagggcacttgtcaaaaaacaatcagcagcaattgtttaacactagagtgtttaggggagtgacagtgtgtgtctgcgtgatagatggaagtaataagagggcacaggggaaaggggccatacgcataagatgatggaacagagagcctggagggtggggtatagagagtgtaggggaagggagaaggcagacaggtaaaaggaaaaagaatgttaagtgttgttcagcctcaagactgacatgatgaaagtacctttattgtggtttttgtaaattagaatgcatgctttattattaaaaaaaacacaattgaaaatgttaaggaccttttcctccttgcttcttataagaaaccatcataagacataacttgtaataattctgtagaaatatacatatataaagatatatgtatatatatattttaaaatagtatgtttttattgcaaaatattcattagtgtcatcatatcatagccagatctacaaccccagagtaattcccatggttatgttacatggcaaaaaggactctgcattgtaattaagtttattaatcagctgactttagcattgggagattattctggattgcccaagcacttaagaataggagaaaccggagagatgcagcagcaatagtcagtggtttcaaatatgaaagggatttcacatactattgttggctttaaagataggaagtcgtgggggcaaggaaactctctaaaggaaattaatctggcaacaacctaaataattctagaaaaggattcttttccagagtcaagaacagagccaggtggttcttctcttctaaagacatttccatgggccagttccaccgcaagcttctcagagagaatatgttctgccgtacggacaccgaacgtcccctaagatggccgcccccatgatgctctcccctaagggctctggctccgttacctgcaacgcaccgctcgcttattttttgttctagtctctcttgcttcagtttttatacggcttctaaaacgcttcgcatttacaatagtgactgaggtgcccagaggtgactttaattttccattgagctgagacgtcacagccatcataaccgctaagaagggatgccgcgcctttgtggtaataatgggttctggcctttgagaagtttgcgccgttcactgtcccctgcgaggagaagactaacttatttctgttccgtgtctgttcagaggactttacccccacgccgtgtctgcctgtgtgaactcaagcctctgataagctctccattttctgccagggctgaggtgtctggaaatcggacagtttaagaggcctccgtccaccgcgtctcccggccgctgtgccttctgtacgtcacgtactcaaagatggccgcccccagagcggcgaggcgacgccggcgcggacgcgtctcctcctgaggaaaagccggaaggccgcattccgctctccatggaaacgcggctgaccgtctctggaggtttagagggggagggagttgggcgaggggcccagaagtggaagaagtttagggaagtaagttcagcttttaagaggtcgcggcgattccaaggagagtcagtccacaggtcctggctaccctgggaagagacaagaagtaaatgaagaaagaggaagattccaggacctagatatgatttctgtggacacccttcactggtgactgaagtttctaaatagaaatttaaggcagatccagaggagacaaagacagagtatcccaggtgctggccatttcccacaacagaagaaaatgatcaatgcccaggaattgctgacactggaggatgttactgtggagttcacctgggaggagtggcagctcctgggcccttttcagaaggatttgtaccgggatgtgatgttggagatctacagcaacctgctatcaatgggttatcaagtcagcaaaccagatgcactctccaagttggaacgaggagaagaaccatggacaatggaagatgaaaggcacagtcgaatctgtccaggtatgtgagaagcagcaagatgcgtaagtaatattatagtcagtgaaagaaggctctgtgggtgtctgaggacacagaagcagtgcctacattaggaatgggaatcgttttccctccacaagaa

SEQ ID NO: 440795 - DNA, 4532 bp, Homo sapiens
ggcgtctgcgttgttggtggcgctatatggtggagtccacaggtcctggctaccctgggaagagacaagaagtaaatgaagaaagaggaagattccaggacctagatatgatttctgtggacacccttcactggtgactgaagtttctaaatagaaatttaaggcagatccagaggagacaaagacagagtatcccaggtgctggccatttcccacaacagaagaaaatgatcaatgcccaggaattgctgacactggaggatgttactgtggagttcacctgggaggagtggcagctcctgggcccttttcagaaggatttgtaccgggatgtgatgttggagatctacagcaacctgctatcaatgggttatcaagtcagcaaaccagatgcactctccaagttggaacgaggagaagaaccatggacaatggaagatgaaaggcacagtcgaatctgtccagaaaacaacgaagttgatgatcatctgcaggatcacttggaaaatcaaaggatgctgaagagtgtggaacaataccatgaacataatgcatttggaaatactgcctctcaaaccaaaagcctttgtcttttcagggaaaatcatgatacatttgagttatatataaaaactttgaaatcaaatttaagtttagtcaaccagaacaaaagctgtgaaattaacaactctactaaatttagtggagatgggaaatcatttcttcatggtaactatgaagaactttattctgcagctaaattctctgtaagtacaaaagccaatagcactaaatcccaagtcagtaagcatcagagaactcatgaaatagaaaaaaaccacgtatgcagtgaatgtgggaaagcgtttgtcaagaagtctcagctcactgatcatgagagagttcatacaggagaaaaaccttatggatgtactttgtgtgcaaaagtgttctccagaaagtccaggctaaatgaacatcaaagaattcataaaagagagaaatcttttatatgcagtgaatgtggaaaagtcttcactatgaagagccgtctgattgaacatcagcgaactcatactggagagaaaccctacatatgcaatgaatgtggaaaaggcttcccaggcaagcgtaatctcattgtacatcagcgaaatcatactggagagaaatcctatatatgtagtgaatgtggaaaaggcttcactgggaagagcatgcttattatacatcagcgaactcatacaggagagaagccctacatctgtagtgaatgtgggaaaggcttcaccacaaaacactatgtcatcatacatcaacgaaatcatacaggagagaaaccatatatatgcaatgaatgtgggaaaggcttcaccatgaagagccgtatgatcgaacatcaacgaactcatacaggagagaaaccctacatatgcagtgaatgtggaaaaggctttcccaggaagagtaatcttattgtacatcagagaaatcatacagtagagaagtcatatctatgtagtgaatgtggaaaaggttttactgtgaaaagcatgctcatcatacatcagcgaactcatacaggagagaagccctacacatgcagtgaatgtgggaaaggcttccccttgaagagtcggctgattgtacatcagcgaactcatactggagagaaaccttacaggtgcagtgaatgtgggaaaggtttcattgtgaatagcggactgatgttacatcagcgaactcatactggagagaaaccgtacatatgcaatgaatgtggaaaaggttttgcctttaagagcaatcttgttgtacaccagcgaactcatactggagagaaaccctttatgtgcagtgaatgtggaaaaggcttcaccatgaaacgctatctcattgtacatcagcaaattcatacagaagagaaatcttgtatatgtagtgaatgtggaagaggctttgccaaggaaacagagcttgctttacataagcaagttcatactggagaaaaaccttatggatgtaatgaatgtggtaaaggcttcactatgaagagccgtctaattgttcatcaacgaactcatacaggagagaaaccctttgtatgcagtgaatgtagaaaagccttctcctcaaagagaaatctcattgtacatcagcgaactcataatggaaacaaaccctgacaatgcagtggacatgttcatgcctttgggaagaaaatctgccttgtacaacatcagagatttcacagtatagattttctacatgtgtactgagtatgaaaaatcatatttcaaaatccagtgttattcactaggatgaatgctatcaatgtcagaaaggcttcaacatgaattcaggctctgaattctttgatgtaccaatgtatagaaaattactcatctgagagagagtctgtggattgggggtaacctttcatttgtcaaccttcattaaaactatgacaacgtccacatgacaaatgtgtaaggtacatagtccttttgcagagaatctgaactgattacatacaaacaaattcatgcagagagaaaaccacgttagtaatgtgaactgattaaacagcagtgtgctcctagcatacatgcatataggcagtgtagagcagcctgttgctagattttcacccttggaagacaatgcaatttccaggagcgaattttaatgaatgcagagaatgcactagtgccttcggtgattaattacctcatattttatgtcacaataaacatgtaggaaataaacttgatacatccaatgcagaaaagtcttgaaaattttctaagtaactatgtcttgaaaagtatttactgagataaatcttacaaaggagtaggctaggaaagccttctatgggaagaaagaccctatctcttcagtgatcataatagatcatcaatgaacttacacatactagcagcattatcatgggaaagcctttgcccagaaataaaaccttaacagttggcagatatatttcatactggagaacaagtttcagatggcagtgaatacacgaggatttcagtgatacatgctgcctcatcatcattacttcatacagaaataaaacttatatgaagagtaactttaaaaaggatcaggaaattcatgaagtaaaaaagtctcatgaaaatgatacataatgccgggcatggtggcttgcacctgtaatcccagcactttgggaggccaaggtgggtggatcacttgaggtcgggagttcgagaccagcctgaccaacatggtgaggcccccctctctgctaaaaatacaaaattagccgagcatggtggctcacgcttgtaatcccagctactctggaggctgggctggagaatcacttgaacctgggaggcagaggtttcagtgagccaagattgcgccattgcattccagcctgggcaacaagagcgaaactctgcctcaaaaaaaaaaaaaaaaaaaaaaccatatttgaggactgtcacaaatctaaactcatgatacacttgatatctattctgtgacagcataccttgcatcatattatcaatgattccataattgtaaagcgggctgttcttatcactgattaaattttaatcctatatataacacaggtgttttctgtgccaatctggtgttatttattagttcttacatattataggccccaaatttatttttttcaatttactgataaatgtaattcagtatatttggatgtgtttatccaagttactaggtaccattatgtagtttacaaaaatgccttaaatgttatttttctaaaatttgttttgaaataattctagattcacaagagattacaaaatatacaaaagtttcctgagtattctttgcttagcatcatcaatgttatcttacataaccataataataaaaaccacggagttctgctcttgttgcccaggttggagtgtaatagcacgatcttggctcactgcaaccccgcctcccaggttcaagagattttcctgcctcagcctcctaagtagctgggattacaggcacccacgaccacgctcgactaatttttgtatttttggtagagacggggtttcactgtgttggccaggctggccttgaactctcgaccccgggcggtccacccgcctcagcctcccaaagtgctgggattacaggcatgagccaccacgcctggcctcctcttgctacctctttatactcacactgtcctcccaatatgacccatggtagccactgatcccattaccctaattttgttatttcaagaatgctattaaaatggaatcgtaaggtacgcaagctttgagatagggctttgttcactcagcaaattacccttaagatctatccaagttgttaggtgtctaaatagttttaatttttgttactgagttagtattcttttaaatggatgcaccagggtttgtgtatccattcactgttgatggacatttgggttgtttccagtgttttgctgttataaataaagatgctgtgactatttgtgtacccga

SEQ ID NO: 440796 - DNA, 4113 bp, Homo sapiens
ctgctgaataggtctattctcatagtatttctctatttggcttgactttatttatgtgaacactcctacccatagggcacttgtcaaaaaacaatcagcagcaattgtttaacactagagtgtttaggggagtgacagtgtgtgtctgcgtgatagatggaagtaataagagggcacaggggaaaggggccatacgcataagatgatggaacagagagcctggagggtggggtatagagagtgtaggggaagggagaaggcagacaggtaaaaggaaaaagaatgttaagtgttgttcagcctcaagactgacatgatgaaagtacctttattgtggtttttgtaaattagaatgcatgctttattattaaaaaaaacacaattgaaaatgttaaggaccttttcctccttgcttcttataagaaaccatcataagacataacttgtaataattctgtagaaatatacatatataaagatatatgtatatatatattttaaaatagtatgtttttattgcaaaatattcattagtgtcatcatatcatagccagatctacaaccccagagtaattcccatggttatgttacatggcaaaaaggactctgcattgtaattaagtttattaatcagctgactttagcattgggagattattctggattgcccaagcacttaagaataggagaaaccggagagatgcagcagcaatagtcagtggtttcaaatatgaaagggatttcacatactattgttggctttaaagataggaagtcgtgggggcaaggaaactctctaaaggaaattaatctggcaacaacctaaataattctagaaaaggattcttttccagagtcaagaacagagccaggtggttcttctcttctaaagacatttccatgggccagttccaccgcaagcttctcagagagaatatgttctgccgtacggacaccgaacgtcccctaagatggccgcccccatgatgctctcccctaagggctctggctccgttacctgcaacgcaccgctcgcttattttttgttctagtctctcttgcttcagtttttatacggcttctaaaacgcttcgcatttacaatagtgactgaggtgcccagaggtgactttaattttccattgagctgagacgtcacagccatcataaccgctaagaagggatgccgcgcctttgtggtaataatgggttctggcctttgagaagtttgcgccgttcactgtcccctgcgaggagaagactaacttatttctgttccgtgtctgttcagaggactttacccccacgccgtgtctgcctgtgtgaactcaagcctctgataagctctccattttctgccagggctgaggtgtctggaaatcggacagtttaagaggcctccgtccaccgcgtctcccggccgctgtgccttctgtacgtcacgtactcaaagatggccgcccccagagcggcgaggcgacgccggcgcggacgcgtctcctcctgaggaaaagccggaaggccgcattccgctctccatggaaacgcggctgaccgtctctggaggtttagagggggagggagttgggcgaggggcccagaagtggaagaagtttagggaagtaagttcagcttttaagaggtcgcggcgattccaaggagagtcagtccacaggtcctggctaccctgggaagagacaagaagtaaatgaagaaagaggaagattccaggacctagatatgatttctgtggacacccttcactggtgactgaagtttctaaatagaaatttaaggcagatccagaggagacaaagacagagtatcccaggtgctggccatttcccacaacagaagaaaatgatcaatgcccaggaattgctgacactggaggatgttactgtggagttcacctgggaggagtggcagctcctgggcccttttcagaaggatttgtaccgggatgtgatgttggagatctacagcaacctgctatcaatgggttatcaagtcagcaaaccagatgcactctccaagttggaacgaggagaagaaccatggacaatggaagatgaaaggcacagtcgaatctgtccagaaaacaacgaagttgatgatcatctgcaggatcacttggaaaatcaaaggatgctgaagagtgtggaacaataccatgaacataatgcatttggaaatactgcctctcaaaccaaaagcctttgtcttttcagggaaaatcatgatacatttgagttatatataaaaactttgaaatcaaatttaagtttagtcaaccagaacaaaagctgtgaaattaacaactctactaaatttagtggagatgggaaatcatttcttcatggtaactatgaagaactttattctgcagctaaattctctgtaagtacaaaagccaatagcactaaatcccaagtcagtaagcatcagagaactcatgaaatagaaaaaaaccacgtatgcagtgaatgtgggaaagcgtttgtcaagaagtctcagctcactgatcatgagagagttcatacaggagaaaaaccttatggatgtactttgtgtgcaaaagtgttctccagaaagtccaggctaaatgaacatcaaagaattcataaaagagagaaatcttttatatgcagtgaatgtggaaaagtcttcactatgaagagccgtctgattgaacatcagcgaactcatactggagagaaaccctacatatgcaatgaatgtggaaaaggcttcccaggcaagcgtaatctcattgtacatcagcgaaatcatactggagagaaatcctatatatgtagtgaatgtggaaaaggcttcactgggaagagcatgcttattatacatcagcgaactcatacaggagagaagccctacatctgtagtgaatgtgggaaaggcttcaccacaaaacactatgtcatcatacatcaacgaaatcatacaggagagaaaccatatatatgcaatgaatgtgggaaaggcttcaccatgaagagccgtatgatcgaacatcaacgaactcatacaggagagaaaccctacatatgcagtgaatgtggaaaaggctttcccaggaagagtaatcttattgtacatcagagaaatcatacagtagagaagtcatatctatgtagtgaatgtggaaaaggttttactgtgaaaagcatgctcatcatacatcagcgaactcatacaggagagaagccctacacatgcagtgaatgtgggaaaggcttccccttgaagagtcggctgattgtacatcagcgaactcatactggagagaaaccttacaggtgcagtgaatgtgggaaaggtttcattgtgaatagcggactgatgttacatcagcgaactcatactggagagaaaccgtacatatgcaatgaatgtggaaaaggttttgcctttaagagcaatcttgttgtacaccagcgaactcatactggagagaaaccctttatgtgcagtgaatgtggaaaaggcttcaccatgaaacgctatctcattgtacatcagcaaattcatacagaagagaaatcttgtatatgtagtgaatgtggaagaggctttgccaaggaaacagagcttgctttacataagcaagttcatactggagaaaaaccttatggatgtaatgaatgtggtaaaggcttcactatgaagagccgtctaattgttcatcaacgaactcatacaggagagaaaccctttgtatgcagtgaatgtagaaaagccttctcctcaaagagaaatctcattgtacatcagcgaactcataatggaaacaaaccctgacaatgcagtggacatgttcatgcctttgggaagaaaatctgccttgtacaacatcagagatttcacagtatagattttctacatgtgtactgagtatgaaaaatcatatttcaaaatccagtgttattcactaggatgaatgctatcaatgtcagaaaggcttcaacatgaattcaggctctgaattctttgatgtaccaatgtatagaaaattactcatctgagagagagtctgtggattgggggtaacctttcatttgtcaaccttcattaaaactatgacaacgtccacatg

SEQ ID NO: 440797 - DNA, 1287 bp, Homo sapiens
tccactgagttgacacgcagacgcagcctcaggaccctaaactctacgccccagcacaccctaccaagcgagcgcccgcggccgcgtgacgtcatctaccccaaacgctgtggccccggccacgcacggcttcggggcgggactacgcggtgacgtcgaggtgcgcggcgcagcgcgcggcgtcagtcttggctggcagacctgtactccgtactccgtacttcgtagtcgcagcggcgcggtcttcggcagtctagtcatccaccgccatcctgggccccacgtgttgcctgaccattcctgagcccaggtgggagccgtggctgaggtgacggtctcaaagtggaagagcttactgtcacagcaactcctttgcaagatgccccggccaggaatagttgctgaacaccccaggcctgctgaggtccctccttgagtctcatgttcaagcagtcttgtgagtaaagcactggctaccccttttcacttactatcttttcaagcatgttctaccaccttggaaggtaagaggttagtaccttcttccagagcagagggcaggcattcttgctgtgcgttgtgaaagggtagagtcctgcgctcctttcttgtagtagtccaatggctcatgcaggtgcctctgactcccctatgggaactggggcttgggagggtggtggaaaatgctgatgctctggctattgctattgttttgaataatcagtggtcccttgtccctaatcgaggaattttgtattttctaccagtgtccatgaaactgggaggcgaccgtgttagctgccagttcctgacagccacctctcaccagtggcttcactctgtgtccctgacccagcacatggcacaagagtgcctgccatccgtcagtgtttctacagcagcaatcccaagatgctggagctagaggggacctgacctgagagaagataccttcagtggctgccaggctgttccttggaacctgtgcagggatgaggcctgcctgtgttaatacacctagtgaggagtggagctgaatttgaatgcaagccttggcaccttaattgagcaagtttgaaacctcgcttgttgcccttctggaaggagtcaggaatttccagttctgggcctgggctgtgggtctggcagacagacctctggccctaggtttgggtgccaggttctctgcttccagaatgagaagctttgctgtgcaccaggacctgggcccttctggtatctcctgaatgaaaaacaagggatatttaataaatatggatttaaata

SEQ ID NO: 440798 - DNA, 744 bp, Homo sapiens
tccactgagttgacacgcagacgcagcctcaggaccctaaactctacgccccagcacaccctaccaagcgagcgcccgcggccgcgtgacgtcatctaccccaaacgctgtggccccggccacgcacggcttcggggcgggactacgcggtgacgtcgaggtgcgcggcgcagcgcgcggcgtcagtcttggctggcagacctgtactccgtactccgtacttcgtagtcgcagcggcgcggtcttcggcagtctagtcatccaccgccatcctgggccccacgtgttgcctgaccattcctgagcccaggtgggagccgtggctgaggtgacggtctcaaagtggaagagcttactgtcacagcaactcctttgcaagatgccccggccaggaatagttgctgaacaccccaggcctgctgaggtccctccttgagtctcatgttcaagcagtctttgtccatgaaactgggaggcgaccgtgttagctgccagttcctgacagccacctctcaccagtggcttcactctgtgtccctgacccagcacatggcacaagagtgcctgccatccgtcagtgtttctacagcagcaatcccaagatgctggagctagaggggacctgacctgagagaagataccttcagtggctgccaggctgttccttggaacctgtgcagggatgaggcctgccctgttttcctcccagtgacgatcccagctgcatctcatcgcgctttgcct

SEQ ID NO: 440799 - DNA, 464 bp, Homo sapiens
caggcctctcagctcatggtgggagtgggttcaggagttggtaagtagggttcagttctgttgttgccaccgatggcaacaggggtttgtaataatccctagttgtgtcaattatgtcacttaattttcacaacaggtctctgaagtgtttctcatctcatttttacagatgaggcctgcctgtgttaatacacctagtgaggagtggagctgaatttgaatgcaagccttggcaccttaattgagcaagtttgaaacctcgcttgttgcccttctggaaggagtcaggaatttccagttctgggcctgggctgtgggtctggcagacagacctctggccctaggtttgggtgccaggttctctgcttccagaatgagaagctttgctgtgcaccaggacctgggcccttctggtatctcctgaatgaaaaacaagggatatttaataaatatggatttaaata

SEQ ID NO: 440800 - DNA, 1436 bp, Homo sapiens
  misc_feature (1436)..(1436): n is a, c, g, or t
tccactgagttgacacgcagacgcagcctcaggaccctaaactctacgccccagcacaccctaccaagcgagcgcccgcggccgcgtgacgtcatctaccccaaacgctgtggccccggccacgcacggcttcggggcgggactacgcggtgacgtcgaggtgcgcggcgcagcgcgcggcgtcagtcttggctggcagacctgtactccgtactccgtacttcgtagtcgcagcggcgcggtcttcggcagtctagtcatccaccgccatcctgggccccacgtgttgcctgaccattcctgagcccaggtgggagccgtggctgaggtgacggtctcaaagtggaagagcttactgtcacagcaactcctttgcaagatgccccgtgtccatgaaactgggaggcgaccgtgttagctgccagttcctgacagccacctctcaccagtggcttcactctgtgtccctgacccagcacatggcacaagagtgcctgccatccgtcagtgtttctacagcagcaatcccaagatgctggagctagaggggacctgacctgagagaagataccttcagtggctgccaggctgttccttggaacctgtgcagggatgaggcctgcctgtgttaatacacctagtgaggagtggagctgaatttgaatgcaagccttggcaccttaattgagcaagtttgaaacctcgcttgttgcccttctggaaggagtcaggaatttccagttctgggcctgggctgtgggtctggcagacagacctctggccctaggtttgggtgccaggttctctgcttccagaatgagaagctttgctgtgcaccaggacctgggcccttctggtatctcctgaatgaaaaacaagggatatttaataaatatggatttaaataaaaaaaagaaaaaaaaaaaaaaaaaaaaaaaaaaaagaaaaagaaaaaaaaaaaaaacacacacagaaaacaaaaaaaaagacggggacacacaaacaaactccacagaggagacacaaacagcacaacacaaatgagaaaaaagagcacacaaaggagataaaaaaaacaagcgaaggctacaaacactgagaggaacaaagccgacaggaaaacatagagagagacacaaacaggcgcgggcgaaacacgcgaaccacccgagaataagacccccacggagaacaacactcacagagatcgtaggaacaccaacaatcgctgggcaacaacacgcgccgcagatatctaatacgggaggcgagcgactatgcaagggagcagaaggacgacggcacgcacgcgagaaagagcagcaggcagcacgacagagcgaggaggacgacgcgagacagatacacgagcaaggaaagacgagagatacgtataagagaacaaaaaccgacaaccagtgaggtccgcacagggn

SEQ ID NO: 440801 - DNA, 591 bp, Homo sapiens
tccactgagttgacacgcagacgcagcctcaggaccctaaactctacgccccagcacaccctaccaagcgagcgcccgcggccgcgtgacgtcatctaccccaaacgctgtggccccggccacgcacggcttcggggcgggactacgcggtgacgtcgaggtgcgcggcgcagcgcgcggcgtcagtcttggctggcagacctgtactccgtactccgtacttcgtagtcgcagcggcgcggtcttcggcagtctagtcatccaccgccatcctgggccccacgtgttgcctgaccattcctgagcccaggtaggggtcctgggggattgggttcagtggcgggcggcgtgggaggctgggccgcagtgagtgggggcaccagtgattcttggagaccaagccttcactacacgtgctacttcctctcaagaggcggttgagcgcgttcggaacattttacccggaggagactcggggattacttgatgagtaacctcgtgcttctctttcagccgagaagtggggcttctgcatgacctgggtggaccccagtaggtgggatgggacgtgtggtcaggagggacctcacc

SEQ ID NO: 440802 - DNA, 835 bp, Homo sapiens
tccactgagttgacacgcagacgcagcctcaggaccctaaactctacgccccagcacaccctaccaagcgagcgcccgcggccgcgtgacgtcatctaccccaaacgctgtggccccggccacgcacggcttcggggcgggactacgcggtgacgtcgaggtgcgcggcgcagcgcgcggcgtcagtcttggctggcagacctgtactccgtactccgtacttcgtagtcgcagcggcgcggtcttcggcagtctagtcatccaccgccatcctgggccccacgtgttgcctgaccattcctgagcccaggtgggagccgtggctgaggtgacggtctcaaagtggaagagcttactgtcacagcaactcctttgcaagatgccccggtaaatcacgttgcagagaccccaactctgccttcctggaactaggcctgcgttttctctgaaccattatttcatggggaaaatgaaatctacttcatgtgcctggtctacttactccttcagaagtgatttctgagccgtaagatacatgagaaaaaaatgaaggggaaaaggcagtatttatattaactacatgatgataaggatgtttctggtcacagtgaaaagccatgctagaattgtagtgtcatagaataatgtggaagtttagttcgtgttgtctgatctatttaataatttaataaggttatctcttccaagacaccttcccttcttcctcagccagaaaggatctttccctgagagtcattagtagctctgggctcctggaaccaagctcaggtgcctaattgaactctggtctcttcccacagcccccagcagggac

SEQ ID NO: 440803 - DNA, 1968 bp, Homo sapiens
ggtgcttgggtctgcggtgaccctatgcattccttcagtgcttgctagaacagttttgaaacggtttgaggccttgccctgctccatccagagcaaggttatagaaatttcagacaatgacttcctccctcctggatctagtgtcctgggccttgtatagatccgtgccatctaatgtggtagccacttggcacacatgattaaattaaatttggagttctatttcattttcacactagccacatttcagatgatcagtagccacaggtggccagtggctaccatatggaccgcacagattagagggcatttctgtcgctgtggaagtgttttggacaatgctggtgtgaaaggtgaagggaatcctgagtgtttgctgtgctccaggctcagtacaaattttattttattatacacttaaagcaaaagtcttataaaagttgaggatgaagccaagagtggtggtaagggtaggagttgaaacagtgaagaggaataacagggaagagtcctgccctgagagactcatggaataggatatttacaaggcaaagcaaagagaaccaaagtctcagttctgcagaggagctgagtgccccaggagctagtggagggtgaggtcaatgtgtgctcatcttaaaggaaaaactcatggaagaggaaggtgctaatgttgaacacctattttgcgccagacctcttaattgttttaaatctttgaggtatcatcatgaggtcgtttttaagttcagtacagatgaggggcccaaggtcagaattatgtgtccagggttgcccagccacaaaccagcagatcagggtttgatgccaggcctctctaaccctgcatcctgagtggaatatagaagccggtgggaagtttggatgggaaggagatggatgccttcaagttcttgtcttggtgttaggtgtgttaaaggactggctgggatgagaagagtgttgctggcttgagcatagcacgagcagcacagctcctgtgttcctctgggtggtggggtcacctctcttaaaggtagaggctttcagctgattctgtcttttcaggccaggaatagttgctgaacaccccaggcctgctgaggtccctccttgagtctcatgttcaagcagtcttgtgagtaaagcactggctaccccttttcacttactatcttttcaagcatgttctaccaccttggaaggtaagaggttagtaccttcttccagagcagagggcaggcattcttgctgtgcgttgtgaaagggtagagtcctgcgctcctttcttgtagtagtccaatggctcatgcaggtgcctctgactcccctatgggaactggggcttgggagggtggtggaaaatgctgatgctctggctattgctattgttttgaataatcagtggtcccttgtccctaatcgaggaattttgtattttctaccagtgtccatgaaactgggaggcgaccgtgttagctgccagttcctgacagccacctctcaccagtggcttcactctgtgtccctgacccagcacatggcacaagagtgcctgccatccgtcagtgtttctacagcagcaatcccaagatgctggagctagaggggacctgacctgagagaagataccttcagtggctgccaggctgttccttggaacctgtgcagggatgaggcctgcctgtgttaatacacctagtgaggagtggagctgaatttgaatgcaagccttggcaccttaattgagcaagtttgaaacctcgcttgttgcccttctggaaggagtcaggaatttccagttctgggcctgggctgtgggtctggcagacagacctctggccctaggtttgggtgccaggttctctgcttccagaatgagaagctttgctgtgcaccaggacctgggcccttctggtatctcctgaatgaaaaacaagggatatttaataaatatggatttaaata

SEQ ID NO: 440804 - DNA, 1881 bp, Homo sapiens
tctaccataaccgtgctattaaaaattgtcggtatggggcgaccgtcggagcatgaacccaacctctcgagctagtacatgctatagacttcacctagtcaatagcgaactagctatactgcaattgatcctaataatcttgactcagcggaacagagttacgcctacgggataacgagctgcaatccgtattgctagagtccatatcgaacgatgagggtttacgacctcgatgttggatcaggacatcccggtggtatcagcaggtgaagggaatcctgagtgtttgctgtgctccaggctcagtacaaattttattttattatacacttaaagcaaaagtcttataaaagttgaggatgaagccaagagtggtggtaagggtaggagttgaaacagtgaagaggaataacagggaagagtcctgccctgagagactcatggaataggatatttacaaggcaaagcaaagagaaccaaagtctcagttctgcagaggagctgagtgccccaggagctagtggagggtgaggtcaatgtgtgctcatcttaaaggaaaaactcatggaagaggaaggtgctaatgttgaacacctattttgcgccagacctcttaattgttttaaatctttgaggtatcatcatgaggtcgtttttaagttcagtacagatgaggggcccaaggtcagaattatgtgtccagggttgcccagccacaaaccagcagatcagggtttgatgccaggcctctctaaccctgcatcctgagtggaatatagaagccggtgggaagtttggatgggaaggagatggatgccttcaagttcttgtcttggtgttaggtgtgttaaaggactggctgggatgagaagagtgttgctggcttgagcatagcacgagcagcacagctcctgtgttcctctgggtggtggggtcacctctcttaaaggtagaggctttcagctgattctgtcttttcaggccaggaatagttgctgaacaccccaggcctgctgaggtccctccttgagtctcatgttcaagcagtcttgtgagtaaagcactggctaccccttttcacttactatcttttcaagcatgttctaccaccttggaaggtaagaggttagtaccttcttccagagcagagggcaggcattcttgctgtgcgttgtgaaagggtagagtcctgcgctcctttcttgtagtagtccaatggctcatgcaggtgcctctgactcccctatgggaactggggcttgggagggtggtggaaaatgctgatgctctggctattgctattgttttgaataatcagtggtcccttgtccctaatcgaggaattttgtattttctaccagtgtccatgaaactgggaggcgaccgtgttagctgccagttcctgacagccacctctcaccagtggcttcactctgtgtccctgacccagcacatggcacaagagtgcctgccatccgtcagtgtttctacagcagcaatcccaagatgctggagctagaggggacctgacctgagagaagataccttcagtggctgccaggctgttccttggaacctgtgcagggatgaggcctgcctgtgttaatacacctagtgaggagtggagctgaatttgaatgcaagccttggcaccttaattgagcaagtttgaaacctcgcttgttgcccttctggaaggagtcaggaatttccagttctgggcctgggctgtgggtctggcagacagacctctggccctaggtttgggtgccaggttctctgcttccagaatgagaagctttgctgtgcaccaggacctgggcccttctggtatctcctgaatgaaaaacaagggatatttaataaatatggatttaaata

SEQ ID NO: 440805 - DNA, 1816 bp, Homo sapiens
  misc_feature (1754)..(1754): n is a, c, g, or t
  misc_feature (1760)..(1760): n is a, c, g, or t
  misc_feature (1762)..(1762): n is a, c, g, or t
  misc_feature (1766)..(1766): n is a, c, g, or t
ggtgcttgggtctgcggtgaccctatgcattccttcagtgcttgctagaacagttttgaaacggtttgaggccttgccctgctccatccagagcaaggttatagaaatttcagacaatgacttcctccctcctggatctagtgtcctgggccttgtatagatccgtgccatctaatgtggtagccacttggcacacatgattaaattaaatttggagttctatttcattttcacactagccacatttcagatgatcagtagccacaggtggccagtggctaccatatggaccgcacagattagagggcatttctgtcgctgtggaagtgttttggacaatgctggtgtgaaaggtgaagggaatcctgagtgtttgctgtgctccaggctcagtacaaattttattttattatacacttaaagcaaaagtcttataaaagttgaggatgaagccaagagtggtggtaagggtaggagttgaaacagtgaagaggaataacagggaagagtcctgccctgagagactcatggaataggatatttacaaggcaaagcaaagagaaccaaagtctcagttctgcagaggagctgagtgccccaggagctagtggagggtgaggtcaatgtgtgctcatcttaaaggaaaaactcatggaagaggaaggtgctaatgttgaacacctattttgcgccagacctcttaattgttttaaatctttgaggtatcatcatgaggtcgtttttaagttcagtacagatgaggggcccaaggtcagaattatgtgtccagggttgcccagccacaaaccagcagatcagggtttgatgccaggcctctctaaccctgcatcctgagtggaatatagaagccggtgggaagtttggatgggaaggagatggatgccttcaagttcttgtcttggtgttaggtgtgttaaaggactggctgggatgagaagagtgttgctggcttgagcatagcacgagcagcacagctcctgtgttcctctgggtggtggggtcacctctcttaaaggtagaggctttcagctgattctgtcttttcaggccaggaatagttgctgaacaccccaggcctgctgaggtccctccttgagtctcatgttcaagcagtcttgtgagtaaagcactggctaccccttttcacttactatcttttcaagcatgttctaccaccttggaaggtaagaggttagtaccttcttccagagcagagggcaggcattcttgctgtgcgttgtgaaagggtagagtcctgcgctcctttcttgtagtagtccaatggctcatgcaggtgcctctgactcccctatgggaactggggcttgggagggtggtggaaaatgctgatgctctggctattgctattgttttgaataatcagtggtcccttgtccctaatcgaggaattttgtattttctaccagtgtccatgaaactgggaggcgaccgtgttagctgccagttcctgacagccacctctcaccagtggcttcactctgtgtccctgacccagcacatggcacaagagtgcctgccatccgtcagtgtttctacagcagcaatcccaagatgctggagctagaggggacctgacctgagagaagataccttcagtggctgccaggctgttccttggaacctgtgcaggggtaagtgtgcaggaaggtctgacctggcaagtcacttcactcctgttttatttagagtcacctggctaagagaaagttcanaaaccntnaccntatctctcgacccttcccgtatgatcagagtcagtcgattggatcccgga

SEQ ID NO: 440806 - DNA, 977 bp, Homo sapiens
tccactgagttgacacgcagacgcagcctcaggaccctaaactctacgccccagcacaccctaccaagcgagcgcccgcggccgcgtgacgtcatctaccccaaacgctgtggccccggccacgcacggcttcggggcgggactacgcggtgacgtcgaggtgcgcggcgcagcgcgcggcgtcagtcttggctggcagacctgtactccgtactccgtacttcgtagtcgcagcggcgcggtcttcggcagtctagtcatccaccgccatcctgggccccacgtgttgcctgaccattcctgagcccaggtgggagccgtggctgaggtgacggtctcaaagtggaagagcttactgtcacagcaactcctttgcaagatgccccggccaggaatagttgctgaacaccccaggcctgctgaggtccctccttgagtctcatgttcaagcagtctttgtccatgaaactgggaggcgaccgtgttagctgccagttcctgacagccacctctcaccagtggcttcactctgtgtccctgacccagcacatggcacaagagtgcctgccatccgtcagtgtttctacagcagcaatcccaagatgctggagctagaggggacctgacctgagagaagataccttcagtggctgccaggctgttccttggaacctgtgcagggatgaggcctgcctgtgttaatacacctagtgaggagtggagctgaatttgaatgcaagccttggcaccttaattgagcaagtttgaaacctcgcttgttgcccttctggaaggagtcaggaatttccagttctgggcctgggctgtgggtctggcagacagacctctggccctaggtttgggtgccaggttctctgcttccagaatgagaagctttgctgtgcaccaggacctgggcccttctggtatctcctgaatgaaaaacaagggatatttaataaatatggatttaaata

SEQ ID NO: 440807 - DNA, 1135 bp, Homo sapiens
  misc_feature (1073)..(1073): n is a, c, g, or t
  misc_feature (1079)..(1079): n is a, c, g, or t
  misc_feature (1081)..(1081): n is a, c, g, or t
  misc_feature (1085)..(1085): n is a, c, g, or t
tccactgagttgacacgcagacgcagcctcaggaccctaaactctacgccccagcacaccctaccaagcgagcgcccgcggccgcgtgacgtcatctaccccaaacgctgtggccccggccacgcacggcttcggggcgggactacgcggtgacgtcgaggtgcgcggcgcagcgcgcggcgtcagtcttggctggcagacctgtactccgtactccgtacttcgtagtcgcagcggcgcggtcttcggcagtctagtcatccaccgccatcctgggccccacgtgttgcctgaccattcctgagcccaggtgggagccgtggctgaggtgacggtctcaaagtggaagagcttactgtcacagcaactcctttgcaagatgccccggccaggaatagttgctgaacaccccaggcctgctgaggtccctccttgagtctcatgttcaagcagtcttgtgagtaaagcactggctaccccttttcacttactatcttttcaagcatgttctaccaccttggaaggtaagaggttagtaccttcttccagagcagagggcaggcattcttgctgtgcgttgtgaaagggtagagtcctgcgctcctttcttgtagtagtccaatggctcatgcaggtgcctctgactcccctatgggaactggggcttgggagggtggtggaaaatgctgatgctctggctattgctattgttttgaataatcagtggtcccttgtccctaatcgaggaattttgtattttctaccagtgtccatgaaactgggaggcgaccgtgttagctgccagttcctgacagccacctctcaccagtggcttcactctgtgtccctgacccagcacatggcacaagagtgcctgccatccgtcagtgtttctacagcagcaatcccaagatgctggagctagaggggacctgacctgagagaagataccttcagtggctgccaggctgttccttggaacctgtgcaggggtaagtgtgcaggaaggtctgacctggcaagtcacttcactcctgttttatttagagtcacctggctaagagaaagttcanaaaccntnaccntatctctcgacccttcccgtatgatcagagtcagtcgattggatcccgga

SEQ ID NO: 440808 - DNA, 830 bp, Homo sapiens
tccactgagttgacacgcagacgcagcctcaggaccctaaactctacgccccagcacaccctaccaagcgagcgcccgcggccgcgtgacgtcatctaccccaaacgctgtggccccggccacgcacggcttcggggcgggactacgcggtgacgtcgaggtgcgcggcgcagcgcgcggcgtcagtcttggctggcagacctgtactccgtactccgtacttcgtagtcgcagcggcgcggtcttcggcagtctagtcatccaccgccatcctgggccccacgtgttgcctgaccattcctgagcccagtgtccatgaaactgggaggcgaccgtgttagctgccagttcctgacagccacctctcaccagtggcttcactctgtgtccctgacccagcacatggcacaagagtgcctgccatccgtcagtgtttctacagcagcaatcccaagatgctggagctagaggggacctgacctgagagaagataccttcagtggctgccaggctgttccttggaacctgtgcagggatgaggcctgcctgtgttaatacacctagtgaggagtggagctgaatttgaatgcaagccttggcaccttaattgagcaagtttgaaacctcgcttgttgcccttctggaaggagtcaggaatttccagttctgggcctgggctgtgggtctggcagacagacctctggccctaggtttgggtgccaggttctctgcttccagaatgagaagctttgctgtgcaccaggacctgggcccttctggtatctcctgaatgaaaaacaagggatatttaataaatatggatttaaata

SEQ ID NO: 440809 - DNA, 778 bp, Homo sapiens
cttgctgcagcattattctgggaatttatgccatgggcccactttctattgatagatgaacctgtcagttggttcattcctcatgcattccaaaaacatgcattgagcttgggtcaagggccaggcatgaggataggcatagttcctgccctcaagaagttcatgagcataggaggtgtatagacaaattgcaaaacaggcaagggtaccaaggtggcataagaaagcatcaattaactatcttggggaccagagaaaccctgagagaagcaatggctgctaaggttttaaaacaaagagtaaatttccagtagaatgaaaggattggcagggcatgccacaatgagggaagaatgtgcaaaggtgtggacgcatgaaatgccatgatgggttccgctgagcaacgtggcattgccagagcatgatgtggaagctcaggggttgaggggtcccttcataggtaggcagggctgaatcctaaggaaactggtaggaagtgtggaggagctagacttgtcatggaaggggtttggagccactggagcctttaaatcaggatagagtcatgatcagaattgcattttaggaaaatccctttggtggctgaatggagactgtggactggatgggcgtgggatggtggcatgggagctatgaggcctttttgaaatgtcaatactaaaacatagttgatggcctgctttacacgatgtttcctctacagcagatagtgagtttccaacacaaaatttatttccataaaagtctttggataaag

SEQ ID NO: 440810 - DNA, 939 bp, Homo sapiens
cttgctgcagcattattctgggaatttatgccatgggcccactttctattgatagatgaacctgtcagttggttcattcctcatgcattccaaaaacatgcattgagcttgggtcaagggccaggcatgaggataggcatagttcctgccctcaagaagttcatgagcataggaggtgtatagacaaattgcaaaacaggcaagggtaccaaggtggcataagaaagcatcaattaactatcttggggaccagagaaaccctgagagaagcaatggctgctaaggttttaaaacaaagagtaaatttccagtagaatgaaaggattggcagggcatgccacaatgagggaagaatgtgcaaaggtgtggacgcatgaaatgccatgatgggttccgctgagcaacgtggcattgccagagcatgatgtggaagctcaggggttgaggggtcccttcataggtaggcagggctgaatcctaaggaaactggtaggaagtgtggaggagctagacttgtcatggaaggggtttggagccactggagcctttaaatcaggatagagtcatgatcagaattgcattttaggaaaatccctttggtggctgaatggagactgtggactggatgggcgtgggatggtggcatgggagctatgaggcctttttgaaatgtcaatactaaaacatagttgatggcctgctttacacgatgtttcctctacagcagatagtgagtttccaacacaaaatttatttccataaaagtctttggataaagcaccttaagagggattttcaacaaggagaggggagcattcaaagagctaatgtttccagttttattttgtcttggtgtagaattgctgggagaggtgtccagccatcctgccatttcttcttcccttgcacagaatgtggcacatttagctccaggcttga

SEQ ID NO: 440811 - DNA, 581 bp, Homo sapiens
ctggagaaaggttaaagaatgatcttgtggcagtcaagaccttctctctaataggcacaatgtaattaattatgattctgttctaggtttcctgtggcataatgtgatggtcaattttctgcatcaacttgactgggctaagggatgctcagatggcaggtaaaatcattgtgcttgtgagggtgtttccagaagagatttgcctttgaatcagaagacagcaaagatttccttcagcaatgaaggaggcatccaccaaactgtcagggcccagagagaagaaaaagacaggaagggtgaatttgacctctctgactgggacatccatctctgcctatcctgggacctccacactcctggttctctggccttcagacttgatcagggactaacaccatcgcctcccacccccacctttgttctgaggcctttagcctctgaatgataccactggctttcctgcttctctatcctgcagtcggcagatcatgggacttcttcactccaaaattgtgtgagccaattcccataacagatagataaatttataaataaacacacaaatttcctacagaaaaaaa

SEQ ID NO: 440812 - DNA, 1424 bp, Homo sapiens
agctggcgaggccgagcccctcctagtgcttccggaccttgctccctgaacactcggaggtggcggtggatcttactccttccagccagtgaggatccagcaacctgctccgtgcctcccgcgcctgttggttggaagtgacgaccttgaagatcggccggttggaagtgacgaccttgaagatcggcgggcgcagcggggccgagggggcgggtctggcgctaggtccagcccctgcgtgccgggaaccccagaggaggtcgcagttcagcccagctgaggcctgtctgcagaatcgacaccaaccagcatcatgtccatgacactggggtactgggacatccgcgggctggcccacgccatccgcctgctcctggaatacacagactcaagctacgaggaaaagaagtatacgatgggggacgctcctgactatgacagaagccagtggctgaatgaaaaattcaagctgggcctggactttcccaatctgccctacttgattgatggggctcacaagatcacccagagcaacgccatcctgtgctacattgcccgcaagcacaacctgtgtggggagacagaagaggagaagattcgtgtggacattttggagaaccaggctatggacagctcctatgcagctggccagagtctgctacagcccagactttgagaaactgaagccagaatacttggaggaactccctgacaatgctgaagctctactcacagtttctggggaagcaggccatggtttgttggagacaagatcacctttgtagatttcctcgcctatgatgtccttgacctccaccgtatatttgagcccaactgcttggacgccttcccaaatctgaaggacttcatctcccgctttgagggcttggagaagatctctgcctacatgaagtccagccgcttcctcccaagacctgtgttcacaaagatggctgtctggggcaacaagtagggccttgaaggccaggaggtgggagtgaggagcccatactcagcctgctgcccaggctgtgcagcgcagctggactctgcatcccagcacctgcctcctcgttcctttctcctgtttattcccatctttactcccaagacttcattgtccctcttcactccccctaaacccctgtcccatgcaggccctttgaagcctcagctacccactatccttcgtgaacatccccctcccatcattacccttccctgcactaaagccagcctgaccttccttcctgttagtggttgtatctgctttgaagggcctacctggcccctcgcctgtggagctcagccctgagctgtccccgtgttgcataaggagcagcattgactggtttacaggccctgctcctgcagcatggcccctgccttaggcctacctgatcaaaataaagcctcagccacat

SEQ ID NO: 440813 - DNA, 703 bp, Homo sapiens
gtgttccaagtgttccccctgtgagatgagtagcacactgattttactgctattcaccgaccttctcctctgcatgaggcagggtgtgaggcacagtgggagttgcatagatgactgccccatcctggaaatgagtgcagtgagaggcctgcaggcagagcagcctgtgagggcttggagaagatctctgcctacatgaagtccagccgcttcctcccaaaacctctgtacacaagggtggctgtctggggcaacaagtaatgccttgaaggccaggaggtgggagtgaggagcccatactcagcctgctgcccaggctgtgcagcgcagctggactctgcatcccagcacctgcctcctcgttcctttctcctgtttattcccatctttacccccaagactttattgggcctcttcacttcccctaaacccctgtcccatgcaggccctttgaagcctcagctacccactttccttcatgaacatccccctcccaacactacccttccctgcactaaagccagcctgaccttccttcctgttagtggttgtatctgctttgaagggcctacctggcccctcgcctgtggagctcagccctgagctgtccccgtgttgcatgacagcattgactggtttacaggccctgctcctgcagcatggcccctgccttaggcctacctgatcaaaataaagcctcagc

SEQ ID NO: 440814 - DNA, 239 bp, Homo sapiens
gacctgcgggccatctctcccagctggcccacgccatccgcctgctcctggaatacacagactcaagctatgaggaaaagaagtacacgatgggggacgctggcccctcgcctgtggagctcagccccgagctgtccccgtgttgcatgaaggagcagcattgactggtttacaggccctgctcctgcagcatggtccctgccttaggcctacctgatggaagtaaagcctcaaccaca

SEQ ID NO: 440815 - DNA, 452 bp, Homo sapiens
ttgacagctgttttctgcctcaggagaaactgaaaccagaatacctgcaggcactccctgaaatgctgaagctctactcacagtttctggggaagcagccatggtttcttggggacaagatcacctttgtggatttcatcgcttatgatgtccttgagagaaaccaagtatttgagcccagctgcctggatgccttcccaaacctgaaggacttcatctcccgatttgagggcttggagaagatctctgcctacatgaagtccagccgcttcctcccaagacctgtgttcacaaagatggctgtctggggaggaagcggctggacttcatgtaggcagagatcttctccaagccaaattctggattgtagcagatcatgcccagctgcatatggttgtccatggtctggttctccaaaatgtccacacgaagcttctccccttctgtctccc

SEQ ID NO: 440816 - DNA, 1509 bp, Homo sapiens
  misc_feature (1461)..(1461): n is a, c, g, or t
  misc_feature (1471)..(1471): n is a, c, g, or t
agctggcgaggccgagcccctcctagtgcttccggaccttgctccctgaacactcggaggtggcggtggatcttactccttccagccagtgaggatccagcaacctgctccgtgcctcccgcgcctgttggttggaagtgacgaccttgaagatcggccggttggaagtgacgaccttgaagatcggcgggcgcagcggggccgagggggcgggtctggcgctaggtccagcccctgcgtgccgggaaccccagaggaggtcgcagttcagcccagctgaggcctgtctgcagaatcgacaccaaccagcatcatgtccatgacactggggtactgggacatccgcgggctggcccacgccatccgcctgctcctggaatacacagactcaagctacgaggaaaagaagtatacgatgggggacgctcctgactatgacagaagccagtggctgaatgaaaaattcaagctgggcctggactttcccaatctgccctacttgattgatggggctcacaagatcacccagagcaacgccatcctgtgctacattgcccgcaagcacaacctgtgtggggagacagaagaggagaagattcgtgtggacattttggagaaccaggctatggacagctcctatgcagctggccagagtctgctacagcccagactttgagaaactgaagccagaatacttggaggaactccctgacaatgctgaagctctactcacagtttctggggaagcaggccatggtttgttggagacaagatcacctttgtagatttcctcgcctatgatgtccttgacctccaccgtatatttgagcccaactgcttggacgccttcccaaatctgaaggacttcatctcccgctttgagggcttggagaagatctctgcctacatgaagtccagccgcttcctcccaagacctgtgttcacaaagatggctgtctggggcaacaagtagggccttgaaggccaggaggtgggagtgaggagcccatactcagcctgctgcccaggctgtgcagcgcagctggactctgcatcccagcacctgcctcctcgttcctttctcctgtttattcccatctttactcccaagacttcattgtccctcttcactccccctaaacccctgtcccatgcaggccctttgaagcctcagctacccactatccttcgtgaacatccccctcccatcattacccttccctgcactaaagccagcctgaccttccttcctgttagtggttgtatctgctttgaagggcctacctggcccctcgcctgtggagctcagccctgagctgtccccgtgttgcataaggagcagcattgactggtttacaggccctgctcctgcagcatggcccctgccttaggcctacctgatcaaaataaagcctcagccacataaaaaaaatattttattctcctcatttttactttctnttttctactntccctcttacctctccccctttcatttcacctaaaaaa

SEQ ID NO: 440817 - DNA, 1560 bp, Homo sapiens
agctggcgaggccgagcccctcctagtgcttccggaccttgctccctgaacactcggaggtggcggtggatcttactccttccagccagtgaggatccagcaacctgctccgtgcctcccgcgcctgttggttggaagtgacgaccttgaagatcggccggttggaagtgacgaccttgaagatcggcgggcgcagcggggccgagggggcgggtctggcgctaggtccagcccctgcgtgccgggaaccccagaggaggtcgcagttcagcccagctgaggcctgtctgcagaatcgacaccaaccagcatcatgtccatgacactggggtactgggacatccgcgggctggcccacgccatccgcctgctcctggaatacacagactcaagctacgaggaaaagaagtatacgatgggggacgctcctgactatgacagaagccagtggctgaatgaaaaattcaagctgggcctggactttcccaatctgccctacttgattgatggggctcacaagatcacccagagcaacgccatcctgtgctacattgcccgcaagcacaacctgtgtggggagacagaagaggagaagattcgtgtggacattttggagaaccaggctatggacagctcctatgcagctggccagagtctgctacagcccagactttgagaaactgaagccagaatacttggaggaactccctgacaatgctgaagctctactcacagtttctggggaagcaggccatggtttgttggagacaagatcacctttgtagatttcctcgcctatgatgtccttgacctccaccgtatatttgagcccaactgcttggacgccttcccaaatctgaaggacttcatctcccgctttgagggcttggagaagatctctgcctacatgaagtccagccgcttcctcccaagacctgtgttcacaaagatggctgtctggggcaacaagtagggccttgaaggccaggaggtgggagtgaggagcccatactcagcctgctgcccaggctgtgcagcgcagctggactctgcatcccagcacctgcctcctcgttcctttctcctgtttattcccatctttactcccaagacttcattgtccctcttcactccccctaaacccctgtcccatgcaggccctttgaagcctcagctacccactatccttcgtgaacatccccctcccatcattacccttccctgcactaaagccagcctgaccttccttcctgttagtggttgtatctgctttgaagggcctacctggcccctcgcctgtggagctcagccctgagctgtccccgtgttgcataaggagcagcattgactggtttacaggccctgctcctgcagcatggcccctgccttaggcctacctgatcaaaataaagcctcagccacataaaaagaaaaaaaaaaaaaaaaaaaaagaaaaaacaatgggggggcccaatacaaaaattaaaaataaaaaacctcgggggggggcccggtccccaattggccttatagggagcggtttaacaatccatgggcggt

SEQ ID NO: 440818 - DNA, 1851 bp, Homo sapiens
agctggcgaggccgagcccctcctagtgcttccggaccttgctccctgaacactcggaggtggcggtggatcttactccttccagccagtgaggatccagcaacctgctccgtgcctcccgcgcctgttggttggaagtgacgaccttgaagatcggccggttggaagtgacgaccttgaagatcggcgggcgcagcggggccgagggggcgggtctggcgctaggtccagcccctgcgtgccgggaaccccagaggaggtcgcagttcagcccagctgaggcctgtctgcagaatcgacaccaaccagcatcatgtccatgacactggggtactgggacatccgcgggctggcccacgccatccgcctgctcctggaatacacagactcaagctacgaggaaaagaagtatacgatgggggacggtaatgacacccttgtgtccgggctctgcccactcacgctgagttggcaccaagcaacccatggtggccacctgtggctacctctgcaggcctcccctgctggagctgcaggctgtcccttccctgagccccggtgagggagtcctgtggccttgcaaggcagaatgctggggcgggatgctgggccccctgtttaattgggttgggtgtccctcagagcttccctaaaccctggaagccttagccgtgtggggtccagagccctcagcgggattctttgtccctgaaccctgggatgtgggactgagtggtcagattctagatccacctgtctcagggatcttgccactggttccttgggagggtccccgggaaggagggctgggctctggggaggtttgttttcacttcttcttccccacggcagctcctgactatgacagaagccagtggctgaatgaaaaattcaagctgggcctggactttcccaatctgccctacttgattgatggggctcacaagatcacccagagcaacgccatcctgtgctacattgcccgcaagcacaacctgtgtggggagacagaagaggagaagattcgtgtggacattttggagaaccaggctatggacagctcctatgcagctggccagagtctgctacagcccagactttgagaaactgaagccagaatacttggaggaactccctgacaatgctgaagctctactcacagtttctggggaagcaggccatggtttgttggagacaagatcacctttgtagatttcctcgcctatgatgtccttgacctccaccgtatatttgagcccaactgcttggacgccttcccaaatctgaaggacttcatctcccgctttgagggcttggagaagatctctgcctacatgaagtccagccgcttcctcccaagacctgtgttcacaaagatggctgtctggggcaacaagtagggccttgaaggccaggaggtgggagtgaggagcccatactcagcctgctgcccaggctgtgcagcgcagctggactctgcatcccagcacctgcctcctcgttcctttctcctgtttattcccatctttactcccaagacttcattgtccctcttcactccccctaaacccctgtcccatgcaggccctttgaagcctcagctacccactatccttcgtgaacatccccctcccatcattacccttccctgcactaaagccagcctgaccttccttcctgttagtggttgtatctgctttgaagggcctacctggcccctcgcctgtggagctcagccctgagctgtccccgtgttgcataaggagcagcattgactggtttacaggccctgctcctgcagcatggcccctgccttaggcctacctgatcaaaataaagcctcagccacat

SEQ ID NO: 440819 - DNA, 1201 bp, Homo sapiens
agcaaggcttcccctctaccctctctgggcctctcacaaacgctgagccccgccccgctgaggcctgtctgcagaatccacagcaaccagcaccatgcccatgacactggggtactggaacatccgcgggctggcccacgccatccgcctgctcctggaatacacagactcaagctatgaggaaaagaagtacacgatgggggacgctcctgattatgacagaagccagtggctgaatgaaaaattcaagctgggcctggactttcccaatctgccctacttgattgatggggctcacaagatcacccagagcaacgccatcttgtgctacattgcccgcaagcacaacctgtgtggggagacagaagaggagaagattcgtgtggacattttggagaaccagaccatggacaaccatatgcagctgggcatgatctgctacaatccagaatttgagaaactgaagccaaagtacttggaggaactccctgaaaagctaaagctctactcagagtttctggggaagcggccatggtttgcaggaaacaagatcacttttgtagattttctcgtctatgatgtccttgacctccaccgtatatttgagcccaagtgcttggacgccttcccaaatctgaaggacttcatctcccgctttgagggcttggagaagatctctgcctacatgaagtccagccgcttcctcccaagacctgtgttctcaaagatggctgtctggggcaacaagtagggccttgaaggccaggaggtgggagtgaggagcccatactcagcctgctgcccaggctgtgcagcgcagctggactctgcatcccagcacctgcctcctcgttcctttctcctgtttattcccatctttactcccaagacttcattgtccctcttcactccccctaaacccctgtcccatgcaggccctttgaagcctcagctacccactatccttcgtgaacatcccctcccatcattacccttccctgcactaaagccagcctgaccttccttcctgttagtggttgtgtctgctttaaagggcctgcctggcccctcgcctgtggagctcagccccgagctgtccccgtgttgcatgaaggagcagcattgactggtttacaggccctgctcctgcagcatggtccctgccttaggcctacctgatggaagtaaagcctcaaccaca

SEQ ID NO: 440820 - DNA, 1415 bp, Homo sapiens
agctggcgaggccgagcccctcctagtgcttccggaccttgctccctgaacactcggaggtggcggtggatcttactccttccagccagtgaggatccagcaacctgctccgtgcctcccgcgcctgttggttggaagtgacgaccttgaagatcggccggttggaagtgacgaccttgaagatcggcgggcgcagcggggccgagggggcgggtctggcgctaggtccagcccctgcgtgccgggaaccccagaggaggtcgcagttcagcccagctgaggcctgtctgcagaatcgacaccaaccagcatcatgtccatgacactggggtactgggacatccgcgggctggcccacgccatccgcctgctcctggaatacacagactcaagctacgaggaaaagaagtatacgatgggggacgctcctgactatgacagaagccagtggctgaatgaaaaattcaagctgggcctggactttcccaatctgccctacttgattgatggggctcacaagatcacccagagcaacgccatcctgtgctacattgcccgcaagcacaacctgtgtggggagacagaagaggagaagattcgtgtggacattttggagaaccaggctatggacagctcctatgcagctggccagagtctgctacagcccagactttgagaaactgaagccagaatacttggaggaactccctgacaatgctgaagctctactcacagtttctggggaagcaggccatggtttgttggagacaagatcacctttgtagatttcctcgcctatgatgtccttgacctccaccgtatatttgagcccaactgcttggacgccttcccaaatctgaaggacttcatctcccgctttgagggcttggagaagatctctgcctacatgaagtccagccgcttcctcccaaaacctctgtacacaagggtggctgtctggggcaacaagtaatgccttgaaggccaggaggtgggagtgaggagcccatactcagcctgctgcccaggctgtgcagcgcagctggactctgcatcccagcacctgcctcctcgttcctttctcctgtttattcccatctttacccccaagactttattgggcctcttcacttcccctaaacccctgtcccatgcaggccctttgaagcctcagctacccactttccttcatgaacatccccctcccaacactacccttccctgcactaaagccagcctgaccttccttcctgttagtggttgtatctgctttgaagggcctacctggcccctcgcctgtggagctcagccctgagctgtccccgtgttgcatgacagcattgactggtttacaggccctgctcctgcagcatggcccctgccttaggcctacctgatcaaaataaagcctcagc

SEQ ID NO: 440821 - DNA, 1201 bp, Homo sapiens
agcaaggcttcccctctaccctctctgggcctctcacaaacgctgagccccgccccgctgaggcctgtctgcagaatccacagcaaccagcaccatgcccatgacactggggtactggaacatccgcgggctggcccattccatccgcctgctcctggaatacacagactcaagctacgaggaaaagaagtacacgatgggggacgctcctgattatgacagaagccagtggctgaatgaaaaattcaagctgggcctggactttcccaatctgccctacttgattgatgggactcacaagatcacccagagcaacgccatcctgcggtacattgcccgcaagcacaacctgtgcggggaatcagaaaaggagcagattcgcgaagacattttggagaaccagtttatggacagccgtatgcagctggccaaactctgctatgacccagattttgagaaactgaagccaaagtacttggaggaactccctgaaaagctaaagctctactcagagtttctggggaagcggccatggtttgcaggaaacaagatcacttttgtagattttctcgtctatgatgtccttgacctccaccgtatatttgagcccaagtgcttggacgccttcccaaatctgaaggacttcatctcccgctttgagggcttggagaagatctctgcctacatgaagtccagccgcttcctcccaagacctgtgttctcaaagatggctgtctggggcaacaagtagggccttgaaggccaggaggtgggagtgaggagcccatactcagcctgctgcccaggctgtgcagcgcagctggactctgcatcccagcacctgcctcctcgttcctttctcctgtttattcccatctttactcccaagacttcattgtccctcttcactccccctaaacccctgtcccatgcaggccctttgaagcctcagctacccactatccttcgtgaacatcccctcccatcattacccttccctgcactaaagccagcctgaccttccttcctgttagtggttgtgtctgctttaaagggcctgcctggcccctcgcctgtggagctcagccccgagctgtccccgtgttgcatgaaggagcagcattgactggtttacaggccctgctcctgcagcatggtccctgccttaggcctacctgatggaagtaaagcctcaaccaca

SEQ ID NO: 440822 - DNA, 1027 bp, Homo sapiens
acgccatcctgtgctacattgcccgcaagcacaacctgtgtggggagacagaagaggagaagattcgtgtggacattttggacaaccagcatcatgtccatgacactggggtactgggacatccgcgggctggcccacgccatccgcctgctcctggaatacacagactcaagctacgaggaaaagaagtatacgatgggggacgctcctgactatgacagaagccagtggctgaatgatcacaagatcacccagagtctgctacagccctgactttgagaaactgaagccagaatacttggaggaactccctgacaatgctgaagctctactcacagtttctggggaagcaggccatggtttgttggagacaagatcacctttgtagatttcctcgcctatgatgtccttgacctccaccgtatatttgagcccaactgcttggacgccttcccaaatctgaaggacttcatctcccgctttgagggcttggagaagatctctgcctacatgaagtccagccgcttcctcccaagacctgtgttcacaaagatggctgtctggggcaacaagtagggccttgaaggccaggaggtgggagtgaggagcccatactcagcctgctgcccaggctgtgcagcgcagctggactctgcatcccagcacctgcctcctcgttcctttctcctgtttattcccatctttactcccaagacttcattgtccctcttcactccccctaaacccctgtcccatgcaggccctttgaagcctcagctacccactatccttcgtgaacatccccctcccatcattacccttccctgcactaaagccagcctgaccttccttcctgttagtggttgtatctgctttgaagggcctacctggcccctcgcctgtggagctcagccctgagctgtccccgtgttgcataaggagcagcattgactggtttacaggccctgctcctgcagcatggcccctgccttaggcctacctgatcaaaataaagcctcagccacat

SEQ ID NO: 440823 - DNA, 1342 bp, Homo sapiens
agctggcgaggccgagcccctcctagtgcttccggaccttgctccctgaacactcggaggtggcggtggatcttactccttccagccagtgaggatccagcaacctgctccgtgcctcccgcgcctgttggttggaagtgacgaccttgaagatcggccggttggaagtgacgaccttgaagatcggcgggcgcagcggggccgagggggcgggtctggcgctaggtccagcccctgcgtgccgggaaccccagaggaggtcgcagttcagcccagctgaggcctgtctgcagaatcgacaccaaccagcatcatgtccatgacactggggtactgggacatccgcgggctggcccacgccatccgcctgctcctggaatacacagactcaagctacgaggaaaagaagtatacgatgggggacgctcctgactatgacagaagccagtggctgaatgaaaaattcaagctgggcctggactttcccaatgtggggagacagaagaggagaagattcgtgtggacattttggagaaccaggctatggacagctcctatgcagctggccagagtctgctacagcccagactttgagaaactgaagccagaatacttggaggaactccctgacaatgctgaagctctactcacagtttctggggaagcaggccatggtttgttggagacaagatcacctttgtggatttcatcgcttatgatgtccttgagagaaaccaagtatttgagcccagctgcctggatgccttcccaaacctgaaggacttcatctcccgatttgagggcttggagaagatctctgcctacatgaagtccagccgcttcctcccaagacctgtgttcacaaagatggctgtctggggcaacaagtagggccttgaaggccaggaggtgggagtgaggagcccatactcagcctgctgcccaggctgtgcagcgcagctggactctgcatcccagcacctgcctcctcgttcctttctcctgtttattcccatctttactcccaagacttcattgtccctcttcactccccctaaacccctgtcccatgcaggccctttgaagcctcagctacccactatccttcgtgaacatccccctcccatcattacccttccctgcactaaagccagcctgaccttccttcctgttagtggttgtatctgctttgaagggcctacctggcccctcgcctgtggagctcagccctgagctgtccccgtgttgcataaggagcagcattgactggtttacaggccctgctcctgcagcatggcccctgccttaggcctacctgatcaaaataaagcctcagccacat

SEQ ID NO: 440824 - DNA, 1573 bp, Homo sapiens
ggtttaggcctgtctgcggaatccgcaccaaccagcaccatgcccatgatactggggtactgggacatccgcgggctggcccacgccatccgcctgctcctggaatacacagactcaagctatgaggaaaagaagtacacgatgggggacggtaatggcaccctcgtgttcgggctctgcccactcacgctaagttggcaccaagcaacccatggtggccacctgtggctgcctctgcaggcctcccctgctggagctgcaggctgtctcttccctgagccccggtgagggagccctctggccttgcaaggcagaatgctggggtgggatgctgggccccctgtctaattgggacgggtgtccctcagggcttgcctaaaccctggaagccttagctgtgtggggtccagagccctcagcgggattctttgtccctgaaccctgggatgtgggactgagtggtcagattctagatccacctgtctcagggatcttgccactggctccgtgggagggtccccgggaaggagggctgggctctggggaggtttgttttcacttcttcttccccaccacagctcctgattatgacagaagccagtggctgaatgaaaaattcaagctgggcctggactttcccaatctgccctacttgattgatggggctcacaagatcacccagagcaacgccatcttgtgctacattgcccgcaagcacaacctgtgtggggagacagaagaggagaagattcgtgtggacattttggagaaccagaccatggacaaccatatgcagctgggcatgatctgctacaatccagaatttgagaaactgaagccaaagtacttggaggaactccctgaaaagctaaagctctactcagagtttctggggaagcggccatggtttgcaggaaacaagatcacttttgtagattttctcgtctatgatgtccttgacctccaccgtatatttgagcccaagtgcttggacgccttcccaaatctgaaggacttcatctcccgctttgagggcttggagaagatctctgcctacatgaagtccagccgcttcctcccaagacctgtgttctcaaagatggctgtctggggcaacaagtagggccttgaaggccaggaggtgggagtgaggagcccatactcagcctgctgcccaggctgtgcagcgcagctggactctgcatcccagcacctgcctcctcgttcctttctcctgtttattcccatctttactcccaagacttcattgtccctcttcactccccctaaacccctgtcccatgcaggccctttgaagcctcagctacccactatccttcgtgaacatcccctcccatcattacccttccctgcactaaagccagcctgaccttccttcctgttagtggttgtgtctgctttaaagggcctgcctggcccctcgcctgtggagctcagccccgagctgtccccgtgttgcatgaaggagcagcattgactggtttacaggccctgctcctgcagcatggtccctgccttaggcctacctgatggaagtaaagcctcaaccaca

SEQ ID NO: 440825 - DNA, 1092 bp, Homo sapiens
ggtttaggcctgtctgcggaatccgcaccaaccagcaccatgcccatgatactggggtactgggacatccgcgggctggcccacgccatccgcctgctcctggaatacacagactcaagctatgaggaaaagaagtacacgatgggggacgctcctgattatgacagaagccagtggctgaatgatcacaagatcacccagagcaacgccatcttgtgctacattgcccgcaagcacaacctgtgtggggagacagaagaggagaagattcgtgtggacattttggagaaccagaccatggacaaccatatgcagctgggcatgatctgctacaatccagaatttgagaaactgaagccaaagtacttggaggaactccctgaaaagctaaagctctactcagagtttctggggaagcggccatggtttgcaggaaacaagatcacttttgtagattttctcgtctatgatgtccttgacctccaccgtatatttgagcccaagtgcttggacgccttcccaaatctgaaggacttcatctcccgctttgagggcttggagaagatctctgcctacatgaagtccagccgcttcctcccaagacctgtgttctcaaagatggctgtctggggcaacaagtagggccttgaaggccaggaggtgggagtgaggagcccatactcagcctgctgcccaggctgtgcagcgcagctggactctgcatcccagcacctgcctcctcgttcctttctcctgtttattcccatctttactcccaagacttcattgtccctcttcactccccctaaacccctgtcccatgcaggccctttgaagcctcagctacccactatccttcgtgaacatcccctcccatcattacccttccctgcactaaagccagcctgaccttccttcctgttagtggttgtgtctgctttaaagggcctgcctggcccctcgcctgtggagctcagccccgagctgtccccgtgttgcatgaaggagcagcattgactggtttacaggccctgctcctgcagcatggtccctgccttaggcctacctgatggaagtaaagcctcaaccaca

SEQ ID NO: 440826 - DNA, 1492 bp, Homo sapiens
agcaaggcttcccctctaccctctctgggcctctcacaaacgctgagccccgccccgctgaggcctgtctgcagaatccacagcaaccagcaccatgcccatgacactggggtactggaacatccgcgggctggcccacgccatccgcctgctcctggaatacacagactcaagctatgaggaaaagaagtacacgatgggggacgctcctgattatgacagaagccagtggctgaatgaaaaattcaagctgggcctggactttcccaatctgccctacttgattgatggggctcacaagatcacccagagcaacgccatcttgtgctacattgcccgcaagcacaacctgtgtggggagacagaagaggagaagattcgtgtggacattttggagaaccagaccatggacaaccatatgcagctgggcatgatctgctacaatccagaatttgagaaactgaagccaaagtacttggaggaactccctgaaaagctaaagctctactcagagtttctggggaagcggccatggtttgcaggaaacaagatcacttttgtagattttctcgtctatgatgtccttgacctccaccgtatatttgagcccaagtgcttggacgccttcccaaatctgaaggacttcatctcccgctttgagggcttggagaagatctctgcctacatgaagtccagccgcttcctcccaagacctgtgttctcaaagatggctgtctggggcaacaagtagggccttgaaggccaggaggtgggagtgaggagcccatactcagcctgctgcccaggctgtgcagcgcagctggactctgcatcccagcacctgcctcctcgttcctttctcctgtttattcccatctttactcccaagacttcattgtccctcttcactccccctaaacccctgtcccatgcaggccctttgaagcctcagctacccactatccttcgtgaacatcccctcccatcattacccttccctgcactaaagccagcctgaccttccttcctgttagtggttgtgtctgctttaaagggcctgcctggcccctcgcctgtggagctcagccccgagctgtccccgtgttgcatgaaggagcagcattgactggtttacaggccctgctcctgcagcatggtccctgccttaggcctacctgatggaagtaaagcctcaaccacaaaaaaaaaagagcaagctaacaacacagaaccaggcgcaacaaccaaccacgaacctggccacccggcggaagacacaacaagacgaccgcagccggacagaaaccaacacgtacacggaacgacacaagcgagaggggggcagcgcaaaaatagtacccgcgggggggcgcaacaagtagccccccacacgtcggtaaaacaggcgcacccaagtgagaatcctaatacaaacagccccgcgcgcgaaacaccccgcgacaggaacaaagcgccacgggccagtggcggc

SEQ ID NO: 440827 - DNA, 1202 bp, Homo sapiens
agcaaggcttcccctctaccctctctgggcctctcacaaacgctgagccccgccccgctgaggcctgtctgcagaatccacagcaaccagcaccatgcccatgacactggggtactggaacatccgcgggctggcccattccatccgcctgctcctggaatacacagactcaagctacgaggaaaagaagtacacgatgggggacgctcctgattatgacagaagccagtggctgaatgaaaaattcaagctgggcctggactttcccaatctgccctacttgattgatgggactcacaagatcacccagagcaacgccatcctgcggtacattgcccgcaagcacaacctgtgcggggaatcagaaaaggagcagattcgcgaagacattttggagaaccagtttatggacagccgtatgcagctggccaaactctgctatgacccagattttgagaaactgaaaccagaatacctgcaggcactccctgaaatgctgaagctctactcacagtttctggggaagcagccatggtttcttggggacaagatcacctttgtggatttcatcgcttatgatgtccttgagagaaaccaagtatttgagcccagctgcctggatgccttcccaaacctgaaggacttcatctcccgatttgagggcttggagaagatctctgcctacatgaagtccagccgcttcctcccaagacctgtgttcacaaagatggctgtctggggcaacaagtagggccttgaaggccaggaggtgggagtgaggagcccatactcagcctgctgcccaggctgtgcagcgcagctggactctgcatcccagcacctgcctcctcgttcctttctcctgtttattcccatctttactcccaagacttcattgtccctcttcactccccctaaacccctgtcccatgcaggccctttgaagcctcagctacccactatccttcgtgaacatccccctcccatcattacccttccctgcactaaagccagcctgaccttccttcctgttagtggttgtatctgctttgaagggcctacctggcccctcgcctgtggagctcagccctgagctgtccccgtgttgcataaggagcagcattgactggtttacaggccctgctcctgcagcatggcccctgccttaggcctacctgatcaaaataaagcctcagccacat

SEQ ID NO: 440828 - DNA, 1736 bp, Homo sapiens
agctggcgaggccgagcccctcctagtgcttccggaccttgctccctgaacactcggaggtggcggtggatcttactccttccagccagtgaggatccagcaacctgctccgtgcctcccgcgcctgttggttggaagtgacgaccttgaagatcggccggttggaagtgacgaccttgaagatcggcgggcgcagcggggccgagggggcgggtctggcgctaggtccagcccctgcgtgccgggaaccccagaggaggtcgcagttcagcccagctgaggcctgtctgcagaatcgacaccaaccagcatcatgtccatgacactggggtactgggacatccgcgggctggcccacgccatccgcctgctcctggaatacacagactcaagctacgaggaaaagaagtatacgatgggggacggtaatgacacccttgtgtccgggctctgcccactcacgctgagttggcaccaagcaacccatggtggccacctgtggctacctctgcaggcctcccctgctggagctgcaggctgtcccttccctgagccccggtgagggagtcctgtggccttgcaaggcagaatgctggggcgggatgctgggccccctgtttaattgggttgggtgtccctcagagcttccctaaaccctggaagccttagccgtgtggggtccagagccctcagcgggattctttgtccctgaaccctgggatgtgggactgagtggtcagattctagatccacctgtctcagggatcttgccactggttccttgggagggtccccgggaaggagggctgggctctggggaggtttgttttcacttcttcttccccacggcagctcctgactatgacagaagccagtggctgaatgaaaaattcaagctgggcctggactttcccaatctgccctacttgattgatggggctcacaagatcacccagagcaacgccatcttgtgctacattgcccgcaagcacaacctgtgtggggagacagaagaggagaagattcgtgtggacattttggagaaccagaccatggacaaccatatgcagctgggcatgatctgctacaatccagaatttgagaaactgaagccaaagtacttggaggaactccctgaaaagctaaagctctactcagagtttctggggaagcggccatggtttgcaggaaacaagggcttggagaagatctctgcctacatgaagtccagccgcttcctcccaagacctgtgttctcaaagatggctgtctggggcaacaagtagggccttgaaggccaggaggtgggagtgaggagcccatactcagcctgctgcccaggctgtgcagcgcagctggactctgcatcccagcacctgcctcctcgttcctttctcctgtttattcccatctttactcccaagacttcattgtccctcttcactccccctaaacccctgtcccatgcaggccctttgaagcctcagctacccactatccttcgtgaacatcccctcccatcattacccttccctgcactaaagccagcctgaccttccttcctgttagtggttgtgtctgctttaaagggcctgcctggcccctcgcctgtggagctcagccccgagctgtccccgtgttgcatgaaggagcagcattgactggtttacaggccctgctcctgcagcatggtccctgccttaggcctacctgatggaagtaaagcctcaaccaca

SEQ ID NO: 440829 - DNA, 1509 bp, Homo sapiens
  misc_feature (1461)..(1461): n is a, c, g, or t
  misc_feature (1471)..(1471): n is a, c, g, or t
agctggcgaggccgagcccctcctagtgcttccggaccttgctccctgaacactcggaggtggcggtggatcttactccttccagccagtgaggatccagcaacctgctccgtgcctcccgcgcctgttggttggaagtgacgaccttgaagatcggccggttggaagtgacgaccttgaagatcggcgggcgcagcggggccgagggggcgggtctggcgctaggtccagcccctgcgtgccgggaaccccagaggaggtcgcagttcagcccagctgaggcctgtctgcagaatcgacaccaaccagcatcatgtccatgacactggggtactgggacatccgcgggctggcccacgccatccgcctgctcctggaatacacagactcaagctacgaggaaaagaagtatacgatgggggacgctcctgactatgacagaagccagtggctgaatgaaaaattcaagctgggcctggactttcccaatctgccctacttgattgatggggctcacaagatcacccagagcaacgccatcctgtgctacattgcccgcaagcacaacctgtgtggggagacagaagaggagaagattcgtgtggacattttggagaaccaggctatggacagctcctatgcagctggccagagtctgctacagcccagactttgagaaactgaagccagaatacttggaggaactccctgacaatgctgaagctctactcacagtttctggggaagcaggccatggtttgttggagacaagatcacctttgtggatttcatcgcttatgatgtccttgagagaaaccaagtatttgagcccagctgcctggatgccttcccaaacctgaaggacttcatctcccgatttgagggcttggagaagatctctgcctacatgaagtccagccgcttcctcccaagacctgtgttcacaaagatggctgtctggggcaacaagtagggccttgaaggccaggaggtgggagtgaggagcccatactcagcctgctgcccaggctgtgcagcgcagctggactctgcatcccagcacctgcctcctcgttcctttctcctgtttattcccatctttactcccaagacttcattgtccctcttcactccccctaaacccctgtcccatgcaggccctttgaagcctcagctacccactatccttcgtgaacatccccctcccatcattacccttccctgcactaaagccagcctgaccttccttcctgttagtggttgtatctgctttgaagggcctacctggcccctcgcctgtggagctcagccctgagctgtccccgtgttgcataaggagcagcattgactggtttacaggccctgctcctgcagcatggcccctgccttaggcctacctgatcaaaataaagcctcagccacataaaaaaaatattttattctcctcatttttactttctnttttctactntccctcttacctctccccctttcatttcacctaaaaaa

SEQ ID NO: 440830 - DNA, 1640 bp, Homo sapiens
agctggcgaggccgagcccctcctagtgcttccggaccttgctccctgaacactcggaggtggcggtggatcttactccttccagccagtgaggatccagcaacctgctccgtgcctcccgcgcctgttggttggaagtgacgaccttgaagatcggccggttggaagtgacgaccttgaagatcggcgggcgcagcggggccgagggggcgggtctggcgctaggtccagcccctgcgtgccgggaaccccagaggaggtcgcagttcagcccagctgaggcctgtctgcagaatcgacaccaaccagcatcatgtccatgacactggggtactgggacatccgcgggctggcccacgccatccgcctgctcctggaatacacagactcaagctacgaggaaaagaagtatacgatgggggacggtaatgacacccttgtgtccgggctctgcccactcacgctgagttggcaccaagcaacccatggtggccacctgtggctacctctgcaggcctcccctgctggagctgcaggctgtcccttccctgagccccggtgagggagtcctgtggccttgcaaggcagaatgctggggcgggatgctgggccccctgtttaattgggttgggtgtccctcagagcttccctaaaccctggaagccttagccgtgtggggtccagagccctcagcgggattctttgtccctgaaccctgggatgtgggactgagtggtcagattctagatccacctgtctcagggatcttgccactggttccttgggagggtccccgggaaggagggctgggctctggggaggtttgttttcacttcttcttccccacggcagctcctgactatgacagaagccagtggctgaatgaaaaattcaagctgggcctggactttcccaatctgccctacttgattgatggggctcacaagatcacccagagcaacgccatcttgtgctacattgcccgcaagcacaacctgtgtggggagacagaagaggagaagattcgtgtggacattttggagaaccagaccatggacaaccatatgcagctgggcatgatctgctacaatccagaatttggcttggagaagatctctgcctacatgaagtccagccgcttcctcccaagacctgtgttctcaaagatggctgtctggggcaacaagtagggccttgaaggccaggaggtgggagtgaggagcccatactcagcctgctgcccaggctgtgcagcgcagctggactctgcatcccagcacctgcctcctcgttcctttctcctgtttattcccatctttactcccaagacttcattgtccctcttcactccccctaaacccctgtcccatgcaggccctttgaagcctcagctacccactatccttcgtgaacatcccctcccatcattacccttccctgcactaaagccagcctgaccttccttcctgttagtggttgtgtctgctttaaagggcctgcctggcccctcgcctgtggagctcagccccgagctgtccccgtgttgcatgaaggagcagcattgactggtttacaggccctgctcctgcagcatggtccctgccttaggcctacctgatggaagtaaagcctcaaccaca

SEQ ID NO: 440831 - DNA, 887 bp, Homo sapiens
tccttttaatccctttatttggccccacccacatgcagattggtccattttacagagagctgattggtccattttacagagtgctgattggtccgttttacagagtgctgattggtctgtttttacagagtgctgattggagaaactgaaaccagaatacctgcaggcactccctgaaatgctgaagctctactcacagtttctggggaagcagccatggtttcttggggacaagatcacctttgtggatttcatcgcttatgatgtccttgagagaaaccaagtatttgagcccagctgcctggatgccttcccaaacctgaaggacttcatctcccgatttgagggcttggagaagatctctgcctacatgaagtccagccgcttcctcccaagacctgtgttcacaaagatggctgtctggggcaacaagtagggccttgaaggccaggaggtgggagtgaggagcccatactcagcctgctgcccaggctgtgcagcgcagctggactctgcatcccagcacctgcctcctcgttcctttctcctgtttattcccatctttactcccaagacttcattgtccctcttcactccccctaaacccctgtcccatgcaggccctttgaagcctcagctacccactatccttcgtgaacatccccctcccatcattacccttccctgcactaaagccagcctgaccttccttcctgttagtggttgtatctgctttgaagggcctacctggcccctcgcctgtggagctcagccctgagctgtccccgtgttgcataaggagcagcattgactggtttacaggccctgctcctgcagcatggcccctgccttaggcctacctgatcaaaataaagcctcagccacat

SEQ ID NO: 440832 - DNA, 1175 bp, Homo sapiens
agcaaggcttcccctctaccctctctgggcctctcacaaacgctgagccccgccccgctgaggcctgtctgcagaatccacagcaaccagcaccatgcccatgacactggggtactggaacatccgcgggctggcccattccatccgcctgctcctggaatacacagactcaagctacgaggaaaagaagtacacgatgggggacgctcctgattatgacagaagccagtggctgaatgaaaaattcaagctgggcctggactttcccaatctgccctacttgattgatgggactcacaagatcacccagagcaacgccatcctgcggtacattgcccgcaagcacaacctgtgcggggaatcagaaaaggagcagattcgcgaagacattttggagaaccagtttatggacagccgtatgcagctggccaaactctgctatgacccagattttgcactccctgaaatgctgaagctctactcacagtttctggggaagcagccatggtttcttggggacaagatcacctttgtggatttcatcgcttatgatgtccttgagagaaaccaagtatttgagcccagctgcctggatgccttcccaaacctgaaggacttcatctcccgatttgagggcttggagaagatctctgcctacatgaagtccagccgcttcctcccaagacctgtgttcacaaagatggctgtctggggcaacaagtagggccttgaaggccaggaggtgggagtgaggagcccatactcagcctgctgcccaggctgtgcagcgcagctggactctgcatcccagcacctgcctcctcgttcctttctcctgtttattcccatctttactcccaagacttcattgtccctcttcactccccctaaacccctgtcccatgcaggccctttgaagcctcagctacccactatccttcgtgaacatccccctcccatcattacccttccctgcactaaagccagcctgaccttccttcctgttagtggttgtatctgctttgaagggcctacctggcccctcgcctgtggagctcagccctgagctgtccccgtgttgcataaggagcagcattgactggtttacaggccctgctcctgcagcatggcccctgccttaggcctacctgatcaaaataaagcctcagccacat

SEQ ID NO: 440833 - DNA, 1618 bp, Homo sapiens
agcaaggcttcccctctaccctctctgggcctctcacaaacgctgagccccgccccgctgaggcctgtctgcagaatccacagcaaccagcaccatgcccatgacactggggtactggaacatccgcgggctggcccattccatccgcctgctcctggaatacacagactcaagctacgaggaaaagaagtacacgatgggggacgctcctgattatgacagaagccagtggctgaatgaaaaattcaagctgggcctggactttcccaatctgccctacttgattgatgggactcacaagatcacccagagcaacgccatcctgcggtacattgcccgcaagcacaacctgtgcggggaatcagaaaaggagcagattcgcgaagacattttggagaaccagtttatggacagccgtatgcagctggccaaactctgctatgacccagattttgtaagtccccccaccccactcccagtctccccttccctactcccagtctcccctttccctgcagagtttgtgtccaaaattgattccttctggtgagttcttggtcttgctgactctaagaatgaagccgcggtcctacacggtgagtgttacagttcttaaagatggtgtgtccggagtttgttccttcagatgttcagatgtgtccgcagtttcttccttccggtgggtttgtggtcttgctgacttcaggggtgaagccgcagaccttcgcagtgagtgctacagctcttaaaggtggcgcgtctggagttgtttattcctcttggtgggttcatggtctggctggcttcaggagtgaagctgcagaccttcatagtgaatgttatagctcataaaggtagttcaaacccaaagagtgagcaacagcaggatttatggtgacgagtgaaagaaaatacacttccacagcctggaagacaacctgagcagagtgctgattggtccgttttacagagtgctgattggtctgtttttacagagtgctgattggagaaactgaaaccagaatacctgcaggcactccctgaaatgctgaagctctactcacagtttctggggaagcagccatggtttcttggggacaagatcacctttgtggatttcatcgcttatgatgtccttgagagaaaccaagtatttgagcccagctgcctggatgccttcccaaacctgaaggacttcatctcccgatttgagggcttggagaagatctctgcctacatgaagtccagccgcttcctcccaagacctgtgttcacaaagatggctgtctggggcaacaagtagggccttgaaggccaggaggtgggagtgaggagcccatactcagcctgctgcccaggctgtgcagcgcagctggactctgcatcccagcacctgcctcctcgttcctttctcctgtttattcccatctttactcccaagacttcattgtccctcttcactccccctaaacccctacctggcccctcgcctgtggagctcagccctgagctgtccccgtgttgcataaggagcagcattgactggtttacaggccctgctcctgcagcatggcccctgccttaggcctacctgatcaaaataaagcctcagccacat

SEQ ID NO: 440834 - DNA, 747 bp, Homo sapiens
gttagctgttactgtggtacaacattacttaaaggaagttggaagagttaactccgcagatctggggaccctaagaggctgtgtgatgcctcagcacttgagcccacgtggaaaggctgtggccagggccctgacctgctgtgtctgcagtggggttgtcccagccctcatgggcagctgaccttgagttctggccttattttcccccctctcagggcttggagaagatctctgcctacatgaagtccagccgcttcctcccaaaacctctgtacacaagggtggctgtctggggcaacaagtaatgccttgaaggccaggaggtgggagtgaggagcccatactcagcctgctgcccaggctgtgcagcgcagctggactctgcatcccagcacctgcctcctcgttcctttctcctgtttattcccatctttacccccaagactttattgggcctcttcacttcccctaaacccctgtcccatgcaggccctttgaagcctcagctacccactttccttcatgaacatccccctcccaacactacccttccctgcactaaagccagcctgaccttccttcctgttagtggttgtatctgctttgaagggcctacctggcccctcgcctgtggagctcagccctgagctgtccccgtgttgcatgacagcattgactggtttacaggccctgctcctgcagcatggcccctgccttaggcctacctgatcaaaataaagcctcagc

SEQ ID NO: 440835 - DNA, 907 bp, Homo sapiens
agctggcgaggccgagcccctcctagtgcttccggaccttgctccctgaacactcggaggtggcggtggatcttactccttccagccagtgaggatccagcaacctgctccgtgcctcccgcgcctgttggttggaagtgacgaccttgaagatcggccggttggaagtgacgaccttgaagatcggcgggcgcagcggggccgagggggcgggtctggcgctaggtccagcccctgcgtgccgggaaccccagaggaggtcgcagttcagcccagctgaggcctgtctgcagaatcgacaccaaccagcatcatgtccatgacactggggtactgggacatccgcgggctggcccacgccatccgcctgctcctggaatacacagactcaagctacgaggaaaagaagtatacgatgggggacgctcctgactatgacagaagccagtggctgaatgaaaaattcaagctgggcctggactttcccaatattagaggtgttcggatcaggagtcttctgcccaattcctctcactcctggttgtctacacagcccctgcatgatgttctgtgtcccagctcatttgttcatgtgacagtatttctatgtcaggcctgccatgagcgggcacagtgagtgcctggtctcccctctgcccttgcatatgggaaggggatgctggggagcctgctggcccaactgagcttccccggtttcccatctatccagctgccctacttgattgatggggctcacaagatcacccagagcaacgccatcctgtgctacattgcccgcaagcacaacctgtgtgagtgtggttggctgcagtgtgtggggggaaggtggcatcctccttggctggattggggtgctatgctcagagtgagtctgtattaactgctt

SEQ ID NO: 440836 - DNA, 1269 bp, Homo sapiens
agctggcgaggccgagcccctcctagtgcttccggaccttgctccctgaacactcggaggtggcggtggatcttactccttccagccagtgaggatccagcaacctgctccgtgcctcccgcgcctgttggttggaagtgacgaccttgaagatcggccggttggaagtgacgaccttgaagatcggcgggcgcagcggggccgagggggcgggtctggcgctaggtccagcccctgcgtgccgggaaccccagaggaggtcgcagttcagcccagctgaggcctgtctgcagaatcgacaccaaccagcatcatgtccatgacactggggtactgggacatccgcgggctggcccacgccatccgcctgctcctggaatacacagactcaagctacgaggaaaagaagtatacgatgggggacggtaatgacacccttgtgtccgggctctgcccactcacgctgagttggcaccaagcaacccatggtggccacctgtggctacctctgcaggcctcccctgctggagctgcaggctgtcccttccctgagccccggtgagggagtcctgtggccttgcaaggcagaatgctggggcgggatgctgggccccctgtttaattgggttgggtgtccctcagagcttccctaaaccctggaagccttagccgtgtggggtccagagccctcagcgggattctttgtccctgaaccctgggatgtgggactgagtggtcagattctagatccacctgtctcagggatcttgccactggttccttgggagggtccccgggaaggagggctgggctctggggaggtttgttttcacttcttcttccccacggcagctcctgactatgacagaagccagtggctgaatgaaaaattcaagctgggcctggactttcccaatctgccctacttgattgatggggctcacaagatcacccagagcaacgccatcttgtgctacattgcccgcaagcacaacctgtgtggggagacagaagaggagaagattcgtgtggacattttggagaaccagaccatggacaaccatatgcagctgggcatgatctgctacaatccagaatttgagaaactgaagccaaagtacttggaggaactccctgaaaagctaaagctctactcagagtttctggggaagcggccatggtttgcaggaaacaagatcacttttgtagattttctcgtctatgatgtcctcttttcttcctttcaagggatttcctagattattcatc

SEQ ID NO: 440837 - DNA, 892 bp, Homo sapiens
ggtttaggcctgtctgcggaatccgcaccaaccagcaccatgcccatgatactggggtactgggacatccgcgggctggcccacgccatccgcctgctcctggaatacacagactcaagctatgaggaaaagaagtacacgatgggggacggtaatggcaccctcgtgttcgggctctgcccactcacgctaagttggcaccaagcaacccatggtggccacctgtggctgcctctgcaggcctcccctgctggagctgcaggctgtctcttccctgagccccggtgagggagccctctggccttgcaaggcagaatgctggggtgggatgctgggccccctgtctaattgggacgggtgtccctcagggcttgcctaaaccctggaagccttagctgtgtggggtccagagccctcagcgggattctttgtccctgaaccctgggatgtgggactgagtggtcagattctagatccacctgtctcagggatcttgccactggctccgtgggagggtccccgggaaggagggctgggctctggggaggtttgttttcacttcttcttccccaccacagctcctgattatgacagaagccagtggctgaatgaaaaattcaagctgggcctggactttcccaatgtaggtgcaggggaaggggcggttttgggggaaagtgcaacgtgtctctgactgcatctcctctccccagcttagaggtgttaagatcaggagtcttctgcccaattcctctcactcctggctgtctaaacagtccttccatgatgttctgtgtccacctgcattcgttcatgtgacagtattcttatttcagtcctgccatgagcaggcacagtgagtgcccggtctcctctctgctcttgcttatgg

SEQ ID NO: 440838 - DNA, 1016 bp, Homo sapiens
agctggcgaggccgagcccctcctagtgcttccggaccttgctccctgaacactcggaggtggcggtggatcttactccttccagccagtgaggatccagcaacctgctccgtgcctcccgcgcctgttggttggaagtgacgaccttgaagatcggccggttggaagtgacgaccttgaagatcggcgggcgcagcggggccgagggggcgggtctggcgctaggtccagcccctgcgtgccgggaaccccagaggaggtcgcagttcagcccagctgaggcctgtctgcagaatcgacaccaaccagcatcatgtccatgacactggggtactgggacatccgcgggctggcccacgccatccgcctgctcctggaatacacagactcaagctacgaggaaaagaagtatacgatgggggacgctcctgactatgacagaagccagtggctgaatgaaaaattcaagctgggcctggactttcccaatgtggggagacagaagaggagaagattcgtgtggacattttggagaaccaggctatggacagctcctatgcagctggccagagtctgctacagcccagactttgagaaactgaagccagaatacttggaggaactccctgacaatgctgaagctctactcacagtttctggggaagcaggccatggtttgttggagacaagatcacctttgtagatttcctcgcctatgatgtccttgacctccaccgtatatttgagcccaactgcttggacgccttcccaaatctgaaggacttcatctcccgctttgaggtgatgcccccatcctcctttctctttgatgccccttgttccgttacctcctttcagatgctttcccagtcctggatctgcataaagaataacttgcatttattgagtgctggcttcatgccaggaaccttgcccagcacattatacctatcgtgtggaatttgaaatttccaacattcctacagggtgacagaattatcttgcccatttagaga

SEQ ID NO: 440839 - DNA, 298 bp, Homo sapiens
atgctggtatgtccagctgaagccagttccagctgtggggaagatggctgcttgctcgtggccagctggggccatacacagccctggggaggccacatctgtgcagggagcttgtgtctgagggtggtgacagctgttttctgcctcaggagaaactgaagccagaatacttggaggaactccctgacaatgctgaagctctactcacagtttctggggaagcaggccatggtttgttggagacaaggtaatgggggcatgtgatgaggacactagagatttgccatacatcctatgt

SEQ ID NO: 440840 - DNA, 871 bp, Homo sapiens
agcaaggcttcccctctaccctctctgggcctctcacaaacgctgagccccgccccgctgaggcctgtctgcagaatccacagcaaccagcaccatgcccatgacactggggtactggaacatccgcgggctggcccattccatccgcctgctcctggaatacacagactcaagctacgaggaaaagaagtacacgatgggggacgctcctgattatgacagaagccagtggctgaatgaaaaattcaagctgggcctggactttcccaatctgccctacttgattgatgggactcacaagatcacccagagcaacgccatcctgcggtacattgcccgcaagcacaacctgtgcggggaatcagaaaaggagcagattcgcgaagacattttggagaaccagtttatggacagccgtatgcagctggccaaactctgctatgacccagattttgagaaactgaaaccagaatacctgcaggcactccctgaaatgctgaagctctactcacagtttctggggaagcagccatggtttcttggggacaagatcacctttgtggatttcatcgcttatgatgtccttgagagaaaccaagtatttgagcccagctgcctggatgccttcccaaacctgaaggacttcatctcccgatttgagcgcggaaaagtgtaatgtaggctggagctcgagaaggacatctggatactggtggtgccggaccagccaaaagaaatcctgtggtcaaaacctgagcacacggaataagcccgtcatcaccatggcacattattttacacagaaagggacacactgtgccggaagtccagggaccccggatggaggacctgcatggggccgggcaaggac

SEQ ID NO: 440841 - DNA, 315 bp, Homo sapiens
gggtgaggcaggaacgagaggaggagatggggctccccttgtgcagagtcgtcacaaagtcagggaccctccatctctgacccgagctgtgggccatctctcccagctggcccattccatccgcctgctcctggaatacacagactcaagctacgaggaaaagaagtacacgatgggggacgcatctaacctgggccgcctgggggcatccctgggctatgccccgatatggttgcgagagtggggagatgctctcagatgggccagccatggttgaaatataaagctggctcaggtgctcctcagattccgacc

SEQ ID NO: 440842 - DNA, 1378 bp, Homo sapiens
agctggcgaggccgagcccctcctagtgcttccggaccttgctccctgaacactcggaggtggcggtggatcttactccttccagccagtgaggatccagcaacctgctccgtgcctcccgcgcctgttggttggaagtgacgaccttgaagatcggccggttggaagtgacgaccttgaagatcggcgggcgcagcggggccgagggggcgggtctggcgctaggtccagcccctgcgtgccgggaaccccagaggaggtcgcagttcagcccagctgaggcctgtctgcagaatcgacaccaaccagcatcatgtccatgacactggggtactgggacatccgcgggctggcccacgccatccgcctgctcctggaatacacagactcaagctacgaggaaaagaagtatacgatgggggacgctcctgactatgacagaagccagtggctgaatgaaaaattcaagctgggcctggactttcccaatctgccctacttgattgatggggctcacaagatcacccagagcaacgccatcctgtgctacattgcccgcaagcacaacctgtgtggggagacagaagaggagaagattcgtgtggacattttggagaaccaggctatggacagctcctatgcagctggccagagtctgctacagcccagactttgagaaactgaagccagaatacttggaggaactccctgacaatgctgaagctctactcacagtttctggggaagcaggccatggtttgttggagacaagatcacctttgtagatttcctcgcctatgatgtccttgacctccaccgtatatttgagcccaactgcttggacgccttcccaaatctgaaggacttcatctcccgctttgaggtttcctgtggcataatgtgatggtcaattttctgcatcaacttgactgggctaagggatgctcagatggcaggtaaaatcattgtgcttgtgagggtgtttccagaagagatttgcctttgaatcagaagacagcaaagatttccttcagcaatgaaggaggcatccaccaaactgtcagggcccagagagaagaaaaagacaggaagggtgaatttgacctctctgactgggacatccatctctgcctatcctgggacctccacactcctggttctctggccttcagacttgatcagggactaacaccatcgcctcccacccccacctttgttctgaggcctttagcctctgaatgataccactggctttcctgcttctctatcctgcagtcggcagatcatgggacttcttcactccaaaattgtgtgagccaattcccataacagatagataaatttataaataaacacacaaatttcctacagaaaaaaa

SEQ ID NO: 440843 - DNA, 1664 bp, Homo sapiens
agctggcgaggccgagcccctcctagtgcttccggaccttgctccctgaacactcggaggtggcggtggatcttactccttccagccagtgaggatccagcaacctgctccgtgcctcccgcgcctgttggttggaagtgacgaccttgaagatcggccggttggaagtgacgaccttgaagatcggcgggcgcagcggggccgagggggcgggtctggcgctaggtccagcccctgcgtgccgggaaccccagaggaggtcgcagttcagcccagctgaggcctgtctgcagaatcgacaccaaccagcatcatgtccatgacactggggtactgggacatccgcgggctggcccacgccatccgcctgctcctggaatacacagactcaagctacgaggaaaagaagtatacgatgggggacgctcctgactatgacagaagccagtggctgaatgaaaaattcaagctgggcctggactttcccaatattagaggtgttcggatcaggagtcttctgcccaattcctctcactcctggttgtctacacagcccctgcatgatgttctgtgtcccagctcatttgttcatgtgacagtatttctatgtcaggcctgccatgagcgggcacagtgagtgcctggtctcccctctgcccttgcatatgggaaggggatgctggggagcctgctggcccaactgagcttccccggtttcccatctatccagctgccctacttgattgatggggctcacaagatcacccagagcaacgccatcctgtgctacattgcccgcaagcacaacctgtgtggggagacagaagaggagaagattcgtgtggacattttggagaaccaggctatggacagctcctatgcagctggccagagtctgctacagcccagactttgagaaactgaagccagaatacttggaggaactccctgacaatgctgaagctctactcacagtttctggggaagcaggccatggtttgttggagacaagatcacctttgtagatttcctcgcctatgatgtccttgacctccaccgtatatttgagcccaactgcttggacgccttcccaaatctgaaggacttcatctcccgctttgagggcttggagaagatctctgcctacatgaagtccagccgcttcctcccaagacctgtgttcacaaagatggctgtctggggcaacaagtagggccttgaaggccaggaggtgggagtgaggagcccatactcagcctgctgcccaggctgtgcagcgcagctggactctgcatcccagcacctgcctcctcgttcctttctcctgtttattcccatctttactcccaagacttcattgtccctcttcactccccctaaacccctgtcccatgcaggccctttgaagcctcagctacccactatccttcgtgaacatccccctcccatcattacccttccctgcactaaagccagcctgaccttccttcctgttagtggttgtatctgctttgaagggcctacctggcccctcgcctgtggagctcagccctgagctgtccccgtgttgcataaggagcagcattgactggtttacaggccctgctcctgcagcatggcccctgccttaggcctacctgatcaaaataaagcctcagccacat

SEQ ID NO: 440844 - DNA, 1424 bp, Homo sapiens
agctggcgaggccgagcccctcctagtgcttccggaccttgctccctgaacactcggaggtggcggtggatcttactccttccagccagtgaggatccagcaacctgctccgtgcctcccgcgcctgttggttggaagtgacgaccttgaagatcggccggttggaagtgacgaccttgaagatcggcgggcgcagcggggccgagggggcgggtctggcgctaggtccagcccctgcgtgccgggaaccccagaggaggtcgcagttcagcccagctgaggcctgtctgcagaatcgacaccaaccagcatcatgtccatgacactggggtactgggacatccgcgggctggcccacgccatccgcctgctcctggaatacacagactcaagctacgaggaaaagaagtatacgatgggggacgctcctgactatgacagaagccagtggctgaatgaaaaattcaagctgggcctggactttcccaatctgccctacttgattgatggggctcacaagatcacccagagcaacgccatcctgtgctacattgcccgcaagcacaacctgtgtggggagacagaagaggagaagattcgtgtggacattttggagaaccaggctatggacagctcctatgcagctggccagagtctgctacagcccagactttgagaaactgaagccagaatacttggaggaactccctgacaatgctgaagctctactcacagtttctggggaagcaggccatggtttgttggagacaagatcacctttgtggatttcatcgcttatgatgtccttgagagaaaccaagtatttgagcccagctgcctggatgccttcccaaacctgaaggacttcatctcccgatttgagggcttggagaagatctctgcctacatgaagtccagccgcttcctcccaagacctgtgttcacaaagatggctgtctggggcaacaagtagggccttgaaggccaggaggtgggagtgaggagcccatactcagcctgctgcccaggctgtgcagcgcagctggactctgcatcccagcacctgcctcctcgttcctttctcctgtttattcccatctttactcccaagacttcattgtccctcttcactccccctaaacccctgtcccatgcaggccctttgaagcctcagctacccactatccttcgtgaacatccccctcccatcattacccttccctgcactaaagccagcctgaccttccttcctgttagtggttgtatctgctttgaagggcctacctggcccctcgcctgtggagctcagccctgagctgtccccgtgttgcataaggagcagcattgactggtttacaggccctgctcctgcagcatggcccctgccttaggcctacctgatcaaaataaagcctcagccacat

SEQ ID NO: 440845 - DNA, 1847 bp, Homo sapiens
agctggcgaggccgagcccctcctagtgcttccggaccttgctccctgaacactcggaggtggcggtggatcttactccttccagccagtgaggatccagcaacctgctccgtgcctcccgcgcctgttggttggaagtgacgaccttgaagatcggccggttggaagtgacgaccttgaagatcggcgggcgcagcggggccgagggggcgggtctggcgctaggtccagcccctgcgtgccgggaaccccagaggaggtcgcagttcagcccagctgaggcctgtctgcagaatcgacaccaaccagcatcatgtccatgacactggggtactgggacatccgcgggctggcccacgccatccgcctgctcctggaatacacagactcaagctacgaggaaaagaagtatacgatgggggacggtaatgacacccttgtgtccgggctctgcccactcacgctgagttggcaccaagcaacccatggtggccacctgtggctacctctgcaggcctcccctgctggagctgcaggctgtcccttccctgagccccggtgagggagtcctgtggccttgcaaggcagaatgctggggcgggatgctgggccccctgtttaattgggttgggtgtccctcagagcttccctaaaccctggaagccttagccgtgtggggtccagagccctcagcgggattctttgtccctgaaccctgggatgtgggactgagtggtcagattctagatccacctgtctcagggatcttgccactggttccttgggagggtccccgggaaggagggctgggctctggggaggtttgttttcacttcttcttccccacggcagctcctgactatgacagaagccagtggctgaatgaaaaattcaagctgggcctggactttcccaatctgccctacttgattgatggggctcacaagatcacccagagcaacgccatcttgtgctacattgcccgcaagcacaacctgtgtggggagacagaagaggagaagattcgtgtggacattttggagaaccagaccatggacaaccatatgcagctgggcatgatctgctacaatccagaatttgagaaactgaagccaaagtacttggaggaactccctgaaaagctaaagctctactcagagtttctggggaagcggccatggtttgcaggaaacaagatcacttttgtagattttctcgtctatgatgtccttgacctccaccgtatatttgagcccaagtgcttggacgccttcccaaatctgaaggacttcatctcccgctttgagggcttggagaagatctctgcctacatgaagtccagccgcttcctcccaagacctgtgttctcaaagatggctgtctggggcaacaagtagggccttgaaggccaggaggtgggagtgaggagcccatactcagcctgctgcccaggctgtgcagcgcagctggactctgcatcccagcacctgcctcctcgttcctttctcctgtttattcccatctttactcccaagacttcattgtccctcttcactccccctaaacccctgtcccatgcaggccctttgaagcctcagctacccactatccttcgtgaacatcccctcccatcattacccttccctgcactaaagccagcctgaccttccttcctgttagtggttgtgtctgctttaaagggcctgcctggcccctcgcctgtggagctcagccccgagctgtccccgtgttgcatgaaggagcagcattgactggtttacaggccctgctcctgcagcatggtccctgccttaggcctacctgatggaagtaaagcctcaaccaca

SEQ ID NO: 440846 - DNA, 1420 bp, Homo sapiens
agctggcgaggccgagcccctcctagtgcttccggaccttgctccctgaacactcggaggtggcggtggatcttactccttccagccagtgaggatccagcaacctgctccgtgcctcccgcgcctgttggttggaagtgacgaccttgaagatcggccggttggaagtgacgaccttgaagatcggcgggcgcagcggggccgagggggcgggtctggcgctaggtccagcccctgcgtgccgggaaccccagaggaggtcgcagttcagcccagctgaggcctgtctgcagaatcgacaccaaccagcatcatgtccatgacactggggtactgggacatccgcgggctggcccacgccatccgcctgctcctggaatacacagactcaagctacgaggaaaagaagtatacgatgggggacgctcctgactatgacagaagccagtggctgaatgaaaaattcaagctgggcctggactttcccaatctgccctacttgattgatggggctcacaagatcacccagagcaacgccatcctgtgctacattgcccgcaagcacaacctgtgtggggagacagaagaggagaagattcgtgtggacattttggagaaccagaccatggacaaccatatgcagctgggcatgatctgctacaatccagaatttgagaaactgaagccaaagtacttggaggaactccctgaaaagctaaagctctactcagagtttctggggaagcggccatggtttgcaggaaacaagatcacttttgtagattttctcgtctatgatgtccttgacctccaccgtatatttgagcccaagtgcttggacgccttcccaaatctgaaggacttcatctcccgctttgagggcttggagaagatctctgcctacatgaagtccagccgcttcctcccaagacctgtgttctcaaagatggctgtctggggcaacaagtagggccttgaaggccaggaggtgggagtgaggagcccatactcagcctgctgcccaggctgtgcagcgcagctggactctgcatcccagcacctgcctcctcgttcctttctcctgtttattcccatctttactcccaagacttcattgtccctcttcactccccctaaacccctgtcccatgcaggccctttgaagcctcagctacccactatccttcgtgaacatcccctcccatcattacccttccctgcactaaagccagcctgaccttccttcctgttagtggttgtgtctgctttaaagggcctgcctggcccctcgcctgtggagctcagccccgagctgtccccgtgttgcatgaaggagcagcattgactggtttacaggccctgctcctgcagcatggtccctgccttaggcctacctgatggaagtaaagcctcaaccaca

SEQ ID NO: 440847 - DNA, 1146 bp, Homo sapiens
ggtttaggcctgtctgcggaatccgcaccaaccagcaccatgcccatgatactggggtactgggacatccgcgggctggcccacgccatccgcctgctcctggaatacacagactcaagctatgaggaaaagaagtacacgatgggggacgctcctgattatgacagaagccagtggctgaatgaaaaattcaagctgggcctggactttcccaatctgccctacttgattgatggggctcacaagatcacccagagcaacgccatcttgtgctacattgcccgcaagcacaacctgtgtggggagacagaagaggagaagattcgtgtggacattttggagaaccagaccatggacaaccatatgcagctgggcatgatctgctacaatccagaatttgagaaactgaagccaaagtacttggaggaactccctgaaaagctaaagctctactcagagtttctggggaagcggccatggtttgcaggaaacaagatcacttttgtagattttctcgtctatgatgtccttgacctccaccgtatatttgagcccaagtgcttggacgccttcccaaatctgaaggacttcatctcccgctttgagggcttggagaagatctctgcctacatgaagtccagccgcttcctcccaagacctgtgttctcaaagatggctgtctggggcaacaagtagggccttgaaggccaggaggtgggagtgaggagcccatactcagcctgctgcccaggctgtgcagcgcagctggactctgcatcccagcacctgcctcctcgttcctttctcctgtttattcccatctttactcccaagacttcattgtccctcttcactccccctaaacccctgtcccatgcaggccctttgaagcctcagctacccactatccttcgtgaacatcccctcccatcattacccttccctgcactaaagccagcctgaccttccttcctgttagtggttgtgtctgctttaaagggcctgcctggcccctcgcctgtggagctcagccccgagctgtccccgtgttgcatgaaggagcagcattgactggtttacaggccctgctcctgcagcatggtccctgccttaggcctacctgatggaagtaaagcctcaaccaca

SEQ ID NO: 440848 - DNA, 1754 bp, Homo sapiens
agcaaggcttcccctctaccctctctgggcctctcacaaacgctgagccccgccccgctgaggcctgtctgcagaatccacagcaaccagcaccatgcccatgacactggggtactggaacatccgcgggctggcccattccatccgcctgctcctggaatacacagactcaagctacgaggaaaagaagtacacgatgggggacgctcctgattatgacagaagccagtggctgaatgaaaaattcaagctgggcctggactttcccaatctgccctacttgattgatgggactcacaagatcacccagagcaacgccatcctgcggtacattgcccgcaagcacaacctgtgcggggaatcagaaaaggagcagattcgcgaagacattttggagaaccagtttatggacagccgtatgcagctggccaaactctgctatgacccagattttgtaagtccccccaccccactcccagtctccccttccctactcccagtctcccctttccctgcagagtttgtgtccaaaattgattccttctggtgagttcttggtcttgctgactctaagaatgaagccgcggtcctacacggtgagtgttacagttcttaaagatggtgtgtccggagtttgttccttcagatgttcagatgtgtccgcagtttcttccttccggtgggtttgtggtcttgctgacttcaggggtgaagccgcagaccttcgcagtgagtgctacagctcttaaaggtggcgcgtctggagttgtttattcctcttggtgggttcatggtctggctggcttcaggagtgaagctgcagaccttcatagtgaatgttatagctcataaaggtagttcaaacccaaagagtgagcaacagcaggatttatggtgacgagtgaaagaaaatacacttccacagcctggaagacaacctgagcagagtgctgattggtccgttttacagagtgctgattggtctgtttttacagagtgctgattggagaaactgaaaccagaatacctgcaggcactccctgaaatgctgaagctctactcacagtttctggggaagcagccatggtttcttggggacaagatcacctttgtggatttcatcgcttatgatgtccttgagagaaaccaagtatttgagcccagctgcctggatgccttcccaaacctgaaggacttcatctcccgatttgagggcttggagaagatctctgcctacatgaagtccagccgcttcctcccaagacctgtgttcacaaagatggctgtctggggcaacaagtagggccttgaaggccaggaggtgggagtgaggagcccatactcagcctgctgcccaggctgtgcagcgcagctggactctgcatcccagcacctgcctcctcgttcctttctcctgtttattcccatctttactcccaagacttcattgtccctcttcactccccctaaacccctgtcccatgcaggccctttgaagcctcagctacccactatccttcgtgaacatccccctcccatcattacccttccctgcactaaagccagcctgaccttccttcctgttagtggttgtatctgctttgaagggcctacctggcccctcgcctgtggagctcagccctgagctgtccccgtgttgcataaggagcagcattgactggtttacaggccctgctcctgcagcatggcccctgccttaggcctacctgatcaaaataaagcctcagccacat

SEQ ID NO: 440849 - DNA, 1589 bp, Homo sapiens
agcaaggcttcccctctaccctctctgggcctctcacaaacgctgagccccgccccgctgaggcctgtctgcagaatccacagcaaccagcaccatgcccatgacactggggtactggaacatccgcgggctggcccattccatccgcctgctcctggaatacacagactcaagctacgaggaaaagaagtacacgatgggggacgctcctgattatgacagaagccagtggctgaatgaaaaattcaagctgggcctggactttcccaatctgccctacttgattgatgggactcacaagatcacccagagcaacgccatcctgcggtacattgcccgcaagcacaacctgtagtttgtgtccaaaattgattccttctggtgagttcttggtcttgctgactctaagaatgaagccgcggtcctacacggtgagtgttacagttcttaaagatggtgtgtccggagtttgttccttcagatgttcagatgtgtccgcagtttcttccttccggtgggtttgtggtcttgctgacttcaggggtgaagccgcagaccttcgcagtgagtgctacagctcttaaaggtggcgcgtctggagttgtttattcctcttggtgggttcatggtctggctggcttcaggagtgaagctgcagaccttcatagtgaatgttatagctcataaaggtagttcaaacccaaagagtgagcaacagcaggatttatggtgacgagtgaaagaaaatacacttccacagcctggaagacaacctgagcagagtgctgattggtccgttttacagagtgctgattggtctgtttttacagagtgctgattggagaaactgaaaccagaatacctgcaggcactccctgaaatgctgaagctctactcacagtttctggggaagcagccatggtttcttggggacaagatcacctttgtggatttcatcgcttatgatgtccttgagagaaaccaagtatttgagcccagctgcctggatgccttcccaaacctgaaggacttcatctcccgatttgagggcttggagaagatctctgcctacatgaagtccagccgcttcctcccaagacctgtgttcacaaagatggctgtctggggcaacaagtagggccttgaaggccaggaggtgggagtgaggagcccatactcagcctgctgcccaggctgtgcagcgcagctggactctgcatcccagcacctgcctcctcgttcctttctcctgtttattcccatctttactcccaagacttcattgtccctcttcactccccctaaacccctgtcccatgcaggccctttgaagcctcagctacccactatccttcgtgaacatccccctcccatcattacccttccctgcactaaagccagcctgaccttccttcctgttagtggttgtatctgctttgaagggcctacctggcccctcgcctgtggagctcagccctgagctgtccccgtgttgcataaggagcagcattgactggtttacaggccctgctcctgcagcatggcccctgccttaggcctacctgatcaaaataaagcctcagccacat

SEQ ID NO: 440850 - DNA, 1035 bp, Homo sapiens
ggtttaggcctgtctgcggaatccgcaccaaccagcaccatgcccatgatactggggtactgggacatccgcgggctggcccacgccatccgcctgctcctggaatacacagactcaagctatgaggaaaagaagtacacgatgggggacgctcctgattatgacagaagccagtggctgaatgaaaaattcaagctgggcctggactttcccaatctgccctacttgattgatggggctcacaagatcacccagagcaacgccatcttgtgctacattgcccgcaagcacaacctgtgtggggagacagaagaggagaagattcgtgtggacattttggagaaccagaccatggacaaccatatgcagctgggcatgatctgctacaatccagaatttgagaaactgaagccaaagtacttggaggaactccctgaaaagctaaagctctactcagagtttctggggaagcggccatggtttgcaggaaacaagggcttggagaagatctctgcctacatgaagtccagccgcttcctcccaagacctgtgttctcaaagatggctgtctggggcaacaagtagggccttgaaggccaggaggtgggagtgaggagcccatactcagcctgctgcccaggctgtgcagcgcagctggactctgcatcccagcacctgcctcctcgttcctttctcctgtttattcccatctttactcccaagacttcattgtccctcttcactccccctaaacccctgtcccatgcaggccctttgaagcctcagctacccactatccttcgtgaacatcccctcccatcattacccttccctgcactaaagccagcctgaccttccttcctgttagtggttgtgtctgctttaaagggcctgcctggcccctcgcctgtggagctcagccccgagctgtccccgtgttgcatgaaggagcagcattgactggtttacaggccctgctcctgcagcatggtccctgccttaggcctacctgatggaagtaaagcctcaaccaca

SEQ ID NO: 440851 - DNA, 1337 bp, Homo sapiens
agcaaggcttcccctctaccctctctgggcctctcacaaacgctgagccccgccccgctgaggcctgtctgcagaatccacagcaaccagcaccatgcccatgacactggggtactggaacatccgcgggctggcccacgccatccgcctgctcctggaatacacagactcaagctatgaggaaaagaagtacacgatgggggacgctcctgattatgacagaagccagtggctgaatgaaaaattcaagctgggcctggactttcccaatctgccctacttgattgatggggctcacaagatcacccagagcaacgccatcttgtgctacattgcccgcaagcacaacctgtgtggggagacagaagaggagaagattcgtgtggacattttggagaaccagaccatggacaaccatatgcagctgggcatgatctgctacaatccagaatttgagaaactgaagccaaagtacttggaggaactccctgaaaagctaaagctctactcagagtttctggggaagcggccatggtttgcaggaaacaagatcacttttgtagattttctcgtctatgatgtccttgacctccaccgtatatttgagcccaagtgcttggacgccttcccaaatctgaaggacttcatctcccgctttgagggcttggagaagatctctgcctacatgaagtccagccgcttcctcccaagacctgtgttctcaaagatggctgtctggggcaacaagtagggccttgaaggccaggaggtgggagtgaggagcccatactcagcctgctgcccaggctgtgcagcgcagctggactctgcatcccagcacctgcctcctcgttcctttctcctgtttattcccatctttactcccaagacttcattgtccctcttcactccccctaaacccctgtcccatgcaggccctttgaagcctcagctacccactatccttcgtgaacatcccctcccatcattacccttccctgcactaaagccagcctgaccttccttcctgttagtggttgtgtctgctttaaagggcctgcctggcccctcgcctgtggagctcagccccgagctgtccccgtgttgcatgaaggagcagcattgactggtttacaggccctgctcctgcagcatggtccctgccttaggcctacctgatggaagtaaagcctcaaccacaaaaaagaaaaaaaaaaaaaaaaaaaaagaaaaaacaatgggggggcccaatacaaaaattaaaaataaaaaacctcgggggggggcccggtccccaattggccttatagggagcggtttaacaatccatgggcggt

SEQ ID NO: 440852 - DNA, 1068 bp, Homo sapiens
agcaaggcttcccctctaccctctctgggcctctcacaaacgctgagccccgccccgctgaggcctgtctgcagaatccacagcaaccagcaccatgcccatgacactggggtactggaacatccgcgggctggcccacgccatccgcctgctcctggaatacacagactcaagctatgaggaaaagaagtacacgatgggggacgctcctgattatgacagaagccagtggctgaatgaaaaattcaagctgggcctggactttcccaatctgccctacttgattgatggggctcacaagatcacccagagcaacgccatcttgtgctacattgcccgcaagcacaacctgtgtggggagacagaagaggagaagattcgtgtggacattttggagaaccagaccatggacaaccatatgcagctgggcatgatctgctacaatccagaatttgagaaactgaagccaaagtacttggaggaactccctgaaaagctaaagctctactcagagtttctggggaagcggccatggtttgcaggaaacaagatcacttttgtagattttctcgtctatgatgtccttgacctccaccgtatatttgagcccaagtgcttggacgccttcccaaatctgaaggacttcatctcccgctttgagggcttggagaagatctctgcctacatgaagtccagccgcttcctcccaagacctgtgttctcaaagatggctgtctggggcaacaagtagggccttgaaggccaggaggtgggagtgaggagcccatactcagcctgctgcccaggctgtgcagcgcagctggactctgcatcccagcacctgcctcctcgttcctttctcctgtttattcccatctttactcccaagacttcattgtccctcttcactccccctaaacccctgtccctggcccctcgcctgtggagctcagccccgagctgtccccgtgttgcatgaaggagcagcattgactggtttacaggccctgctcctgcagcatggtccctgccttaggcctacctgatggaagtaaagcctcaaccaca

SEQ ID NO: 440853 - DNA, 1420 bp, Homo sapiens
agctggcgaggccgagcccctcctagtgcttccggaccttgctccctgaacactcggaggtggcggtggatcttactccttccagccagtgaggatccagcaacctgctccgtgcctcccgcgcctgttggttggaagtgacgaccttgaagatcggccggttggaagtgacgaccttgaagatcggcgggcgcagcggggccgagggggcgggtctggcgctaggtccagcccctgcgtgccgggaaccccagaggaggtcgcagttcagcccagctgaggcctgtctgcagaatcgacaccaaccagcatcatgtccatgacactggggtactgggacatccgcgggctggcccacgccatccgcctgctcctggaatacacagactcaagctacgaggaaaagaagtatacgatgggggacggtaatgacacccttgtgtccgggctctgcccactcacgctgagttggcaccaagcaacccatggtggccacctgtggctacctctgcaggcctcccctgctggagctgcaggctgtcccttccctgagccccggtgagggagtcctgtggccttgcaaggcagaatgctggggcgggatgctgggccccctgtttaattgggttgggtgtccctcagagcttccctaaaccctggaagccttagccgtgtggggtccagagccctcagcgggattctttgtccctgaaccctgggatgtgggactgagtggtcagattctagatccacctgtctcagggatcttgccactggttccttgggagggtccccgggaaggagggctgggctctggggaggtttgttttcacttcttcttccccacggcagctcctgactatgacagaagccagtggctgaatgaaaaattcaagctgggcctggactttcccaatctgccctacttgattgatggggctcacaagatcacccagagcaacgccatcttgtgctacattgcccgcaagcacaacctgtgtggggagacagaagaggagaagattcgtgtggacattttggagaaccagaccatggacaaccatatgcagctgggcatgatctgctacaatccagaatttgagaaactgaagccaaagtacttggaggaactccctgaaaagctaaacatgcaggccctttgaagcctcagctacccactatccttcgtgaacatcccctcccatcattacccttccctgcactaaagccagcctgaccttccttcctgttagtggttgtgtctgctttaaagggcctgcctggcccctcgcctgtggagctcagccccgagctgtccccgtgttgcatgaaggagcagcattgactggtttacaggccctgctcctgcagcatggtccctgccttaggcctacctgatggaagtaaagcctcaaccaca

SEQ ID NO: 440854 - DNA, 1021 bp, Homo sapiens
acgccatcctgtgctacattgcccgcaagcacaacctgtgtggggagacagaagaggagaagattcgtgtggacattttggacaaccagcatcatgtccatgacactggggtactgggacatccgcgggctggcccacgccatccgcctgctcctggaatacacagactcaagctacgaggaaaagaagtatacgatgggggacgctcctgactatgacagaagccagtggctgaatgaaaaattcaagctgggcctggactttcccaatctgccctacttgattgatggggctcacaagatcacccagagcaacgccatcctgtgctacattgagaaactgaagccagaatacttggaggaactccctgacaatgctgaagctctactcacagtttctggggaagcaggccatggtttgttggagacaagatcacctttgtagatttcctcgcctatgatgtccttgacctccaccgtatatttgagcccaactgcttggacgccttcccaaatctgaaggacttcatctcccgctttgagggcttggagaagatctctgcctacatgaagtccagccgcttcctcccgccaggaggtgggagtgaggagcccatactcagcctgctgcccaggctgtgcagcgcagctggactctgcatcccagcacctgcctcctcgttcctttctcctgtttattcccatctttacccccaagactttattgggcctcttcacttcccctaaacccctgtcccatgcaggccctttgaagcctcagctacccactttccttcatgaacatccccctcccaacactacccttccctgcactaaagccagcctgaccttccttcctgttagtggttgtatctgctttgaagggcctacctggcccctcgcctgtggagctcagccctgagctgtccccgtgttgcatgacagcattgactggtttacaggccctgctcctgcagcatggcccctgccttaggcctacctgatcaaaataaagcctcagc

SEQ ID NO: 440855 - DNA, 6122 bp, Homo sapiens
ctggagctacacgcaggtgcggcgcacgggcggcggcggcgtggagaccgtgcagggccccggcgtgtcgtgggtgcaccccgacggcgtgggcgtgcagatcgacaccatcacgccggagatccgcgcgctctacaacgtgctggccaaggtgaagcgcgagcgcgacgagtataagcggaggtgggaggaggagctcgccaagcgcatgaaccttcagaccatggtggacacgctgcaggaggcagcacaggaggctgatgccatccaggaggagatgaatgagaagatcgagcggctcaaggccgagctggtggtgtttaaggggcttatgagtgaccccatgacagacctggacacaaagatccaagaaaaggccatgaaggtggacatggacatctgccgccgaatcgatatcacggccaagctgtgcgatgtcgcacagcagcggaactcagaagacgtgtccaagatcttccaggtggtccccaaaaagaaagagcgtaaggtggcttccgatgatgacatctctgagcaggacggggaggtgaaccggttctcggacgatgaggtcggctccatgaacatcaccgatgagatgaagcgcatgtttaaccagctgcgggagacctttgactttgacgacgactgtgacagcctgacgtgggaagagaatgaagacacgctgctgctctgggaggatttcaccaactgcaatccgaccatcgacctgcagggcgagcaagaggaaaacttgggcaacttgatccatgagaccgaatccttcttcaagacgagagacaaggagtaccaggaaacgataggtcagatcgagctcgagctggccacagccaaaagtgacatgaaccgacacctgcacgagtacatggagatgtgcagcatgaagcgaggcctggacgtgcagatggagacctgccgccggctcatcaaaggctccgcagacaggaattcaccgtcccccagctccgtggccagcagcgactcaggaagtacagatgagatccaggatgagttcgagcgcgaggcggatgtggagcccatggtcagctgatgactgaggccctgcgagcctggtggtcttggtgatggggccctgccacctctcctcatggggccaggaaggcccctcggagtggggttcgaagccacaccacacagactttctctgccctcccttctctggaggccctgagggactgctgcttccttccttccttccacaccaccaacgggtgccccgtctccatcccccacccacccaaggaatggtgctgtcaatttctattgttctccacattacaaatgcagacttctgtgcggactttgcagtgttaactgtgccttctcccttaagctgagccactttgagctccaaagaattattcctagcaggtgtttttatacagaactctaagctgagggccgggccaaccggccgtggtgtaatgtggtttctgccgtccgtcccacctgctcctctgattggccatgggctatgccctcccttcctcctgagccagcccagactcggcctggagcttggggtgctctgccaacccccaggaaggagccgcttgcctctgtgagctttctaggcctgggtagggaccaccccaattttctcactccctgaaggagagaaaggtggaaggaagggaaggaggacacattttaattttttggggggatcgagtggcaaagttgaagggacaaggcactgtgaggggaaggcagagcctcactgtgtttaaactactatgcaaaaaacaaaacaaacaacaaaagcagcttgccttatatcattgtggaaggcaggacctctcctgggctcctggcttccccctggagctgggagagaggccggggttagggtgatctgtgtggcagcactgactgggtagtgtgggtttggccgaggttggtcatgaggctggggttcccgcaaggcactggcctccctgaccgcttgcttccttccggacctctgggttcagggcgggggcggagggatccttgatttccctgataacttgatgttcttccctccctcgccagccaacaatagaggcttagagatctgtaatttctctgtgagaaagtctgaaggggccaggcctggtctctgctcccttctacccgccttgggttaggactgtccggcagttgcctgcttttggctgctggcaggagagaagcagggtgggctgctggcagtgcaggagctggagtgagggccatcctctttctgctcctcgacacacgcaagccgctctcagcagttccctcgactggccagtcggggtattgatctgagccagcatcccccaagacttgaatggcttgagtgggactgcgttgaagggcactgtgtggcccccttccaaatctcagcttggagccagctgagcaggctttgctttattattattttttaagcctactgcagtgggtctgttgccaattttaattttttattgtcccaggagctccctctagtggtcaaggtagcaaaatgtgcccaaggactagaacttgggtccctctgccttgcctggaggcagaaggagggggctctgggtttgactgggattgtggtccccaggggtccgtggcctttaaggctcttctctcttttctgtttcccccacctgtgttacagtcttaaaaatactgtacataaaagatatatgtagagagagagagagagcgtgagaatgtgttagtgactatgtgtgatgtaatttatcacgatttggtggccttcgtcatgagttttttcctttgttttcttttgctgggggcacctcccacgggtcccctgtggcagtctggctgtgacacttccatagtcagcatctcttgttagccaaacagttccctttgacaggtacttggagggacaatggttttggaagagagacggcccttctctctcctcactcacccttgttctaaaggttacagggttcaaacatacctgattcttgttgttattgttgttgaatttttattttaaccaaaggttatcagagccagttgggcttggacctcagctgctaaaaagattttccgtttcctcgagggcaggaaaacatccaccctcgtgggtctcctccgtccagggccgagggaggcattggacaatgtggtatgggagtttcgtgggcagcgtggaagccggccctgggttgttccccaaggtggtgggagggtgacagatatatctttagacttaagactgtaaggcagcagtgttagcatgggagtaactaaggttactgtggttatcggtgtccggcggtattatttttactttcctccttgtatacataggtcatttgtctttgaggactagggtactctagggagtttgaaaactgcaggagccagaaagagatcctggcctgagagtcccttctggctggcttttaatatctgctctcctcttgggagtgaggacttggggcaggtgggtaggagagggaaagccagagtgtgatgggcctgcctcctgggctggttcctgggtccggcctgcctgcctgcctgcctgcctctccaccacatgcttttttcagttaatgtcagtgggccctgcttgtcccctcaccatgagcccacagcttgccaagaaagaccccaacgctcgctggggcagcaccagtcctagctgggacgaattggtccatcctttgtaaagctgtaaatacttaattttgactttctatttctaagcccagtgtcatattgacactggtattttagaattttctcagatgggctctcctgcgctgccctctgtctcctgtttttgggggttttatacaaacagaggattggggagggataggaagactagcatccttttggctccctggttggttgtgaaatacacacacacacacacacacacacacacacactcgcactcctctgagactccgaacagagaaaaaaattattggcaaatcaacacatttttctttctcgtcttgagaaaatgtcttgaggtccctgaagggccaaatccatcgtggactaactctgtgggtagagctcagatgacctagggagaattaaaccacttaagcttggagtgggaggagagggggtggggtgggggagaatataagatgtaacttaagctaaatgtaatctatttataaagcaagagactctcatctatttttatgaaaggaagggttttttaatctagggtaggcagttgtggtagcccagcattttcctgtggacgagacatggtgcatgttgttgctggattgaatggaacccattcctgtcccccggcctcgtcttctgtcctcacttttggtcatccacacccatgagcagcttcagcagagtgtaggtcccacttcaccccattctcctctcctctgacccctcagctccttggaagtcttggggtggggatctgagggggtgggtgggctgcaggaaattcagaaatgtggtgggtgggggaagggacaaggcgcattagggagggaacaagctgggctctggggataggctctgattaattagttactctgactctggtctgccgagatccatttccaacccagttgcgttgggagagggttgggaggcagcagagcatgggtgacagtgggagcacacgacttccttggagcctgggcctttgcgggtcccaggtggtcaggcagctggagcagaagtggaaatggcttaagatgctcatagcccagccccggctgtgtctactccaggccaagcctgggctgcagtccttgctatgttccccccagggccctggggggagggatcagggtgctgggggtttcctaggacaggggtcttcccccttgagacaccaagctctggctctagaagagctctctcctggagtggggagtctggaggggactgggtgggtgcaggtaaagccagattctctctggaagggaattttctatgaatggatgatttccaggctcagggtgggctgtgtgttagttctgagcaaatccctcaccaagacccttccctcccaagccctcaaagaaatgaggcaaagcccttccctgcaagaccccttgtggatgtttttgcatctacctgatttttagccccacccagggagactttataccccatgatcctgccccaccgttgctgttgtctgccagctgggtctagcatcacagggaagggggggatttatactcatggaaagactactgatcctaccggaaaccaacctgtttactgtactgttgtaaatatcatgccctttatatcctgtatattggcttcttttaaataaagtgaaatgtcttagaaaaaaaaaaaacaaagaaacaaaaaaacttggggggcatattatatgtgcaggggtgtgcgggaaaaagagggatacagtagaatggtgcacacatgtggtcttcatataggcgtgttttcatgtgaaccacagttttcttggtccaccaaacagtgggcaagaaatcggcccgggatacacccgaatagggcgacgcccgctattaaattgtccggaaataaagcccacggggtaaaccctgtgcacatatcacgaactccggaaaacaagcatagaacagagcacagcagcacgacgaaggaccaacaaacaacacaacatcagcaaaaacacacaagagaacacaccagaaaccataaatagcatacagacaaaataaagagccaggcaaacccaagaacacaaacaaacatcaacgaacacaaaaaaccaaaaaaccaaaaaaccagccaaacaaacataaaagtaacacccaaaaacaaaaaacaagtaagaagagggaaaggcacgaagacgagagggagaagaagaggactcagccagaagacgacgcgagaggggggagccacagggaagcaaagagcaaaaaaggcgagagacggcgagggaaagacacagcagaggctagtaagcagagagaggaggacagccgacaagcacggacaaagagcaagcgagagaagaggcagaagagggagagggtgcagataagagagggcggagggagacacggagcaggcagccagaaaagacaacgcagacggaaaaagaa

SEQ ID NO: 440856 - DNA, 6071 bp, Homo sapiens
ctggagctacacgcaggtgcggcgcacgggcggcggcggcgtggagaccgtgcagggccccggcgtgtcgtgggtgcaccccgacggcgtgggcgtgcagatcgacaccatcacgccggagatccgcgcgctctacaacgtgctggccaaggtgaagcgcgagcgcgacgagtataagcggaggtgggaggaggagctcgccaagcgcatgaaccttcagaccatggtggacacgctgcaggaggcagcacaggaggctgatgccatccaggaggagatgaatgagaagatcgagcggctcaaggccgagctggtggtgtttaaggggcttatgagtgaccccatgacagacctggacacaaagatccaagaaaaggccatgaaggtggacatggacatctgccgccgaatcgatatcacggccaagctgtgcgatgtcgcacagcagcggaactcagaagacgtgtccaagatcttccaggtggtccccaaaaagaaagagcgtaaggtggcttccgatgatgacatctctgagcaggacggggaggtgaaccggttctcggacgatgaggtcggctccatgaacatcaccgatgagatgaagcgcatgtttaaccagctgcgggagacctttgactttgacgacgactgtgacagcctgacgtgggaagagaatgaagacacgctgctgctctgggaggatttcaccaactgcaatccgaccatcgacctgcagggcgagcaagaggaaaacttgggcaacttgatccatgagaccgaatccttcttcaagacgagagacaaggagtaccaggaaacgataggtcagatcgagctcgagctggccacagccaaaagtgacatgaaccgacacctgcacgagtacatggagatgtgcagcatgaagcgaggcctggacgtgcagatggagacctgccgccggctcatcaaaggctccgcagacaggaattcaccgtcccccagctccgtggccagcagcgactcaggaagtacagatgagatccaggatgagttcgagcgcgaggcggatgtggagcccatggtcagctgatgactgaggccctgcgagcctggtggtcttggtgatggggccctgccacctctcctcatggggccaggaaggcccctcggagtggggttcgaagccacaccacacagactttctctgccctcccttctctggaggccctgagggactgctgcttccttccttccttccacaccaccaacgggtgccccgtctccatcccccacccacccaaggaatggtgctgtcaatttctattgttctccacattacaaatgcagacttctgtgcggactttgcagtgttaactgtgccttctcccttaagctgagccactttgagctccaaagaattattcctagcaggtgtttttatacagaactctaagctgagggccgggccaaccggccgtggtgtaatgtggtttctgccgtccgtcccacctgctcctctgattggccatgggctatgccctcccttcctcctgagccagcccagactcggcctggagcttggggtgctctgccaacccccaggaaggagccgcttgcctctgtgagctttctaggcctgggtagggaccaccccaattttctcactccctgaaggagagaaaggtggaaggaagggaaggaggacacattttaattttttggggggatcgagtggcaaagttgaagggacaaggcactgtgaggggaaggcagagcctcactgtgtttaaactactatgcaaaaaacaaaacaaacaacaaaagcagcttgccttatatcattgtggaaggcaggacctctcctgggctcctggcttccccctggagctgggagagaggccggggttagggtgatctgtgtggcagcactgactgggtagtgtgggtttggccgaggttggtcatgaggctggggttcccgcaaggcactggcctccctgaccgcttgcttccttccggacctctgggttcagggcgggggcggagggatccttgatttccctgataacttgatgttcttccctccctcgccagccaacaatagaggcttagagatctgtaatttctctgtgagaaagtctgaaggggccaggcctggtctctgctcccttctacccgccttgggttaggactgtccggcagttgcctgcttttggctgctggcaggagagaagcagggtgggctgctggcagtgcaggagctggagtgagggccatcctctttctgctcctcgacacacgcaagccgctctcagcagttccctcgactggccagtcggggtattgatctgagccagcatcccccaagacttgaatggcttgagtgggactgcgttgaagggcactgtgtggcccccttccaaatctcagcttggagccagctgagcaggctttgctttattattattttttaagcctactgcagtgggtctgttgccaattttaattttttattgtcccaggagctccctctagtggtcaaggtagcaaaatgtgcccaaggactagaacttgggtccctctgccttgcctggaggcagaaggagggggctctgggtttgactgggattgtggtccccaggggtccgtggcctttaaggctcttctctcttttctgtttcccccacctgtgttacagtcttaaaaatactgtacataaaagatatatgtagagagagagagagagcgtgagaatgtgttagtgactatgtgtgatgtaatttatcacgatttggtggccttcgtcatgagttttttcctttgttttcttttgctgggggcacctcccacgggtcccctgtggcagtctggctgtgacacttccatagtcagcatctcttgttagccaaacagttccctttgacaggtacttggagggacaatggttttggaagagagacggcccttctctctcctcactcacccttgttctaaaggttacagggttcaaacatacctgattcttgttgttattgttgttgaatttttattttaaccaaaggttatcagagccagttgggcttggacctcagctgctaaaaagattttccgtttcctcgagggcaggaaaacatccaccctcgtgggtctcctccgtccagggccgagggaggcattggacaatgtggtatgggagtttcgtgggcagcgtggaagccggccctgggttgttccccaaggtggtgggagggtgacagatatatctttagacttaagactgtaaggcagcagtgttagcatgggagtaactaaggttactgtggttatcggtgtccggcggtattatttttactttcctccttgtatacataggtcatttgtctttgaggactagggtactctagggagtttgaaaactgcaggagccagaaagagatcctggcctgagagtcccttctggctggcttttaatatctgctctcctcttgggagtgaggacttggggcaggtgggtaggagagggaaagccagagtgtgatgggcctgcctcctgggctggttcctgggtccggcctgcctgcctgcctgcctgcctctccaccacatgcttttttcagttaatgtcagtgggccctgcttgtcccctcaccatgagcccacagcttgccaagaaagaccccaacgctcgctggggcagcaccagtcctagctgggacgaattggtccatcctttgtaaagctgtaaatacttaattttgactttctatttctaagcccagtgtcatattgacactggtattttagaattttctcagatgggctctcctgcgctgccctctgtctcctgtttttgggggttttatacaaacagaggattggggagggataggaagactagcatccttttggctccctggttggttgtgaaatacacacacacacacacacacacacacacacactcgcactcctctgagactccgaacagagaaaaaaattattggcaaatcaacacatttttctttctcgtcttgagaaaatgtcttgaggtccctgaagggccaaatccatcgtggactaactctgtgggtagagctcagatgacctagggagaatataagatgtaacttaagctaaatgtaatctatttataaagcaagagactctcatctatttttatgaaaggaagggttttttaatctagggtaggcagttgtggtagcccagcattttcctgtggacgagacatggtgcatgttgttgctggattgaatggaacccattcctgtcccccggcctcgtcttctgtcctcacttttggtcatccacacccatgagcagcttcagcagagtgtaggtcccacttcaccccattctcctctcctctgacccctcagctccttggaagtcttggggtggggatctgagggggtgggtgggctgcaggaaattcagaaatgtggtgggtgggggaagggacaaggcgcattagggagggaacaagctgggctctggggataggctctgattaattagttactctgactctggtctgccgagatccatttccaacccagttgcgttgggagagggttgggaggcagcagagcatgggtgacagtgggagcacacgacttccttggagcctgggcctttgcgggtcccaggtggtcaggcagctggagcagaagtggaaatggcttaagatgctcatagcccagccccggctgtgtctactccaggccaagcctgggctgcagtccttgctatgttccccccagggccctggggggagggatcagggtgctgggggtttcctaggacaggggtcttcccccttgagacaccaagctctggctctagaagagctctctcctggagtggggagtctggaggggactgggtgggtgcaggtaaagccagattctctctggaagggaattttctatgaatggatgatttccaggctcagggtgggctgtgtgttagttctgagcaaatccctcaccaagacccttccctcccaagccctcaaagaaatgaggcaaagcccttccctgcaagaccccttgtggatgtttttgcatctacctgatttttagccccacccagggagactttataccccatgatcctgccccaccgttgctgttgtctgccagctgggtctagcatcacagggaagggggggatttatactcatggaaagactactgatcctaccggaaaccaacctgtttactgtactgttgtaaatatcatgccctttatatcctgtatattggcttcttttaaataaagtgaaatgtcttagaaaaaaaaaaaacaaagaaacaaaaaaacttggggggcatattatatgtgcaggggtgtgcgggaaaaagagggatacagtagaatggtgcacacatgtggtcttcatataggcgtgttttcatgtgaaccacagttttcttggtccaccaaacagtgggcaagaaatcggcccgggatacacccgaatagggcgacgcccgctattaaattgtccggaaataaagcccacggggtaaaccctgtgcacatatcacgaactccggaaaacaagcatagaacagagcacagcagcacgacgaaggaccaacaaacaacacaacatcagcaaaaacacacaagagaacacaccagaaaccataaatagcatacagacaaaataaagagccaggcaaacccaagaacacaaacaaacatcaacgaacacaaaaaaccaaaaaaccaaaaaaccagccaaacaaacataaaagtaacacccaaaaacaaaaaacaagtaagaagagggaaaggcacgaagacgagagggagaagaagaggactcagccagaagacgacgcgagaggggggagccacagggaagcaaagagcaaaaaaggcgagagacggcgagggaaagacacagcagaggctagtaagcagagagaggaggacagccgacaagcacggacaaagagcaagcgagagaagaggcagaagagggagagggtgcagataagagagggcggagggagacacggagcaggcagccagaaaagacaacgcagacggaaaaagaa

SEQ ID NO: 440857 - DNA, 5555 bp, Homo sapiens
ccccgactagcccgacagctcgcgaacgtgttatccccccgactagcccgacaggcgggagacctttgactttgacgacgactgtgacagcctgacgtgggaagagaatgaagacacgctgctgctctgggaggatttcaccaactgcaatccgaccatcgacctgcagggcgagcaagaggaaaacttgggcaacttgatccatgagaccgaatccttcttcaagacgagagacaaggagtaccaggaaacgataggtcagatcgagctcgagctggccacagccaaaagtgacatgaaccgacacctgcacgagtacatggagatgtgcagcatgaagcgaggcctggacgtgcagatggagacctgccgccggctcatcaaaggctccgcagacaggaattcaccgtcccccagctccgtggccagcagcgactcaggaagtacagatgagatccaggatgagttcgagcgcgaggcggatgtggagcccatggtcagctgatgactgaggccctgcgagcctggtggtcttggtgatggggccctgccacctctcctcatggggccaggaaggcccctcggagtggggttcgaagccacaccacacagactttctctgccctcccttctctggaggccctgagggactgctgcttccttccttccttccacaccaccaacgggtgccccgtctccatcccccacccacccaaggaatggtgctgtcaatttctattgttctccacattacaaatgcagacttctgtgcggactttgcagtgttaactgtgccttctcccttaagctgagccactttgagctccaaagaattattcctagcaggtgtttttatacagaactctaagctgagggccgggccaaccggccgtggtgtaatgtggtttctgccgtccgtcccacctgctcctctgattggccatgggctatgccctcccttcctcctgagccagcccagactcggcctggagcttggggtgctctgccaacccccaggaaggagccgcttgcctctgtgagctttctaggcctgggtagggaccaccccaattttctcactccctgaaggagagaaaggtggaaggaagggaaggaggacacattttaattttttggggggatcgagtggcaaagttgaagggacaaggcactgtgaggggaaggcagagcctcactgtgtttaaactactatgcaaaaaacaaaacaaacaacaaaagcagcttgccttatatcattgtggaaggcaggacctctcctgggctcctggcttccccctggagctgggagagaggccggggttagggtgatctgtgtggcagcactgactgggtagtgtgggtttggccgaggttggtcatgaggctggggttcccgcaaggcactggcctccctgaccgcttgcttccttccggacctctgggttcagggcgggggcggagggatccttgatttccctgataacttgatgttcttccctccctcgccagccaacaatagaggcttagagatctgtaatttctctgtgagaaagtctgaaggggccaggcctggtctctgctcccttctacccgccttgggttaggactgtccggcagttgcctgcttttggctgctggcaggagagaagcagggtgggctgctggcagtgcaggagctggagtgagggccatcctctttctgctcctcgacacacgcaagccgctctcagcagttccctcgactggccagtcggggtattgatctgagccagcatcccccaagacttgaatggcttgagtgggactgcgttgaagggcactgtgtggcccccttccaaatctcagcttggagccagctgagcaggctttgctttattattattttttaagcctactgcagtgggtctgttgccaattttaattttttattgtcccaggagctccctctagtggtcaaggtagcaaaatgtgcccaaggactagaacttgggtccctctgccttgcctggaggcagaaggagggggctctgggtttgactgggattgtggtccccaggggtccgtggcctttaaggctcttctctcttttctgtttcccccacctgtgttacagtcttaaaaatactgtacataaaagatatatgtagagagagagagagagcgtgagaatgtgttagtgactatgtgtgatgtaatttatcacgatttggtggccttcgtcatgagttttttcctttgttttcttttgctgggggcacctcccacgggtcccctgtggcagtctggctgtgacacttccatagtcagcatctcttgttagccaaacagttccctttgacaggtacttggagggacaatggttttggaagagagacggcccttctctctcctcactcacccttgttctaaaggttacagggttcaaacatacctgattcttgttgttattgttgttgaatttttattttaaccaaaggttatcagagccagttgggcttggacctcagctgctaaaaagattttccgtttcctcgagggcaggaaaacatccaccctcgtgggtctcctccgtccagggccgagggaggcattggacaatgtggtatgggagtttcgtgggcagcgtggaagccggccctgggttgttccccaaggtggtgggagggtgacagatatatctttagacttaagactgtaaggcagcagtgttagcatgggagtaactaaggttactgtggttatcggtgtccggcggtattatttttactttcctccttgtatacataggtcatttgtctttgaggactagggtactctagggagtttgaaaactgcaggagccagaaagagatcctggcctgagagtcccttctggctggcttttaatatctgctctcctcttgggagtgaggacttggggcaggtgggtaggagagggaaagccagagtgtgatgggcctgcctcctgggctggttcctgggtccggcctgcctgcctgcctgcctgcctctccaccacatgcttttttcagttaatgtcagtgggccctgcttgtcccctcaccatgagcccacagcttgccaagaaagaccccaacgctcgctggggcagcaccagtcctagctgggacgaattggtccatcctttgtaaagctgtaaatacttaattttgactttctatttctaagcccagtgtcatattgacactggtattttagaattttctcagatgggctctcctgcgctgccctctgtctcctgtttttgggggttttatacaaacagaggattggggagggataggaagactagcatccttttggctccctggttggttgtgaaatacacacacacacacacacacacacacacacactcgcactcctctgagactccgaacagagaaaaaaattattggcaaatcaacacatttttctttctcgtcttgagaaaatgtcttgaggtccctgaagggccaaatccatcgtggactaactctgtgggtagagctcagatgacctagggagaattaaaccacttaagcttggagtgggaggagagggggtggggtgggggagaatataagatgtaacttaagctaaatgtaatctatttataaagcaagagactctcatctatttttatgaaaggaagggttttttaatctagggtaggcagttgtggtagcccagcattttcctgtggacgagacatggtgcatgttgttgctggattgaatggaacccattcctgtcccccggcctcgtcttctgtcctcacttttggtcatccacacccatgagcagcttcagcagagtgtaggtcccacttcaccccattctcctctcctctgacccctcagctccttggaagtcttggggtggggatctgagggggtgggtgggctgcaggaaattcagaaatgtggtgggtgggggaagggacaaggcgcattagggagggaacaagctgggctctggggataggctctgattaattagttactctgactctggtctgccgagatccatttccaacccagttgcgttgggagagggttgggaggcagcagagcatgggtgacagtgggagcacacgacttccttggagcctgggcctttgcgggtcccaggtggtcaggcagctggagcagaagtggaaatggcttaagatgctcatagcccagccccggctgtgtctactccaggccaagcctgggctgcagtccttgctatgttccccccagggccctggggggagggatcagggtgctgggggtttcctaggacaggggtcttcccccttgagacaccaagctctggctctagaagagctctctcctggagtggggagtctggaggggactgggtgggtgcaggtaaagccagattctctctggaagggaattttctatgaatggatgatttccaggctcagggtgggctgtgtgttagttctgagcaaatccctcaccaagacccttccctcccaagccctcaaagaaatgaggcaaagcccttccctgcaagaccccttgtggatgtttttgcatctacctgatttttagccccacccagggagactttataccccatgatcctgccccaccgttgctgttgtctgccagctgggtctagcatcacagggaagggggggatttatactcatggaaagactactgatcctaccggaaaccaacctgtttactgtactgttgtaaatatcatgccctttatatcctgtatattggcttcttttaaataaagtgaaatgtcttagaaaaaaaaaaaacaaagaaacaaaaaaacttggggggcatattatatgtgcaggggtgtgcgggaaaaagagggatacagtagaatggtgcacacatgtggtcttcatataggcgtgttttcatgtgaaccacagttttcttggtccaccaaacagtgggcaagaaatcggcccgggatacacccgaatagggcgacgcccgctattaaattgtccggaaataaagcccacggggtaaaccctgtgcacatatcacgaactccggaaaacaagcatagaacagagcacagcagcacgacgaaggaccaacaaacaacacaacatcagcaaaaacacacaagagaacacaccagaaaccataaatagcatacagacaaaataaagagccaggcaaacccaagaacacaaacaaacatcaacgaacacaaaaaaccaaaaaaccaaaaaaccagccaaacaaacataaaagtaacacccaaaaacaaaaaacaagtaagaagagggaaaggcacgaagacgagagggagaagaagaggactcagccagaagacgacgcgagaggggggagccacagggaagcaaagagcaaaaaaggcgagagacggcgagggaaagacacagcagaggctagtaagcagagagaggaggacagccgacaagcacggacaaagagcaagcgagagaagaggcagaagagggagagggtgcagataagagagggcggagggagacacggagcaggcagccagaaaagacaacgcagacggaaaaagaa

SEQ ID NO: 440858 - DNA, 6053 bp, Homo sapiens
ctggagctacacgcaggtgcggcgcacgggcggcggcggcgtggagaccgtgcagggccccggcgtgtcgtgggtgcaccccgacggcgtgggcgtgcagatcgacaccatcacgccggagatccgcgcgctctacaacgtgctggccaaggtgaagcgcgagcgcgacgagtataagcggaggtgggaggaggagctcgccaagcgcatgaaccttcagaccatggtggacacgctgcaggaggcagcacaggaggctgatgccatccaggaggagatgaatgagaagatcgagcggctcaaggccgagctggtggtgtttaaggggcttatgagtgaccccatgacagacctggacacaaagatccaagaaaaggccatgaaggtggacatggacatctgccgccgaatcgatatcacggccaagctgtgcgatgtcgcacagcagcggaactcagaagacgtgtccaagatcttccaggtggtccccaaaaagaaagagcgtaaggtggcttccgatgatgacatctctgagcaggacggggaggtgaaccggttctcggacgatgaggtcggctccatgaacatcaccgatgagatgaagcgcatgtttaaccagctgcgggagacctttgactttgacgacgactgtgacagcctgacgtgggaagagaatgaagacacgctgctgctctgggaggatttcaccaactgcaatccgaccatcgacctgcagggcgagcaagaggaaaacttgggcaacttgatccatgagaccgaatccttcttcaagacgagagacaaggagtaccaggaaacgataggtcagatcgagctcgagctggccacagccaaaagtgacatgaaccgacacctgcacgagtacatggagatgtgcagcatgaagcgaggcctggacgtgcagatggagacctgccgccggctcatcaaaggctccgcagacaggaattcaccgtcccccagctccgtggccagcagcgactcaggaagtacagatgagatccaggatgagttcgagcgcgaggcggatgtggagcccatggtcagctgatgactgaggccctgcgagcctggtggtcttggtgatggggccctgccacctctcctcatggggccaggaaggcccctcggagtggggttcgaagccacaccacacagactttctctgccctcccttctctggaggccctgagggactgctgcttccttccttccttccacaccaccaacgggtgccccgtctccatcccccacccacccaaggaatggtgctgtcaatttctattgttctccacattacaaatgcagacttctgtgcggactttgcagtgttaactgtgccttctcccttaagctgagccactttgagctccaaagaattattcctagcaggtgtttttatacagaactctaagctgagggccgggccaaccggccgtggtgtaatgtggtttctgccgtccgtcccacctgctcctctgattggccatgggctatgccctcccttcctcctgagccagcccagactcggcctggagcttggggtgctctgccaacccccaggaaggagccgcttgcctctgtgagctttctaggcctgggtagggaccaccccaattttctcactccctgaaggagagaaaggtggaaggaagggaaggaggacacattttaattttttggggggatcgagtggcaaagttgaagggacaaggcactgtgaggggaaggcagagcctcactgtgtttaaactactatgcaaaaaacaaaacaaacaacaaaagcagcttgccttatatcattgtggaaggcaggacctctcctgggctcctggcttccccctggagctgggagagaggccggggttagggtgatctgtgtggcagcactgactgggtagtgtgggtttggccgaggttggtcatgaggctggggttcccgcaaggcactggcctccctgaccgcttgcttccttccggacctctgggttcagggcgggggcggagggatccttgatttccctgataacttgatgttcttccctccctcgccagccaacaatagaggcttagagatctgtaatttctctgtgagaaagtctgaaggggccaggcctggtctctgctcccttctacccgccttgggttaggactgtccggcagttgcctgcttttggctgctggcaggagagaagcagggtgggctgctggcagtgcaggagctggagtgagggccatcctctttctgctcctcgacacacgcaagccgctctcagcagttccctcgactggccagtcggggtattgatctgagccagcatcccccaagacttgaatggcttgagtgggactgcgttgaagggcactgtgtggcccccttccaaatctcagcttggagccagctgagcaggctttgctttattattattttttaagcctactgcagtgggtctgttgccaattttaattttttattgtcccaggagctccctctagtggtcaaggtagcaaaatgtgcccaaggactagaacttgggtccctctgccttgcctggaggcagaaggagggggctctgggtttgactgggattgtggtccccaggggtccgtggcctttaaggctcttctctcttttctgtttcccccacctgtgttacagtcttaaaaatactgtacataaaagatatatgtagagagagagagagagcgtgagaatgtgttagtgactatgtgtgatgtaatttatcacgatttggtggccttcgtcatgagttttttcctttgttttcttttgctgggggcacctcccacgggtcccctgtggcagtctggctgtgacacttccatagtcagcatctcttgttagccaaacagttccctttgacaggtacttggagggacaatggttttggaagagagacggcccttctctctcctcactcacccttgttctaaaggttacagggttcaaacatacctgattcttgttgttattgttgttgaatttttattttaaccaaaggttatcagagccagttgggcttggacctcagctgctaaaaagattttccgtttcctcgagggcaggaaaacatccaccctcgtgggtctcctccgtccagggccgagggaggcattggacaatgtggtatgggagtttcgtgggcagcgtggaagccggccctgggttgttccccaaggtggtgggagggtgacagatatatctttagacttaagactgtaaggcagcagtgttagcatgggagtaactaaggttactgtggttatcggtgtccggcggtattatttttactttcctccttgtatacataggtcatttgtctttgaggactagggtactctagggagtttgaaaactgcaggagccagaaagagatcctggcctgagagtcccttctggctggcttttaatatctgctctcctcttgggagtgaggacttggggcaggtgggtaggagagggaaagccagagtgtgatgggcctgcctcctgggctggttcctgggtccggcctgcctgcctgcctgcctgcctctccaccacatgcttttttcagttaatgtcagtgggccctgcttgtcccctcaccatgagcccacagcttgccaagaaagaccccaacgctcgctggggcagcaccagtcctagctgggacgaattggtccatcctttgtaaagctgtaaatacttaattttgactttctatttctaagcccagtgtcatattgacactggtattttagaattttctcagatgggctctcctgcgctgccctctgtctcctgtttttgggggttttatacaaacagaggattggggagggataggaagactagcatccttttggctccctggttggttgtgaaatacacacacacacacacacacacacacacacactcgcactcctctgagactccgaacagagaaaaaaattattggcaaatcaacacatttttctttctcgtcttgagaaaatgtcttgaggtccctgaagggccaaatccatcgtggactaactctgtgggtagagctcagatgacctagggagaattaaaccacttaagcttggagtgggaggagagggggtggggtgggggagaatataagatgtaacttaagctaaatgtaatctatttataaagcaagagactctcatctatttttatgaaaggaagggttttttaatctagggtaggcagttgtggtagcccagcattttcctgtggacgagacatggtgcatgttgttgctggattgaatggaacccattcctgtcccccggcctcgtcttctgtcctcacttttggtcatccacacccatgagcagcttcagcagagtgtaggtcccacttcaccccattctcctctcctctgacccctcagctccttggaagtcttggggtggggatctgagggggtgggtgggctgcaggaaattcagaaatgtggtgggtgggggaagggacaaggcgcattagggagggaacaagctgggctctggggataggctctgattaattagttactctgactctggtctgccgagatccatttccaacccagttgcgttgggagagggttgggaggcagcagagcatgggtgacagtgggagcacacgacttccttggagcctgggcctttgcgggtcccaggtggtcaggcagctggagcagaagtggaaatggcttaagatgctcatagcccagccccggctgtgtctactccaggccaagcctgggctgcagtccttgctatgttccccccagggccctggggggagggatcagggtgctgggggtttcctaggacaggggtcttcccccttgagacaccaagctctggctctagaagagctctctcctggagtggggagtctggaggggactggggtgggctgtgtgttagttctgagcaaatccctcaccaagacccttccctcccaagccctcaaagaaatgaggcaaagcccttccctgcaagaccccttgtggatgtttttgcatctacctgatttttagccccacccagggagactttataccccatgatcctgccccaccgttgctgttgtctgccagctgggtctagcatcacagggaagggggggatttatactcatggaaagactactgatcctaccggaaaccaacctgtttactgtactgttgtaaatatcatgccctttatatcctgtatattggcttcttttaaataaagtgaaatgtcttagaaaaaaaaaaaacaaagaaacaaaaaaacttggggggcatattatatgtgcaggggtgtgcgggaaaaagagggatacagtagaatggtgcacacatgtggtcttcatataggcgtgttttcatgtgaaccacagttttcttggtccaccaaacagtgggcaagaaatcggcccgggatacacccgaatagggcgacgcccgctattaaattgtccggaaataaagcccacggggtaaaccctgtgcacatatcacgaactccggaaaacaagcatagaacagagcacagcagcacgacgaaggaccaacaaacaacacaacatcagcaaaaacacacaagagaacacaccagaaaccataaatagcatacagacaaaataaagagccaggcaaacccaagaacacaaacaaacatcaacgaacacaaaaaaccaaaaaaccaaaaaaccagccaaacaaacataaaagtaacacccaaaaacaaaaaacaagtaagaagagggaaaggcacgaagacgagagggagaagaagaggactcagccagaagacgacgcgagaggggggagccacagggaagcaaagagcaaaaaaggcgagagacggcgagggaaagacacagcagaggctagtaagcagagagaggaggacagccgacaagcacggacaaagagcaagcgagagaagaggcagaagagggagagggtgcagataagagagggcggagggagacacggagcaggcagccagaaaagacaacgcagacggaaaaagaa

SEQ ID NO: 440859 - DNA, 5180 bp, Homo sapiens
ctggagctacacgcaggtgcggcgcacgggcggcggcggcgtggagaccgtgcagggccccggcgtgtcgtgggtgcaccccgacggcgtgggcgtgcagatcgacaccatcacgccggagatccgcgcgctctacaacgtgctggccaaggtgaagcgcgagcgcgacgagtataagcggaggtgggaggaggagctcgccaagcgcatgaaccttcagaccatggtggacacgctgcaggaggcagcacaggaggctgatgccatccaggaggagatgaatgagaagatcgagcggctcaaggccgagctggtggtgtttaaggggcttatgagtgaccccatgacagacctggacacaaagatccaagaaaaggccatgaaggtggacatggacatctgccgccgaatcgatatcacggccaagctgtgcgatgtcgcacagcagcggaactcagaagacgtgtccaagatcttccaggtggtccccaaaaagaaagagcgtaaggtggcttccgatgatgacatctctgagcaggacggggaggtgaaccggttctcggacgatgaggtcggctccatgaacatcaccgatgagatgaagcgcatgtttaaccagctgcgggagacctttgactttgacgacgactgtgacagcctgacgtgggaagagaatgaagacacgctgctgctctgggaggatttcaccaactgcaatccgaccatcgacctgcagggcgagcaagaggaaaacttgggcaacttgatccatgagaccgaatccttcttcaagacgagagacaaggagtaccaggaaacgataggtcagatcgagctcgagctggccacagccaaaagtgacatgaaccgacacctgcacgagtacatggagatgtgcagcatgaagcgaggcctggacgtgcagatggagacctgccgccggctcatcaaaggctccgcagacaggaattcaccgtcccccagctccgtggccagcagcgactcaggaagtacagatgagatccaggatgagttcgagcgcgaggcggatgtggagcccatggtcagctgatgactgaggccctgcgagcctggtggtcttggtgatggggccctgccacctctcctcatggggccaggaaggcccctcggagtggggttcgaagccacaccacacagactttctctgccctcccttctctggaggccctgagggactgctgcttccttccttccttccacaccaccaacgggtgccccgtctccatcccccacccacccaaggaatggtgctgtcaatttctattgttctccacattacaaatgcagacttctgtgcggactttgcagtgttaactgtgccttctcccttaagctgagccactttgagctccaaagaattattcctagcaggtgtttttatacagaactctaagctgagggccgggccaaccggccgtggtgtaatgtggtttctgccgtccgtcccacctgctcctctgattggccatgggctatgccctcccttcctcctgagccagcccagactcggcctggagcttggggtgctctgccaacccccaggaaggagccgcttgcctctgtgagctttctaggcctgggtagggaccaccccaattttctcactccctgaaggagagaaaggtggaaggaagggaaggaggacacattttaattttttggggggatcgagtggcaaagttgaagggacaaggcactgtgaggggaaggcagagcctcactgtgtttaaactactatgcaaaaaacaaaacaaacaacaaaagcagcttgccttatatcattgtggaaggcaggacctctcctgggctcctggcttccccctggagctgggagagaggccggggttagggtgatctgtgtggcagcactgactgggtagtgtgggtttggccgaggttggtcatgaggctggggttcccgcaaggcactggcctccctgaccgcttgcttccttccggacctctgggttcagggcgggggcggagggatccttgatttccctgataacttgatgttcttccctccctcgccagccaacaatagaggcttagagatctgtaatttctctgtgagaaagtctgaaggggccaggcctggtctctgctcccttctacccgccttgggttaggactgtccggcagttgcctgcttttggctgctggcaggagagaagcagggtgggctgctggcagtgcaggagctggagtgagggccatcctctttctgctcctcgacacacgcaagccgctctcagcagttccctcgactggccagtcggggtattgatctgagccagcatcccccaagacttgaatggcttgagtgggactgcgttgaagggcactgtgtggcccccttccaaatctcagcttggagccagctgagcaggctttgctttattattattttttaagcctactgcagtgggtctgttgccaattttaattttttattgtcccaggagctccctctagtggtcaaggtagcaaaatgtgcccaaggactagaacttgggtccctctgccttgcctggaggcagaaggagggggctctgggtttgactgggattgtggtccccaggggtccgtggcctttaaggctcttctctcttttctgtttcccccacctgtgttacagtcttaaaaatactgtacataaaagatatatgtagagagagagagagagcgtgagaatgtgttagtgactatgtgtgatgtaatttatcacgatttggtggccttcgtcatgagttttttcctttgttttcttttgctgggggcacctcccacgggtcccctgtggcagtctggctgtgacacttccatagtcagcatctcttgttagccaaacagttccctttgacaggtacttggagggacaatggttttggaagagagacggcccttctctctcctcactcacccttgttctaaaggttacagggttcaaacatacctgattcttgttgttattgttgttgaatttttattttaaccaaaggttatcagagccagttgggcttggacctcagctgctaaaaagattttccgtttcctcgagggcaggaaaacatccaccctcgtgggtctcctccgtccagggccgagggaggcattggacaatgtggtatgggagtttcgtgggcagcgtggaagccggccctgggttgttccccaaggtggtgggagggtgacagatatatctttagacttaagactgtaaggcagcagtgttagcatgggagtaactaaggttactgtggttatcggtgtccggcggtattatttttactttcctccttgtatacataggtcatttgtctttgaggactagggtactctagggagtttgaaaactgcaggagccagaaagagatcctggcctgagagtcccttctggctggcttttaatatctgctctcctcttgggagtgaggacttggggcaggtgggtaggagagggaaagccagagtgtgatgggcctgcctcctgggctggttcctgggtccggcctgcctgcctgcctgcctgcctctccaccacatgcttttttcagttaatgtcagtgggccctgcttgtcccctcaccatgagcccacagcttgccaagaaagaccccaacgctcgctggggcagcaccagtcctagctgggacgaattggtccatcctttgtaaagctgtaaatacttaattttgactttctatttctaagcccagtgtcatattgacactggtattttagaattttctcagatgggctctcctgcgctgccctctgtctcctgtttttgggggttttatacaaacagaggattggggagggataggaagactagcatccttttggctccctggttggttgtgaaatacacacacacacacacacacacacacacacactcgcactcctctgagactccgaacagagaaaaaaattattggcaaatcaacacatttttctttctcgtcttgagaaaatgtcttgaggtccctgaagggccaaatccatcgtggactaactctgtgggtagagctcagatgacctagggagaattaaaccacttaagcttggagtgggaggagagggggtggggtgggggagaatataagatgtaacttaagctaaatgtaatctatttataaagcaagagactctcatctatttttatgaaaggaagggttttttaatctagggtaggcagttgtggtagcccagcattttcctgtggacgagacatggtgcatgttgttgctggattgaatggaacccattcctgtcccccggcctcgtcttctgtcctcacttttggtcatccacacccatgagcagcttcagcagagtgtaggtcccacttcaccccattctcctctcctctgacccctcagctccttggaagtcttggggtggggatctgagggggtgggtgggctgcaggaaattcagaaatgtggtgggtgggggaagggacaaggcgcattagggagggaacaagctgggctctggggataggctctgattaattagttactctgactctggtctgccgagatccatttccaacccagttgcgttgggagagggttgggaggcagcagagcatgggtgacagtgggagcacacgacttccttggagcctgggcctttgcgggtcccaggtggtcaggcagctggagcagaagtggaaatggcttaagatgctcatagcccagccccggctgtgtctactccaggccaagcctgggctgcagtccttgctatgttccccccagggccctggggggagggatcaggggagactttataccccatgatcctgccccaccgttgctgttgtctgccagctgggtctagcatcacagggaagggggggatttatactcatggaaagactactgatcctaccggaaaccaacctgtttactgtactgttgtaaatatcatgccctttatatcctgtatattggcttcttttaaataaagtgaaatgtcttagaactgatggtgcttttttttgtttttgtttttaaacagaagatgaatctggtgttgggggaggggtaggaggacggaaggccacagaaaccctcaaactcattagttaattagccataaaataggggatttcatatcacctg

SEQ ID NO: 440860 - DNA, 1048 bp, Homo sapiens
ctggagctacacgcaggtgcggcgcacgggcggcggcggcgtggagaccgtgcagggccccggcgtgtcgtgggtgcaccccgacggcgtgggcgtgcagatcgacaccatcacgccggagatccgcgcgctctacaacgtgctggccaaggtgaagcgcgagcgcgacgagtataagcggaggtgggaggaggagctcgccaagcgcatgaaccttcagaccatggtggacacgctgcaggaggcagcacaggaggctgatgccatccaggaggagatgaatgagaagatcgagcggctcaaggccgagctggtggtgtttaaggggcttatgagtgaccccatgacagacctggacacaaagatccaagaaaaggccatgaaggtggacatggacatctgccgccgaatcgatatcacggccaagctgtgcgatgtcgcacagcagcggaactcagaagacgtgtccaagatcttccaggtggtccccaaaaagaaagagcgtaaggtggcttccgatgatgacatctctgagcaggacggggaggtgaaccggttctcggacgatgaggtcggctccatgaacatcaccgatgagatgaagcgcatgtttaaccagctgcgggagacctttgactttgacgacgactgtgacagcctgacgtgggaagagaatgaagacacgctgctgctctgggaggatttcaccaactgcaatccgaccatcgacctgcagggcgagcaagaggaaaacttgggcaacttgatccatgagaccgaatccttcttcaagacgagagacaaggagtaccaggaaacgataggtcagatcgagctcgagctggccacagccaaaagtgacatgaaccgacacctgcacgagtacatggagatgtgcagcatgaagcgaggcctggacgtgcagatggagacctgccgccggctcatcaaaggctccgcagacaggaattcaccgtcccccagctccgtggccagcagcgttccacaacggggacctctagagcgaccgcagcagcagctgccgcac

SEQ ID NO: 440861 - DNA, 396 bp, Homo sapiens
ctgccttctgttcagtcatgccctctggtgtcacccccacaggcgggagacctttgactttgacgacgactgtgacagcctgacgtgggaagagaatgaagacacgctgctgctctgggaggatttcaccaactgcaatccgaccatcgacctgcagggcgagtgacctgccttctctgggggtgcctctctcacaggatccctcattctttcctttgcatgcagcctttgatccccagctaaactatcccttctgtgcccccagcaagaggaaaacttgggcaacttgatccatgagaccgaatccttcttcaagacgagagacaaggagtaccaggaaacgataggtcagatcgaggtgagggctcgggacgtggagcccactcgtgaggctct

SEQ ID NO: 440862 - DNA, 5489 bp, Homo sapiens
ctggagctacacgcaggtgcggcgcacgggcggcggcggcgtggagaccgtgcagggccccggcgtgtcgtgggtgcaccccgacggcgtgggcgtgcagatcgacaccatcacgccggagatccgcgcgctctacaacgtgctggccaaggtgaagcgcgagcgcgacgagtataagcggaggtgggaggaggagctcgccaagcgcatgaaccttcagaccatggtggacacgctgcaggaggcagcacaggaggctgatgccatccaggaggagatgaatgagaagatcgagcggctcaaggccgagctggtggtgtttaaggggcttatgagtgaccccatgacagacctggacacaaagatccaagaaaaggccatgaaggtggacatggacatctgccgccgaatcgatatcacggccaagctgtgcgatgtcgcacagcagcggaactcagaagacgtgtccaagatcttccaggtggtccccaaaaagaaagagcgtaaggtggcttccgatgatgacatctctgagcaggacggggaggtgaaccggttctcggacgatgaggtcggctccatgaacatcaccgatgagatgaagcgcatgtttaaccagctgcgggagacctttgactttgacgacgactgtgacagcctgacgtgggaagagaatgaagacacgctgctgctctgggaggatttcaccaactgcaatccgaccatcgacctgcagggcgagcaagaggaaaacttgggcaacttgatccatgagaccgaatccttcttcaagacgagagacaaggagtaccaggaaacgataggtcagatcgagctcgagctggccacagccaaaagtgacatgaaccgacacctgcacgagtacatggagatgtgcagcatgaagcgaggcctggacgtgcagatggagacctgccgccggctcatcaaaggctccgcagacaggaattcaccgtcccccagctccgtggccagcagcgactcaggaagtacagatgagatccaggatgagttcgagcgcgaggcggatgtggagcccatggtcagctgatgactgaggccctgcgagcctggtggtcttggtgatggggccctgccacctctcctcatggggccaggaaggcccctcggagtggggttcgaagccacaccacacagactttctctgccctcccttctctggaggccctgagggactgctgcttccttccttccttccacaccaccaacgggtgccccgtctccatcccccacccacccaaggaatggtgctgtcaatttctattgttctccacattacaaatgcagacttctgtgcggactttgcagtgttaactgtgccttctcccttaagctgagccactttgagctccaaagaattattcctagcaggtgtttttatacagaactctaagctgagggccgggccaaccggccgtggtgtaatgtggtttctgccgtccgtcccacctgctcctctgattggccatgggctatgccctcccttcctcctgagccagcccagactcggcctggagcttggggtgctctgccaacccccaggaaggagccgcttgcctctgtgagctttctaggcctgggtagggaccaccccaattttctcactccctgaaggagagaaaggtggaaggaagggaaggaggacacattttaattttttggggggatcgagtggcaaagttgaagggacaaggcactgtgaggggaaggcagagcctcactgtgtttaaactactatgcaaaaaacaaaacaaacaacaaaagcagcttgccttatatcattgtggaaggcaggacctctcctgggctcctggcttccccctggagctgggagagaggccggggttagggtgatctgtgtggcagcactgactgggtagtgtgggtttggccgaggttggtcatgaggctggggttcccgcaaggcactggcctccctgaccgcttgcttccttccggacctctgggttcagggcgggggcggagggatccttgatttccctgataacttgatgttcttccctccctcgccagccaacaatagaggcttagagatctgtaatttctctgtgagaaagtctgaaggggccaggcctggtctctgctcccttctacccgccttgggttaggactgtccggcagttgcctgcttttggctgctggcaggagagaagcagggtgggctgctggcagtgcaggagctggagtgagggccatcctctttctgctcctcgacacacgcaagccgctctcagcagttccctcgactggccagtcggggtattgatctgagccagcatcccccaagacttgaatggcttgagtgggactgcgttgaagggcactgtgtggcccccttccaaatctcagcttggagccagctgagcaggctttgctttattattattttttaagcctactgcagtgggtctgttgccaattttaattttttattgtcccaggagctccctctagtggtcaaggtagcaaaatgtgcccaaggactagaacttgggtccctctgccttgcctggaggcagaaggagggggctctgggtttgactgggattgtggtccccaggggtccgtggcctttaaggctcttctctcttttctgtttcccccacctgtgttacagtcttaaaaatactgtacataaaagatatatgtagagagagagagagagcgtgagaatgtgttagtgactatgtgtgatgtaatttatcacgatttggtggccttcgtcatgagttttttcctttgttttcttttgctgggggcacctcccacgggtcccctgtggcagtctggctgtgacacttccatagtcagcatctcttgttagccaaacagttccctttgacaggtacttggagggacaatggttttggaagagagacggcccttctctctcctcactcacccttgttctaaaggttacagggttcaaacatacctgattcttgttgttattgttgttgaatttttattttaaccaaaggttatcagagccagttgggcttggacctcagctgctaaaaagattttccgtttcctcgagggcaggaaaacatccaccctcgtgggtctcctccgtccagggccgagggaggcattggacaatgtggtatgggagtttcgtgggcagcgtggaagccggccctgggttgttccccaaggtggtgggagggtgacagatatatctttagacttaagactgtaaggcagcagtgttagcatgggagtaactaaggttactgtggttatcggtgtccggcggtattatttttactttcctccttgtatacataggtcatttgtctttgaggactagggtactctagggagtttgaaaactgcaggagccagaaagagatcctggcctgagagtcccttctggctggcttttaatatctgctctcctcttgggagtgaggacttggggcaggtgggtaggagagggaaagccagagtgtgatgggcctgcctcctgggctggttcctgggtccggcctgcctgcctgcctgcctgcctctccaccacatgcttttttcagttaatgtcagtgggccctgcttgtcccctcaccatgagcccacagcttgccaagaaagaccccaacgctcgctggggcagcaccagtcctagctgggacgaattggtccatcctttgtaaagctgtaaatacttaattttgactttctatttctaagcccagtgtcatattgacactggtattttagaattttctcagatgggctctcctgcgctgccctctgtctcctgtttttgggggttttatacaaacagaggattggggagggataggaagactagcatccttttggctccctggttggttgtgaaatacacacacacacacacacacacacacacacactcgcactcctctgagactccgaacagagaaaaaaattattggcaaatcaacacatttttctttctcgtcttgagaaaatgtcttgaggtccctgaagggccaaatccatcgtggactaactctgtgggtagagctcagatgacctagggagaattaaaccacttaagcttggagtgggaggagagggggtggggtgggggagaatataagatgtaacttaagctaaatgtaatctatttataaagcaagagactctcatctatttttatgaaaggaagggttttttaatctagggtaggcagttgtggtagcccagcattttcctgtggacgagacatggtgcatgttgttgctggattgaatggaacccattcctgtcccccggcctcgtcttctgtcctcacttttggtcatccacacccatgagcagcttcagcagagtgtaggtcccacttcaccccattctcctctcctctgacccctcagctccttggaagtcttggggtggggatctgagggggtgggtgggctgcaggaaattcagaaatgtggtgggtgggggaagggacaaggcgcattagggagggaacaagctgggctctggggataggctctgattaattagttactctgactctggtctgccgagatccatttccaacccagttgcgttgggagagggttgggaggcagcagagcatgggtgacagtgggagcacacgacttccttggagcctgggcctttgcgggtcccaggtggtcaggcagctggagcagaagtggaaatggcttaagatgctcatagcccagccccggctgtgtctactccaggccaagcctgggctgcagtccttgctatgttccccccagggccctggggggagggatcagggtgctgggggtttcctaggacaggggtcttcccccttgagacaccaagctctggctctagaagagctctctcctggagtggggagtctggaggggactgggtgggtgcaggtaaagccagattctctctggaagggaattttctatgaatggatgatttccaggctcagggtgggctgtgtgttagttctgagcaaatccctcaccaagacccttccctcccaagccctcaaagaaatgaggcaaagcccttccctgcaagaccccttgtggatgtttttgcatctacctgatttttagccccacccagggagactttataccccatgatcctgccccaccgttgctgttgtctgccagctgggtctagcatcacagggaagggggggatttatactcatggaaagactactgatcctaccggaaaccaacctgtttactgtactgttgtaaatatcatgccctttatatcctgtatattggcttcttttaaataaagtgaaatgtcttagaactgatggtgcttttttttgtttttgtttttaaacagaagatgaatctggtgttgggggaggggtaggaggacggaaggccacagaaaccctcaaactcattagttaattagccataaaataggggatttcatatcacctg

SEQ ID NO: 440863 - DNA, 5619 bp, Homo sapiens
atcccctgcgctacctgctggagaagcagctgttagcagcagcagagctttcgcatggtgaactcgctgctgttcggggagatggtctccgtggccagcagcgactcaggaagtacagatgagatccaggatgagttcgagcgcgaggcggatgtggagcccatggtcagaatgaagacacgctgctgctctgggaggatttcaccaactgcaatccgaccatcgacctgcagggcgagcaagaggaaaacttgggcaacttgatccatgagaccgaatccttcttcaagacgagagacaaggagtaccaggaaacgataggtcagatcgagctcgagctggccacagccaaaagtgacatgaaccgacacctgcacgagtacatggagatgtgcagcatgaagcgaggcctggacgtgcagatggagacctgccgccggctcatcaaaggctccgcagacaggaattcaccgtcccccagctccgtggccagcagcgactcaggaagtacagatgagatccaggatgagttcgagcgcgaggcggatgtggagcccatggtcagctgatgactgaggccctgcgagcctggtggtcttggtgatggggccctgccacctctcctcatggggccaggaaggcccctcggagtggggttcgaagccacaccacacagactttctctgccctcccttctctggaggccctgagggactgctgcttccttccttccttccacaccaccaacgggtgccccgtctccatcccccacccacccaaggaatggtgctgtcaatttctattgttctccacattacaaatgcagacttctgtgcggactttgcagtgttaactgtgccttctcccttaagctgagccactttgagctccaaagaattattcctagcaggtgtttttatacagaactctaagctgagggccgggccaaccggccgtggtgtaatgtggtttctgccgtccgtcccacctgctcctctgattggccatgggctatgccctcccttcctcctgagccagcccagactcggcctggagcttggggtgctctgccaacccccaggaaggagccgcttgcctctgtgagctttctaggcctgggtagggaccaccccaattttctcactccctgaaggagagaaaggtggaaggaagggaaggaggacacattttaattttttggggggatcgagtggcaaagttgaagggacaaggcactgtgaggggaaggcagagcctcactgtgtttaaactactatgcaaaaaacaaaacaaacaacaaaagcagcttgccttatatcattgtggaaggcaggacctctcctgggctcctggcttccccctggagctgggagagaggccggggttagggtgatctgtgtggcagcactgactgggtagtgtgggtttggccgaggttggtcatgaggctggggttcccgcaaggcactggcctccctgaccgcttgcttccttccggacctctgggttcagggcgggggcggagggatccttgatttccctgataacttgatgttcttccctccctcgccagccaacaatagaggcttagagatctgtaatttctctgtgagaaagtctgaaggggccaggcctggtctctgctcccttctacccgccttgggttaggactgtccggcagttgcctgcttttggctgctggcaggagagaagcagggtgggctgctggcagtgcaggagctggagtgagggccatcctctttctgctcctcgacacacgcaagccgctctcagcagttccctcgactggccagtcggggtattgatctgagccagcatcccccaagacttgaatggcttgagtgggactgcgttgaagggcactgtgtggcccccttccaaatctcagcttggagccagctgagcaggctttgctttattattattttttaagcctactgcagtgggtctgttgccaattttaattttttattgtcccaggagctccctctagtggtcaaggtagcaaaatgtgcccaaggactagaacttgggtccctctgccttgcctggaggcagaaggagggggctctgggtttgactgggattgtggtccccaggggtccgtggcctttaaggctcttctctcttttctgtttcccccacctgtgttacagtcttaaaaatactgtacataaaagatatatgtagagagagagagagagcgtgagaatgtgttagtgactatgtgtgatgtaatttatcacgatttggtggccttcgtcatgagttttttcctttgttttcttttgctgggggcacctcccacgggtcccctgtggcagtctggctgtgacacttccatagtcagcatctcttgttagccaaacagttccctttgacaggtacttggagggacaatggttttggaagagagacggcccttctctctcctcactcacccttgttctaaaggttacagggttcaaacatacctgattcttgttgttattgttgttgaatttttattttaaccaaaggttatcagagccagttgggcttggacctcagctgctaaaaagattttccgtttcctcgagggcaggaaaacatccaccctcgtgggtctcctccgtccagggccgagggaggcattggacaatgtggtatgggagtttcgtgggcagcgtggaagccggccctgggttgttccccaaggtggtgggagggtgacagatatatctttagacttaagactgtaaggcagcagtgttagcatgggagtaactaaggttactgtggttatcggtgtccggcggtattatttttactttcctccttgtatacataggtcatttgtctttgaggactagggtactctagggagtttgaaaactgcaggagccagaaagagatcctggcctgagagtcccttctggctggcttttaatatctgctctcctcttgggagtgaggacttggggcaggtgggtaggagagggaaagccagagtgtgatgggcctgcctcctgggctggttcctgggtccggcctgcctgcctgcctgcctgcctctccaccacatgcttttttcagttaatgtcagtgggccctgcttgtcccctcaccatgagcccacagcttgccaagaaagaccccaacgctcgctggggcagcaccagtcctagctgggacgaattggtccatcctttgtaaagctgtaaatacttaattttgactttctatttctaagcccagtgtcatattgacactggtattttagaattttctcagatgggctctcctgcgctgccctctgtctcctgtttttgggggttttatacaaacagaggattggggagggataggaagactagcatccttttggctccctggttggttgtgaaatacacacacacacacacacacacacacacacactcgcactcctctgagactccgaacagagaaaaaaattattggcaaatcaacacatttttctttctcgtcttgagaaaatgtcttgaggtccctgaagggccaaatccatcgtggactaactctgtgggtagagctcagatgacctagggagaattaaaccacttaagcttggagtgggaggagagggggtggggtgggggagaatataagatgtaacttaagctaaatgtaatctatttataaagcaagagactctcatctatttttatgaaaggaagggttttttaatctagggtaggcagttgtggtagcccagcattttcctgtggacgagacatggtgcatgttgttgctggattgaatggaacccattcctgtcccccggcctcgtcttctgtcctcacttttggtcatccacacccatgagcagcttcagcagagtgtaggtcccacttcaccccattctcctctcctctgacccctcagctccttggaagtcttggggtggggatctgagggggtgggtgggctgcaggaaattcagaaatgtggtgggtgggggaagggacaaggcgcattagggagggaacaagctgggctctggggataggctctgattaattagttactctgactctggtctgccgagatccatttccaacccagttgcgttgggagagggttgggaggcagcagagcatgggtgacagtgggagcacacgacttccttggagcctgggcctttgcgggtcccaggtggtcaggcagctggagcagaagtggaaatggcttaagatgctcatagcccagccccggctgtgtctactccaggccaagcctgggctgcagtccttgctatgttccccccagggccctggggggagggatcagggtgctgggggtttcctaggacaggggtcttcccccttgagacaccaagctctggctctagaagagctctctcctggagtggggagtctggaggggactgggtgggtgcaggtaaagccagattctctctggaagggaattttctatgaatggatgatttccaggctcagggtgggctgtgtgttagttctgagcaaatccctcaccaagacccttccctcccaagccctcaaagaaatgaggcaaagcccttccctgcaagaccccttgtggatgtttttgcatctacctgatttttagccccacccagggagactttataccccatgatcctgccccaccgttgctgttgtctgccagctgggtctagcatcacagggaagggggggatttatactcatggaaagactactgatcctaccggaaaccaacctgtttactgtactgttgtaaatatcatgccctttatatcctgtatattggcttcttttaaataaagtgaaatgtcttagaaaaaaaaaaaacaaagaaacaaaaaaacttggggggcatattatatgtgcaggggtgtgcgggaaaaagagggatacagtagaatggtgcacacatgtggtcttcatataggcgtgttttcatgtgaaccacagttttcttggtccaccaaacagtgggcaagaaatcggcccgggatacacccgaatagggcgacgcccgctattaaattgtccggaaataaagcccacggggtaaaccctgtgcacatatcacgaactccggaaaacaagcatagaacagagcacagcagcacgacgaaggaccaacaaacaacacaacatcagcaaaaacacacaagagaacacaccagaaaccataaatagcatacagacaaaataaagagccaggcaaacccaagaacacaaacaaacatcaacgaacacaaaaaaccaaaaaaccaaaaaaccagccaaacaaacataaaagtaacacccaaaaacaaaaaacaagtaagaagagggaaaggcacgaagacgagagggagaagaagaggactcagccagaagacgacgcgagaggggggagccacagggaagcaaagagcaaaaaaggcgagagacggcgagggaaagacacagcagaggctagtaagcagagagaggaggacagccgacaagcacggacaaagagcaagcgagagaagaggcagaagagggagagggtgcagataagagagggcggagggagacacggagcaggcagccagaaaagacaacgcagacggaaaaagaa

SEQ ID NO: 440864 - DNA, 6012 bp, Homo sapiens
ctggagctacacgcaggtgcggcgcacgggcggcggcggcgtggagaccgtgcagggccccggcgtgtcgtgggtgcaccccgacggcgtgggcgtgcagatcgacaccatcacgccggagatccgcgcgctctacaacgtgctggccaaggtgaagcgcgagcgcgacgagtataagcggaggtgggaggaggagctcgccaagcgcatgaaccttcagaccatggtggacacgctgcaggaggcagcacaggaggctgatgccatccaggaggagatgaatgagaagatcgagcggctcaaggccgagctggtggtgtttaaggggcttatgagtgaccccatgacagacctggacacaaagatccaagaaaaggccatgaaggtggacatggacatctgccgccgaatcgatatcacggccaagctgtgcgatgtcgcacagcagcggaactcagaagacgtgtccaagatcttccaggtggtccccaaaaagaaagagcgtaaggtggcttccgatgatgacatctctgagcaggacggggaggtgaaccggttctcggacgatgaggtcggctccatgaacatcaccgatgagatgaagcgcatgtttaaccagctgcgggagacctttgactttgacgacgactgtgacagcctgacgtgggaagagaatgaagacacgctgctgctctgggaggatttcaccaactgcaatccgaccatcgacctgcagggcgagcaagaggaaaacttgggcaacttgatccatgagaccgaatccttcttcaagacgagagacaaggagtaccaggaaacgataggtcagatcgagctcgagctggccacagccaaaagtgacatgaaccgacacctgcacgagtacatggagatgtgcagcatgaagcgaggcctggacgtgcagatggagacctgccgccggctcatcaaaggctccgcagacaggaattcaccgtcccccagctccgtggccagcagcgactcaggaagtacagatgagatccaggatgagttcgagcgcgaggcggatgtggagcccatggtcagctgatgactgaggccctgcgagcctggtggtcttggtgatggggccctgccacctctcctcatggggccaggaaggcccctcggagtggggttcgaagccacaccacacagactttctctgccctcccttctctggaggccctgagggactgctgcttccttccttccttccacaccaccaacgggtgccccgtctccatcccccacccacccaaggaatggtgctgtcaatttctattgttctccacattacaaatgcagacttctgtgcggactttgcagtgttaactgtgccttctcccttaagctgagccactttgagctccaaagaattattcctagcaggtgtttttatacagaactctaagctgagggccgggccaaccggccgtggtgtaatgtggtttctgccgtccgtcccacctgctcctctgattggccatgggctatgccctcccttcctcctgagccagcccagactcggcctggagcttggggtgctctgccaacccccaggaaggagccgcttgcctctgtgagctttctaggcctgggtagggaccaccccaattttctcactccctgaaggagagaaaggtggaaggaagggaaggaggacacattttaattttttggggggatcgagtggcaaagttgaagggacaaggcactgtgaggggaaggcagagcctcactgtgtttaaactactatgcaaaaaacaaaacaaacaacaaaagcagcttgccttatatcattgtggaaggcaggacctctcctgggctcctggcttccccctggagctgggagagaggccggggttagggtgatctgtgtggcagcactgactgggtagtgtgggtttggccgaggttggtcatgaggctggggttcccgcaaggcactggcctccctgaccgcttgcttccttccggacctctgggttcagggcgggggcggagggatccttgatttccctgataacttgatgttcttccctccctcgccagccaacaatagaggcttagagatctgtaatttctctgtgagaaagtctgaaggggccaggcctggtctctgctcccttctacccgccttgggttaggactgtccggcagttgcctgcttttggctgctggcaggagagaagcagggtgggctgctggcagtgcaggagctggagtgagggccatcctctttctgctcctcgacacacgcaagccgctctcagcagttccctcgactggccagtcggggtattgatctgagccagcatcccccaagacttgaatggcttgagtgggactgcgttgaagggcactgtgtggcccccttccaaatctcagcttggagccagctgagcaggctttgctttattattattttttaagcctactgcagtgggtctgttgccaattttaattttttattgtcccaggagctccctctagtggtcaaggtagcaaaatgtgcccaaggactagaacttgggtccctctgccttgcctggaggcagaaggagggggctctgggtttgactgggattgtggtccccaggggtccgtggcctttaaggctcttctctcttttctgtttcccccacctgtgttacagtcttaaaaatactgtacataaaagatatatgtagagagagagagagagcgtgagaatgtgttagtgactatgtgtgatgtaatttatcacgatttggtggccttcgtcatgagttttttcctttgttttcttttgctgggggcacctcccacgggtcccctgtggcagtctggctgtgacacttccatagtcagcatctcttgttagccaaacagttccctttgacaggtacttggagggacaatggttttggaagagagacggcccttctctctcctcactcacccttgttctaaaggttacagggttcaaacatacctgattcttgttgttattgttgttgaatttttattttaaccaaaggttatcagagccagttgggcttggacctcagctgctaaaaagattttccgtttcctcgagggcaggaaaacatccaccctcgtgggtctcctccgtccagggccgagggaggcattggacaatgtggtatgggagtttcgtgggcagcgtggaagccggccctgggttgttccccaaggtggtgggagggtgacagatatatctttagacttaagactgtaaggcagcagtgttagcatgggagtaactaaggttactgtggttatcggtgtccggcggtattatttttactttcctccttgtatacataggtcatttgtctttgaggactagggtactctagggagtttgaaaactgcaggagccagaaagagatcctggcctgagagtcccttctggctggcttttaatatctgctctcctcttgggagtgaggacttggggcaggtgggtaggagagggaaagccagagtgtgatgggcctgcctcctgggctggttcctgggtccggcctgcctgcctgcctgcctgcctctccaccacatgcttttttcagttaatgtcagtgggccctgcttgtcccctcaccatgagcccacagcttgccaagaaagaccccaacgctcgctggggcagcaccagtcctagctgggacgaattggtccatcctttgtaaagctgtaaatacttaattttgactttctatttctaagcccagtgtcatattgacactggtattttagaattttctcagatgggctctcctgcgctgccctctgtctcctgtttttgggggttttatacaaacagaggattggggagggataggaagactagcatccttttggctccctggttggttgtgaaatacacacacacacacacacacacacacacacactcgcactcctctgagactccgaacagagaaaaaaattattggcaaatcaacacatttttctttctcgtcttgagaaaatgtcttgaggtccctgaagggccaaatccatcgtggactaactctgtgggtagagctcagatgacctagggagaattaaaccacttaagcttggagtgggaggagagggggtggggtgggggagaatataagatgtaacttaagctaaatgtaatctatttataaagcaagagactctcatctatttttatgaaaggaagggttttttaatctagggtaggcagttgtggtagcccagcattttcctgtggacgagacatggtgcatgttgttgctggattgaatggaacccattcctgtcccccggcctcgtcttctgtcctcacttttggtcatccacacccatgagcagcttcagcagagtgtaggtcccacttcaccccattctcctctcctctgacccctcagctccttggaagtcttggggtggggatctgagggggtgggtgggctgcaggaaattcagaaatgtggtgggtgggggaagggacaaggcgcattagggagggaacaagctgggctctggggataggctctgattaattagttactctgactctggtctgccgagatccatttccaacccagttgcgttgggagagggttgggaggcagcagagcatgggtgacagtgggagcacacgacttccttggagcctgggcctttgcgggtcccaggtggtcaggcagctggagcagaagtggaaatggcttaagatgctcatagcccagccccggctgtgtctactccaggccaagcctgggctgcagtccttgctatgttccccccagggccctggggggagggatcagggtgctgggggtttcctaggacaggggtcttcccccttgagacaccaagctctggctctagaagagctctctcctggagtggggagtctggaggggactgggtgggtgcaggtaaagccagattgaaatgaggcaaagcccttccctgcaagaccccttgtggatgtttttgcatctacctgatttttagccccacccagggagactttataccccatgatcctgccccaccgttgctgttgtctgccagctgggtctagcatcacagggaagggggggatttatactcatggaaagactactgatcctaccggaaaccaacctgtttactgtactgttgtaaatatcatgccctttatatcctgtatattggcttcttttaaataaagtgaaatgtcttagaaaaaaaaaaaacaaagaaacaaaaaaacttggggggcatattatatgtgcaggggtgtgcgggaaaaagagggatacagtagaatggtgcacacatgtggtcttcatataggcgtgttttcatgtgaaccacagttttcttggtccaccaaacagtgggcaagaaatcggcccgggatacacccgaatagggcgacgcccgctattaaattgtccggaaataaagcccacggggtaaaccctgtgcacatatcacgaactccggaaaacaagcatagaacagagcacagcagcacgacgaaggaccaacaaacaacacaacatcagcaaaaacacacaagagaacacaccagaaaccataaatagcatacagacaaaataaagagccaggcaaacccaagaacacaaacaaacatcaacgaacacaaaaaaccaaaaaaccaaaaaaccagccaaacaaacataaaagtaacacccaaaaacaaaaaacaagtaagaagagggaaaggcacgaagacgagagggagaagaagaggactcagccagaagacgacgcgagaggggggagccacagggaagcaaagagcaaaaaaggcgagagacggcgagggaaagacacagcagaggctagtaagcagagagaggaggacagccgacaagcacggacaaagagcaagcgagagaagaggcagaagagggagagggtgcagataagagagggcggagggagacacggagcaggcagccagaaaagacaacgcagacggaaaaagaa

SEQ ID NO: 440865 - DNA, 4915 bp, Homo sapiens
ctggagctacacgcaggtgcggcgcacgggcggcggcggcgtggagaccgtgcagggccccggcgtgtcgtgggtgcaccccgacggcgtgggcgtgcagatcgacaccatcacgccggagatccgcgcgctctacaacgtgctggccaaggtgaagcgcgagcgcgacgagtataagcggaggtgggaggaggagctcgccaagcgcatgaaccttcagaccatggtggacacgctgcaggaggcagcacaggaggctgatgccatccaggaggagatgaatgagaagatcgagcggctcaaggccgagctggtggtgtttaaggggcttatgagtgaccccatgacagacctggacacaaagatccaagaaaaggccatgaaggtggacatggacatctgccgccgaatcgatatcacggccaagctgtgcgatgtcgcacagcagcggaactcagaagacgtgtccaagatcttccaggtggtccccaaaaagaaagagcgtaaggtggcttccgatgatgacatctctgagcaggacggggaggtgaaccggttctcggacgatgaggtcggctccatgaacatcaccgatgagatgaagcgcatgtttaaccagctgcgggagacctttgactttgacgacgactgtgacagcctgacgtgggaagagaatgaagacacgctgctgctctgggaggatttcaccaactgcaatccgaccatcgacctgcagggcgagcaagaggaaaacttgggcaacttgatccatgagaccgaatccttcttcaagacgagagacaaggagtaccaggaaacgataggtcagatcgagctcgagctggccacagccaaaagtgacatgaaccgacacctgcacgagtacatggagatgtgcagcatgaagcgaggcctggacgtgcagatggagacctgccgccggctcatcaaaggctccgcagacaggaattcaccgtcccccagctccgtggccagcagcgactcaggaagtacagatgagatccaggatgagttcgagcgcgaggcggatgtggagcccatggtcagctgatgactgaggccctgcgagcctggtggtcttggtgatggggccctgccacctctcctcatggggccaggaaggcccctcggagtggggttcgaagccacaccacacagactttctctgccctcccttctctggaggccctgagggactgctgcttccttccttccttccacaccaccaacgggtgccccgtctccatcccccacccacccaaggaatggtgctgtcaatttctattgttctccacattacaaatgcagacttctgtgcggactttgcagtgttaactgtgccttctcccttaagctgagccactttgagctccaaagaattattcctagcaggtgtttttatacagaactctaagctgagggccgggccaaccggccgtggtgtaatgtggtttctgccgtccgtcccacctgctcctctgattggccatgggctatgccctcccttcctcctgagccagcccagactcggcctggagcttggggtgctctgccaacccccaggaaggagccgcttgcctctgtgagctttctaggcctgggtagggaccaccccaattttctcactccctgaaggagagaaaggtggaaggaagggaaggaggacacattttaattttttggggggatcgagtggcaaagttgaagggacaaggcactgtgaggggaaggcagagcctcactgtgtttaaactactatgcaaaaaacaaaacaaacaacaaaagcagcttgccttatatcattgtggaaggcaggacctctcctgggctcctggcttccccctggagctgggagagaggccggggttagggtgatctgtgtggcagcactgactgggtagtgtgggtttggccgaggttggtcatgaggctggggttcccgcaaggcactggcctccctgaccgcttgcttccttccggacctctgggttcagggcgggggcggagggatccttgatttccctgataacttgatgttcttccctccctcgccagccaacaatagaggcttagagatctgtaatttctctgtgagaaagtctgaaggggccaggcctggtctctgctcccttctacccgccttgggttaggactgtccggcagttgcctgcttttggctgctggcaggagagaagcagggtgggctgctggcagtgcaggagctggagtgagggccatcctctttctgctcctcgacacacgcaagccgctctcagcagttccctcgactggccagtcggggtattgatctgagccagcatcccccaagacttgaatggcttgagtgggactgcgttgaagggcactgtgtggcccccttccaaatctcagcttggagccagctgagcaggctttgctttattattattttttaagcctactgcagtgggtctgttgccaattttaattttttattgtcccaggagctccctctagtggtcaaggtagcaaaatgtgcccaaggactagaacttgggtccctctgccttgcctggaggcagaaggagggggctctgggtttgactgggattgtggtccccaggggtccgtggcctttaaggctcttctctcttttctgtttcccccacctgtgttacagtcttaaaaatactgtacataaaagatatatgtagagagagagagagagcgtgagaatgtgttagtgactatgtgtgatgtaatttatcacgatttggtggccttcgtcatgagttttttcctttgttttcttttgctgggggcacctcccacgggtcccctgtggcagtctggctgtgacacttccatagtcagcatctcttgttagccaaacagttccctttgacaggtacttggagggacaatggttttggaagagagacggcccttctctctcctcactcacccttgttctaaaggttacagggttcaaacatacctgattcttgttgttattgttgttgaatttttattttaaccaaaggttatcagagccagttgggcttggacctcagctgctaaaaagattttccgtttcctcgagggcaggaaaacatccaccctcgtgggtctcctccgtccagggccgagggaggcattggacaatgtggtatgggagtttcgtgggcagcgtggaagccggccctgggttgttccccaaggtggtgggagggtgacagatatatctttagacttaagactgtaaggcagcagtgttagcatgggagtaactaaggttactgtggttatcggtgtccggcggtattatttttactttcctccttgtatacataggtcatttgtctttgaggactagggtactctagggagtttgaaaactgcaggagccagaaagagatcctggcctgagagtcccttctggctggcttttaatatctgctctcctcttgggagtgaggacttggggcaggtgggtaggagagggaaagccagagtgtgatgggcctgcctcctgggctggttcctgggtccggcctgcctgcctgcctgcctgcctctccaccacatgcttttttcagttaatgtcagtgggccctgcttgtcccctcaccatgagcccacagcttgccaagaaagaccccaacgctcgctggggcagcaccagtcctagctgggacgaattggtccatcctttgtaaagctgtaaatacttaattttgactttctatttctaagcccagtgtcatattgacactggtattttagaattttctcagatgggctctcctgcgctgccctctgtctcctgtttttgggggttttatacaaacagaggattggggagggataggaagactagcatccttttggctccctggttggttgtgaaatacacacacacacacacacacacacacacacactcgcactcctctgagactccgaacagagaaaaaaattattggcaaatcaacacatttttctttctcgtcttgagaaaatgtcttgaggtccctgaagggccaaatccatcgtggactaactctgtgggtagagctcagatgacctagggagaattaaaccacttaagcttggagtgggaggagagggggtggggtgggggagaatataagatgtaacttaagctaaatgtaatctatttataaagcaagagactctcatctatttttatgaaaggaagggttttttaatctagggtaggcagttgtggtagcccagcattttcctgtggacgagacatggtgcatgttgttgctggattgaatggaacccattcctgtcccccggcctcgtcttctgtcctcacttttggtcatccacacccatgagcagcttcagcagagtgtaggtcccacttcaccccattctcctctcctctgacccctcagctccttggaagtcttggggtggggatctgagggggtgggtgggctgcaggaaattcagaaatgtggaaatgaggcaaagcccttccctgcaagaccccttgtggatgtttttgcatctacctgatttttagccccacccagggagactttataccccatgatcctgccccaccgttgctgttgtctgccagctgggtctagcatcacagggaagggggggatttatactcatggaaagactactgatcctaccggaaaccaacctgtttactgtactgttgtaaatatcatgccctttatatcctgtatattggcttcttttaaataaagtgaaatgtcttagaactgatggtgcttttttttgtttttgtttttaaacagaagatgaatctggtgttgggggaggggtaggaggacggaaggccacagaaaccctcaaactcattagttaattagccataaaataggggatttcatatcacctg

SEQ ID NO: 440866 - DNA, 1241 bp, Homo sapiens
ggcggggctggacgcgcgctccaagatggcggcgaacgtgttcccgttccgcgacgcccgtgccgcaccggacccagtgctggaggccggcccggtggcacacgggccactgccggtaccgctggtgctggacaacgggtcgttccaagtccgcgctggctgggcgtgtcccgggcaggacccaggtcccgagccgcgcctgcagttccgcgcggtgtgcgcccgcggtcgtggcggggcacggggcgcgtcgggcccgcaggtggggaacgctctgggcagcctggagccactgcgctggatgctgcgctcgcccttcgaccgcaacgtgccggtcaacctggagcttcaggagttgctgctggactacagcttccagcacctgggtgtctcctcacagggctgtgttgatcatcccatagttttgacagaagctgtgtgcaacccactgtattcacggcaaatgatgtctgagcttctttttgagtgctacgggattcccaaggttgcctatggaatagacagcctcttcagcttctaccacaataagccaaagaactcgatgtgcagtgggctaatcatttcatctggataccagtgtacgcatgttttacccatcttagaagggagattagatgctaaaaactgcaagcgcatcaatcttggaggaagccaagcagctggttacctccagcgtctcctccagctgaagtaccctgggcacctggcagccatcaccctcagccgcatggaggagattctgcatgagcacagctacatcgctgaggattatgtggaaggtatccaagaggatgtttgcctgcagcttttgggtgttgtctaccttgtattccttaaattattgccagcatgattctttgcttgctcactttttaagcacctccttcccctttttgtattccctttcttaaactattcagtaaactgataacttatgttgtataggttcccttcacaaatggtagcttttataacttgcctttaatacagaacttggaattgcacaactttcagcttttccagatattaaatatttttaagagtgagcagaacatatcagactaaaaatatcttaagctagaaaacaattgaaattgttttattatacccttataataacatctatgctgcagaaacacctctttttcttttcaaacttgtcttggacttttggttgtattttacttcaaattaaagtatgagttttagttgctattgtc

SEQ ID NO: 440867 - DNA, 481 bp, Homo sapiens
tttttagctttttgtgtagaagtttttctgttttgtactgagagcttacatttctgcatccacatttcgttctgatatttgagttaagggactatattaggagttgtttctttcctaggtacccaaaggacattcaggaaatgctggttcagaacgttttcctcactggcggcaacacgatgtatcctggcatgaaagccagaatggagaaggaactgttggagatgagacccttccggtcttcttttcaggtactgattgttcgagtagtcagttattttgaaaatagcattacctgttttctgattgcaaaagtaataatcatgcagaaatatccactgttaacatttttgtggcttttcttctggtcttaagtccatgcttaatttttaaagcaaaatgggaatcatgttttatatactgttttgtggtttctttaaattggaagatgaagacatgcgtagaattctaagagtgtgaa

SEQ ID NO: 440868 - DNA, 2553 bp, Homo sapiens
ggcggggctggacgcgcgctccaagatggcggcgaacgtgttcccgttccgcgacgcccgtgccgcaccggacccagtgctggaggccggcccggtggcacacgggccactgccggtaccgctggtgctggacaacgggtcgttccaagtccgcgctggctgggcgtgtcccgggcaggacccaggtcccgagccgcgcctgcagttccgcgcggtgtgcgcccgcggtcgtggcggggcacggggcgcgtcgggcccgcaggtggggaacgctctgggcagcctggagccactgcgctggatgctgcgctcgcccttcgaccgcaacgtgccggtcaacctggagcttcaggagttgctgctggactacagcttccagcacctgggtgtctcctcacagggctgtgttgatcatcccatagttttgacagaagctgtgtgcaacccactgtattcacggcaaatgatgtctgagcttctttttgagtgctacgggattcccaaggttgcctatggaatagacagcctcttcagcttctaccacaataagccaaagaactcgatgtgcagtgggctaatcatttcatctggataccagtgtacgcatgttttacccatcttagaagggagattagatgctaaaaactgcaagcgcatcaatcttggaggaagccaagcagctggttacctccagcgtctcctccagctgaagtaccctgggcacctggcagccatcaccctcagccgcatggaggagattctgcatgagcacagctacatcgctgaggattatgtggaagaattacacaaatggcggtgtcctgattattatgagaataatgtccacaagatgcagctcccattttccagcaagctcctgggcagcactctgacctctgaggagaaacaagaaaggcggcagcagcaattgcggcggctgcaggagctcaatgcccggcggcgggaggagaagctgcagctggatcaggagcgtctggaccgactgctatatgtgcaggaacttctagaggatggccagatggatcagtttcacaaagctctgatagagctgaatatggactccccagaagagctgcagtcctacatccagaagctcagtatagcagtggagcaggctaagcagaaaatcctccaagcggaagtcaacctcgaggtggatgtggtagacagcaagccagagacccctgacctggagcagctggagccgtctttggaagatgtggaaagcatgaatgattttgatcccttgttttcagaggaaacacctggagtggagaagccggtcaccactgttcagcccgtgtttaacttggcagcatatcatcagctatttgttgggacagaaagaattcgagctccagagattattttccagccatctctcataggagaagaacaggctgggattgcagagactcttcagtacattctggacaggtacccaaaggacattcaggaaatgctggttcagaacgttttcctcactggcggcaacacgatgtatcctggcatgaaagccagaatggagaaggaactgttggagatgagacccttccggtcttcttttcaggttcaacttgcctcgaaccctgtgctggatgcctggtacggtgctcgtgactgggccttgaaccacctagatgataatgaagtttggatcaccaggaaagagtatgaagaaaagggaggagagtacctcaaggagcactgtgcttccaacatctatgtccccatccgcctgccgaagcaggcctcccgctcctcagatgcccaggcatccagcaagggctccgctgctggtggaggtggtgctggtgagcaggcatagcagaggccctccagagagactgccctgcacgccatgccttgggccacgttggcagtgtgacaggactgtgattgtgctagatgtacctgcccaagtctgctggtcacatttggcagcaaaatggatttctcctggggagaacaaagttaagggacactgagacctgcccttcagaattcggttcacttgggggcttctgtggtagagactaactggccttctgatgtctttgttcaactgtggccagctgtggcatcagcttcctggagcagtaaatgaagacagagtggaggacacaaatgtacaaaatgcacaagactgatttcttaccacattttagtctttcttgttttaaaaaaaattctttaaaatttatcttgtccgtgtagatactttattcttctggatgtattcagaaattgcatgaatgcccagtgaggggaggtctttcatgcatataaaaaggtaatgtttattgccgggcacagtggcacgtgcctgttaaggcccagctttgtgggaggctaaggcaggaggatcgctggagcttaggagttcgaggctatcgtgtgctgtgatcgcacctgtgaataaccactgcactccagcctgggcaacataggaagacattgtctctaaaaagatacatttttcataaaaggtaatgtttattcaataaaagcagttgcctcaggaaccggaaa

SEQ ID NO: 440869 - DNA, 863 bp, Homo sapiens
  misc_feature (775)..(775): n is a, c, g, or t
  misc_feature (791)..(791): n is a, c, g, or t
  misc_feature (814)..(814): n is a, c, g, or t
  misc_feature (850)..(850): n is a, c, g, or t
  misc_feature (858)..(858): n is a, c, g, or t
ggcggggctggacgcgcgctccaagatggcggcgaacgtgttcccgttccgcgacgcccgtgccgcaccggacccagtgctggaggccggcccggtggcacacgggccactgccggtaccgctggtgctggacaacgggtcgttccaagtccgcgctggctgggcgtgtcccgggcaggacccaggtcccgagccgcgcctgcagttccgcgcggtgtgcgcccgcggtcgtggcggggcacggggcgcgtcgggcccgcaggtggggaacgctctgggcagcctggagccactgcgctggatgctgcgctcgcccttcgaccgcaacgtgccggtcaacctggagcttcaggagttgctgctggactacagcttccagcacctgggtgtctcctcacagggctgtgttgatcatcccatagttttgacagaagctgtgtgcaacccactgtattcacggcaaatgatgtctgagcttctttttgagtgctacgggattcccaaggttgcctatggaatagacagcctcttcagcttctaccacaataagccaaagaactcgatgtgcagtgggctaatcatttcatctggataccagtgtacgcatgttttacccatcttagaagggagattagatgctaaaaactgcaagcgcatcaatcttggaggaagccaagcagctggttacctccagcgtctcctccagctgaagtaccctgggcacctggcagccatcacccctccagcccgccatgggaagaaaaattctgccttnaaacacaaaccttccntccccttaaaagaattaatgttnggaaaaaaatttacccccaaattggcgggtgttccntgaatttnttaat

SEQ ID NO: 440870 - DNA, 561 bp, Homo sapiens
ggggcgacagtgtccccgcccgcccccggccgggtcgcgggcatgaaggacagctggatcgcggcggggggcggaggtggggcggcccgggcccctggactctagacctacgccgcccgggcacgaaggcccagccctggccctggccgcggtctcagcccgggaccccggatcgcgcagaaatgcactgaacaggcccctacaattgggctccagaaactacctgagctcggactacctgttgcctcacattggcaaaagagggggaaaccagaaggagggaattctgctgcggcgacttgactttccccgccccgagcagaaaggcattgacgtttgtaggcggtgacccgccccttctctggcccttgctgcgtgatggggtctccatgcactttatttatttgcagtctgttttctaggcggtggagcttctagacaccgaccggaatgacatacgtttctgtgtgtgattcactgtgtactggtcagcacaggctggccagagagatgttcttgtttctggtgttgtcacgtcttcttgttttctctaagtttaaa

SEQ ID NO: 440871 - DNA, 1012 bp, Homo sapiens
ccgccgtcctgaggctcgagctcttgcgggtcgatcggtcggcggggcctgcgcggggcccgggcccatggcggcgtcggcggctctgttgcggcgacttgactttccccgccccgagcagaaaggcattgacgtttgtaggcggtgacccgccccttctctggccttgccaagagtctcatccctaccctggggcacctctgaccctggacctgcttgggcagaggcagcgtgaagggcctgaacaagaggagaagaagggccttcctagtagaggcacagcatggacaaaggctcacaggggtgggggtgcccagtgatcgagtcctggcttgggagggaaggtctgagttccctgggaactgaaatcggctagcagcactgtgagagaggtgtatttccccctcctaatgacagaggaaaccgaggcttcggggagggggggatttgcccttgacatgcagataggatgaggaggaactgcgtgtgcccctgggcctgcaggctcccacacccctccccagtcttctccaagacctggcatgatgggaggagggaggggaaagtgaagagggaagcatagggctcctagggcaccaagggagaggggcccaagggtagggaatctggggatctcgctttctttggagcagtacagaagatcacaggaaagattaggacagacagctgagatggcagacaggagagatgggccccaggatccctggggagccaagctttcccccacagcctagcctccccaccccacctggagttctctacctcccctccccacctcttctctcccctacagggcccttgctgcgtgatggggtctccatgcactttatttatttgcagtctgttttctaggcggtggagcttctagacaccgaccggaatgacatacgtttctgtgtgtgattcactgtgtactggtcagcacaggctggccagagagatgttcttgtttctggtgttgtcacgtcttcttgttttctctaagtttaaa

SEQ ID NO: 440872 - DNA, 2222 bp, Homo sapiens
ccgccgtcctgaggctcgagctcttgcgggtcgatcggtcggcggggcctgcgcggggcccgggcccatggcggcgtcggcggctctgttgcggcgacttgactttccccgccccgagcagaaaggcattgacgtttgtaggcggtgacccgccccttctctggccttgccaagagtctcatccctaccctggggcacctctgaccctggacctgcttgggcagaggcagcgtgaagggcctgaacaagaggagaagaagggccttcctagtagaggcacagcatggacaaaggctcacaggggtgggggtgcccagtgatcgagtcctggcttgggagggaaggtctgagttccctgggaactgaaatcggctagcagcactgtgagagaggtgtatttccccctcctaatgacagaggaaaccgaggcttcggggagggggggatttgcccttgacatgcagataggatgaggaggaactgcgtgtgcccctgggcctgcaggctcccacacccctccccagtcttctccaagacctggcatgatgggaggagggaggggaaagtgaagagggaagcatagggctcctagggcaccaagggagaggggcccaagggtagggaatctggggatctcgctttctttggagcagtacagaagatcacaggaaagattaggacagacagctgagatggcagacaggagagatgggccccaggatccctggggagccaagctttcccccacagcctagcctccccaccccacctggagcttcaccaagggcttttcagcagtgaagtggcacaaacctcccagtttggtgggcaagtggggctgatggtggtgtcatggctcctggagacacgacataaccaggagggtgaagggataaacctggggtgggctggggctgagacccatggcatgaccccaattctctctcctcaagctcgacccccccgccatccccaggatcacacaggagaatctcatcctcacggcttggattggtcctgggggcccccggttgtgctgctaactggtgtacaatgctcaagagcagcccagaggggagccaggaagggaccctcgccctcacctgctatccccatttccgcatctcttgcactggtaccctgagggccacattctcagttcctgggattgaaaactgcagcagcagtctggccagctccaggacagagttccaaccacctaccacgtaccctcctcagcaggccactggacccaggtcctgaatgaagctgtccgcctgcctcaccccagaagaggctggacagtggctgcctcgtgccccctgcagtctcccacagccagggcccgatggggtgcctccttgtcccaagtctcctgagaacccctgaccttgctggcctctctcatccgccccaaccctgtccacccttgaccacctctgggggcctgtcagcctgctggtccccccaacagatctctgggggcagcctctgtgggacaagagtgatacagagctggaggagaagaggagtgaggggcctccttgtgtctgatgcacagatgtggccctttcaaaccctggtgtcaccctctgggtgactggatccctagctccagcctcttcctgggccagccaggaagggtggaggaaagttctttgctgattgcatgtgtgatacagtggggggtgcctgagccctccccatgcaaggggctcatcctgggactctggaagctgcttccctactgggagaaatgtgtgtcggagctgcaggggtccctaccctcagagacccccgactgcagggaacccaccccataagagggtcacggatgtccatgtccgcccaccccccgtggcttctgctgtggctatattggcctagaggggctgactggggaggagcagggctaagccctcagcatttgctcctgtccctgccttttcacccctgctgcctgaagtggtagccccgcctgctgcttctctacctcccctccccacctcttctctcccctacagggcccttgctgcgtgatggggtctccatgcactttatttatttgcagtctgttttctaggcggtggagcttctagacaccgaccggaatgacatacgtttctgtgtgtgattcactgtgtactggtcagcacaggctggccagagagatgttcttgtttctggtgttgtcacgtcttcttgttttctctaagtttaaa

SEQ ID NO: 440873 - DNA, 523 bp, Homo sapiens
  misc_feature (291)..(291): n is a, c, g, or t
  misc_feature (366)..(366): n is a, c, g, or t
  misc_feature (394)..(394): n is a, c, g, or t
  misc_feature (403)..(403): n is a, c, g, or t
  misc_feature (427)..(427): n is a, c, g, or t
  misc_feature (448)..(448): n is a, c, g, or t
  misc_feature (453)..(453): n is a, c, g, or t
  misc_feature (456)..(456): n is a, c, g, or t
  misc_feature (495)..(495): n is a, c, g, or t
  misc_feature (507)..(507): n is a, c, g, or t
atacatacatgggtgaacaaggactctgaaacaaattagggagggaaaccacccatcaagaggcaattgcacaagtttattaattgactcagtgaaaatgattcaaattattagaaattcagatgtacctagaggacatgatgcattctcatggaaagctggtgtttcccacatctgagtgaatgtgctggattattccccatcaaaatgttagtttgaatcaacaagggtcaataatcttgtgaatggctttatgttctagtatatttaagtacttattgtgtgccttgnggaattctgctcttcggttctctcctccacggtgctgacgtggacttcggccacaccctcttcttggggggactncttttttctcatcaaacacttctgtcancaacggggnaggtttctcttcagaaggtccccngggagccactgacttgctccnctganggnaggtcaactttctcatattcagttgataaccggggtcgngggaatttcttnccgctcctgtgggtgg

SEQ ID NO: 440874 - DNA, 1400 bp, Homo sapiens
ggactgcaacgcggaggagcaggatggagatccctgtgcctgtgcagccgtcttggctgcgccgcgcctcggccccgttgcccggactttcggcgcccggacgcctctttgaccagcgcttcggcgaggggctgctggaggccgagctggctgcgctctgccccaccacgctcgccccctactacctgcgcgcacccagcgtggcgctgcccgtcgcccaggtgccgacggaccccggccacttttcggtgctgctagacgtgaagcacttctcgccggaggaaattgctgtcaaggtggtgggcgaacacgtggaggtgcacgcgcgccacgaggagcgcccggatgagcacggattcgtcgcgcgcgagttccaccgtcgctaccgcctgccgcctggcgtggatccggctgccgtgacgtccgcgctgtcccccgagggcgtcctgtccatccaggccgcgcccgcaccccgggagcctcctcaggctccctctattaaagccgatctgactccgcccagccagatgtcccgagtgcgccaaggactgtcctctcacccactcctggattctgccctgacctccatcctggacactgccttgataacatagacccttccactgacaccctcgctctcacaccccctccagctttccgaccccacaccgacaactccccggcttccagaccctaccagcactaccctaaccctcagccgacagtctcagccccaccgacccactttcttggcatatagccccacttaagacccctcctctacttccttctgagtcctctacaaagacatccgggtactacatttccatcccttccctattttgacaccaaattatggtgtagacagccctcccccaaccccaggccagtcaggcacaatccccccaccccccaaacgtcctggactgcacagacctcccactccagaccatccaggcctggttcccaagacccgatccttcccctgcaaccagacagtctacaactgccccctccagcccattttctgccgtgaaaccccagccagccacaccagactctggaaccctttttcgactgccccaactcttggacaccaggccaactagaacacccaacaccaaactgtacagactctcccaccccaacctccccagactctgcacggatgtcctaggccccctccccaactctaaccagaccccatccccctaagtccctttgtcttgacccccaagtcttcaaccagatatcctcggcaacccacctcccaccctcctcctcttctccttcaagacccaactgagcacccgctctgattccccacagcctttctccctgccaccactcccttagtctttcccaggcttactctcccaataaatgtgctagagctctgc

SEQ ID NO: 440875 - DNA, 1459 bp, Homo sapiens
ggactgcaacgcggaggagcaggatggagatccctgtgcctgtgcagccgtcttggctgcgccgcgcctcggccccgttgcccggactttcggcgcccggacgcctctttgaccagcgcttcggcgaggggctgctggaggccgagctggctgcgctctgccccaccacgctcgccccctactacctgcgcgcacccagcgtggcgctgcccgtcgcccaggtgccgacggaccccggccacttttcggtgctgctagacgtgaagcacttctcgccggaggaaattgctgtcaaggtggtgggcgaacacgtggaggtgcacgcgcgccacgaggagcgcccggatgagcacggattcgtcgcgcgcgagttccaccgtcgctaccgcctgccgcctggcgtggatccggctgccgtgacgtccgcgctgtcccccgagggcgtcctgtccatccaggccgcaccagcgtcggcccaggccccaccgccagccgcagccaagtaggagggggctgggccgcgcccgcaccccgggagcctcctcaggctccctctattaaagccgatctgactccgcccagccagatgtcccgagtgcgccaaggactgtcctctcacccactcctggattctgccctgacctccatcctggacactgccttgataacatagacccttccactgacaccctcgctctcacaccccctccagctttccgaccccacaccgacaactccccggcttccagaccctaccagcactaccctaaccctcagccgacagtctcagccccaccgacccactttcttggcatatagccccacttaagacccctcctctacttccttctgagtcctctacaaagacatccgggtactacatttccatcccttccctattttgacaccaaattatggtgtagacagccctcccccaaccccaggccagtcaggcacaatccccccaccccccaaacgtcctggactgcacagacctcccactccagaccatccaggcctggttcccaagacccgatccttcccctgcaaccagacagtctacaactgccccctccagcccattttctgccgtgaaaccccagccagccacaccagactctggaaccctttttcgactgccccaactcttggacaccaggccaactagaacacccaacaccaaactgtacagactctcccaccccaacctccccagactctgcacggatgtcctaggccccctccccaactctaaccagaccccatccccctaagtccctttgtcttgacccccaagtcttcaaccagatatcctcggcaacccacctcccaccctcctcctcttctccttcaagacccaactgagcacccgctctgattccccacagcctttctccctgccaccactcccttagtctttcccaggcttactctcccaataaatgtgctagagctctgc

SEQ ID NO: 440876 - DNA, 1676 bp, Homo sapiens
ggactgcaacgcggaggagcaggatggagatccctgtgcctgtgcagccgtcttggctgcgccgcgcctcggccccgttgcccggactttcggcgcccggacgcctctttgaccagcgcttcggcgaggggctgctggaggccgagctggctgcgctctgccccaccacgctcgccccctactacctgcgcgcacccagcgtggcgctgcccgtcgcccaggtgccgacggaccccggccacttttcggtgctgctagacgtgaagcacttctcgccggaggaaattgctgtcaaggtggtgggcgaacacgtggaggtgcacgcgcgccacgaggagcgcccggatgagcacggattcgtcgcgcgcgagttccaccgtcgctaccgcctgccgcctggcgtggatccggctgccgtgacgtccgcgctgtcccccgagggcgtcctgtccatccaggccgcaccagcgtcggcccaggccccaccgccagccgcagccaagtaggagggggctgggccgcgcccgcaccccgggagcctcctcaggctccctctattaaagccgatctgactccgcccagccagatgtcccgagtgcgccaaggactgtcctctcacccactcctggattctgccctgacctccatcctggacactgccttgataacatagacccttccactgacaccctcgctctcacaccccctccagctttccgaccccacaccgacaactccccggcttccagaccctaccagcactaccctaaccctcagccgacagtctcagccccaccgacccactttcttggcatatagccccacttaagacccctcctctacttccttctgagtcctctacaaagacatccgggtactacatttccatcccttccctattttgacaccaaattatggtgtagacagccctcccccaaccccaggccagtcaggcacaatccccccaccccccaaacgtcctggactgcacagacctcccactccagaccatccaggcctggttcccaagacccgatccttcccctgcaaccagacagtctacaactgccccctccagcccattttctgccgtgaaaccccagccagccacaccagactctggaaccctttttcgactgccccaactcttggacaccaggccaactagaacacccaacaccaaactgtacagactctcccaccccaacctccccagactctgcacggatgtcctaggccccctccccaactctaaccagaccccatccccctaagtccctttgtcttgacccccaagtcttcaaccagatatcctcggcaacccacctcccaccctcctcctcttctccttcaagacccaactgagcacccgctctgattccccacagcctttctccctgccaccactcccttagtctttcccaggcttactctcccaataaatgtgctagagctctgcaaaaaaaacaaacagaggaagaccgcaacgaaagacaacaaacaaaacacacaacacaaacaaaaaagcacacccgacagcagacaacagaagaaaacgatgaaaccaaaccgcaaaaggaaggcgggggggcacgacccccacacaccaagcagggcgcgagcccggcgcaacgaggcacccagcaacggagagaacaggcgccccaccactgccc

SEQ ID NO: 440877 - DNA, 1400 bp, Homo sapiens
ggactgcaacgcggaggagcaggatggagatccctgtgcctgtgcagccgtcttggctgcgccgcgcctcggccccgttgcccggactttcggcgcccggacgcctctttgaccagcgcttcggcgaggggctgctggaggccgagctggctgcgctctgccccaccacgctcgccccctactacctgcgcgcacccagcgtggcgctgcccgtcgcccaggtgccgacggaccccggccacttttcggtgctgctagacgtgaagcacttctcgccggaggaaattgctgtcaaggtggtgggcgaacacgtggaggtgcacgcgcgccacgaggagcgcccggatgagcacggattcgtcgcgcgcgagttccaccgtcgctaccgcctgccgcctggcgtggatccggctgccgtgacgtccgcgctgtcccccgagggcgtcctgtccatccaggccgcaccagcgtcggcccaggccccaccgccagccgcagccaagtaggagggggctgggccgcgcccgcaccccgggagcctcctcaggctccctctattaaagccgatctgactccgcccagccagatgtcccgagtgcgccaaggactgtcctctcacccactcctggattctgccctgacctccatcctggacactgccttgataacatagacccttccactgacaccctcgctctcacaccccctccagctttccgaccccacaccgacaactccccggcttccagaccctaccagcactaccctaaccctcagccgacagtctcagccccaccgacccactttcttggcatatagccccacttaagacccctcctctacttccttctgagtcctctacaaagacatccgggtactacatttccatcccttccctattttgacaccaaattatggtgtagacagccctcccccaaccccaggccagtcaggcacaatccccccaccccccaaacgtcctggactgcacagacctcccactccagaccatccaggcctggttcccaagacccgatccttcccctgcaaccagacagtctacaactgccccctccagcccattttctgccgtgaaaccccagccagccacaccagactctggaaccctttttcgactgccccaactcttggacaccaggccaactagaacacccatttttccatttcttcagagggaaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcacctccagctgtactagtgccattggaataataaatttgataaggtggtga

SEQ ID NO: 440878 - DNA, 1547 bp, Homo sapiens
ggactgcaacgcggaggagcaggatggagatccctgtgcctgtgcagccgtcttggctgcgccgcgcctcggccccgttgcccggactttcggcgcccggacgcctctttgaccagcgcttcggcgaggggctgctggaggccgagctggctgcgctctgccccaccacgctcgccccctactacctgcgcgcacccagcgtggcgctgcccgtcgcccaggtgccgacggaccccggccacttttcggtgctgctagacgtgaagcacttctcgccggaggaaattgctgtcaaggtggtgggcgaacacgtggaggtgcacgcgcgccacgaggagcgcccggtgagccgcggcgtggggcggggctggagcgggtacgctcgccgccgggccggaggggcggggccgctcaagcctccctcccctccaggatgagcacggattcgtcgcgcgcgagttccaccgtcgctaccgcctgccgcctggcgtggatccggctgccgtgacgtccgcgctgtcccccgagggcgtcctgtccatccaggccgcaccagcgtcggcccaggccccaccgccagccgcagccaagtaggagggggctgggccgcgcccgcaccccgggagcctcctcaggctccctctattaaagccgatctgactccgcccagccagatgtcccgagtgcgccaaggactgtcctctcacccactcctggattctgccctgacctccatcctggacactgccttgataacatagacccttccactgacaccctcgctctcacaccccctccagctttccgaccccacaccgacaactccccggcttccagaccctaccagcactaccctaaccctcagccgacagtctcagccccaccgacccactttcttggcatatagccccacttaagacccctcctctacttccttctgagtcctctacaaagacatccgggtactacatttccatcccttccctattttgacaccaaattatggtgtagacagccctcccccaaccccaggccagtcaggcacaatccccccaccccccaaacgtcctggactgcacagacctcccactccagaccatccaggcctggttcccaagacccgatccttcccctgcaaccagacagtctacaactgccccctccagcccattttctgccgtgaaaccccagccagccacaccagactctggaaccctttttcgactgccccaactcttggacaccaggccaactagaacacccaacaccaaactgtacagactctcccaccccaacctccccagactctgcacggatgtcctaggccccctccccaactctaaccagaccccatccccctaagtccctttgtcttgacccccaagtcttcaaccagatatcctcggcaacccacctcccaccctcctcctcttctccttcaagacccaactgagcacccgctctgattccccacagcctttctccctgccaccactcccttagtctttcccaggcttactctcccaataaatgtgctagagctctgc

SEQ ID NO: 440879 - DNA, 1311 bp, Homo sapiens
ggactgcaacgcggaggagcaggatggagatccctgtgcctgtgcagccgtcttggctgcgccgcgcctcggccccgttgcccggactttcggcgcccggacgcctctttgaccagcgcttcggcgaggggctgctggaggccgagctggctgcgctctgccccaccacgctcgccccctactacctgcgcgcacccagcgtggcgctgcccgtcgcccaggtgccgacggaccccggccacttttcggtgctgctagacgtgaagcacttctcgccggaggaaattgctgtcaaggtggtgggcgaacacgtggaggtgcacgcgcgccacgaggagcgcccggatgagcacggattcgtcgcgcgcgagttccaccgtcgctaccgcctgccgcctggcgtggatccggctgccgtgacgtccgcgctgtcccccgagggcgtcctgtccatccaggccgcaccagcgtcggcccaggccccaccgccagccgcagccaagtaggagggggctgggccgcgcccgcaccccgggagcctcctcaggctccctctattaaagccgatctgactccgcccagccagatgtcccgagtgcgccaaggactgtcctctcacccactcctggattctgccctgacctccatcctggacactgccttgataacatagacccttccactgacaccctcgctctcacaccccctccagctttccgaccccacaccgacaactccccggcttccagaccctaccagcactaccctaaccctcagccgacagtctcagccccaccgacccactttcttggcatatagccccacttaagacccctcctctacttccttctgagtcctctacaaagacatccgggtactacatttccatcccttccctattttgacaccaaattatggtgtagacagccctcccccaaccccaggccagtcaggcacaatccccccaccccccaaacgtcctggactgcacagacctcccactccagaccatccaggcctggttcccaagacccgatccttcccctgcaaccagacagtctacaactgccccctccagcccattttctgccgtgaaaccccagccagccacaccagactctggaaccctttttcgactgccccaactcttggacaccaggccaactagaacacccaacaccaaactgtacagactctcccaccccaacctgagcaagccagcctggcttgctcaggtctgactctctttggacaataaaataaagtgcattactgaacaaagagtaactcaaaaccagaatcagacaaatc

SEQ ID NO: 440880 - DNA, 355 bp, Homo sapiens
gattcctgatgctccaaggcgactgatgggcgctggatgaagtggctcagtcagcttggctgggggccggtgtcatgttgtgctcctggggcgggggcacggagtggcatttcacgtattgctgccgctcactcccctccaccctcagctccaccctcagcagatgataatatcaagacacctgccttccaccctcagcggatgatctcaagacaccttccgagcgtcagctcactccccttccaccctcagctccaccctcagcagatgataatatcaagatacctgctgagcgtctgcggattccgcttccaccatcagccgatgataatctcgcagactaccttccgagcgt

SEQ ID NO: 440881 - DNA, 2740 bp, Homo sapiens
atgttttataggtatgatctcgtgaaaccttgagagaaactgaatgacgaatgaaactattgttcctgtttcacacagaagaaaactgaggttaaaaggggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctgctcactccccttccaccctcagcggatgataatctcaagacacctcccgagtgttctcacggatgataatctcaagacaccttccgagcgtcagctcactccccttccaccctcagctccacccctcagctccaccctcagcagatgataatatcaagacacctgccgagcgtctgcgggggccgcttccaccctcagcagatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccctttccaccctcagctccaccctcagcagatgataatatcaagacacctgccgagcgtctgcggggagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccgaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcattacccgaacccaagaggcggaggttgagctgagaagaggccagtgcactcaagcctgagcaataagaataaaaccgagtagaacaaaataaaaaattcaaaaaacaaaacaaaacccacactccaaaaactaacaaagaataaataaataatataaaaataaaataaa

SEQ ID NO: 440882 - DNA, 1900 bp, Homo sapiens
atgttttataggtatgatctcgtgaaaccttgagagaaactgaatgacgaatgaaactattgttcctgtttcacacagaagaaaactgaggttaaaaggggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctgctcactccccttccaccctcagcggatgataatctcaagacacctcccgagtgttctcactcactcccctccaccctcagctccaccctcagcagatgataatatcaagacacctgccttccaccctcagcggatgatctcaagacaccttccgagcgtcagctcactccccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccgaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcattacccgaacccaagaggcggaggttgagctgagaagaggccagtgcactcaagcctgagcaataagaataaaaccgagtagaacaaaataaaaaattcaaaaaacaaaacaaaacccacactccaaaaactaacaaagaataaataaataatataaaaataaaataaa

SEQ ID NO: 440883 - DNA, 2285 bp, Homo sapiens
  misc_feature (29)..(29): n is a, c, g, or t
  misc_feature (32)..(32): n is a, c, g, or t
atatcgagctcgtccgggagtggagaganaanggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctgctcactccccttccaccctcagcggatgataatctcaagacacctcccgagtgttctcacggatgataatctcaagacaccttccgagcgtcagctcactccccttccaccctcagctccacccctcagctccaccctcagcagatgataatatcaagacacctgccgagcgtctgcgggggccgcttccaccctcagcagatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccctttccaccctcagctccaccctcagcagatgataatatcaagacacctgccgagcgtctgcggggagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccgaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcattacccgaacccaagaggcggaggttgagctgagaagaggccagtgcactcaagcctgagcaataagaataaaaccgagtagaacaaaataaaaaattcaaaaaacaaaacaaaacccacactccaaaaactaacaaagaataaataaataatataaaaataaaataaa

SEQ ID NO: 440884 - DNA, 2267 bp, Homo sapiens
atgttttataggtatgatctcgtgaaaccttgagagaaactgaatgacgaatgaaactattgttcctgtttcacacagaagaaaactgaggttaaaaggggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctgctcactccccttccaccccaccctcagctctaccctcagctccaccctcagcggaatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtcgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccgaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcattacccgaacccaagaggcggaggttgagctgagaagaggccagtgcactcaagcctgagcaataagaataaaaccgagtagaacaaaataaaaaattcaaaaaacaaaacaaaacccacactccaaaaactaacaaagaataaataaataatataaaaataaaataaa

SEQ ID NO: 440885 - DNA, 1839 bp, Homo sapiens
atgttttataggtatgatctcgtgaaaccttgagagaaactgaatgacgaatgaaactattgttcctgtttcacacagaagaaaactgaggttaaaaggggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccagaaaacaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctgctcactccccttccaccctcagcggatgataatctcaagacacctcccgagtgttctcactcactcccctccaccctcagctccaccctcagcagatgataatatcaagacacctgccttccaccctcagcggatgatctcaagacaccttccgagcgtcagctcactccccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccgaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcattacccgaacccaagaggcggaggttgagctgagaagaggccagtgcactcaagcctgagcaataagaataaaaccgagtagaacaaaataaaaaattcaaaaaacaaaacaaaacccacactccaaaaactaacaaagaataaataaataatataaaaataaaataaa

SEQ ID NO: 440886 - DNA, 2354 bp, Homo sapiens
  misc_feature (29)..(29): n is a, c, g, or t
  misc_feature (32)..(32): n is a, c, g, or t
atatcgagctcgtccgggagtggagaganaanggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagatcaaccacatccttcaaaaggactatgcctgtttataagcccagctgtttctgccctgtgaaacacggaaaatgtttcaacgtgcgcaagagttgcggcggcgagcagaggactaccacaaatgcaaaatccccctttctggaagacaggctcttagcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctgctcactccccttccaccctcagcggatgataatctcaagacacctcccgagtgttctcacggatgataatctcaagacaccttccgagcgtcagctcactccccttccaccctcagctccacccctcagctccaccctcagcagatgataatatcaagacacctgccgagcgtctgcgggggccgcttccaccctcagcagatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccctttccaccctcagctccaccctcagcagatgataatatcaagacacctgccgagcgtctgcggggagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccgaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcattacccgaacccaagaggcggaggttgagctgagaagaggccagtgcactcaagcctgagcaataagaataaaaccgagtagaacaaaataaaaaattcaaaaaacaaaacaaaacccacactccaaaaactaacaaagaataaataaataatataaaaataaaataaa

SEQ ID NO: 440887 - DNA, 2996 bp, Homo sapiens
atgttttataggtatgatctcgtgaaaccttgagagaaactgaatgacgaatgaaactattgttcctgtttcacacagaagaaaactgaggttaaaaggggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctgctcactccccttccaccctcagcggatgataatctcaagacacctcccgagtgttctcacggatgataatctcaagacaccttccgagcgtcagctcactccccttccaccctcagctccacccctcagctccaccctcagcagatgataatatcaagacacctgccgagcgtctgcgggggccgcttccaccctcagcagatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccctttccaccctcagctccaccctcagcagatgataatatcaagacacctgccgagcgtctgcggggagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccgaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcattacccgaacccaagaggcggaggttgagctgagaagaggccagtgcactcaagcctgagcaataagaataaaaccgagtagaacaaaataaaaaattcaaaaaacaaaacaaaacccacactccaaaaactaacaaagaataaataaataatataaaaataaaataaaaaaaaatcctaggtttatttctaagttcaaatcataaggattggttaaatcacttagtttttcttacccaacagccttcatctggatgaaaagaggggaaacatgacgagaagggggaacagacagagacaggcttggtacgcatttctctacgatgaatggctggcagctaagatatacaaacgcatctggcccttctctaacgaaggccacaggtggctgggcattccagggacctttacaccaggcaagataa

SEQ ID NO: 440888 - DNA, 2656 bp, Homo sapiens
atgttttataggtatgatctcgtgaaaccttgagagaaactgaatgacgaatgaaactattgttcctgtttcacacagaagaaaactgaggttaaaaggggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctgctcactccccttccaccctcagcggatgataatctcaagacacctcccgagtgttctcacggatgataatctcaagacaccttccgagcgtcagctcactccccttccaccctcagctccacccctcagctccaccctcagcagatgataatatcaagacacctgccgagcgtctgcgggggccgcttccaccctcagcagatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccctttccaccctcagctccaccctcagcagatgataatatcaagacacctgccgagcgtctgcggggagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccatcatcacccgaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcattacccgaacccaagaggcggaggttgagctgagaagaggccagtgcactcaagcctgagcaataagaataaaaccgagtagaacaaaataaaaaattcaaaaaacaaaacaaaacccacactccaaaaactaacaaagaataaataaataatataaaaataaaataaa

SEQ ID NO: 440889 - DNA, 2698 bp, Homo sapiens
atgttttataggtatgatctcgtgaaaccttgagagaaactgaatgacgaatgaaactattgttcctgtttcacacagaagaaaactgaggttaaaaggggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctgctcactccccttccaccctcagcggatgataatctcaagacacctcccgagtgttctcacggatgataatctcaagacaccttccgagcgtcagctcactccccttccaccctcagctccacccctcagctccaccctcagcagatgataatatcaagacacctgccgagcgtctgcgggggccgcttccaccctcagcagatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccctttccaccctcagctccaccctcagcagatgataatatcaagacacctgccgagcgtctgcggggagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccgaacccaagaggcggagggccgctgacgtggaaccatcatcacccgaacccaagaggcggagggtcggtgacgtggaaccgtcacgcaaacccaagaggcggagggccgctgacgtggaaccatcattacccgaacccaagaggcggaggttgagctgagaagaggccagtgcactcaagcctgagcaataagaataaaaccgagtagaacaaaataaaaaattcaaaaaacaaaacaaaacccacactccaaaaactaacaaagaataaataaataatataaaaataaaataaa

SEQ ID NO: 440890 - DNA, 2820 bp, Homo sapiens
atgttttataggtatgatctcgtgaaaccttgagagaaactgaatgacgaatgaaactattgttcctgtttcacacagaagaaaactgaggttaaaaggggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctgctcactccccttccaccctcagcggatgataatctcaagacacctcccgagtgttctcacggatgataatctcaagacaccttccgagcgtcagctcactccccttccaccctcagctccacccctcagctccaccctcagcagatgataatatcaagacacctgccgagcgtctgcgggggccgcttccaccctcagcagatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccctttccaccctcagctccaccctcagcagatgataatatcaagacacctgccgagcgtctgcggggagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccgaacccaagaggcggagggccgctgacgtggaaccatcatcacccgaacccaagaggcggagggtcggtgacgtggaaccgtcacgcaaacccaagaggcggagggccgctgacgtggaaccatcattacccgaacccaagaggcggaggttgagctgagaagaggccagtgcactcaagcctgagcaataagaataaaaccgagtagaacaaaataaaaaattcaaaaaacaaaacaaaacccacactccaaaaactaacaaagaataaataaataatataaaaataaaataaatactgcagtccttatgttattgctttgtttcgatatctggtatgattgcctgagggacctgaggtttttaatcataggggtttttttttaatctttagaagtggttggttatgtaaaatatt

SEQ ID NO: 440891 - DNA, 2653 bp, Homo sapiens
atgttttataggtatgatctcgtgaaaccttgagagaaactgaatgacgaatgaaactattgttcctgtttcacacagaagaaaactgaggttaaaaggggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctgctcactccccttccaccctcagcggatgataatctcaagacacctcccgagtgttctcacggatgataatctcaagacaccttccgagcgtcagctcactccccttccaccctcagctccacccctcagctccaccctcagcagatgataatatcaagacacctgccgagcgtctgcgggggccgcttccaccctcagcagatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccctttccaccctcagctccaccctcagcagatgataatatcaagacacctgccgagcgtctgcggggagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccgaacccaagaggcggagggtcggtgatgtggaaccgtcacgcaaacccaagaggcggagggccgctgacgtggaaccatcatcacccgaacccaagaggcggaggttgagctgagaagaggccagtgcactcaagcctgagcaataagaataaaaccgagtagaacaaaataaaaaattcaaaaaacaaaacaaaacccacactccaaaaactaacaaagaataaataaataatataaaaataaaataaa

SEQ ID NO: 440892 - DNA, 1576 bp, Homo sapiens
atgttttataggtatgatctcgtgaaaccttgagagaaactgaatgacgaatgaaactattgttcctgtttcacacagaagaaaactgaggttaaaaggggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctgctcactccccttccaccctcagcggatgataatctcaagacacctcccgagtgttctcacggatgataatctcaagacaccttccgagcgtcagctcactccccttccaccctcagctccaccctcagcagatgataatatcaagacacctgccgagcgtcgtgcgggggccgcttccaccctcagcggatgataatctcaagacaccttccgagcgtcagctcactccctcactcccctccaccctcagctccaccctcagcagatgataatatcaagacacctgccttccaccctcagcggatgatctcaagacaccttccgagcgtcagctcactccccttccaccctcagctccaccctcagcagatgataatatcaagatacctgctgagcgtctgcggattccgcttccaccatcagccgatgataatctcgcagactaccttccgagcgt

SEQ ID NO: 440893 - DNA, 423 bp, Homo sapiens
aacattccctcctttggccctacaggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctgctcactccccttccaccctcagcggatgataatctcaagacacctcccgagtgttctca

SEQ ID NO: 440894 - DNA, 586 bp, Homo sapiens
atgttttataggtatgatctcgtgaaaccttgagagaaactgaatgacgaatgaaactattgttcctgtttcacacagaagaaaactgaggttaaaaggggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttatcaatactctggctgaccatcatcatcgtgggactgactttggtggaagtccttggttacatgtcattattgcgtttccgacaagttataaagttgtcattaccctctggatagtttacctttgggtgagtatactaactttctgtagaggtatacttgtaatcacaaataagaataaattatataaaacaattcacatttctggacttcattatgaatatgtggttttacccaaaaaatcagggaaatgatttattagtataagaattatgaaaacatctgccatttgcattatgaaaattaaataggtcggtgtttgtttaa

SEQ ID NO: 440895 - DNA, 2728 bp, Homo sapiens
atgttttataggtatgatctcgtgaaaccttgagagaaactgaatgacgaatgaaactattgttcctgtttcacacagaagaaaactgaggttaaaaggggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctgctcactccccttccaccctcagcggatgataatctcaagacacctcccgagtgttctcacggatgataatctcaagacaccttccgagcgtcagctcactccccttccaccctcagctccacccctcagctccaccctcagcagatgataatatcaagacacctgccgagcgtctgcgggggccgcttccaccctcagcagatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccctttccaccctcagctccaccctcagcagatgataatatcaagacacctgccgagcgtctgcggggagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccgaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcattacccgaacccaagaggcggaggttgagctgagaagaggccagtgcactcaagcctgagcaataagaataaaaccgagtagaacaaaataaaaaattcaaaaaacaaaacaaaacccacactccaaaaactaacaaagaataaataaataatataaaaataaaataaa

SEQ ID NO: 440896 - DNA, 2070 bp, Homo sapiens
atgttttataggtatgatctcgtgaaaccttgagagaaactgaatgacgaatgaaactattgttcctgtttcacacagaagaaaactgaggttaaaaggggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctgctcactccccttccaccctcagcggatgataatctcaagacacctcccgagtgttctcacggatgataatctcaagacaccttccgagcgtcagctcactccccttccaccctcagctccaccctcagcagatgataatatcaagacacctgccgagcgtcgtgcgggggccgcttccaccctcagcggatgataatctcaagacaccttccgagcgtcagctcactccctcactcccctccaccctcagctccaccctcagcagatgataatatcaagacacctgccttccaccctcagcggatgatctcaagacaccttccgagcgtcagctcactccccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccgaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcattacccgaacccaagaggcggaggttgagctgagaagaggccagtgcactcaagcctgagcaataagaataaaaccgagtagaacaaaataaaaaattcaaaaaacaaaacaaaacccacactccaaaaactaacaaagaataaataaataatataaaaataaaataaa

SEQ ID NO: 440897 - DNA, 2039 bp, Homo sapiens
atgttttataggtatgatctcgtgaaaccttgagagaaactgaatgacgaatgaaactattgttcctgtttcacacagaagaaaactgaggttaaaaggggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctgctcactccccttccaccctcagcggatgataatctcaagacacctcccgagtgttctcaccaccctcagctctaccctcagctccaccctcagcggaatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtcgttccaccctcagcggatgataatctcaagacaccttccgagcgtcagctcactccccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccgaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcattacccgaacccaagaggcggaggttgagctgagaagaggccagtgcactcaagcctgagcaataagaataaaaccgagtagaacaaaataaaaaattcaaaaaacaaaacaaaacccacactccaaaaactaacaaagaataaataaataatataaaaataaaataaa

SEQ ID NO: 440898 - DNA, 2849 bp, Homo sapiens
atgttttataggtatgatctcgtgaaaccttgagagaaactgaatgacgaatgaaactattgttcctgtttcacacagaagaaaactgaggttaaaaggggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaagtaaggagcttcctccctgcagttgcaggatagttcagtgctgatgcagatgatgccacggcccttagactctctcaacattcaatttctcatgtgttggctttttcagatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctgctcactccccttccaccctcagcggatgataatctcaagacacctcccgagtgttctcacggatgataatctcaagacaccttccgagcgtcagctcactccccttccaccctcagctccacccctcagctccaccctcagcagatgataatatcaagacacctgccgagcgtctgcgggggccgcttccaccctcagcagatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccctttccaccctcagctccaccctcagcagatgataatatcaagacacctgccgagcgtctgcggggagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccgaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcattacccgaacccaagaggcggaggttgagctgagaagaggccagtgcactcaagcctgagcaataagaataaaaccgagtagaacaaaataaaaaattcaaaaaacaaaacaaaacccacactccaaaaactaacaaagaataaataaataatataaaaataaaataaa

SEQ ID NO: 440899 - DNA, 3073 bp, Homo sapiens
atgttttataggtatgatctcgtgaaaccttgagagaaactgaatgacgaatgaaactattgttcctgtttcacacagaagaaaactgaggttaaaaggggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctgctcactccccttccaccctcagcggatgataatctcaagacacctcccgagtgttctcacggatgataatctcaagacaccttccgagcgtcagctcactccccttccaccctcagctccacccctcagctccaccctcagcagatgataatatcaagacacctgccgagcgtctgcgggggccgcttccaccctcagcagatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccctttccaccctcagctccaccctcagcagatgataatatcaagacacctgccgagcgtctgcggggagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccgaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcattacccgaacccaagaggcggaggttgagctgagaagaggccagtgcactcaagcctgagcaataagaataaaaccgagtagaacaaaataaaaaattcaaaaaacaaaacaaaacccacactccaaaaactaacaaagaataaataaataatataaaaataaaataaaaaaacaaaaaaggaaaaaagagaaaaaaaaagaaaagaaaaaaagacaaacagagaaacaaagaaggaaaacaaggcggggggggggcaaggagagagacccgcggcggggccaaaatggagcggaaaaccgagaattgggagacaagggggccccacaagagggagccataaatagaaaaagagagaagcgggcgaggaaaacacacgccgagcggaggcggagaccaaagcgcccggggcgaacactgcgagaaggcacccccaactagggggagggagatacaggagcggcaaagaccgtaggagggagaggaggagacagggagggcac

SEQ ID NO: 440900 - DNA, 2862 bp, Homo sapiens
atgttttataggtatgatctcgtgaaaccttgagagaaactgaatgacgaatgaaactattgttcctgtttcacacagaagaaaactgaggttaaaaggggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctgctcactccccttccaccctcagcggatgataatctcaagacacctcccgagtgttctcacggatgataatctcaagacaccttccgagcgtcagctcactccccttccaccctcagctccacccctcagctccaccctcagcagatgataatatcaagacacctgccgagcgtctgcgggggccgcttccaccctcagcagatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccctttccaccctcagctccaccctcagcagatgataatatcaagacacctgccgagcgtctgcggggagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccgaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcattacccgaacccaagaggcggaggttgagctgagaagaggccagtgcactcaagcctgagcaataagaataaaaccgagtagaacaaaataaaaaattcaaaaaacaaaacaaaacccacactccaaaaactaacaaagaataaataaataatataaaaataaaataaatactgcagtccttatgttattgctttgtttcgatatctggtatgattgcctgagggacctgaggtttttaatcataggggtttttttttaatctttagaagtggttggttatgtaaaatatt

SEQ ID NO: 440901 - DNA, 2701 bp, Homo sapiens
  misc_feature (2659)..(2659): n is a, c, g, or t
  misc_feature (2664)..(2664): n is a, c, g, or t
  misc_feature (2684)..(2684): n is a, c, g, or t
atgttttataggtatgatctcgtgaaaccttgagagaaactgaatgacgaatgaaactattgttcctgtttcacacagaagaaaactgaggttaaaaggggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctgctcactccccttccaccctcagcggatgataatctcaagacacctcccgagtgttctcacggatgataatctcaagacaccttccgagcgtcagctcactccccttccaccctcagctccacccctcagctccaccctcagcagatgataatatcaagacacctgccgagcgtctgcgggggccgcttccaccctcagcagatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccctttccaccctcagctccaccctcagcagatgataatatcaagacacctgccgagcgtctgcggggagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccgaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcattacccgaacccaagaggcggaggttgagctgagaagaggccagtgcactcaagcctgagcaataagaataaaaccgaggttgctgtntcacnatacctcatgcttcacatanccgagcgagggaccgct

SEQ ID NO: 440902 - DNA, 2225 bp, Homo sapiens
atgttttataggtatgatctcgtgaaaccttgagagaaactgaatgacgaatgaaactattgttcctgtttcacacagaagaaaactgaggttaaaaggggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctgctcactccccttccaccctcagcggatgataatctcaagacacctcccgagtgttctcaccaccctcagctctaccctcagctccaccctcagcggaatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtcgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccatcatcacccgaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcattacccgaacccaagaggcggaggttgagctgagaagaggccagtgcactcaagcctgagcaataagaataaaaccgagtagaacaaaataaaaaattcaaaaaacaaaacaaaacccacactccaaaaactaacaaagaataaataaataatataaaaataaaataaa

SEQ ID NO: 440903 - DNA, 1795 bp, Homo sapiens
atgttttataggtatgatctcgtgaaaccttgagagaaactgaatgacgaatgaaactattgttcctgtttcacacagaagaaaactgaggttaaaaggggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctgctcactccccttccaccctcagcggatgataatctcaagacacctcccgagtgttctcacggatgataatctcaagacaccttccgagcgtcagctcactccccttccaccctcagctccacccctcagctccaccctcagcagatgataatatcaagacacctgccgagcgtctgcgggggccgcttccaccctcagcagatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccctttccaccctcagctccaccctcagcagatgataatatcaagacacctgccgagcgtctgcggggagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatcatcagcagcccaggggctgctgatgattatgtgagaagacgcaggccggatgtcagaggggggtcccggagctcg

SEQ ID NO: 440904 - DNA, 817 bp, Homo sapiens
atgttttataggtatgatctcgtgaaaccttgagagaaactgaatgacgaatgaaactattgttcctgtttcacacagaagaaaactgaggttaaaaggggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagtaagatgtgccttgacacaaatactgttgtatgaaccatgtgccaatcaaagtagacaactgtaaagtccttgagaatattttctacaatatttgtggcaaattcagtgggttcaaaattgagtttgtccttt

SEQ ID NO: 440905 - DNA, 5131 bp, Homo sapiens
  misc_feature (3523)..(3523): n is a, c, g, or t
  misc_feature (3998)..(3998): n is a, c, g, or t
  misc_feature (4596)..(4596): n is a, c, g, or t
cttaggaacgggttgctaagctggtgtttttgctccaagacatggctgcagcttcccagggaggagcccaggggcatctccaacactcagcctttccctccggacccttttaaaagattcaacagcaccgtctctctccacttccatcctagaatgcagaatctgcaaagtgccttttgtaaagtttcttaagggacccatcccagccaaaatgaatcccagggaagaaaaagtaaaaataattacagaggagttcattgaaaatgatgaggatgcagacatgggaagacagaataagaactcaaaggttcgaagacagccaagaaagaaacaggcagaagccaactcctttctcccgagcctgctggcagatcctcccccacctctccgcaggagttcccctcctaggctgggagcatcccgtgcagggtaaatcttttcaagccaccaactgctgtccccaaggaaatggtgtccgaaaaatcccaccttggcaacccccaggagcctgtgcaggaggagcccaagacccgcctcctgagtatgacagtccggagaggcccacggagcttacctccaattccttcaacttccagaacaggctttgcagaattttccatgaggggacgcatgagggagaaattgcaagcagcgaggtccaaagcagaaagtgcattgctgcaggaaatccccactcctcggcccagacgcttacgaagtcccagtaagaaagaattggagactgaatttggcacagagccagggaaagaggtagaaaggactcaacaagaagttgactcccaaagttactcaagagtcaagttccatgattctgcacgaaaaatcaagcctaaaccccaggttccacctggcttcccttctgcagaagaggcctataacttctttactttcaactttgatcccgaaccagaaggatcagaggaaaaaccaaaagcaagacatagagcgggaactaatcaagaggaggaggaaggggaagaagaagaaccacctgcacaaggaggaggaaaggaaatggatgaggaagaactgcttaatggtgatgatgccgaggacttcctattgggcttagatcacgtggctgacgattttgtagcagtcagacctgcagattatgaaagcatccatgatcggctgcagatggaaagagaaatgctcttcatacccagtaggcagacagtccctacatataaaaagcttcctgagaatgtacagcccaggttcctggaagatgaaggcctttacaccggggtaagaccagaggtggcacgcaccaatcagaacatcatggagaacagattgctgatgcaggaccccgaaagaagatggtttggagatgacggcaggatcctagctctgccaaaccccatcaagccatttccttcaaggccgccagtactaacacaggagcagagcattaaggcagagcttgaaacactgtataaaaaggctgtaaaatacgttcacagtagtcagcatgtgatcagatctggagaccctcctggaaatttccaactggacattgatatttcagggttaatcttcactcatcatccctgttttagccgagagcatgttttggcagccaagctggcccagttatatgaccagtaccttgcaagacaccagagaaacaaggcgaaatttcttactgataagctccaagctttaagaaatgctgttcagactggccttgatccagaaaaacctcatcagtctctcgataccatccaaaaaaccatcaatgagtataaatctgaaattcgacaaacaagaaaattccgtgatgctgaacaagaaaaagatagaacattgcttaagactatcataaaagtttggaaagagatgaaatcccttcgagagttccagagatttacaaatactcccttgaaacttgttttgagaaaggaaaaagctgaccagaaagcagatgaagaagcatatgaagcagaaattcaagctgaaataagtgaactgttagaagagcacacggaggagtacgcacagaagatggaagaatacagaacgtcgttacaacagtggaaggcctggaggaaagtgcaaagggccaagaagaagaaaaggaaacaagcagcagaagaacatcccggtgatgagattgcagagccgtatcccgaggaggaccttgtgaagcccagccctccagagcccactgatcgggcagtgatagagcaggaggtgagggagagagcagcccagagcaggaggaggccttgggagcccacgctggtcccggagctaagcctggcaggaagcgtaacacccaatgaccagtgccccagagcggaggtctcgagaagggaggatgtaaagaagcgctcagtgtacttaaaagtgctgttcaacaacaaggaggtgtccaggacagtcagtcggccactaggagcagacttccgagttcactttgggcagattttcaatttgcaaatagtcaactggccggagagtttaacacttcaggtctatgaaactgtcggacacagtagtcccaccttgctagcagaagtgtttctgcctattcctgagactactgttgtcactggaagggctcctactgaagaagtggagtttagcagtaatcagcatgtgacactggaccacgagggagttggaagtggagtgcccttctcatttgaagctgatggcagtaaccagctgactctgatgacctcagggaaagtgtctcatagtgtggcatgggccattggagaaaacgggatacctttaattcctccattgtcacagcagaacatcggatttcggagtgctttgaagaaagcagatgccatctcatctattggcacatcaggactgacagacatgaaaaaattggccaagtgggcagcagagtccaagctcgacccaaatgaccccaacaatgcccctttgatgcagcttatctcggttgctaccagtggtgaatcctatgtccctgatttctttagactggagcagctgcaacaggagtttaactttgtttcagatcaagaattaaatagatccaaacgatttaggcttcttcatcttagaagccaagaggtgccagaattccgaaattataagcaagttccagtctatgaccgagaaattatggaaaaggtattccaggactatgagaaacggttacgagacagaaatgtaatagaaaccaaggaacacatagacacccatagggccatagtagccaagtacctccagcaggttagagaatcagtgataaatcgtttcttaattgcaaaacaatattttcttcttgctgatatgatagtagaagaagaagttcccaatatcagcattttgggcctaagccttttcaagctggcagaacaaaagcgaccactgcggccaaggagaaaaggtcggaagaaggtgacagcccaaaacctgtctgatggagacataaagctgctggtgaacattgtgcgagcttacgacattccagtgaggaagccggcagtgagcaaattccagcagccgtcgnggtcttcaaggatgttcagtgaaaagcatgctgcttccccaagcacgtacagcccaacccacaatgctgactaccccctcggccaggttttagtacgtccctttgtagaagtctcttttcaacgaacagtttgccatacgactacggctgaaggaccaaaccctagctggaatgaagaactagaacttccatttagggctcctaatggagattatagcacagccagtctgcagtcagtgaaagatgttgtgttcattaacatttttgatgaagtactgcatgatgtcttagaggatgaccgtgaaagaggaagtggaatccatactcgtattgagagacactggctgggatgtgtgaaaatgccatttagcacaatatatttccaagcaaggtttgagtctcaggaagatgagaaattacttcaagcaactgagaagtttcaagctgaatgtgccttaaagtttccaaatcgtcngtgccttacaacagtaattgatataagcggaaaaactgtttttatcacacgttatctcaaacctttaaaccctcctcaggagctccttaatgtctaccccaataatctacaggcaactgcagaactggtggctcgatatgtgtccttgattcccttcttgcctgacactgtctcatttggtggtatctgtgacctctggagcacatctgatcaatttcttgatctcctggcaggggatgaagaagaacatgcagtactattgtgtaattactttctgtctctgggtaagaaggcctggctgttgatgggcaatgctattcctgagggtccaactgcctatgtgctaacttgggagcaaggtcgttatttaatatggaatccctgcagtggacatttttatggacaatttgatacattctgtcccttgaaaaatgtgggctgtttaataggtcctgacaatatttggtttaatattcaacgatatgaatctccactaaggataaattttgatgtcaccaggcccaagctatggaaatctttcttttcaagaagccttccatatcctggcctttccagtgttcagcctgaagagctaatntaccagcgctcagacaaagcagctgcagctgagctacaagacaggattgaaaaaatactaaaagaaaaaatcatggactggaggccacgccatctgactcggtggaataggtattgtacctctactctgcgtcacttcttgcctctgttagaaaaaagtcaaggagaagatgtagaagatgaccacagagcagaactgctaaaacagctgggagactacaggttctctggatttcctcttcacatgccttattctgaagtgaagcctttaattgacgctgtgtatagtactggagtacataatattgatgttcctaatgttgaatttgctttagctgtatacatacacccataccccaaaaatgttttgtctgtttggatctatgttgcctctcttatacgcaacaggtaatttttttcactgtactttctgtatcatgtaaaaactacacttaggatatgagaaaattttaaattatatgcatcacatcagaagaacatattattggcaaataataaaattatcaactgttttc

SEQ ID NO: 440906 - DNA, 3611 bp, Homo sapiens
cttaggaacgggttgctaagctggtgtttttgctccaagacatggctgcagcttcccagggaggagcccaggggcatctccaacactcagcctttccctccggacccttttaaaagattcaacagcaccgtctctctccacttccatcctagaatgcagaatctgcaaagtgccttttgtaaagtttcttaagggacccatcccagccaaaatgaatcccagggaagaaaaagtaaaaataattacagaggagttcattgaaaatgatgaggatgcagacatgggaagacagaataagaactcaaaggttcgaagacagccaagaaagaaacagccaccaactgctgtccccaaggaaatggtgtccgaaaaatcccaccttggcaacccccaggagcctgtgcaggaggagcccaagacccgcctcctgagtatgacagtccggagaggcccacggagcttacctccaattccttcaacttccagaacaggctttgcagaattttccatgaggggacgcatgagggagaaattgcaagcagcgaggtccaaagcagaaagtgcattgctgcaggaaatccccactcctcggcccagacgcttacgaagtcccagtaagaaagaattggagactgaatttggcacagagccagggaaagaggtagaaaggactcaacaagaagttgactcccaaagttactcaagagtcaagttccatgattctgcacgaaaaatcaagcctaaaccccaggttccacctggcttcccttctgcagaagaggcctataacttctttactttcaactttgatcccgaaccagaaggatcagaggaaaaaccaaaagcaagacatagagcgggaactaatcaagaggaggaggaaggggaagaagaagaaccacctgcacaaggaggaggaaaggaaatggatgaggaagaactgcttaatggtgatgatgccgaggacttcctattgggcttagatcacgtggctgacgattttgtagcagtcagacctgcagattatgaaagcatccatgatcggctgcagatggaaagagaaatgctcttcatacccagtaggcagacagtccctacatataaaaagcttcctgagaatgtacagcccaggttcctggaagatgaaggcctttacaccggggtaagaccagaggtggcacgcaccaatcagaacatcatggagaacagattgctgatgcaggaccccgaaagaagatggtttggagatgacggcaggatcctagctctgccaaaccccatcaagccatttccttcaaggccgccagtactaacacaggagcagagcattaaggcagagcttgaaacactgtataaaaaggctgtaaaatacgttcacagtagtcagcatgtgatcagatctggagaccctcctggaaatttccaactggacattgatatttcagggttaatcttcactcatcatccctgttttagccgagagcatgttttggcagccaagctggcccagttatatgaccagtaccttgcaagacaccagagaaacaaggcgaaatttcttactgataagctccaagctttaagaaatgctgttcagactggccttgatccagaaaaacctcatcagtctctcgataccatccaaaaaaccatcaatgagtataaatctgaaattcgacaaacaagaaaattccgtgatgctgaacaagaaaaagatagaacattgcttaagactatcataaaagtttggaaagagatgaaatcccttcgagagttccagagatttacaaatactcccttgaaacttgttttgagaaaggaaaaagctgaccagaaagcagatgaagaagcatatgaagcagaaattcaagctgaaataagtgaactgttagaagagcacacggaggagtacgcacagaagatggaagaatacagaacgtcgttacaacagtggaaggcctggaggaaagtgcaaagggccaagaagaagaaaaggaaacaagcagcagaagaacatcccggtgatgagattgcagagccgtatcccgaggaggaccttgtgaagcccagccctccagagcccactgatcgggcagtgatagagcaggaggtgagggagagagcagcccagagcaggaggaggccttgggagcccacgctggtcccggagctaagcctggcaggaagcgtaacacccaatgaccagtgccccagagcggaggtctcgagaagggaggatgtaaagaagcgctcagtgtacttaaaagtgctgttcaacaacaaggaggtgtccaggacagtcagtcggccactaggagcagacttccgagttcactttgggcagattttcaatttgcaaatagtcaactggccggagagtttaacacttcaggtctatgaaactgtcggacacagtagtcccaccttgctagcagaagtgtttctgcctattcctgagactactgttgtcactggaagggctcctactgaagaagtggagtttagcagtaatcagcatgtgacactggaccacgagggagttggaagtggagtgcccttctcatttgaagctgatggcagtaaccagctgactctgatgacctcagggaaagtgtctcatagtgtggcatgggccattggagaaaacgggatacctttaattcctccattgtcacagcagaacatcggatttcggagtgctttgaagaaagcagatgccatctcatctattggcacatcaggactgacagacatgaaaaaattggccaagtgggcagcagagtccaagctcgacccaaatgaccccaacaatgcccctttgatgcagcttatctcggttgctaccagtggtgaatcctatgtccctgatttctttagactggagcagctgcaacaggagtttaactttgtttcagatcaagaattaaatagatccaaacgatttaggcttcttcatcttagaagccaagaggtgccagaattccgaaattataagcaagttccagtctatgaccgagaaattatggaaaaggtattccaggactatgagaaacggttacgagacagaaatgtaatagaaaccaaggaacacatagacacccatagggccatagtagccaagtacctccagcagctaaaagaaaaaatcatggactggaggccacgccatctgactcggtggaataggtattgtacctctactctgcgtcacttcttgcctctgttagaaaaaagtcaaggagaagatgtagaagatgaccacagagcagaactgctaaaacagctgggagactacaggttctctggatttcctcttcacatgccttattctgaagtgaagcctttaattgacgctgtgtatagtactggagtacataatattgatgttcctaatgttgaatttgctttagctgtatacatacacccataccccaaaaatgttttgtctgtttggatctatgttgcctctcttatacgcaacaggtaatttttttcactgtactttctgtatcatgtaaaaactacacttaggatatgagaaaattttaaattatatgcatcacatcagaagaacatattattggcaaataataaaattatcaactgttttc

SEQ ID NO: 440907 - DNA, 1563 bp, Homo sapiens
cttaggaacgggttgctaagctggtgtttttgctccaagacatggctgcagcttcccagggaggagcccaggggcatctccaacactcagcctttccctccggacccttttaaaagattcaacagcaccgtctctctccacttccatcctagaatgcagaatctgcaaagtgccttttgtaaagtttcttaagctatattctaatggatatgggctgacattaacaaggacccatcccagccaaaatgaatcccagggaagaaaaagtaaaaataattacagaggagttcattgaaaatgatgaggatgcagacatgggaagacagaataagaactcaaaggttcgaagacagccaagaaagaaacagccaccaactgctgtccccaaggaaatggtgtccgaaaaatcccaccttggcaacccccaggagcctgtgcaggaggagcccaagacccgcctcctgagtatgacagtccggagaggcccacggagagagctggttgttaaaaagagcctgggcaggccaggcacggtgactcacgtctgtaatcccagcactttggaaggccgaggcgggtaaatcacctgaggttgggagttcaagaccagcctgaccaacatggagaaaccccatctctactaaaaatacaaaaaaattagccaggcgtggtggcgcatgcctgtaatcccagctacttgggaggctgaggcatgagaattgcttgaacctgggaggtggaggttgcagtgagccgagatcggagcactgcactccagcctaggcaacagagcaagactccatctcagaaaacaaacaaacaaaaaagagcctggaacctcctcccctctctcttgctccctctctcaccatgcgacacacctgtttccccttccccttctgacataagtgaaagcttcctaaggcctcaccagaggcagatgctggcaccatgcttattgcacagtctgcagaacagtgagccaaaataaacctcttttctttataaattacccagtctcagatattcctttatagcaatgcaaaatggactaacaatacataagttagggagtgttaattagaatggaaattaaatatgcagaaactcaaaggaagatgaaattgttagggaagacatatgtgttaacctagtgaggcttgaatcagatgtttggaagaaatgagggaggtttctgaggctcctggtgaccttgccattgaggacacatatacttctccccctacacacgccttttcttcttccccagtacaatgaacattaggaattacctgctcattgtagggaaaatgaccacccttcaggcattgcttttcatgaaaagtggattagacaagaggagaagtggttacactttttaattgttacataattgttagactgttttccctatggcaaagttgggaaataagtaactgttggaaactagaggcctttggaagcaagtagactcttagattggaaaaatgtggttctaatctaaaagcaatgatacaatgagagctgttatgaattaataaaaacagaaccaaaatttaaaca

SEQ ID NO: 440908 - DNA, 1183 bp, Homo sapiens
cttaggaacgggttgctaagctggtgtttttgctccaagacatggctgcagcttcccagggaggagcccaggggcatctccaacactcagcctttccctccggacccttttaaaagattcaacagcaccgtctctctccacttccatcctagaatgcagaatctgcaaagtgccttttgtaaagtttcttaagggacccatcccagccaaaatgaatcccagggaagaaaaagtaaaaataattacagaggagttcattgaaaatgatgaggatgcagacatgggaagacagaataagaactcaaaggttcgaagacagccaagaaagaaacagccaccaactgctgtccccaaggaaatggtgtccgaaaaatcccaccttggcaacccccaggagcctgtgcaggaggagcccaagacccgcctcctgagtatgacagtccggagaggcccacggagcttacctccaattccttcaacttccagaacaggctttgcagaattttccatgaggggacgcatgagggagaaattgcaagcagcgaggtccaaagcagaaagtgcattgctgcaggaaatccccactcctcggcccagacgcttacgaagtcccagtaagaaagaattggagactgaatttggcacagagccagggaaagaggtagaaaggactcaacaagaagttgactcccaaagttactcaagagtcaagttccatgattctgcacgaaaaatcaagcctaaaccccaggttccacctggcttcccttctgcagaagaggcctataacttctttactttcaactttgatcccgaaccagaaggatcagaggaaaaaccaaaagcaagacatagagcgggaactaatcaagaggaggaggaaggggaagaagaagaaccacctgcacaaggaggaggaaaggaaatggtatttaatatcaggatggtaatgaggtgtgggtggagggctaggaggaaaaagctgatgtccctgcaagaaagaaagtggctgaggagaaacctgccaccaccaggagaatgacactccacgtctgagttgaaatcccaagtactgaattcacatggctccctgtagctctgggttagaccctacaatgtggtaggaagaaccttgattaaacctgtttatttttcttttgtggaaaaaagaattaaataatgt

SEQ ID NO: 440909 - DNA, 2177 bp, Homo sapiens
cttaggaacgggttgctaagctggtgtttttgctccaagacatggctgcagcttcccagggaggagcccaggggcatctccaacactcagcctttccctccggacccttttaaaagattcaacagcaccgtctctctccacttccatcctagaatgcagaatctgcaaagtgccttttgtaaagtttcttaagggacccatcccagccaaaatgaatcccagggaagaaaaagtaaaaataattacagaggagttcattgaaaatgatgaggatgcagacatgggaagacagaataagaactcaaaggttcgaagacagccaagaaagaaacagccaccaactgctgtccccaaggaaatggtgtccgaaaaatcccaccttggcaacccccaggagcctgtgcaggaggagcccaagacccgcctcctgagtatgacagtccggagaggcccacggagcttacctccaattccttcaacttccagaacaggctttgcagaattttccatgaggggacgcatgagggagaaattgcaagcagcgaggtccaaagcagaaagtgcattgctgcaggaaatccccactcctcggcccagacgcttacgaagtcccagtaagaaagaattggagactgaatttggcacagagccagggaaagaggtagaaaggactcaacaagaagttgactcccaaagttactcaagagtcaagttccatgattctgcacgaaaaatcaagcctaaaccccaggttccacctggcttcccttctgcagaagaggcctataacttctttactttcaactttgatcccgaaccagaaggatcagaggaaaaaccaaaagcaagacatagagcgggaactaatcaagaggaggaggaaggggaagaagaagaaccacctgcacaaggaggaggaaaggaaatggatgaggaagaactgcttaatggtgatgatgccgaggacttcctattgggcttagatcacgtggctgacgattttgtagcagtcagacctgcagattatgaaagcatccatgatcggctgcagatggaaagagaaatgctcttcatacccagtaggcagacagtccctacatataaaaagcttcctgagaatgtacagcccaggttcctggaagatgaaggcctttacaccggggtaagaccagaggtggcacgcaccaatcagaacatcatggagaacagattgctgatgcaggaccccgaaagaagatggtttggagatgacggcaggatcctagctctgccaaaccccatcaagccatttccttcaaggccgccagtactaacacaggagcagagcattaaggcagagcttgaaacactgtataaaaaggctgtaaaatacgttcacagtagtcagcatgtgatcagatctggagaccctcctggaaatttccaactggacattgatatttcagggttaatcttcactcatcatccctgttttagccgagagcatgttttggcagccaagctggcccagttatatgaccagtaccttgcaagacaccagagaaacaaggcgaaatttcttactgataagctccaagctttaagaaatgctgttcagactggccttgatccagaaaaacctcatcagtctctcgataccatccaaaaaaccatcaatgagtataaatctgaaattcgacaaacaagaaaattccgtgatgctgaacaagaaaaagatagaacattgcttaagactatcataaaagtttggaaagagatgaaatcccttcgagagttccagagatttacaaatactcccttgaaacttgttttgagaaagtaggcttttttgaaaaattattttattgggctatatcatacattaagaaaaatgtataaaacatggatacagttttaaaagtaattacaaacaaatatgcatgtaaccacttcccaggttaagaaatagaacattgcatacctgagcagcccctcccaaataacattctcctcaatccccaaaataacaactacctagacttttgtgatcattgttttcttgcttttatacttttgccaactatgtgcaatctctaagaatatatagtttaatattgcctgtatttgacttatacataactgaaagtatgttgtgtgtattctttagggaatacatacatgcttcttttcttcagtac

SEQ ID NO: 440910 - DNA, 375 bp, Homo sapiens
gttactttttaacattatgcaggatgaggaagaactgcttaatggtgatgatgccgaggacttcctattgggcttagatcacgtggctgacgattttgtagcagtcagacctgcagattatgaaagcatccatgatcggctgcagatggaaagagaaatgctcttcatacccagtaggcagacaggtacttgctctttttattttcttgttcagcttagacatcgtcacttaccttgtcatgaaatatggctagtgtataaggatgcctcatctccagaactgattccagtttctaatctaacaatcaagaaatatcttcaaacaaacaaaaaaaacacaacatggaaaaatatccattcaacaaacacttattg

SEQ ID NO: 440911 - DNA, 333 bp, Homo sapiens
tttttattttgttttgtttttgtttttgttttttaggcttacctccaattccttcaacttccagaacaggctttgcagaattttccatgaggggacgcatgagggagaaattgcaagcagcgagggtgagagaaaccacatgaatattctgttcagtgctgattgcaatcttccagggcttgtctagcttactttttatgctccaaactgcatggatttgaataccattcaatttgtctttcaagttttaaatgttaatgtcttattttgcattggcacagatgaaaattatgcttcagaatttaatgtcacttttctgaaccattttccttg

SEQ ID NO: 440912 - DNA, 5141 bp, Homo sapiens
  misc_feature (3413)..(3413): n is a, c, g, or t
  misc_feature (4067)..(4067): n is a, c, g, or t
  misc_feature (4606)..(4606): n is a, c, g, or t
cttaggaacgggttgctaagctggtgtttttgctccaagacatggctgcagcttcccagggaggagcccaggggcatctccaacactcagcctttccctccggacccttttaaaagattcaacagcaccgtctctctccacttccatcctagaatgcagaatctgcaaagtgccttttgtaaagtttcttaagggacccatcccagccaaaatgaatcccagggaagaaaaagtaaaaataattacagaggagttcattgaaaatgatgaggatgcagacatgggaagacagaataagaactcaaaggttcgaagacagccaagaaagaaacagccaccaactgctgtccccaaggaaatggtgtccgaaaaatcccaccttggcaacccccaggagcctgtgcaggaggagcccaagacccgcctcctgagtatgacagtccggagaggcccacggagcttacctccaattccttcaacttccagaacaggctttgcagaattttccatgaggggacgcatgagggagaaattgcaagcagcgaggtccaaagcagaaagtgcattgctgcaggaaatccccactcctcggcccagacgcttacgaagtcccagtaagaaagaattggagactgaatttggcacagagccagggaaagaggtagaaaggactcaacaagaagttgactcccaaagttactcaagagtcaagttccatgattctgcacgaaaaatcaagcctaaaccccaggttccacctggcttcccttctgcagaagaggcctataacttctttactttcaactttgatcccgaaccagaaggatcagaggaaaaaccaaaagcaagacatagagcgggaactaatcaagaggaggaggaaggggaagaagaagaaccacctgcacaaggaggaggaaaggaaatggatgaggaagaactgcttaatggtgatgatgccgaggacttcctattgggcttagatcacgtggctgacgattttgtagcagtcagacctgcagattatgaaagcatccatgatcggctgcagatggaaagagaaatgctcttcatacccagtaggcagacagtccctacatataaaaagcttcctgagaatgtacagcccaggttcctggaagatgaaggcctttacaccggggtaagaccagaggtggcacgcaccaatcagaacatcatggagaacagattgctgatgcaggaccccgaaagaagatggtttggagatgacggcaggatcctagctctgccaaaccccatcaagccatttccttcaaggccgccagtactaacacaggagcagagcattaaggcagagcttgaaacactgtataaaaaggctgtaaaatacgttcacagtagtcagcatgtgatcagatctggagaccctcctggaaatttccaactggacattgatatttcagggttaatcttcactcatcatccctgttttagccgagagcatgttttggcagccaagctggcccagttatatgaccagtaccttgcaagacaccagagaaacaaggcgaaatttcttactgataagctccaagctttaagaaatgctgttcagactggccttgatccagaaaaacctcatcagtctctcgataccatccaaaaaaccatcaatgagtataaatctgaaattcgacaaacaagaaaattccgtgatgctgaacaagaaaaagatagaacattgcttaagactatcataaaagtttggaaagagatgaaatcccttcgagagttccagagatttacaaatactcccttgaaacttgttttgagaaaggaaaaagctgaccagaaagcagatgaagaagcatatgaagcagaaattcaagctgaaataagtgaactgttagaagagcacacggaggagtacgcacagaagatggaagaatacagaacgtcgttacaacagtggaaggcctggaggaaagtgcaaagggccaagaagaagaaaaggaaacaagcagcagaagaacatcccggtgatgagattgcagagccgtatcccgaggaggaccttgtgaagcccagccctccagagcccactgatcgggcagtgatagagcaggaggtgagggagagagcagcccagagcaggaggaggccttgggagcccacgctggtcccggagctaagcctggcaggaagcgtaacacccaatgaccagtgccccagagcggaggtctcgagaagggaggatgtaaagaagcgctcagtgtacttaaaagtgctgttcaacaacaaggaggtgtccaggacagtcagtcggccactaggagcagacttccgagttcactttgggcagattttcaatttgcaaatagtcaactggccggagagtttaacacttcaggtctatgaaactgtcggacacagtagtcccaccttgctagcagaagtgtttctgcctattcctgagactactgttgtcactggaagggctcctactgaagaagtggagtttagcagtaatcagcatgtgacactggaccacgagggagttggaagtggagtgcccttctcatttgaagctgatggcagtaaccagctgactctgatgacctcagggaaagtgtctcatagtgtggcatgggccattggagaaaacgggatacctttaattcctccattgtcacagcagaacatcggatttcggagtgctttgaagaaagcagatgccatctcatctattggcacatcaggactgacagacatgaaaaaattggccaagtgggcagcagagtccaagctcgacccaaatgaccccaacaatgcccctttgatgcagcttatctcggttgctaccagtggtgaatcctatgtccctgatttctttagactggagcagctgcaacaggagtttaactttgtttcagatcaagaattaaatagatccaaacgatttaggcttcttcatcttagaagccaagaggtgccagaattccgaaattataagcaagttccagtctatgaccgagaaattatggaaaaggtattccaggactatgagaaacggttacgagacagaaatgtaatagaaaccaaggaacacatagacacccatagggccatagtagccaagtacctccagcaggttagagaatcagtgataaatcgtttcttaattgcaaaacaatattttcttcttgctgatatgatagtagaagaagaagttcccaatatcagcattttgggcctaagccttttcaagctggcagaacaaaagcgaccactgcggccaaggagaaaaggtcggaagaaggtgacagcccaaaacctgtctgatggagacataaagctgctggtgaacattgtgcgagcttacgacattccagtgaggaagccggcagtgagcaaattccagcagccgtcgnggtcttcaaggatgttcagtgaaaagcatgctgcttccccaagcacgtacagcccaacccacaatgctgactaccccctcggccaggttttagtacgtccctttgtagaagtctcttttcaacgaacagtttgccatacgactacggctgaaggaccaaaccctagctggaatgaagaactagaacttccatttagggctcctaatggagattatagcacagccagtctgcagtcagtgaaagatgttgtgttcattaacatttttgatgaagtactgcatgatgtcttagaggatgaccgtgaaagaggaagtggaatccatactcgtattgagagacactggctgggatgtgtgaaaatgccatttagcacaatatatttccaagcaaggattgatggaacatttaaaatagatattcccccagttcttctgggctacagtaaggagcgaaatatgattcttgagcgggggttttgattctgtccgaagcttaaagtgaaggctcctacattaccctctttattaccattgagccccagctggttcctggagagtccattcgagaaaagtttgagtctcaggaagatgagaaattacttcaagcaactgagaagtttcaagctgaatgtgccttaaagtttccaaatcgtcngtgccttacaacagtaattgatataagcggaaaaactgtttttatcacacgttatctcaaacctttaaaccctcctcaggagctccttaatgtctaccccaataatctacaggcaactgcagaactggtggctcgatatgtgtccttgattcccttcttgcctgacactgtctcatttggtggtatctgtgacctctggagcacatctgatcaatttcttgatctcctggcaggggatgaagaagaacatgcagtactattgtgtaattactttctgtctctgggtaagaaggcctggctgttgatgggcaatgctattcctgagggtccaactgcctatgtgctaacttgggagcaaggtcgttatttaatatggaatccctgcagtggacatttttatggacaatttgatacattctgtcccttgaaaaatgtgggctgtttaataggtcctgacaatgcccaagctatggaaatctttcttttcaagaagccttccatatcctggcctttccagtgttcagcctgaagagctaatntaccagcgctcagacaaagcagctgcagctgagctacaagacaggattgaaaaaatactaaaagaaaaaatcatggactggaggccacgccatctgactcggtggaataggtattgtacctctactctgcgtcacttcttgcctctgttagaaaaaagtcaaggagaagatgtagaagatgaccacagagcagaactgctaaaacagctgggagactacaggttctctggatttcctcttcacatgccttattctgaagtgaagcctttaattgacgctgtgtatagtactggagtacataatattgatgttcctaatgttgaatttgctttagctgtatacatacacccataccccaaaaatgttttgtctgtttggatctatgttgcctctcttatacgcaacaggtaatttttttcactgtactttctgtatcatgtaaaaactacacttaggatatgagaaaattttaaattatatgcatcacatcagaagaacatattattggcaaataataaaattatcaactgttttc

SEQ ID NO: 440913 - DNA, 1529 bp, Homo sapiens
cttaggaacgggttgctaagctggtgtttttgctccaagacatggctgcagcttcccagggaggagcccaggggcatctccaacactcagcctttccctccggacccttttaaaagattcaacagcaccgtctctctccacttccatcctagaatgcagaatctgcaaagtgccttttgtaaagtttcttaagggacccatcccagccaaaatgaatcccagggaagaaaaagtaaaaataattacagaggagttcattgaaaatgatgaggatgcagacatgggaagacagaataagaactcaaaggttcgaagacagccaagaaagaaacagccaccaactgctgtccccaaggaaatggtgtccgaaaaatcccaccttggcaacccccaggagcctgtgcaggaggagcccaagacccgcctcctgagtatgacagtccggagaggcccacggagagagctggttgttaaaaagagcctgggcaggccaggcacggtgactcacgtctgtaatcccagcactttggaaggccgaggcgggtaaatcacctgaggttgggagttcaagaccagcctgaccaacatggagaaaccccatctctactaaaaatacaaaaaaattagccaggcgtggtggcgcatgcctgtaatcccagctacttgggaggctgaggcatgagaattgcttgaacctgggaggtggaggttgcagtgagccgagatcggagcactgcactccagcctaggcaacagagcaagactccatctcagaaaacaaacaaacaaaaaagagcctggaacctcctcccctctctcttgctccctctctcaccatgcgacacacctgtttccccttccccttctgacataagtgaaagcttcctaaggcctcaccagaggcagatgctggcaccatgcttattgcacagtctgcagaacagtgagccaaaataaacctcttttctttataaattacccagtctcagatattcctttatagcaatgcaaaatggactaacaatacataagttagggagtgttaattagaatggaaattaaatatgcagaaactcaaaggaagatgaaattgttagggaagacatatgtgttaacctagtgaggcttgaatcagatgtttggaagaaatgagggaggtttctgaggctcctggtgaccttgccattgaggacacatatacttctccccctacacacgccttttcttcttccccagtacaatgaacattaggaattacctgctcattgtagggaaaatgaccacccttcaggcattgcttttcatgaaaagtggattagacaagaggagaagtggttacactttttaattgttacataattgttagactgttttccctatggcaaagttgggaaataagtaactgttggaaactagaggcctttggaagcaagtagactcttagattggaaaaatgtggttctaatctaaaagcaatgatacaatgagagctgttatgaattaataaaaacagaaccaaaatttaaaca

SEQ ID NO: 440914 - DNA, 1639 bp, Homo sapiens
cttaggaacgggttgctaagctggtgtttttgctccaagacatggctgcagcttcccagggaggagcccaggggcatctccaacactcagcctttccctccggacccttttaaaagattcaacagcaccgtctctctccacttccatcctagaatgcagaatctgcaaagtgccttttgtaaagtttcttaagggacccatcccagccaaaatgaatcccagggaagaaaaagtaaaaataattacagaggagttcattgaaaatgatgaggatgcagacatgggaagacagaataagaactcaaaggttcgaagacagccaagaaagaaacaggcagaagccaactcctttctcccgagcctgctggcagatcctcccccacctctccgcaggagttcccctcctaggctgggagcatcccgtgcagggtaaatcttttcaagccaccaactgctgtccccaaggaaatggtgtccgaaaaatcccaccttggcaacccccaggagcctgtgcaggaggagcccaagacccgcctcctgagtatgacagtccggagaggcccacggagagagctggttgttaaaaagagcctgggcaggccaggcacggtgactcacgtctgtaatcccagcactttggaaggccgaggcgggtaaatcacctgaggttgggagttcaagaccagcctgaccaacatggagaaaccccatctctactaaaaatacaaaaaaattagccaggcgtggtggcgcatgcctgtaatcccagctacttgggaggctgaggcatgagaattgcttgaacctgggaggtggaggttgcagtgagccgagatcggagcactgcactccagcctaggcaacagagcaagactccatctcagaaaacaaacaaacaaaaaagagcctggaacctcctcccctctctcttgctccctctctcaccatgcgacacacctgtttccccttccccttctgacataagtgaaagcttcctaaggcctcaccagaggcagatgctggcaccatgcttattgcacagtctgcagaacagtgagccaaaataaacctcttttctttataaattacccagtctcagatattcctttatagcaatgcaaaatggactaacaatacataagttagggagtgttaattagaatggaaattaaatatgcagaaactcaaaggaagatgaaattgttagggaagacatatgtgttaacctagtgaggcttgaatcagatgtttggaagaaatgagggaggtttctgaggctcctggtgaccttgccattgaggacacatatacttctccccctacacacgccttttcttcttccccagtacaatgaacattaggaattacctgctcattgtagggaaaatgaccacccttcaggcattgcttttcatgaaaagtggattagacaagaggagaagtggttacactttttaattgttacataattgttagactgttttccctatggcaaagttgggaaataagtaactgttggaaactagaggcctttggaagcaagtagactcttagattggaaaaatgtggttctaatctaaaagcaatgatacaatgagagctgttatgaattaataaaaacagaaccaaaatttaaaca

SEQ ID NO: 440915 - DNA, 1090 bp, Homo sapiens
cttaggaacgggttgctaagctggtgtttttgctccaagacatggctgcagcttcccagggaggagcccaggggcatctccaacactcagcctttccctccggacccttttaaaagattcaacagcaccgtctctctccacttccatcctagaatgcagaatctgcaaagtgccttttgtaaagtttcttaagggacccatcccagccaaaatgaatcccagggaagaaaaagtaaaaataattacagaggagttcattgaaaatgatgaggatgcagacatgggaagacagaataagaactcaaaggttcgaagacagccaagaaagaaacaggcagaagccaactcctttctcccgagcctgctggcagatcctcccccacctctccgcaggagttcccctcctaggctgggagcatcccgtgcagggtaaatcttttcaagccaccaactgctgtccccaaggaaatggtgtccgaaaaatcccaccttggcaacccccaggagcctgtgcaggaggagcccaagacccgcctcctgagtatgacagtccggagaggcccacggaagagctggttgttaaaaagagcctgggattacaggcgtgagccaccgcgcctggccaaaacaacattttaagtagaagatccaggttttagtgcagcttctgccgttaactaggcttaataaatcacaaccttggggccacagttgccttatatgtcaactgaacgtgtttagaatacacatagttaaatttccttatttttcccttggtggctgccctgtggaaaccgtttagaatattggtaagtgtgtaggaacctagtagtgtaagtatacctgggtgttccacagctgatcagtgattgccttgaaataaattcaagggcaatttattcatttttactagggagatagaactttacagcaatcagatatttggtccatatccaggttagctggtaagaggattatgggagaaaaaatggtagtagaagttattctaattccggatggaataaaaccatttgagtagtgtatcatgtgaaaagaggtggatatctgtgaagtgccatctgtgtacaac

SEQ ID NO: 440916 - DNA, 1787 bp, Homo sapiens
ggcggaagtgggaagccgaggtctgaattgcgcgtggtggccatggcggccagcggggctgtggaaccagggcccccgggggctgccgtcgccccgtcgcccgccccggccccgccgcctgcccctgatcacctgttccggcccatcagcgccgaggacgaggagcagcagcccaccgagatcgagtcgctatgcatgaactgttactgcaatggcatgacgcgcctcctgctcaccaagattcccttcttcagagaaataatagtgagctccttttcctgcgagcactgtggctggaacaacacggagatccagtcggcaggcaggatccaggaccagggagtgcgctacactttgtctgtcagggctctggaggacatgaacagagaagtggtgaagactgactctgctgccacaaggattcctgagctagattttgaaattcctgcctttagccagaaaggagctctgaccactgttgaaggattgatcacccgtgctatctctggcctggagcaggaccagcctgcacgaagggcaaacaaagatgctacagctgaaagaattgatgagttcattgtcaaactgaaggagctaaagcaagtagcctcccctttcactctgatcattgatgatccctcagggaacagttttgtggaaaacccacatgctcctcagaaagatgatgccctggtgatcacacactacaaccggacccgacagcaggaagagatgctggggcttcaagaagaagcaccagcagagaagccagaagaggaagatctcagaaatgaagtgctccagttcagcacaaactgcccagaatgcaatgcccccgctcagaccaacatgaagctagtacaaatccctcactttaaggaggttatcatcatggctaccaactgcgagaactgtgggcatcggaccaatgaggtgaaatctggaggagcagtagaacccttgggcaccaggatcaccctccacatcacagatgcctcagatatgaccagagacctcctcaagtctgagacttgcagtgtggaaatcccagagctagaatttgaactgggaatggcagtcctcgggggcaagttcaccacactggaagggctgctgaaagacatccgggaactggtgaccaaaaatcctttcacactgggcgacagttccaatcctggacagacggagagactacaggagtttagccagaagatggaccagatcatcgaaggtaacatgaaggcccactttattatggatgatccagcaggaaacagttacttgcagaatgtgtatgcgcctgaagatgatcctgagatgaaggtggagcgttacaagcgcacctttgaccaaaatgaggagctagggctcaatgacatgaagacagagggctatgaggcaggcctggctccgcaacggtagcagtgggtggctcaagggccagcctccagcgctgctctttctgtaggttatttattagtattggatgaaggcgaaggctgggagtgtctttcccaccagcccttgcccatggtggggaggacatctggtctgagtcagagatctgtgcacactttctaaacagcttgtgatgcaagtgtgagcctattgtgttacttgaccttattttggaagttttgaattggcctaggaggaaacccagaaatgaaccaggggtatgtcatcacttttttcatatcaagtcctcaccctccttccacataatgctctatcctctaaggttggaactctgaagttggagaaggtggaataaagttacacctgga

SEQ ID NO: 440917 - DNA, 1837 bp, Homo sapiens
ggcggaagtgggaagccgaggtctgaattgcgcgtggtggccatggcggccagcggggctgtggaaccagggcccccgggggctgccgtcgccccgtcgcccgccccggccccgccgcctgcccctgatcacctgttccggcccatcagcgccgaggacgaggagcagcagcccaccgagatcgagtcgctatgcatgaactgttactgcaatggcatgacgcgcctcctgctcaccaagattcccttcttcagagaaataatagtgagctccttttcctgcgagcactgtggctggaacaacacggagatccagtcggcaggcaggatccaggaccagggagtgcgctacactttgtctgtcagggctctggaggacatgaacagagaagtggtgaagactgactctgctgccacaaggattcctgagctagattttgaaattcctgcctttagccagaaaggagctctgaccactgttgaaggattgatcacccgtgctatctctggcctggagcaggaccagcctgcacgaagggcaaacaaagatgctacagctgaaagaattgatgagttcattgtcaaactgaaggagctaaagcaagtagcctcccctttcactctgatcattgatgatccctcagggaacagttttgtggaaaacccacatgctcctcagaaagatgatgccctggtgatcacacactacaaccggacccgacagcaggaagagatgctggggcttcaagaagaagcaccagcagagaagccagaagaggaagatctcagaaatgaagtgctccagttcagcacaaactgcccagaatgcaatgcccccgctcagaccaacatgaagctagtacatggtggtcttgttcgcctggaagtagatttccttaactccgttttccagaaatccctcactttaaggaggttatcatcatggctaccaactgcgagaactgtgggcatcggaccaatgaggtgaaatctggaggagcagtagaacccttgggcaccaggatcaccctccacatcacagatgcctcagatatgaccagagacctcctcaagtctgagacttgcagtgtggaaatcccagagctagaatttgaactgggaatggcagtcctcgggggcaagttcaccacactggaagggctgctgaaagacatccgggaactggtgaccaaaaatcctttcacactgggcgacagttccaatcctggacagacggagagactacaggagtttagccagaagatggaccagatcatcgaaggtaacatgaaggcccactttattatggatgatccagcaggaaacagttacttgcagaatgtgtatgcgcctgaagatgatcctgagatgaaggtggagcgttacaagcgcacctttgaccaaaatgaggagctagggctcaatgacatgaagacagagggctatgaggcaggcctggctccgcaacggtagcagtgggtggctcaagggccagcctccagcgctgctctttctgtaggttatttattagtattggatgaaggcgaaggctgggagtgtctttcccaccagcccttgcccatggtggggaggacatctggtctgagtcagagatctgtgcacactttctaaacagcttgtgatgcaagtgtgagcctattgtgttacttgaccttattttggaagttttgaattggcctaggaggaaacccagaaatgaaccaggggtatgtcatcacttttttcatatcaagtcctcaccctccttccacataatgctctatcctctaaggttggaactctgaagttggagaaggtggaataaagttacacctgga

SEQ ID NO: 440918 - DNA, 1739 bp, Homo sapiens
ggcggaagtgggaagccgaggtctgaattgcgcgtggtggccatggcggccagcggggctgtggaaccagggcccccgggggctgccgtcgccccgtcgcccgccccggccccgccgcctgcccctgatcacctgttccggcccatcagcgccgaggacgaggagcagcagcccaccgagatcgagtcgctatgcatgaactgttactgcaatggcatgacgcgcctcctgctcaccaagattcccttcttcagagaaataatagtgagctccttttcctgcgagcactgtggctggaacaacacggagatccagtcggcaggcaggatccaggaccagggagtgcgctacactttgtctgtcagggctctggaggacatgaacagagaagtggtgaagactgactctgctgccacaaggattcctgagctagattttgaaattcctgcctttagccagaaaggagctctgaccactgttgaaggattgatcacccgtgctatctctggcctggagcaggaccagcctgcacgaagggcaaacaaagatgctacagctgaaagaattgatgagttcattgtcaaactgaaggagctaaagcaagtagcctcccctttcactctgatcattgatgatccctcagggaacagttttgtggaaaacccacatgctcctcagaaagatgatgccctggtgatcacacactacaaccggacccgacagcaggaagagatgctggggcttcaagtgctccagttcagcacaaactgcccagaatgcaatgcccccgctcagaccaacatgaagctagtacaaatccctcactttaaggaggttatcatcatggctaccaactgcgagaactgtgggcatcggaccaatgaggtgaaatctggaggagcagtagaacccttgggcaccaggatcaccctccacatcacagatgcctcagatatgaccagagacctcctcaagtctgagacttgcagtgtggaaatcccagagctagaatttgaactgggaatggcagtcctcgggggcaagttcaccacactggaagggctgctgaaagacatccgggaactggtgaccaaaaatcctttcacactgggcgacagttccaatcctggacagacggagagactacaggagtttagccagaagatggaccagatcatcgaaggtaacatgaaggcccactttattatggatgatccagcaggaaacagttacttgcagaatgtgtatgcgcctgaagatgatcctgagatgaaggtggagcgttacaagcgcacctttgaccaaaatgaggagctagggctcaatgacatgaagacagagggctatgaggcaggcctggctccgcaacggtagcagtgggtggctcaagggccagcctccagcgctgctctttctgtaggttatttattagtattggatgaaggcgaaggctgggagtgtctttcccaccagcccttgcccatggtggggaggacatctggtctgagtcagagatctgtgcacactttctaaacagcttgtgatgcaagtgtgagcctattgtgttacttgaccttattttggaagttttgaattggcctaggaggaaacccagaaatgaaccaggggtatgtcatcacttttttcatatcaagtcctcaccctccttccacataatgctctatcctctaaggttggaactctgaagttggagaaggtggaataaagttacacctgga

SEQ ID NO: 440919 - DNA, 1772 bp, Homo sapiens
cccggttatttcatcacggcgtggcgttcagtgcttagttacgtgtctggtgcctgcacttcacaggctagcgtcgccccagacgccagcctaggcacgcgagctagccctgatcacctgttccggcccatcagcgccgaggacgaggagcagcagcccaccgagatcgagtcgctatgcatgaactgttactgcaatggcatgacgcgcctcctgctcaccaagattcccttcttcagagaaataatagtgagctccttttcctgcgagcactgtggctggaacaacacggagatccagtcggcaggcaggatccaggaccagggagtgcgctacactttgtctgtcagggctctggaggacatgaacagagaagtggtgaagactgactctgctgccacaaggattcctgagctagattttgaaattcctgcctttagccagaaaggagctctgaccactgttgaaggattgatcacccgtgctatctctggcctggagcaggaccagcctgcacgaagggcaaacaaagatgctacagctgaaagaattgatgagttcattgtcaaactgaaggagctaaagcaagtagcctcccctttcactctgatcattgatgatccctcagggaacagttttgtggaaaacccacatgctcctcagaaagatgatgccctggtgatcacacactacaaccggacccgacagcaggaagagatgctggggcttcaagaagaagcaccagcagagaagccagaagaggaagatctcagaaatgaagtgctccagttcagcacaaactgcccagaatgcaatgcccccgctcagaccaacatgaagctagtacaaatccctcactttaaggaggttatcatcatggctaccaactgcgagaactgtgggcatcggaccaatgaggtgaaatctggaggagcagtagaacccttgggcaccaggatcaccctccacatcacagatgcctcagatatgaccagagacctcctcaagtctgagacttgcagtgtggaaatcccagagctagaatttgaactgggaatggcagtcctcgggggcaagttcaccacactggaagggctgctgaaagacatccgggaactggtgaccaaaaatcctttcacactgggcgacagttccaatcctggacagacggagagactacaggagtttagccagaagatggaccagatcatcgaaggtaacatgaaggcccactttattatggatgatccagcaggaaacagttacttgcagaatgtgtatgcgcctgaagatgatcctgagatgaaggtggagcgttacaagcgcacctttgaccaaaatgaggagctagggctcaatgacatgaagacagagggctatgaggcaggcctggctccgcaacggtagcagtgggtggctcaagggccagcctccagcgctgctctttctgtaggttatttattagtattggatgaaggcgaaggctgggagtgtctttcccaccagcccttgcccatggtggggaggacatctggtctgagtcagagatctgtgcacactttctaaacagcttgtgatgcaagtgtgagcctattgtgttacttgaccttattttggaagttttgaattggcctaggaggaaacccagaaatgaaccaggggtatgtcatcacttttttcatatcaagtcctcaccctccttccacataatgctctatcctctaaggttggaactctgaagttggagaaggtggaataaagttacacctgga

SEQ ID NO: 440920 - DNA, 1702 bp, Homo sapiens
tggtactggtgttgtcatcagctcaagtgagataagatttgtgaaaatgctttgtaaatgttgtctgagggtatgaaatgagcagtagttgttatgaatagtattctcaccatttggacagcctggctcacaccacctgtactattcgaaaggagcagtctggaccctgtggagtggcgagagggagagacagctgggctgcggtctgatggaaggggacggtctggttattacttgaggagaagctgttctgcagtctctttgtactgaacgtattcttttcttcccaggacatgaacagagaagtggtgaagactgactctgctgccacaaggattcctgagctagattttgaaattcctgcctttagccagaaaggagctctgaccactgttgaaggattgatcacccgtgctatctctggcctggagcaggaccagcctgcacgaagggcaaacaaagatgctacagctgaaagaattgatgagttcattgtcaaactgaaggagctaaagcaagtagcctcccctttcactctgatcattgatgatccctcagggaacagttttgtggaaaacccacatgctcctcagaaagatgatgccctggtgatcacacactacaaccggacccgacagcaggaagagatgctggggcttcaagaagaagcaccagcagagaagccagaagaggaagatctcagaaatgaagtgctccagttcagcacaaactgcccagaatgcaatgcccccgctcagaccaacatgaagctagtacaaatccctcactttaaggaggttatcatcatggctaccaactgcgagaactgtgggcatcggaccaatgaggtgaaatctggaggagcagtagaacccttgggcaccaggatcaccctccacatcacagatgcctcagatatgaccagagacctcctcaagtctgagacttgcagtgtggaaatcccagagctagaatttgaactgggaatggcagtcctcgggggcaagttcaccacactggaagggctgctgaaagacatccgggaactggtgaccaaaaatcctttcacactgggcgacagttccaatcctggacagacggagagactacaggagtttagccagaagatggaccagatcatcgaaggtaacatgaaggcccactttattatggatgatccagcaggaaacagttacttgcagaatgtgtatgcgcctgaagatgatcctgagatgaaggtggagcgttacaagcgcacctttgaccaaaatgaggagctagggctcaatgacatgaagacagagggctatgaggcaggcctggctccgcaacggtagcagtgggtggctcaagggccagcctccagcgctgctctttctgtaggttatttattagtattggatgaaggcgaaggctgggagtgtctttcccaccagcccttgcccatggtggggaggacatctggtctgagtcagagatctgtgcacactttctaaacagcttgtgatgcaagtgtgagcctattgtgttacttgaccttattttggaagttttgaattggcctaggaggaaacccagaaatgaaccaggggtatgtcatcacttttttcatatcaagtcctcaccctccttccacataatgctctatcctctaaggttggaactctgaagttggagaaggtggaataaagttacacctgga

SEQ ID NO: 440921 - DNA, 327 bp, Homo sapiens
ctttggttggggctttactttgtggtttctctaactgatgaggtggcacctgacataactgatgaggtggcacctgagcatttctcccactccagggcagggtgttggggacactgaggtatacctgccaacttgcgacctgcatctttgctattttaggaagaagcaccagcagagaagccagaagaggaagatctcagaaatgaagtgagtcacattggctactggtgaggaaggagcagagttgtgggctgagactgatgctgttcagcatctgtcttccttgtcaccaacatagatgaccactagcataccaactgagtgtct

SEQ ID NO: 440922 - DNA, 305 bp, Homo sapiens
cctttggttggggctttactttgtggtttctctaactgatgaggtggcacctgacataactgatgaggtggcacctgagcatttctcccactccagggcagggtgttggggacactgaggtatacctgccaacttgcgacctgcatctttgctattttaggaagaagcaccagcagagaagccagaagaggaagatctcagaaatgaagtgagtcacattggctactggtgaggaaggagcagagttgtgggctgagactgatgctgttcagcatctgtcttccttgtcaccaacatagatgacc

SEQ ID NO: 440923 - DNA, 232 bp, Homo sapiens
gttgggaacttgccctcttctggaggactctgtgggctgcctcttgtgaatatttcctgcagttctgggaccagcatatgtttgtgtggggtttggctttgtttttccccagatggtggtcttgttcgcctggaagtagatttccttaactccgttttccagaaatccctcactttaaggaggttatcatcatggctaccaactgcgagaactgtgggcatcggaccaatga

SEQ ID NO: 440924 - DNA, 414 bp, Homo sapiens
gcggccgcgagcggcgggtgggtagggcttgtgccgggacgagccgggggtcagacccagccaggtgggcccggccggggaccccgaggagcgcccggagatagtagggcggggaaagggagtttcattgatttttttccttagctactttctacttcaccagggcatgacgcgcctcctgctcaccaagattcccttcttcagagaaataatagtgagctccttttcctgcgagcactgtggctggaacaacacggagatccagtcggcaggcaggatccaggaccagggagtgcgctacactttgtctgtcagggctctggaggtgagaggacctcagagcaggtacctcagtattctagagagagattcggtactggggtcagagctctggtccaggcggtcggatcttaa

SEQ ID NO: 440925 - DNA, 2826 bp, Homo sapiens
ggcggaagtgggaagccgaggtctgaattgcgcgtggtggccatggcggccagcggggctgtggaaccagggcccccgggggctgccgtcgccccgtcgcccgccccggccccgccgcctgcccctgatcacctgttccggcccatcagcgccgaggacgaggagcagcagcccaccgagatcgagtcgctatgcatgaactgttactgcaatggcatgacgcgcctcctgctcaccaagattcccttcttcagagaaataatagtgagctccttttcctgcgagcactgtggctggaacaacacggagatccagtcggcaggcaggatccaggaccagggagtgcgctacactttgtctgtcagggctctggaggacatgaacagagaagtggtgaagactgactctgctgccacaaggattcctgagctagattttgaaattcctgcctttagccagaaaggagctctgaccactgttgaaggattgatcacccgtgctatctctggcctggagcaggaccagcctgcacgaagggcaaacaaagatgctacagctgaaagaattgatgagttcattgtcaaactgaaggagctaaagcaagtagcctcccctttcactctgatcattgatgatccctcagggaacagttttgtggaaaacccacatgctcctcagaaagatgatgccctggtgatcacacactacaaccggacccgacagcaggaagagatgctggggcttcaagaagaagcaccagcagagaagccagaagaggaagatctcagaaatgaagtgctccagttcagcacaaactgcccagaatgcaatgcccccgctcagaccaacatgaagctagtacaaatccctcactttaaggaggttatcatcatggctaccaactgcgagaactgtgggcatcggaccaatgaggtgaaatctggaggagcagtagaacccttgggcaccaggatcaccctccacatcacagatgcctcagatatgaccagagacctcctcaagtctgagacttgcagtgtggaaatcccagagctagaatttgaactgggaatggcagtcctcgggggcaagttcaccacactggaagggctgctgaaagacatccgggaactggtgaccaaaaatcctttcacactgggcgacagttccaatcctggacagacggagagactacaggagtttagccagaagatggaccagatcatcgaaggtaacatgaaggcccactttattatggatgatccagcaggaaacagttacttgcagaatgtgtatgcgcctgaagatgatcctgagatgaaggtggagcgttacaagcgcacctttgaccaaaatgaggagctagggctcaatgacatgaagacagagggctatgaggcaggcctggctccgcaacggtagcagtgggtggctcaagggccagcctccagcgctgctctttctgtaggttatttattagtattggatgaaggcgaaggctgggagtgtctttcccaccagcccttgcccatggtggggaggacatctggtctgagtcagagatctgtgcacactttctaaacagcttgtgatgcaagtgtgagcctattgtgttacttgaccttattttggaagttttgaattggcctaggaggaaacccagaaatgaaccaggggtatgtcatcacttttttcatatcaagtcctcaccctccttccacataatgctctatcctctaaggttggaactctgaagttggagaaggtggaataaagttacacctggagtttgttgttggttttgagtatataaaatactgactttgaacaggaaaggagtctcctgaggggagaccgagtccagcacaagtgaaggagttaccattgaaatgatgactttcaaacagcactggcctctgtattgaccctatccttgtttgatatcatgctgttagaattcagcctcctaaagaaaattttcccgtgtatctactgtaatttggggattgcagctggcatttaattcattccttcagcagatgcttgcttatctactttatgccaagcacaccacagaacagaggacaaaataaatctctttcatggaacttgaagtctagtggggaaaaatgacaataaacagatgaggaaaacagtacatcagatggtgattagtgtcatggaggaatgtaaagcagggaatggggctgggttgtgcaaggaaatggggagtagggaagatcttctgaacaagaaggtgataatttgacatttgggcaaagctgaggaggaggtcagggagtgagctgtgtgggtatctgggggaagagatttcctggcagagggaactgcaaatgctagagctgtgaggttagagccagtgggggtacctgatcagttagccctactctcagttagaaatgttgaaacacattcatccagagagaaaggaggctctctgcagttcttctgaaagttaaggaccagtgaacactctgctgcttgggccctggacttcccagccagtgttctttgcactgtagtctcctgcctctcataaacaaaaggtgactcctgtggtgcagactgcagggtatttgttcaataaagaccagttcattgattaggaaaaaaaaaaaaaaaaaaaaaaaaaaaaaaatttttggggcggccctgtgggccccttggaaaagagctttttgaagaaccattcgcggtggggggcggcgggggccccagtggggttagcgtggaacacaggtggggccaaagagggtgttccccagagaggagagacaccgggggccaagagacaagagcggcgga

SEQ ID NO: 440926 - DNA, 1287 bp, Homo sapiens
ggcggaagtgggaagccgaggtctgaattgcgcgtggtggccatggcggccagcggggctgtggaaccagggcccccgggggctgccgtcgccccgtcgcccgccccggccccgccgcctgcccctgatcacctgttccggcccatcagcgccgaggacgaggagcagcagcccaccgagatcgagtcgctatgcatgaactgttactgcaatggcatgacgcgcctcctgctcaccaagattcccttcttcagagaaataatagtgagctccttttcctgcgagcactgtggctggaacaacacggagatccagtcggcaggcaggatccaggaccagggagtgcgctacactttgtctgtcagggctctggaggacatgaacagagaagtggtgaagactgactctgctgccacaaggattcctgagctagattttgaaattcctgcctttagccagaaaggagctctgaccactgttgaaggattgatcacccgtgctatctctggcctggagcaggaccagcctgcacgaagggcaaacaaagatgctacagctgaaagaattgatgagttcattgtcaaactgaaggagctaaagcaagtagcctcccctttcactctgatcattgatgatccctcagggaacagttttgtggaaaacccacatgctcctcagaaagatgatgccctggtgatcacacactacaaccggacccgacagcaggaagagatgctggggcttcaagaagaagcaccagcagagaagccagaagaggaagatctcagaaatgaagtgctccagttcagcacaaactgcccagaatgcaatgcccccgctcagaccaacatgaagctagtacaaatccctcactttaaggaggttatcatcatggctaccaactgcgagaactgtgggcatcggaccaatgaggtgaaatctggaggagcagtagaacccttgggcaccaggatcaccctccacatcacagatgcctcagatatgaccagagacctcctcaagtctgagacttgcagtgtggaaatcccagagctagaatttgaactgggaatggcagtcctcgggggcaagttcaccacactggaagggctgctgaaagacatccgggaactggtgaccaaaaatcctttcacactgggcgacagttccaatcctggacagacggagagactacaggagtttagccagaagatggaccagatcatcgaaggtaacatgagcccactttattatggatgtccgacgaccgagatctgtagagcgacc

SEQ ID NO: 440927 - DNA, 1772 bp, Homo sapiens
ggtatgaatctgctcatcatggacaaatgataccatatgcttgagcgacatcagtggcccccgggggctgccgtcgccccgtcgcccgccccggccccgccgcctgcccctgatcacctgttccggcccatcagcgccgaggacgaggagcagcagcccaccgagatcgagtcgctatgcatgaactgttactgcaatggcatgacgcgcctcctgctcaccaagattcccttcttcagagaaataatagtgagctccttttcctgcgagcactgtggctggaacaacacggagatccagtcggcaggcaggatccaggaccagggagtgcgctacactttgtctgtcagggctctggaggacatgaacagagaagtggtgaagactgactctgctgccacaaggattcctgagctagattttgaaattcctgcctttagccagaaaggagctctgaccactgttgaaggattgatcacccgtgctatctctggcctggagcaggaccagcctgcacgaagggcaaacaaagatgctacagctgaaagaattgatgagttcattgtcaaactgaaggagctaaagcaagtagcctcccctttcactctgatcattgatgatccctcagggaacagttttgtggaaaacccacatgctcctcagaaagatgatgccctggtgatcacacactacaaccggacccgacagcaggaagagatgctggggcttcaagaagaagcaccagcagagaagccagaagaggaagatctcagaaatgaagtgctccagttcagcacaaactgcccagaatgcaatgcccccgctcagaccaacatgaagctagtacaaatccctcactttaaggaggttatcatcatggctaccaactgcgagaactgtgggcatcggaccaatgaggtgaaatctggaggagcagtagaacccttgggcaccaggatcaccctccacatcacagatgcctcagatatgaccagagacctcctcaagtctgagacttgcagtgtggaaatcccagagctagaatttgaactgggaatggcagtcctcgggggcaagttcaccacactggaagggctgctgaaagacatccgggaactggtgaccaaaaatcctttcacactgggcgacagttccaatcctggacagacggagagactacaggagtttagccagaagatggaccagatcatcgaaggtaacatgaaggcccactttattatggatgatccagcaggaaacagttacttgcagaatgtgtatgcgcctgaagatgatcctgagatgaaggtggagcgttacaagcgcacctttgaccaaaatgaggagctagggctcaatgacatgaagacagagggctatgaggcaggcctggctccgcaacggtagcagtgggtggctcaagggccagcctccagcgctgctctttctgtaggttatttattagtattggatgaaggcgaaggctgggagtgtctttcccaccagcccttgcccatggtggggaggacatctggtctgagtcagagatctgtgcacactttctaaacagcttgtgatgcaagtgtgagcctattgtgttacttgaccttattttggaagttttgaattggcctaggaggaaacccagaaatgaaccaggggtatgtcatcacttttttcatatcaagtcctcaccctccttccacataatgctctatcctctaaggttggaactctgaagttggagaaggtggaataaagttacacctgga

SEQ ID NO: 440928 - DNA, 525 bp, Homo sapiens
ggcggaagtgggaagccgaggtctgaattgcgcgtggtggccatggcggccagcggggctgtggaaccagggcccccgggggctgccgtcgccccgtcgcccgccccggccccgccgcctgcccctgatcacctgttccggcccatcagcgccgaggacgaggagcagcagcccaccgagatcgagtcgctatgcatgaactgttactgcaatggcatgacgcgcctcctgctcaccaagattcccttcttcagagaaataatagtgagctccttttcctgcgagcactgtggctggaacaacacggagatccagtcggcaggcaggatccaggaccagggagtgcgctacactttgtctgtcagggctctggaggacatgaacagagaagtggtgaagactgactctgctgccacaaggattcctgagctagattttgaaattcctgcctttagccagaaaggagctctgaccactgttgaaggattgatcacccgtagcggggtgttccgggatcctctaaat

SEQ ID NO: 440929 - DNA, 1818 bp, Homo sapiens
cctcagcctcccaagtagccggaattacaggcatgtgccaccatgctgggctaatttttgtatttttagtggagacggtgtttcaccatgttggccaggctgttcttgaactcctggcctcaagtgacccgcccacattggcctcccaaagtgctgggattacaggcgtgagcccccgtgcccagcaaggattgctgttttaattcttgtatcttcgttgcttctttggtctttgcttaaacaaaacaataaagcttaatagttggggagaatgctgttaccagtgtcctctaggaaggctgttagcatatggctctactgagcagcagtgccatctggtgcctgagatcatgtgcttcaggcagttgtcacactgcatctacagccaagcatcacagaaacacttcactcatgtggtcagggaaggtgggactgattcacatgttagagacaggtcagatgggaaaattaaggcccaacttggtgttggggaataaccatactctggtctttcaagtgtagtagctgatgattcccaagaaactgatgaattttctgagtccagacaaaatttccccaagcctgctctctctgttggatatacataatagagaaagtcaaatcagccctttggggtttgtggtaaaaattcactcacccattgaagcctaaggtggctttgtaccttccagatctctcagcaaatcccctgggcagaaatgtcacctgcttgccatgtctttgaggggttcaggtcagcctggagaacaggctccttaggtcaaaaaccttgttttaagagccactgtggtacagtcaatgtaacccacttgtgcagaagccatgcttccaaggaaggtctcaggttgacaactagacatcaaatctgagaagccaactgtggagtaatgtgtttttttctctgtggacaagagtgatcagaaaggtgcttgatcttgaacaattgatccatgatgaaaaaatgaccattagctctcccccagaagcgtctgtgtttgctgaatggagctgagattttgatccgctatcagactccagaaagatccaggagttccaagaacatggcaaagagtcaaaatcttaggacaaggaattaaaatgccagaatgcaaatgtccaacaggcctggtagctcacagctatcaacaccctagaattccacactgcctcactgcagttgctcaaggatgggtatgtttctgtctctgaaattcgggaaaaagccttaagtgccagagaaggtgcttccaagactgtctgcagaattcctttcctagggtctgtctctgggtacccaaaagggcagagaaggaaccctaagattagcatagagccactcatctctcctcccctccccaccccttcttcccctgcttccattccccatggctctctcctctgactgtgaaacacttcctctccagcagtgttgggaaagttctggacctctactggatctagccataaatggtggtcttcagaaaaatggagattgtggctgccagcacccacaagacagcagcctcatgccatgcaggcagcaagccatcctgaacagcgttcctcccagagtctgtttcctcacctgctgttcactggtgagaggaaaagggacttgttctcccttgaccagttttctagttttcctgttcccaccctggtctttgcctgatgacagagaaactttctaaaaaaaaacaaaaacaaaagctataaaaaatctgcaaaacaaaaaagaaaggaggagaaacaaaacatgttgtggggcgcatggggccttggaagaggctttaaaac

SEQ ID NO: 440930 - DNA, 824 bp, Homo sapiens
  misc_feature (376)..(377): n is a, c, g, or t
  misc_feature (379)..(379): n is a, c, g, or t
  misc_feature (383)..(384): n is a, c, g, or t
  misc_feature (388)..(388): n is a, c, g, or t
  misc_feature (401)..(401): n is a, c, g, or t
  misc_feature (408)..(408): n is a, c, g, or t
  misc_feature (424)..(424): n is a, c, g, or t
  misc_feature (426)..(426): n is a, c, g, or t
  misc_feature (438)..(438): n is a, c, g, or t
  misc_feature (440)..(440): n is a, c, g, or t
  misc_feature (442)..(442): n is a, c, g, or t
  misc_feature (454)..(454): n is a, c, g, or t
  misc_feature (464)..(464): n is a, c, g, or t
  misc_feature (467)..(467): n is a, c, g, or t
  misc_feature (469)..(469): n is a, c, g, or t
  misc_feature (475)..(475): n is a, c, g, or t
  misc_feature (477)..(477): n is a, c, g, or t
aaatttattgccagatattttcccactgagaatactgaggttattcacataatcacttccttaacaaaggaagaagcacttttaacttgggctgcattccctttgtgagggtccacatttaggatcctcctgctaccataaggccccttttggggttctttgggtgtggctgcatctcaccatgttgaggattgcctttttttttttttttttttttttaaacacaagaagcctttgtgctcgtgttcctcccagggcgtggagtgtgcggggggtgcaactcttgggcctccagcgtgaacccttctgtgcctctcccgaggtttcaggcaattctcctcctggccctcagcctctcccaagttaccgggaattnnangggnntgtngtgcccccagtgngggggcntaattttgggtttttntnagggggagaacngngngtgtttacccantgtgtgtggncgngngttgtntntttgaaccttccgtggccctccagttgacccgcccacattgggcccccccaaagggggggggatatcaacggggggtgacccccgcgggccccagaagcggaattggccggtataaaatcctggggatcctcacgagggcatacatgaggcctcgggcttaacacaaaaccaaatgacgcctaaacggcggcggaaaaggggcgtcaccagtgggtcctctaggaagggggcggcagcatatggccaaatgggagcagaggcccacggtgtccgaaacaaagtgctccaggacgagtcacacggcatcaagcgcagattcaagaaacataccctgtgccgaagggga

SEQ ID NO: 440931 - DNA, 1060 bp, Homo sapiens
aacactcttgttgatacaaagaaagatctagaattaaaaactttacaggaggaaagtgaaaaggctggaactaactcacccaaaatatttagcaagttaatcataaataagataatagattttgagtctttcggttttcagtggagaactttatatttgattttgcctaatgtgtgaaactgtataaagcatactctatagtatatgttcctgctgcctggaagcagacacatcatcaaagtgtgtgtgtgtgcaagagaaaacacattaatttctctttctcagtttgtcataagaggggagtgctataaagaatcttctggctgggtgtggtggctcaaacctgtaatcccagaactttgggagaccaaggcttgcagtgagctgtgattgcaccactgcactccagcctgaatgacagagcaggaccgtgtctcaaaaaaaaaaaaaaaaggaatctttttacctgcaaattgtaaggtactcgagggcagacattggcattttcagatacatgtgaccctgtgtgtttgtgtgaatttctgtgcacacgtacatccccctcccacgccttgacataatgcatacagataaatgttgaggttcagtggcagctgttttgtttcccacagacattttacttagattattctggaaaacattctgaagagaatcacaagcattgatcataaagttagaagatgtgatgtttaagacaacatggacataggaattgaaattttctttcccattgtctctcgagtgtttttgaggccagtgtttcttactcttgcttgagtatacctggataacaaaatccagtttctaagatttctgccctagagattctgatggatttggtgtgctgcgtgcccctagaccctggagattcttaggacaaagcaaatttgggacactggggaagaaaagaaaaagagaataagataaagttcacctgaaaggatattccaggaatggggagcagagtttgcaaggtcatagaggctcaaaagaacaatggagaaagggcagtagatggtgggggtaggaagaacaaagc

SEQ ID NO: 440932 - DNA, 683 bp, Homo sapiens
  misc_feature (672)..(672): n is a, c, g, or t
  misc_feature (674)..(674): n is a, c, g, or t
ggcagagggcggggcctgcttctcctcagcttcaggcggctgcgacgagccctcaggcgaacctctcggctttcccgcgcggcgccgcctcttgctgcgcctccgcctcctcctctgctccgccaccggcttcctcctcctgagcagtcagcccgcgcgccggccggctccgttatggcgacccgcagccctggcgtcgtgattagtgatgatgaaccaggttatgaccttgatttattttgcatacctaatcattatgctgaggatttggaaagggtgtttattcctcatggactaattatggacaggactgaacgtcttgctcgagatgtgatgaaggagatgggaggccatcacattgtagccctctgtgtgctcaaggggggctataaattctttgctgacctgctggattacatcaaagcactgaatagaaatagtgatagatccattcctatgactgtagattttatcagactgaagagctattgtaatgaccagtcaacaggggacataaaagtaattggtggagatgatctctcaactttaactggaaagaatgtcttgatgtggaagatataatgacactggcaaaacaagcagactttgctttcctggtcagcatatatccgaggtcaagtcgcaactgccggtggaccccagaggttgggnangccagcttg

SEQ ID NO: 440933 - DNA, 266 bp, Homo sapiens
tcaattttcacatcaaagacagcatcttacttttctaacacacggtggtataattaacaatattcaatcaccgtgtgttagaaaagtaagaagcagtcaattttcacatcaaagacagcatctaagaagttttgttctgtcctggaattattttagtagtgtttcagtaatgttgactgtattttccaacttgttcaaattattaccagtgaatctttgtcagcagttcccttttaaatgcaaatcaataaattcccaaaaattta

SEQ ID NO: 440934 - DNA, 355 bp, Homo sapiens
tcaattttcacatcaaagacagcatcttacttttctaacacacggtggtataattaacaatattcaatcaccgtgtgttagaaaagtaagaagcagtcaattttcacatcaaagacagcatctaagaagttttgttctgtcctggaattattttagtagtgtttcagtaatgttgactgtattttccaacttgttcaaattattaccagtgaatctttgtcagcagttcccttttaaatgcaaatcaataaattcccaaaaatttaactgctttatgaattcaatttaaaaatccttaaaataagtcctgtctctttaaaaaaacctatgcatagttatcatttctctacaaatt

SEQ ID NO: 440935 - DNA, 1510 bp, Homo sapiens
ggcagagggcggggcctgcttctcctcagcttcaggcggctgcgacgagccctcaggcgaacctctcggctttcccgcgcggcgccgcctcttgctgcgcctccgcctcctcctctgctccgccaccggcttcctcctcctgagcagtcagcccgcgcgccggccggctccgttatggcgacccgcagccctggcgtcgtgattagtgatgatgaaccaggttatgaccttgatttattttgcatacctaatcattatgctgaggatttggaaagggtgtttattcctcatggactaattatggacaggactgaacgtcttgctcgagatgtgatgaaggagatgggaggccatcacattgtagccctctgtgtgctcaaggggggctataaattctttgctgacctgctggattacatcaaagcactgaatagaaatagtgatagatccattcctatgactgtagattttatcagactgaagagctattgtaatgaccagtcaacaggggacataaaagtaattggtggagatgatctctcaactttaactggaaagaatgtcttgattgtggaagatataattgacactggcaaaacaatgcagactttgctttccttggtcaggcagtataatccaaagatggtcaaggtcgcaagcttgctggtgaaaaggaccccacgaagtgttggatataagccagactttgttggatttgaaattccagacaagtttgttgtaggatatgcccttgactataatgaatacttcagggatttgaatcatgtttgtgtcattagtgaaactggaaaagcaaaatacaaagcctaagatgagagttcaagttgagtttggaaacatctggagtcctattgacatcgccagtaaaattatcaatgttctagttctgtggccatctgcttagtagagctttttgcatgtatcttctaagaattttatctgttttgtactttagaaatgtcagttgctgcattcctaaactgtttatttgcactatgagcctatagactatcagttccctttgggcggattgttgtttaacttgtaaatgaaaaaattctcttaaaccacagcactattgagtgaaacattgaactcatatctgtaagaaataaagagaagatatattagttttttaattggtattttaatttttatatatgcaggaaagaatagaagtgattgaatattgttaattataccaccgtgtgttagaaaagtaagaagcagtcaattttcacatcaaagacagcatctaagaagttttgttctgtcctggaattattttagtagtgtttcagtaatgttgactgtattttccaacttgttcaaattattaccagtgaatctttgtcagcagttcccttttaaatgcaaatcaataaattcccaaaaatttaactgctttatgaattcaatttaaaaatccttaaaataagtcctgtctctttaaaaaaacctatgcatagttatcatttctctacaaatt

SEQ ID NO: 440936 - DNA, 1611 bp, Homo sapiens
ctggcgtcgtgattagtgatgatgaaccaggttatgaccttgatttattttgcatacctaatcattatgctgaggatttggaaagggtgtttattcctcatggactaattatggacaggactgaacgtcttgctcgagatgtgatgaaggagatgggaggccatcacattgtagccctctgtgtgctcaaggggggctataaattctttgctgacctgctggattacatcaaagcactgaatagaaatagtgatagatccattcctatgactgtagattttatcagactgaagagctattgtattagtgatgatgaaccaggttatgaccttgatttattttgcatacctaatcattatgctgaggatttggaaagggtgtttattcctcatggactaattatggacaggactgaacgtcttgctcgagatgtgatgaaggagatgggaggccatcacattgtagccctctgtgtgctcaaggggggctataaattctttgctgacctgctggattacatcaaagcactgaatagaaatagtgatagatccattcctatgactgtagattttatcagactgaagagctattgtaatgaccagtcaacaggggacataaaagtaattggtggagatgatctctcaactttaactggaaagaatgtcttgattgtggaagatataattgacactggcaaaacaatgcagactttgctttccttggtcaggcagtataatccaaagatggtcaaggtcgcaagcttgctggtgaaaaggaccccacgaagtgttggatataagccagactttgttggatttgaaattccagacaagtttgttgtaggatatgcccttgactataatgaatacttcagggatttgaatcatgtttgtgtcattagtgaaactggaaaagcaaaatacaaagcctaagatgagagttcaagttgagtttggaaacatctggagtcctattgacatcgccagtaaaattatcaatgttctagttctgtggccatctgcttagtagagctttttgcatgtatcttctaagaattttatctgttttgtactttagaaatgtcagttgctgcattcctaaactgtttatttgcactatgagcctatagactatcagttccctttgggcggattgttgtttaacttgtaaatgaaaaaattctcttaaaccacagcactattgagtgaaacattgaactcatatctgtaagaaataaagagaagatatattagttttttaattggtattttaatttttatatatgcaggaaagaatagaagtgattgaatattgttaattataccaccgtgtgttagaaaagtaagaagcagtcaattttcacatcaaagacagcatctaagaagttttgttctgtcctggaattattttagtagtgtttcagtaatgttgactgtattttccaacttgttcaaattattaccagtgaatctttgtcagcagttcccttttaaatgcaaatcaataaattcccaaaaatttaactgctttatgaattcaatttaaaaatccttaaaataagtcctgtctctttaaaaaaacctatgcatagttatcatttctctacaaatt

SEQ ID NO: 440937 - DNA, 848 bp, Homo sapiens
ggcagagggcggggcctgcttctcctcagcttcaggcggctgcgacgagccctcaggcgaacctctcggctttcccgcgcggcgccgcctcttgctgcgcctccgcctcctcctctgctccgccaccggcttcctcctcctgagcagtcagcccgcgcgccggccggctccgttatggcgacccgcagccctggcgtcgtgattagtgatgatgaaccaggttatgaccttgatttattttgcatacctaatcattatgctgaggatttggaaagggtgtttattcctcatggactaattatggacaggactgaacgtcttgctcgagatgtgatgaaggagatgggaggccatcacattgtagccctctgtgtgctcaaggggggctataaattctttgctgacctgctggattacatcaaagcactgaatagaaatagtgatagatccattcctatgactgtagattttatcagactgaagagctattgtaatgaccagtcaacaggggacataaaagtaattggtggagatgatctctcaactttaactggaaagaatgtcttgattgtggaagatataattgacactggcaaaacaatgcagactttgctttccttggtcaggcagtataatccaaagatggtcaaggtcgcaaggtatgtatgacattttgacacagaatattttcctcatttgaagggggattaagtgattgcttctttttaaggataaatgttttcaactgtcattttatcttcgaaaagtaatgtaatctcatataagacttaagatataatccttttaaataattttgtcatgtgttaataaagctcataattacagtc

SEQ ID NO: 440938 - DNA, 357 bp, Homo sapiens
aatgaccagtcaacaggggacataaaagtaattggtggagatgatctctcaactttaactggaaaggtatgtatcttgaaagggaagaaaaaaaagcacttcataccgagtcaattagtaacagtgtgctttcaatcaatcactaagagataatttacatagtataactaaatgggttatttaacccttggaagcagtctaggttaattatcgttccctaggtcatgtagtaaaaagacagtagaatccaacattaaccttaaatgtccatattgtcaagtactgctgtctgcctctgtgggactctaatttgggatccttcaaaaaacattgatgggggaaaagatagcctttaaa

SEQ ID NO: 440939 - DNA, 517 bp, Homo sapiens
gggcgcctatagtctcagctactcgggaggctgaggcaggagaatggcgtgaacccgggaggcagagcttgcagtgagcagagatcgtgccactgcactccagtctgggtgacagagcaagactccgtctcaaaaaaaaaaacaaaaacaagaaacaaattaaactaatgtgatagactactgctttgttttcaaaagatacactccccaaaagttactgatctaaaatacagtagtactatctctgtttagtaagaaccctgacaactaatagtgttcttatatgtaaaatgctattcttgcctttcatttcagaatatactttttaaatgtgaatttctggatttttttttatagcatgtttgtgtcattagtgaaactggaaaagcaaaatacaaagcctaagatgagagttcaagttgagtttggaaacatctggagtcctattgacatcgccagtaaaattatcaatgttctagttctgtggccatctgcttagtagagctttttgcatgta

SEQ ID NO: 440940 - DNA, 1421 bp, Homo sapiens
ggcagagggcggggcctgcttctcctcagcttcaggcggctgcgacgagccctcaggcgaacctctcggctttcccgcgcggcgccgcctcttgctgcgcctccgcctcctcctctgctccgccaccggcttcctcctcctgagcagtcagcccgcgcgccggccggctccgttatggcgacccgcagccctggcgtcgtgattagtgatgatgaaccaggttatgaccttgatttattttgcatacctaatcattatgctgaggatttggaaagggtgtttattcctcatggactaattatggacaggactgaacgtcttgctcgagatgtgatgaaggagatgggaggccatcacattgtagccctctgtgtgctcaaggggggctataaattctttgctgacctgctggattacatcaaagcactgaatagaaatagtgatagatccattcctatgactgtagattttatcagactgaagagctattgtaatgaccagtcaacaggggacataaaagtaattggtggagatgatctctcaactttaactggaaagaatgtcttgattgtggaagatataattgacactggcaaaacaatgcagactttgctttccttggtcaggcagtataatccaaagatggtcaaggtcgcaagcttgctggtgaaaaggaccccacgaagtgttggatataagccagactttgttggatttgaaattccagacaagtttgttgtaggatatgcccttgactataatgaatacttcagggatttgaatcatgtttgtgtcattagtgaaactggaaaagcaaaatacaaagcctaagatgagagttcaagttgagtttggaaacatctggagtcctattgacatcgccagtaaaattatcaatgttctagttctgtggccatctgcttagtagagctttttgcatgtatcttctaagaattttatctgttttgtactttagaaatgtcagttgctgcattcctaaactgtttatttgcactatgagcctatagactatcagttccctttgggcggattgttgtttaacttgtaaatgaaaaaattctcttaaaccacagcactattgagtgaaacattgaactcatatctgtaagaaataaagagaagatatattagttttttaattggtattttaatttttatatatgcaggaaagaatagaagtgattgaatattgttaattataccaccgtgtgttagaaaagtaagaagcagtcaattttcacatcaaagacagcatctaagaagttttgttctgtcctggaattattttagtagtgtttcagtaatgttgactgtattttccaacttgttcaaattattaccagtgaatctttgtcagcagttcccttttaaatgcaaatcaataaattcccaaaaattta

SEQ ID NO: 440941 - DNA, 1367 bp, Homo sapiens
ggcagagggcggggcctgcttctcctcagcttcaggcggctgcgacgagccctcaggcgaacctctcggctttcccgcgcggcgccgcctcttgctgcgcctccgcctcctcctctgctccgccaccggcttcctcctcctgagcagtcagcccgcgcgccggccggctccgttatggcgacccgcagccctggcgtcgtgattagtgatgatgaaccaggttatgaccttgatttattttgcatacctaatcattatgctgaggatttggaaagggtgtttattcctcatggactaattatggacaggactgaacgtcttgctcgagatgtgatgaaggagatgggaggccatcacattgtagccctctgtgtgctcaaggggggctataaattctttgctgacctgctggattacatcaaagcactgaatagaaatagtgatagatccattcctatgactgtagattttatcagactgaagagctattgtaatgaccagtcaacaggggacataaaagtaattggtggagatgatctctcaactttaactggaaagaatgtcttgattgtggaagatataattgacactggcaaaacaatgcagactttgctttccttggtcaggcagtataatccaaagatggtcaaggtcgcaagcttgctggtgaaaaggaccccacgaagtgttggatataagccagactttgttggatttgaaattccagacaagtttgttgtaggatatgcccttgactataatgaatacttcagggatttgaatcatgtttgtgtcattagtgaaactggaaaagcaaaatacaaagcctaagatgagagttcaagttgagtttggaaacatctggagtcctattgacatcgccagtaaaattatcaatgttctagttctgtggccatctgcttagtagagctttttgcatgtatcttctaagaattttatctgttttgtactttagaaatgtcagttgctgcattcctaaactgtttatttgcactatgagcctatagactatcagttccctttgggcggattgttgtttaacttgtaaatgaaaaaattctcttaaaccacagcactattgagtgaaacattgaactcatatctgtaagaaataaagagaagatatattagttttttaattggtattttaatttttatatatgcaggaaagaatagaagtgattgaatattgttaattataccaccgtgtgttagtctgtcctggaattattttagtagtgtttcagtaatgttgactgtattttccaacttgttcaaattattaccagtgaatctttgtcagcagttcccttttaaatgcaaatcaataaattcccaaaaattta

SEQ ID NO: 440942 - DNA, 1244 bp, Homo sapiens
aggccggtacctctgttgagggtctgtatgtcacctatcactgtaatcaagacgcgctatgagagtgggaaatagggctaggagagtatctacgctgcccctctgtgtgctcaaggggggctataaattctttgctgacctgctggattacatcaaagcactgaatagaaatagtgatagatccattcctatgactgtagattttatcagactgaagagctattgtaatgaccagtcaacaggggacataaaagtaattggtggagatgatctctcaactttaactggaaagaatgtcttgattgtggaagatataattgacactggcaaaacaatgcagactttgctttccttggtcaggcagtataatccaaagatggtcaaggtcgcaagcttgctggtgaaaaggaccccacgaagtgttggatataagccagactttgttggatttgaaattccagacaagtttgttgtaggatatgcccttgactataatgaatacttcagggatttgaatcatgtttgtgtcattagtgaaactggaaaagcaaaatacaaagcctaagatgagagttcaagttgagtttggaaacatctggagtcctattgacatcgccagtaaaattatcaatgttctagttctgtggccatctgcttagtagagctttttgcatgtatcttctaagaattttatctgttttgtactttagaaatgtcagttgctgcattcctaaactgtttatttgcactatgagcctatagactatcagttccctttgggcggattgttgtttaacttgtaaatgaaaaaattctcttaaaccacagcactattgagtgaaacattgaactcatatctgtaagaaataaagagaagatatattagttttttaattggtattttaatttttatatatgcaggaaagaatagaagtgattgaatattgttaattataccaccgtgtgttagaaaagtaagaagcagtcaattttcacatcaaagacagcatctaagaagttttgttctgtcctggaattattttagtagtgtttcagtaatgttgactgtattttccaacttgttcaaattattaccagtgaatctttgtcagcagttcccttttaaatgcaaatcaataaattcccaaaaatttaactgctttatgaattcaatttaaaaatccttaaaataagtcctgtctctttaaaaaaacctatgcatagttatcatttctctacaaatt

SEQ ID NO: 440943 - DNA, 2803 bp, Homo sapiens
caggaggtgggagctgcccgcttcaggcctcagaatcactcttggagttagatatttaagaatccttcctgccttgacagccagtctgtgaaatgatggtgaggtgggcacttctttgtggtgagtgcagaattctggggagacattgccaaggaattttactggaagactccatgccctggcccattccttcggtacaactttgatgtgactaaagggaaaatcttcattgagtggatgaaaggagcaactaccaacatctgctacaatgtactggatcgaaatgtccatgagaaaaagcttggagataaagttgctttttactgggagggcaatgagccaggggagaccactcagatcacataccatcagcttctggtccaagtgtgtcagttcagcaatgttctccgaaaacagggcattcagaagggggaccgagtggccatctacatgcctatgatcccagagcttgtggtggccatgctggcatgtgcccgcattggggctttgcactccattgtgtttgcaggcttctcttcagagtctctatgtgaacggatcttggattccagctgcagtcttctcatcactacagatgccttctacaggggggaaaagcttgtgaacctgaaggagctggctgacgaggccctgcagaagtgtcaggagaagggtttcccagtaagatgctgcattgtggtcaagcacctggggcgggcagagctcggcatgggtgactccaccagccagtcccccccaattaagaggtcatgcccagatgtgcagatctcatggaaccaagggattgacttgtggtggcatgagctcatgcaagaggcaggggatgagtgtgagcccgagtggtgtgatgccgaggacccactcttcatcctgtacaccagtggctccacaggcaaacccaagggtgtggttcacacagttgggggctacatgctctatgtagccacaaccttcaagtatgtgtttgacttccatgcagaggatgtgttctggtgcacggcagacattggttggatcactggtcattcctacgtcacctatgggccactggccaatggtgccaccagtgttttgtttgaggggattcccacatatccggacgtgaaccgcctgtggagcattgtggacaaatacaaggtgaccaagttctacacagcacccacagccatccgtctgctcatgaagtttggagatgagcctgtcaccaagcatagccgggcatccttgcaggtgttaggcacagtgggtgaacccatcaaccctgaggcctggctatggtaccaccgggtggtaggtgcccagcgctgccccatcgtggacaccttctggcaaacagagacaggtggccacatgttgactccccttcctggtgccacacccatgaaacccggttctgctactttcccattctttggtgtagctcctgcaatcctgaatgagtccggggaagagttggaaggtgaagctgaaggttatctggtgttcaagcagccctggccagggatcatgcgcacagtctatgggaaccacgaacgctttgagacaacctactttaagaagtttcctggatactatgttacaggagatggctgccagcgggaccaggatggctattactggatcactggcaggattgatgacatgctcaatgtatctggacacctgctgagtacagcagaggtggagtcagcacttgtggaacatgaggctgttgcagaggcagctgtggtgggccaccctcatcctgtgaagggtgaatgcctctactgctttgtcaccttgtgtgatggccacaccttcagccccaagctcaccgaggagctcaagaagcagattagagaaaagattggccccattgccacaccagactacatccagaatgcacctggcttgcctaaaacccgctcagggaaaatcatgaggcgagtgcttcggaagattgctcagaatgaccatgacctcggggacatgtctactgtggctgacccatctgtcatcagtcacctcttcagccaccgctgcctgaccatccagtgaacatgatcctgacctttacctaggattcctcctgctccaaactttgcccatcctctttgccccctcaggagtgctgagggccagtgttgacccacactaccctcccttgaccagctgtctgggaccggaaaccagctttgtctccaggtagagacaacatcctgtgactgccaggcagaaaggacagggcccaggtcagcctcagtctgctgtgcctccagactgcagagctctcagaacccagaacagagacgaaaaggctacctctcctacccaagttaagtgttcaaaggggatgtgagggcctccactgaagcagggaggcagctgtgtaatcctatgtcagctctcttaggaagccccagtacttatattgggcatgcacttgcccttaaaaacaatgatttgtgagtccaggaacaatttactatttttaaaatattttgctgcttctgttctgggtctgaattcccttttgtgccagatgccagtactgtctgcccattggctccaggggctgtatgggcagattcagtctccagagggtattcagatcatctgcttctttgaaggagtaaatgtgttttgttcctagggccagaggagcttgtcttccttgtcctctgttcccaccctcccctgaacagaacccagcccataagagacattctcagatgaaactctgttttcttgccccagtcaggctcaagccctgtggttgtaggaataaagcctgtgatctcaa

SEQ ID NO: 440944 - DNA, 847 bp, Homo sapiens
  misc_feature (713)..(713): n is a, c, g, or t
  misc_feature (727)..(727): n is a, c, g, or t
ttggtatttggggctactcagcatagagggtagagactgcctgccttttctctcctggtcccacctcagctgaccctctgtcagctcgaatcagctggaagagccagagttaagaggcctactcaggaagggccctatggacattgtgcccactaggcagcatggggcttactaaggcctggaatgtctgttgctccccaaagatgccttctacaggggggaaaagcttgtgaacctgaaggagctggctgacgaggccctgcagaagtgtcaggagaagggtttcccagtaagatgctgcattgtggtcaagcacctggggcgggcagagctcggcatgggtgactccaccagccagtcccccccaattaagaggtcatgcccagatgtgcagatctcatggaaccaagggattgacttgtggtggcatgagctcatgcaagaggcaggggatgagtgtgagcccgagtggtgtgatgccgaggacccactcttcatcctgtacaccagtggctccacaggcaaacccaagggtgtggttcacacagttgggggctacatgctctatgtagccacaaccttcaagtatgtgtttgacttccatgcagaggatgtgttctggtgcacggcagacattggttggatcactggtcattcctacgtcacctatgggccactggccaatggtgccaccagtgttttgtgtggggggnttcccccatattcnggacgtgaaccggctgtggggcctttgtgggcccttcaccgggggcccagtttttcacaatggccccaggccgtcgctggtcatgaaggttggcgattacctgtttcccagcataccggg

SEQ ID NO: 440945 - DNA, 876 bp, Homo sapiens
ccgagtatgaaatgtgttctggagtgtaaagtgaatatacaggttggcggattaagcagatcgtgaggaacagtagagccaattaatgatcgtgaagtccgtgtaacgccgctggtggctacaaaaaatgttgagccgtatatgccgtcggaaatggtgacgggagattcgaagtactctgaggcttgtacggagggtaaaatatagagcccagtaaatttgtcataagccgtgcttgaatatttcggattcggtggttctctataagactatggtgagctcaggtgattgatactgctcgtcctattaaaacggatgtgtccaggagtgggactatagggtctgtcttggaggcccagttatcactgcaagttgttggggaggggctagagcaagctgctccccaaaccacaaacagattccagggggccccatgggctgattgccctcttcctgttcagtctccactagtctcccactaggataataataatagccaacatttctagaatactttgtgccaccgctaggctaagtgctttaaatgaattaccccacttaatccctagagtcacctccatgaaacagatcttattgttaccttcatgctaaagatgatgaaactgagactcatggaagttaaatcacttgcccaaggccacactgctagaaaggtggcatttaaactctagcaggctcattctacagcctgagttccataagataaaatgagagagtaaagagacaagtgtgttgagagcaagagaagcagtgaacctgaggctgtctctgtgggcagggacttgaggaggaaacaggtggggaacaaagccatctctactttgatttttgaaaagtctggctaagggtgctgaa

SEQ ID NO: 440946 - DNA, 624 bp, Homo sapiens
cttggggcacttggcctagttagatagtggagaactggactgacatgtgtgaagaatttggggttctggggccccttgggagttgagtcagagttgcctcattcctcttcttgggttctgtctcccgtttgcttctagactttcccattctttggtgtagctcctgcaatcctgaatgagtccggggaagagttggaaggtgaagctgaaggttatctgctgcttaggactgaaacttcatggttggaggtttgctcactgagagaccctggaggggaccctcgatactttgcctgcatctcttccttttgggccataagtctcctaagggcgttttaagagttgctcagattcctgatggtacctttttgggtctggaagactaagtcccatcttcttttgacaaagattctacagaaaggaggctttataacatagtagaaaatcacgtaggatctggagtcaccctgcctgggttcgaatcctagctctgcctcttctgtgacctcagataagttatttaacacctctgaatctacattttctaatttgtaaaatagggttaaagtggtgtctctggccgggcacggtggctcacacctgtaatcctagcactttgggagg

SEQ ID NO: 440947 - DNA, 361 bp, Homo sapiens
agttcggcctgttttctcagtcccggcacccgccgcgaccgcaaaggcggccgcggttctaggaacttgacgtgatggggcttcctgaggagcgggtccggagcggcagcgggagccggggccaggaggaagctggagccggaggccgggcgcggagttggtctccgccgcccgaggtcagccgctccgcgcacgtcccctcgctgcagcgctaccgcgagctgcaccggcgctccgtggaggagccgcggggtgaggcccggcccgggcgggcctggggtgtcagtgaggagaagagtgggggctccctgggggagtcgggggctcccttgggaagctgaggggtgggtgaggagatgga

SEQ ID NO: 440948 - DNA, 2882 bp, Homo sapiens
caggaggtgggagctgcccgcttcaggcctcagaatcactcttggagttagatatttaagaatccttcctgccttgacagccagtctgtgaaatgatggtgaggtgggcacttctttgtggtgagtgcagatctggatggagatttgtgaaggcaaggagattgaagacatgtcctcataagagggagaaaatctgagctggttccaggaattctggggagacattgccaaggaattttactggaagactccatgccctggcccattccttcggtacaactttgatgtgactaaagggaaaatcttcattgagtggatgaaaggagcaactaccaacatctgctacaatgtactggatcgaaatgtccatgagaaaaagcttggagataaagttgctttttactgggagggcaatgagccaggggagaccactcagatcacataccatcagcttctggtccaagtgtgtcagttcagcaatgttctccgaaaacagggcattcagaagggggaccgagtggccatctacatgcctatgatcccagagcttgtggtggccatgctggcatgtgcccgcattggggctttgcactccattgtgtttgcaggcttctcttcagagtctctatgtgaacggatcttggattccagctgcagtcttctcatcactacagatgccttctacaggggggaaaagcttgtgaacctgaaggagctggctgacgaggccctgcagaagtgtcaggagaagggtttcccagtaagatgctgcattgtggtcaagcacctggggcgggcagagctcggcatgggtgactccaccagccagtcccccccaattaagaggtcatgcccagatgtgcagatctcatggaaccaagggattgacttgtggtggcatgagctcatgcaagaggcaggggatgagtgtgagcccgagtggtgtgatgccgaggacccactcttcatcctgtacaccagtggctccacaggcaaacccaagggtgtggttcacacagttgggggctacatgctctatgtagccacaaccttcaagtatgtgtttgacttccatgcagaggatgtgttctggtgcacggcagacattggttggatcactggtcattcctacgtcacctatgggccactggccaatggtgccaccagtgttttgtttgaggggattcccacatatccggacgtgaaccgcctgtggagcattgtggacaaatacaaggtgaccaagttctacacagcacccacagccatccgtctgctcatgaagtttggagatgagcctgtcaccaagcatagccgggcatccttgcaggtgttaggcacagtgggtgaacccatcaaccctgaggcctggctatggtaccaccgggtggtaggtgcccagcgctgccccatcgtggacaccttctggcaaacagagacaggtggccacatgttgactccccttcctggtgccacacccatgaaacccggttctgctactttcccattctttggtgtagctcctgcaatcctgaatgagtccggggaagagttggaaggtgaagctgaaggttatctggtgttcaagcagccctggccagggatcatgcgcacagtctatgggaaccacgaacgctttgagacaacctactttaagaagtttcctggatactatgttacaggagatggctgccagcgggaccaggatggctattactggatcactggcaggattgatgacatgctcaatgtatctggacacctgctgagtacagcagaggtggagtcagcacttgtggaacatgaggctgttgcagaggcagctgtggtgggccaccctcatcctgtgaagggtgaatgcctctactgctttgtcaccttgtgtgatggccacaccttcagccccaagctcaccgaggagctcaagaagcagattagagaaaagattggccccattgccacaccagactacatccagaatgcacctggcttgcctaaaacccgctcagggaaaatcatgaggcgagtgcttcggaagattgctcagaatgaccatgacctcggggacatgtctactgtggctgacccatctgtcatcagtcacctcttcagccaccgctgcctgaccatccagtgaacatgatcctgacctttacctaggattcctcctgctccaaactttgcccatcctctttgccccctcaggagtgctgagggccagtgttgacccacactaccctcccttgaccagctgtctgggaccggaaaccagctttgtctccaggtagagacaacatcctgtgactgccaggcagaaaggacagggcccaggtcagcctcagtctgctgtgcctccagactgcagagctctcagaacccagaacagagacgaaaaggctacctctcctacccaagttaagtgttcaaaggggatgtgagggcctccactgaagcagggaggcagctgtgtaatcctatgtcagctctcttaggaagccccagtacttatattgggcatgcacttgcccttaaaaacaatgatttgtgagtccaggaacaatttactatttttaaaatattttgctgcttctgttctgggtctgaattcccttttgtgccagatgccagtactgtctgcccattggctccaggggctgtatgggcagattcagtctccagagggtattcagatcatctgcttctttgaaggagtaaatgtgttttgttcctagggccagaggagcttgtcttccttgtcctctgttcccaccctcccctgaacagaacccagcccataagagacattctcagatgaaactctgttttcttgccccagtcaggctcaagccctgtggttgtaggaataaagcctgtgatctcaa

SEQ ID NO: 440949 - DNA, 3076 bp, Homo sapiens
agttcggcctgttttctcagtcccggcacccgccgcgaccgcaaaggcggccgcggttctaggaacttgacgtgatggggcttcctgaggagcgggtccggagcggcagcgggagccggggccaggaggaagctggagccggaggccgggcgcggagttggtctccgccgcccgaggtcagccgctccgcgcacgtcccctcgctgcagcgctaccgcgagctgcaccggcgctccgtggaggagccgcgggaattctggggagacattgccaaggaattttactggaagactccatgccctggcccattccttcggtacaactttgatgtgactaaagggaaaatcttcattgagtggatgaaaggagcaactaccaacatctgctacaatgtactggatcgaaatgtccatgagaaaaagcttggagataaagttgctttttactgggagggcaatgagccaggggagaccactcagatcacataccatcagcttctggtccaagtgtgtcagttcagcaatgttctccgaaaacagggcattcagaagggggaccgagtggccatctacatgcctatgatcccagagcttgtggtggccatgctggcatgtgcccgcattggggctttgcactccattgtgtttgcaggcttctcttcagagtctctatgtgaacggatcttggattccagctgcagtcttctcatcactacagatgccttctacaggggggaaaagcttgtgaacctgaaggagctggctgacgaggccctgcagaagtgtcaggagaagtaagtgtgtttggctactgtctgagttgactgagcctttccccagtgccaggttccctttgtcccctctaccctaaatggacatgggtgggtcttgccaagttccctttgagccaacaaggctaccactttaggcttttctcttctccaggggtttcccagtaagatgctgcattgtggtcaagcacctggggcgggcagagctcggcatgggtgactccaccagccagtcccccccaattaagaggtcatgcccagatgtgcagatctcatggaaccaagggattgacttgtggtggcatgagctcatgcaagaggcaggggatgagtgtgagcccgagtggtgtgatgccgaggacccactcttcatcctgtacaccagtggctccacaggcaaacccaagggtgtggttcacacagttgggggctacatgctctatgtagccacaaccttcaagtatgtgtttgacttccatgcagaggatgtgttctggtgcacggcagacattggttggatcactggtcattcctacgtcacctatgggccactggccaatggtgccaccagtgttttgtttgaggggattcccacatatccggacgtgaaccgcctgtggagcattgtggacaaatacaaggtgaccaagttctacacagcacccacagccatccgtctgctcatgaagtttggagatgagcctgtcaccaagcatagccgggcatccttgcaggtgttaggcacagtgggtgaacccatcaaccctgaggcctggctatggtaccaccgggtggtaggtgcccagcgctgccccatcgtggacaccttctggcaaacagagacaggtggccacatgttgactccccttcctggtgccacacccatgaaacccggttctgctactttcccattctttggtgtagctcctgcaatcctgaatgagtccggggaagagttggaaggtgaagctgaaggttatctggtgttcaagcagccctggccagggatcatgcgcacagtctatgggaaccacgaacgctttgagacaacctactttaagaagtttcctggatactatgttacaggagatggctgccagcgggaccaggatggctattactggatcactggcaggattgatgacatgctcaatgtatctggacacctgctgagtacagcagaggtggagtcagcacttgtggaacatgaggctgttgcagaggcagctgtggtgggccaccctcatcctgtgaagggtgaatgcctctactgctttgtcaccttgtgtgatggccacaccttcagccccaagctcaccgaggagctcaagaagcagattagagaaaagattggccccattgccacaccagactacatccagaatgcacctggcttgcctaaaacccgctcagggaaaatcatgaggcgagtgcttcggaagattgctcagaatgaccatgacctcggggacatgtctactgtggctgacccatctgtcatcagtcacctcttcagccaccgctgcctgaccatccagtgaacatgatcctgacctttacctaggattcctcctgctccaaactttgcccatcctctttgccccctcaggagtgctgagggccagtgttgacccacactaccctcccttgaccagctgtctgggaccggaaaccagctttgtctccaggtagagacaacatcctgtgactgccaggcagaaaggacagggcccaggtcagcctcagtctgctgtgcctccagactgcagagctctcagaacccagaacagagacgaaaaggctacctctcctacccaagttaagtgttcaaaggggatgtgagggcctccactgaagcagggaggcagctgtgtaatcctatgtcagctctcttaggaagccccagtacttatattgggcatgcacttgcccttaaaaacaatgatttgtgagtccaggaacaatttactatttttaaaatattttgctgcttctgttctgggtctgaattcccttttgtgccagatgccagtactgtctgcccattggctccaggggctgtatgggcagattcagtctccagagggtattcagatcatctgcttctttgaaggagtaaatgtgttttgttcctagggccagaggagcttgtcttccttgtcctctgttcccaccctcccctgaacagaacccagcccataagagacattctcagatgaaactctgttttcttgccccagtcaggctcaagccctgtggttgtaggaataaagcctgtgatctcaa

SEQ ID NO: 440950 - DNA, 2150 bp, Homo sapiens
aagctggaagcacaaaactaacggctaggtacgaggctgggtgttgggtcagcacctggggcgggcagagctcggcatgggtgactccaccagccagtcccccccaattaagaggtcatgcccagatgtgcagatctcatggaaccaagggattgacttgtggtggcatgagctcatgcaagaggcaggggatgagtgtgagcccgagtggtgtgatgccgaggacccactcttcatcctgtacaccagtggctccacaggcaaacccaagggtgtggttcacacagttgggggctacatgctctatgtagccacaaccttcaagtatgtgtttgacttccatgcagaggatgtgttctggtgcacggcagacattggttggatcactggtcattcctacgtcacctatgggccactggccaatggtgccaccagtgttttgtttgaggggattcccacatatccggacgtgaaccgcctgtggagcattgtggacaaatacaaggtgaccaagttctacacagcacccacagccatccgtctgctcatgaagtttggagatgagcctgtcaccaagcatagccgggcatccttgcaggtgttaggcacagtgggtgaacccatcaaccctgaggcctggctatggtaccaccgggtggtaggtgcccagcgctgccccatcgtggacaccttctggcaaacagagacaggtggccacatgttgactccccttcctggtgccacacccatgaaacccggttctgctactttcccattctttggtgtagctcctgcaatcctgaatgagtccggggaagagttggaaggtgaagctgaaggttatctggtgttcaagcagccctggccagggatcatgcgcacagtctatgggaaccacgaacgctttgagacaacctactttaagaagtttcctggatactatgttacaggagatggctgccagcgggaccaggatggctattactggatcactggcaggattgatgacatgctcaatgtatctggacacctgctgagtacagcagaggtggagtcagcacttgtggaacatgaggctgttgcagaggcagctgtggtgggccaccctcatcctgtgaagggtgaatgcctctactgctttgtcaccttgtgtgatggccacaccttcagccccaagctcaccgaggagctcaagaagcagattagagaaaagattggccccattgccacaccagactacatccagaatgcacctggcttgcctaaaacccgctcagggaaaatcatgaggcgagtgcttcggaagattgctcagaatgaccatgacctcggggacatgtctactgtggctgacccatctgtcatcagtcacctcttcagccaccgctgcctgaccatccagtgaacatgatcctgacctttacctaggattcctcctgctccaaactttgcccatcctctttgccccctcaggagtgctgagggccagtgttgacccacactaccctcccttgaccagctgtctgggaccggaaaccagctttgtctccaggtagagacaacatcctgtgactgccaggcagaaaggacagggcccaggtcagcctcagtctgctgtgcctccagactgcagagctctcagaacccagaacagagacgaaaaggctacctctcctacccaagttaagtgttcaaaggggatgtgagggcctccactgaagcagggaggcagctgtgtaatcctatgtcagctctcttaggaagccccagtacttatattgggcatgcacttgcccttaaaaacaatgatttgtgagtccaggaacaatttactatttttaaaatattttgctgcttctgttctgggtctgaattcccttttgtgccagatgccagtactgtctgcccattggctccaggggctgtatgggcagattcagtctccagagggtattcagatcatctgcttctttgaaggagtaaatgtgttttgttcctagggccagaggagcttgtcttccttgtcctctgttcccaccctcccctgaacagaacccagcccataagagacattctcagatgaaactctgttttcttgccccagtcaggctcaagccctgtggttgtaggaataaagcctgtgatctcaa

SEQ ID NO: 440951 - DNA, 2411 bp, Homo sapiens
ttggtatttggggctactcagcatagagggtagagactgcctgccttttctctcctggtcccacctcagctgaccctctgtcagctcgaatcagctggaagagccagagttaagaggcctactcaggaagggccctatggacattgtgcccactaggcagcatggggcttactaaggcctggaatgtctgttgctccccaaagatgccttctacaggggggaaaagcttgtgaacctgaaggagctggctgacgaggccctgcagaagtgtcaggagaagggtttcccagtaagatgctgcattgtggtcaagcacctggggcgggcagagctcggcatgggtgactccaccagccagtcccccccaattaagaggtcatgcccagatgtgcagatctcatggaaccaagggattgacttgtggtggcatgagctcatgcaagaggcaggggatgagtgtgagcccgagtggtgtgatgccgaggacccactcttcatcctgtacaccagtggctccacaggcaaacccaagggtgtggttcacacagttgggggctacatgctctatgtagccacaaccttcaagtatgtgtttgacttccatgcagaggatgtgttctggtgcacggcagacattggttggatcactggtcattcctacgtcacctatgggccactggccaatggtgccaccagtgttttgtttgaggggattcccacatatccggacgtgaaccgcctgtggagcattgtggacaaatacaaggtgaccaagttctacacagcacccacagccatccgtctgctcatgaagtttggagatgagcctgtcaccaagcatagccgggcatccttgcaggtgttaggcacagtgggtgaacccatcaaccctgaggcctggctatggtaccaccgggtggtaggtgcccagcgctgccccatcgtggacaccttctggcaaacagagacaggtggccacatgttgactccccttcctggtgccacacccatgaaacccggttctgctactttcccattctttggtgtagctcctgcaatcctgaatgagtccggggaagagttggaaggtgaagctgaaggttatctggtgttcaagcagccctggccagggatcatgcgcacagtctatgggaaccacgaacgctttgagacaacctactttaagaagtttcctggatactatgttacaggagatggctgccagcgggaccaggatggctattactggatcactggcaggattgatgacatgctcaatgtatctggacacctgctgagtacagcagaggtggagtcagcacttgtggaacatgaggctgttgcagaggcagctgtggtgggccaccctcatcctgtgaagggtgaatgcctctactgctttgtcaccttgtgtgatggccacaccttcagccccaagctcaccgaggagctcaagaagcagattagagaaaagattggccccattgccacaccagactacatccagaatgcacctggcttgcctaaaacccgctcagggaaaatcatgaggcgagtgcttcggaagattgctcagaatgaccatgacctcggggacatgtctactgtggctgacccatctgtcatcagtcacctcttcagccaccgctgcctgaccatccagtgaacatgatcctgacctttacctaggattcctcctgctccaaactttgcccatcctctttgccccctcaggagtgctgagggccagtgttgacccacactaccctcccttgaccagctgtctgggaccggaaaccagctttgtctccaggtagagacaacatcctgtgactgccaggcagaaaggacagggcccaggtcagcctcagtctgctgtgcctccagactgcagagctctcagaacccagaacagagacgaaaaggctacctctcctacccaagttaagtgttcaaaggggatgtgagggcctccactgaagcagggaggcagctgtgtaatcctatgtcagctctcttaggaagccccagtacttatattgggcatgcacttgcccttaaaaacaatgatttgtgagtccaggaacaatttactatttttaaaatattttgctgcttctgttctgggtctgaattcccttttgtgccagatgccagtactgtctgcccattggctccaggggctgtatgggcagattcagtctccagagggtattcagatcatctgcttctttgaaggagtaaatgtgttttgttcctagggccagaggagcttgtcttccttgtcctctgttcccaccctcccctgaacagaacccagcccataagagacattctcagatgaaactctgttttcttgccccagtcaggctcaagccctgtggttgtaggaataaagcctgtgatctcaa

SEQ ID NO: 440952 - DNA, 3239 bp, Homo sapiens
agttcggcctgttttctcagtcccggcacccgccgcgaccgcaaaggcggccgcggttctaggaacttgacgtgatggggcttcctgaggagcgggtccggagcggcagcgggagccggggccaggaggaagctggagccggaggccgggcgcggagttggtctccgccgcccgaggtcagccgctccgcgcacgtcccctcgctgcagcgctaccgcgagctgcaccggcgctccgtggaggagccgcgggaattctggggagacattgccaaggaattttactggaagactccatgccctggcccattccttcggtacaactttgatgtgactaaagggaaaatcttcattgagtggatgaaaggagcaactaccaacatctgctacaatgtactggatcgaaatgtccatgagaaaaagcttggagataaagttgctttttactgggagggcaatgagccaggggagaccactcagatcacataccatcagcttctggtccaagtgtgtcagttcagcaatgttctccgaaaacagggcattcagaagggggaccgagtggccatctacatgcctatgatcccagagcttgtggtggccatgctggcatgtgcccgcattggggctttgcactccattgtgtttgcaggcttctcttcagagtctctatgtgaacggatcttggattccagctgcagtcttctcatcactacagatgccttctacaggggggaaaagcttgtgaacctgaaggagctggctgacgaggccctgcagaagtgtcaggagaagggtttcccagtaagatgctgcattgtggtcaagcacctggggcgggcagagctcggcatgggtgactccaccagccagtcccccccaattaagaggtcatgcccagatgtgcagatctcatggaaccaagggattgacttgtggtggcatgagctcatgcaagaggcaggggatgagtgtgagcccgagtggtgtgatgccgaggacccactcttcatcctgtacaccagtggctccacaggcaaacccaagggtgtggttcacacagttgggggctacatgctctatgtagccacaaccttcaagtatgtgtttgacttccatgcagaggatgtgttctggtgcacggcagacattggttggatcactggtcattcctacgtcacctatgggccactggccaatggtgccaccagtgttttgtttgaggggattcccacatatccggacgtgaaccgcctgtggagcattgtggacaaatacaaggtgaccaagttctacacagcacccacagccatccgtctgctcatgaagtttggagatgagcctgtcaccaagcatagccgggcatccttgcaggtgttaggcacagtgggtgaacccatcaaccctgaggcctggctatggtaccaccgggtggtaggtgcccagcgctgccccatcgtggacaccttctggcaaacagagacaggtggccacatgttgactccccttcctggtgccacacccatgaaacccggttctgctactttcccattctttggtgtagctcctgcaatcctgaatgagtccggggaagagttggaaggtgaagctgaaggttatctggtgttcaagcagccctggccagggatcatgcgcacagtctatgggaaccacgaacgctttgagacaacctactttaagaagtttcctggatactatgttacaggagatggctgccagcgggaccaggatggctattactggatcactggcaggattgatgacatgctcaatgtatctggacacctgctgagtacagcagaggtggagtcagcacttgtggaacatgaggctgttgcagaggcagctgtggtgggccaccctcatcctgtgaagggtgaatgcctctactgctttgtcaccttgtgtgatggccacaccttcagccccaagctcaccgaggagctcaagaagcagattagagaaaagattggccccattgccacaccagactacatccagaatgcacctggcttgcctaaaacccgctcagggaaaatcatgaggcgagtgcttcggaagattgctcagaatgaccatgacctcggggacatgtctactgtggctgacccatctgtcatcagtcacctcttcagccaccgctgcctgaccatccagtgaacatgatcctgacctttacctaggattcctcctgctccaaactttgcccatcctctttgccccctcaggagtgctgagggccagtgttgacccacactaccctcccttgaccagctgtctgggaccggaaaccagctttgtctccaggtagagacaacatcctgtgactgccaggcagaaaggacagggcccaggtcagcctcagtctgctgtgcctccagactgcagagctctcagaacccagaacagagacgaaaaggctacctctcctacccaagttaagtgttcaaaggggatgtgagggcctccactgaagcagggaggcagctgtgtaatcctatgtcagctctcttaggaagccccagtacttatattgggcatgcacttgcccttaaaaacaatgatttgtgagtccaggaacaatttactatttttaaaatattttgctgcttctgttctgggtctgaattcccttttgtgccagatgccagtactgtctgcccattggctccaggggctgtatgggcagattcagtctccagagggtattcagatcatctgcttctttgaaggagtaaatgtgttttgttcctagggccagaggagcttgtcttccttgtcctctgttcccaccctcccctgaacagaacccagcccataagagacattctcagatgaaactctgttttcttgccccagtcaggctcaagccctgtggttgtaggaataaagcctgtgatctcaaaaaaaaaaaaaaaaaaaaaaaaaaaagaaacacaacaaaaaaacagggggggcgcgcccaaagaaaattccccagggaggggccccatgttacgcgggctacccgaggtctctgtggtcacacggggggcaccacacaatagggaggcccggaatataaaagccgtgagagaaccgaggaacagcctattaccaaacagcggagagacacggagaaacaccggtgccgccatcgtgggaacaccctcggggagagagagcagcactaaaaccgggagggagcgaccacacaatgtgggaccacaaatacacaaa

SEQ ID NO: 440953 - DNA, 2492 bp, Homo sapiens
agttcggcctgttttctcagtcccggcacccgccgcgaccgcaaaggcggccgcggttctaggaacttgacgtgatggggcttcctgaggagcgggtccggagcggcagcgggagccggggccaggaggaagctggagccggaggccgggcgcggagttggtctccgccgcccgaggtcagccgctccgcgcacgtcccctcgctgcagcgctaccgcgagctgcaccggcgctccgtggaggagccgcgggaattctggggagacattgccaaggaattttactggaagactccatgccctggcccattccttcggtacaactttgatgtgactaaagggaaaatcttcattgagtggatgaaaggagcaactaccaacatctgctacaatgtactggatcgaaatgtccatgagaaaaagcttggagataaagttgctttttactgggagggcaatgagccaggggagaccactcagatcacataccatcagcttctggtccaagtgtgtcagttcagcaatgttctccgaaaacagggcattcagaagggggaccgagtggccatctacatgcctatgatcccagagcttgtggtggccatgctggcatgtgcccgcattggggctttgcactccattgtgtttgcaggcttctcttcagagtctctatgtgaacggatcttggattccagctgcagtcttctcatcactacagatgccttctacaggggggaaaagcttgtgaacctgaaggagctggctgacgaggccctgcagaagtgtcaggagaagggtttcccagtaagatgctgcattgtggtcaagcacctggggcgggcagagctcggcatgggtgactccaccagccagtcccccccaattaagaggtcatgcccagatgtgcagatctcatggaaccaagggattgacttgtggtggcatgagctcatgcaagaggcaggggatgagtgtgagcccgagtggtgtgatgccgaggacccactcttcatcctgtacaccagtggctccacaggcaaacccaagggtgtggttcacacagttgggggctacatgctctatgtagccacaaccttcaagtatgtgtttgacttccatgcagaggatgtgttctggtgcacggcagacattggttggatcactggtcattcctacgtcacctatgggccactggccaatggtgccaccagtgttttgtttgaggggattcccacatatccggacgtgaaccgcctgtggagcattgtggacaaatacaaggtgaccaagttctacacagcacccacagccatccgtctgctcatgaagtttggagatgagcctgtcaccaagcatagccgggcatccttgcaggtgttaggcacagtgggtgaacccatcaaccctgaggcctggctatggtaccaccgggtggtaggtgcccagcgctgccccatcgtggacaccttctggcaaacagagacaggtggccacatgttgactccccttcctggtgccacacccatgaaacccggttctgctactttcccattctttggtgtagctcctgcaatcctgaatgagtccggggaagagttggaaggtgaagctgaaggttatctggtgttcaagcagccctggccagggatcatgcgcacagtctatgggaaccacgaacgctttgagacaacctactttaagaagtttcctggatactatgttacaggagatggctgccagcgggaccaggatggctattactggatcactggcaggattgatgacatgctcaatgtatctggacacctgctgagtacagcagaggtggagtcagcacttgtggaacatgaggctgttgcagaggcagctgtggtgggccaccctcatcctgtgaagggtgaatgcctctactgctttgtcaccttgtgtgatggccacaccttcagccccaagctcaccgaggagctcaagaagcagattagagaaaagattggccccattgccacaccagactacatccagaatgcacctggcttgcctaaaacccgctcagggaaaatcatgaggcgagtgcttcggaagattgctcagaatgaccatgacctcggggacatgtctactgtggctgacccatctgtcatcagtcacctcttcagccaccgctgcctgaccatccagtgaacatgatcctgacctttacctaggattcctcctgctccaaactttgcccatcctctttgccccctcaggagtgctgagggccagtgttgacccacactaccctcccttgaccagctgtctgggaccggaaaccagctttgtctccaggtagagacaacatcctgtgactgccaggcagaaaggacagggcccaggtcagcctcagtctgctgtgcctccagacatcagcctcagtttacccacccagaaaaaggcgagaacataacacttcgctcagaagagccagagggccttgttccatgtgatcgtggg

SEQ ID NO: 440954 - DNA, 2519 bp, Homo sapiens
caggaggtgggagctgcccgcttcaggcctcagaatcactcttggagttagatatttaagaatccttcctgccttgacagccagtctgtgaaatgatggtgaggtgggcacttctttgtggtgagtgcagatctggatggagatttgtgaaggcaaggagattgaagacatgtcctcataagagggagaaaatctgagctggttccaggaattctggggagacattgccaaggaattttactggaagactccatgccctggcccattccttcggtacaactttgatgtgactaaagggaaaatcttcattgagtggatgaaaggagcaactaccaacatctgctacaatgtactggatcgaaatgtccatgagaaaaagcttggagataaagttgctttttactgaaattagccaggtgtggtggtgcacgcctgtaatcccagctactcgggagtctgaggcagaagaattgcctgaacccaggaggcggaggttgcagtgagccaagatcgcgccattttactccagcctgggcaacaggagcttagataatccacatgaaggggttagcagagaaactaacaattagtacttgataaacattagctgttgtgattattgtattcatacttgcaggagcctcacctgtcccttcaaccccaccccatttcactttcccaagagcaagttagtaacagggacagggcttacatccaggccttctgactcagcctagaattccatccattccatcgatctgctgccaaagaatgttactgattgggcaataattatttacttggtgtgtgggcaccactgttttttaaatgagtgttttcatttgtatcaaactggacctgctttcctcaaggattgcccaaaaggagacacaaatttactaaacacttatcaataatagaacaccgtgctaggcaatttccatatactattaatttaatcctcacaataactttggaagacagaaagtattttctctgatttacagatgaggatcctgaagctcagaggggtaaagttacttctctgaggtcacctagctagtaagtggtagagctgggattccaagccaggatcctctgtctccaaagcctgtacttcattcaggacactttcccccacatttagaaaagctgtaattatcttccagtgagacagcatagcaaatgtgatcactgtcccttcctcactccccaggtgttcaagcagccctggccagggatcatgcgcacagtctatgggaaccacgaacgctttgagacaacctactttaagaagtttcctggatactatgttacaggagatggctgccagcgggaccaggatggctattactggatcactggcaggattgatgacatgctcaatgtatctggacacctgctgagtacagcagaggtggagtcagcacttgtggaacatgaggctgttgcagaggcagctgtggtgggccaccctcatcctgtgaagggtgaatgcctctactgctttgtcaccttgtgtgatggccacaccttcagccccaagctcaccgaggagctcaagaagcagattagagaaaagattggccccattgccacaccagactacatccagaatgcacctggcttgcctaaaacccgctcagggaaaatcatgaggcgagtgcttcggaagattgctcagaatgaccatgacctcggggacatgtctactgtggctgacccatctgtcatcagtcacctcttcagccaccgctgcctgaccatccagtgaacatgatcctgacctttacctaggattcctcctgctccaaactttgcccatcctctttgccccctcaggagtgctgagggccagtgttgacccacactaccctcccttgaccagctgtctgggaccggaaaccagctttgtctccaggtagagacaacatcctgtgactgccaggcagaaaggacagggcccaggtcagcctcagtctgctgtgcctccagactgcagagctctcagaacccagaacagagacgaaaaggctacctctcctacccaagttaagtgttcaaaggggatgtgagggcctccactgaagcagggaggcagctgtgtaatcctatgtcagctctcttaggaagccccagtacttatattgggcatgcacttgcccttaaaaacaatgatttgtgagtccaggaacaatttactatttttaaaatattttgctgcttctgttctgggtctgaattcccttttgtgccagatgccagtactgtctgcccattggctccaggggctgtatgggcagattcagtctccagagggtattcagatcatctgcttctttgaaggagtaaatgtgttttgttcctagggccagaggagcttgtcttccttgtcctctgttcccaccctcccctgaacagaacccagcccataagagacattctcagatgaaactctgttttcttgccccagtcaggctcaagccctgtggttgtaggaataaagcctgtgatctcaa

SEQ ID NO: 440955 - DNA, 2396 bp, Homo sapiens
agttcggcctgttttctcagtcccggcacccgccgcgaccgcaaaggcggccgcggttctaggaacttgacgtgatggggcttcctgaggagcgggtccggagcggcagcgggagccggggccaggaggaagctggagccggaggccgggcgcggagttggtctccgccgcccgaggtcagccgctccgcgcacgtcccctcgctgcagcgctaccgcgagctgcaccggcgctccgtggaggagccgcgggaattctggggagacattgccaaggaattttactggaagactccatgccctggcccattccttcggtacaactttgatgtgactaaagggaaaatcttcattgagtggatgaaaggagcaactaccaacatctgctacaatgtactggatcgaaatgtccatgagaaaaagcttggagataaagttgctttttactgggagggcaatgagccaggggagaccactcagatcacataccatcagcttctggtccaagtgtgtcagttcagcaatgttctccgaaaacagggcattcagaagggggaccgagtggccatctacatgcctatgatcccagagcttgtggtggccatgctggcatgtgcccgcattggggctttgcactccattgtgtttgcaggcttctcttcagagtctctatgtgaacggatcttggattccagctgcagtcttctcatcactacagatgccttctacaggggggaaaagcttgtgaacctgaaggagctggctgacgaggccctgcagaagtgtcaggagaagggtttcccagtaagatgctgcattgtggtcaagcacctggggcgggcagagctcggcatgggtgactccaccagccagtcccccccaattaagaggtcatgcccagatgtgcagatctcatggaaccaagggattgacttgtggtggcatgagctcatgcaagaggcaggggatgagtgtgagcccgagtggtgtgatgccgaggacccactcttcatcctgtacaccagtggctccacaggcaaacccaagggtgtggttcacacagttgggggctacatgctctatgtagccacaaccttcaagtatgtgtttgacttccatgcagaggatgtgttctggtgcacggcagacattggttggatcactggtcattcctacgtcacctatgggccactggccaatggtgccaccagtgttttgtttgaggggattcccacatatccggacgtgaaccgcctgtggagcattgtggacaaatacaaggtgaccaagttctacacagcacccacagccatccgtctgctcatgaagtttggagatgagcctgtcaccaagcatagccgggcatccttgcaggtgttaggcacagtgggtgaacccatcaaccctgaggcctggctatggtaccaccgggtggtaggtgcccagcgctgccccatcgtggacaccttctggcaaacagagacaggtggccacatgttgactccccttcctggtgccacacccatgaaacccggttctgctactttcccattctttggtgtagctcctgcaatcctgaatgagtccggggaagagttggaaggtgaagctgaaggttatctggtgttcaagcagccctggccagggatcatgcgcacagtctatgggaaccacgaacgctttgagacaacctactttaagaagtttcctggatactatgttacaggagatggctgccagcgggaccaggatggctattactggatcactggcaggattgatgacatgctcaatgtatctggacacctgctgagtacagcagaggtggagtcagcacttgtggaacatgaggctgttgcagaggcagctgtggtgggccaccctcatcctgtgaagggtgaatgcctctactgctttgtcaccttgtgtgatggccacaccttcagccccaagctcaccgaggagctcaagaagcagattagagaaaagattggccccattgccacaccagactacatccagaatgcacctggcttgcctaaaacccgctcaggtatgttcagaggcctccatggattgggatgggctgaggcctggtggtggtggggtgtgcgtggatgaaagcctttggcagggctagggtgggtcagtgctttcaccaagtaactagaggtctgtggttccccagggaaaatcatgaggcgagtgcttcggaagattgctcagaatgaccatgagcttaataccctgaccaaaagcactgctgacagagcatgatgaagatggaaaaaaagcaacaaaataaaacaagatagaatagtgtaacaaggtactctattcaatttctaagcaaatcttaagtgtcattctaggtcgtatcttcatatcttggaagac

SEQ ID NO: 440956 - DNA, 2121 bp, Homo sapiens
agttcggcctgttttctcagtcccggcacccgccgcgaccgcaaaggcggccgcggttctaggaacttgacgtgatggggcttcctgaggagcgggtccggagcggcagcgggagccggggccaggaggaagctggagccggaggccgggcgcggagttggtctccgccgcccgaggtcagccgctccgcgcacgtcccctcgctgcagcgctaccgcgagctgcaccggcgctccgtggaggagccgcgggaattctggggagacattgccaaggaattttactggaagactccatgccctggcccattccttcggtacaactttgatgtgactaaagggaaaatcttcattgagtggatgaaaggagcaactaccaacatctgctacaatgtactggatcgaaatgtccatgagaaaaagcttggagataaagttgctttttactgggagggcaatgagccaggggagaccactcagatcacataccatcagcttctggtccaagtgtgtcagttcagcaatgttctccgaaaacagggcattcagaagggggaccgagtggccatctacatgcctatgatcccagagcttgtggtggccatgctggcatgtgcccgcattggggctttgcactccattgtgtttgcaggcttctcttcagagtctctatgtgaacggatcttggattccagctgcagtcttctcatcactacagatgccttctacaggggggaaaagcttgtgaacctgaaggagctggctgacgaggccctgcagaagtgtcaggagaagggtttcccagtaagatgctgcattgtggtcaagcacctggggcgggcagagctcggcatgggtgactccaccagccagtcccccccaattaagaggtcatgcccagatgtgcagatctcatggaaccaagggattgacttgtggtggcatgagctcatgcaagaggcaggggatgagtgtgagcccgagtggtgtgatgccgaggacccactcttcatcctgtacaccagtggctccacaggcaaacccaagggtgtggttcacacagttgggggctacatgctctatgtagccacaaccttcaagtatgtgtttgacttccatgcagaggatgtgttctggtgcacggcagacattggttggatcactggtcattcctacgtcacctatgggccactggccaatggtgccaccagtgttttgtttgaggggattcccacatatccggacgtgaaccgcctgtggagcattgtggacaaatacaaggtgaccaagttctacacagcacccacagccatccgtctgctcatgaagtttggagatgagcctgtcaccaagcatagccgggcatccttgcaggtgttaggcacagtgggtgaacccatcaaccctgaggcctggctatggtaccaccgggtggtaggtgcccagcgctgccccatcgtggacaccttctggcaaacagagacaggtggccacatgttgactccccttcctggtgccacacccatgaaacccggttctgctactttcccattctttggtgtagctcctgcaatcctgaatgagtccggggaagagttggaaggtgaagctgaaggttatctggtgagccctggccctaggagtctttaaggagagagggaaagggtctgccaagggtactttgctttagagttaataacctaatctctcctggtagctgcttaggactgaaacttcatggttggaggtttgctcactgagagaccctggaggggaccctcgatactttgcctgcatctcttccttttgggccataagtctcctaagggcgttttaagagttgctcagattcctgatggtacctttttgggtctggaagactaagtcccatcttcttttgacaaagattctacagaaaggaggctttataacatagtagaaaatcacgtaggatctggagtcaccctgcctgggttcgaatcctagctctgcctcttctgtgacctcagataagttatttaacacctctgaatctacattttctaatttgtaaaatagggttaaagtggtgtctctggccgggcacggtggctcacacctgtaatcctagcactttgggagg

SEQ ID NO: 440957 - DNA, 1640 bp, Homo sapiens
agttcggcctgttttctcagtcccggcacccgccgcgaccgcaaaggcggccgcggttctaggaacttgacgtgatggggcttcctgaggagcgggtccggagcggcagcgggagccggggccaggaggaagctggagccggaggccgggcgcggagttggtctccgccgcccgaggtcagccgctccgcgcacgtcccctcgctgcagcgctaccgcgagctgcaccggcgctccgtggaggagccgcgggaattctggggagacattgccaaggaattttactggaagactccatgccctggcccattccttcggtacaactttgatgtgactaaagggaaaatcttcattgagtggatgaaaggagcaactaccaacatctgctacaatgtactggatcgaaatgtccatgagaaaaagcttggagataaagttgctttttactgggagggcaatgagccaggggagaccactcagatcacataccatcagcttctggtccaagtgtgtcagttcagcaatgttctccgaaaacagggcattcagaagggggaccgagtggccatctacatgcctatgatcccagagcttgtggtggccatgctggcatgtgcccgcattggggctttgcactccattgtgtttgcaggcttctcttcagagtctctatgtgaacggatcttggattccagctgcagtcttctcatcactacagatgccttctacaggggggaaaagcttgtgaacctgaaggagctggctgacgaggccctgcagaagtgtcaggagaagtaagtgtgtttggctactgtctgagttgactgagcctttccccagtgccaggttccctttgtcccctctaccctaaatggacatgggtgggtcttgccaagttccctttgagccaacaaggctaccactttaggcttttctcttctccaggggtttcccagtaagatgctgcattgtggtcaagcacctggggcgggcagagctcggcatgggtgactccaccagccagtcccccccaattaagaggtcatgcccagatgtgcaggtgagtctggcactgctatgcctttctccaggctcaaattccttcacttttcctgcctagaaaattcttgatgtccttctttgcctgctcatcagtatactgaggatccaggagcaattctaggaatgcctcctctagcagggctaggtgggaactggaagactttgaccttgactgtgggtagagaggcccttgtaccttgagaacatagcacaagcgattgtaagggagactcctatgctggttggggtatccttgtgggcacaggggatcctcagggcctaggcttgtgttagaaatgtctaacttgagtgacaatatatagtcatctccattactaggctgtgatgtggggtgggctatctttgtggcctaagggatgcccaccttggaaggaccagagtccagccctcacaatatggcctttgttagctttggacccccaggcttctggtgggaatggtagaaatgcccagtgatggcctccaggctgagcagcatgagggatcaaagttctggggttgagtaagagtctgtgacttgaggctccctgaggggtcttagggctagagaggctgtag

SEQ ID NO: 440958 - DNA, 289 bp, Homo sapiens
ggggctctggagaagtaggttgggcctagatgatggagggtcttaaataacaaactaaggagcttagaaggtttgtgtcataggtccatattagttattcagtttcttctaggaccctggcttagagatcctgaaagttccatgagcaacccctttcttcattcactcaatccctggggctttcttctctccctcagactttcttcccttccctagtttgcaggcttctcttcagagtctctatgtgaacggatcttggattccagctgcagtcttctcatcactacag

SEQ ID NO: 440959 - DNA, 2925 bp, Homo sapiens
agttcggcctgttttctcagtcccggcacccgccgcgaccgcaaaggcggccgcggttctaggaacttgacgtgatggggcttcctgaggagcgggtccggagcggcagcgggagccggggccaggaggaagctggagccggaggccgggcgcggagttggtctccgccgcccgaggtcagccgctccgcgcacgtcccctcgctgcagcgctaccgcgagctgcaccggcgctccgtggaggagccgcgggaattctggggagacattgccaaggaattttactggaagactccatgccctggcccattccttcggtacaactttgatgtgactaaagggaaaatcttcattgagtggatgaaaggagcaactaccaacatctgctacaatgtactggatcgaaatgtccatgagaaaaagcttggagataaagttgctttttactgggagggcaatgagccaggggagaccactcagatcacataccatcagcttctggtccaagtgtgtcagttcagcaatgttctccgaaaacagggcattcagaagggggaccgagtggccatctacatgcctatgatcccagagcttgtggtggccatgctggcatgtgcccgcattggggctttgcactccattgtgtttgcaggcttctcttcagagtctctatgtgaacggatcttggattccagctgcagtcttctcatcactacagatgccttctacaggggggaaaagcttgtgaacctgaaggagctggctgacgaggccctgcagaagtgtcaggagaagggtttcccagtaagatgctgcattgtggtcaagcacctggggcgggcagagctcggcatgggtgactccaccagccagtcccccccaattaagaggtcatgcccagatgtgcagatctcatggaaccaagggattgacttgtggtggcatgagctcatgcaagaggcaggggatgagtgtgagcccgagtggtgtgatgccgaggacccactcttcatcctgtacaccagtggctccacaggcaaacccaagggtgtggttcacacagttgggggctacatgctctatgtagccacaaccttcaagtatgtgtttgacttccatgcagaggatgtgttctggtgcacggcagacattggttggatcactggtcattcctacgtcacctatgggccactggccaatggtgccaccagtgttttgtttgaggggattcccacatatccggacgtgaaccgcctgtggagcattgtggacaaatacaaggtgaccaagttctacacagcacccacagccatccgtctgctcatgaagtttggagatgagcctgtcaccaagcatagccgggcatccttgcaggtgttaggcacagtgggtgaacccatcaaccctgaggcctggctatggtaccaccgggtggtaggtgcccagcgctgccccatcgtggacaccttctggcaaacagagacaggtggccacatgttgactccccttcctggtgccacacccatgaaacccggttctgctactttcccattctttggtgtagctcctgcaatcctgaatgagtccggggaagagttggaaggtgaagctgaaggttatctggtgttcaagcagccctggccagggatcatgcgcacagtctatgggaaccacgaacgctttgagacaacctactttaagaagtttcctggatactatgttacaggagatggctgccagcgggaccaggatggctattactggatcactggcaggattgatgacatgctcaatgtatctggacacctgctgagtacagcagaggtggagtcagcacttgtggaacatgaggctgttgcagaggcagctgtggtgggccaccctcatcctgtgaagggtgaatgcctctactgctttgtcaccttgtgtgatggccacaccttcagccccaagctcaccgaggagctcaagaagcagattagagaaaagattggccccattgccacaccagactacatccagaatgcacctggcttgcctaaaacccgctcagggaaaatcatgaggcgagtgcttcggaagattgctcagaatgaccatgacctcggggacatgtctactgtggctgacccatctgtcatcagtcacctcttcagccaccgctgcctgaccatccagtgaacatgatcctgacctttacctaggattcctcctgctccaaactttgcccatcctctttgccccctcaggagtgctgagggccagtgttgacccacactaccctcccttgaccagctgtctgggaccggaaaccagctttgtctccaggtagagacaacatcctgtgactgccaggcagaaaggacagggcccaggtcagcctcagtctgctgtgcctccagactgcagagctctcagaacccagaacagagacgaaaaggctacctctcctacccaagttaagtgttcaaaggggatgtgagggcctccactgaagcagggaggcagctgtgtaatcctatgtcagctctcttaggaagccccagtacttatattgggcatgcacttgcccttaaaaacaatgatttgtgagtccaggaacaatttactatttttaaaatattttgctgcttctgttctgggtctgaattcccttttgtgccagatgccagtactgtctgcccattggctccaggggctgtatgggcagattcagtctccagagggtattcagatcatctgcttctttgaaggagtaaatgtgttttgttcctagggccagaggagcttgtcttccttgtcctctgttcccaccctcccctgaacagaacccagcccataagagacattctcagatgaaactctgttttcttgccccagtcaggctcaagccctgtggttgtaggaataaagcctgtgatctcaa

SEQ ID NO: 440960 - DNA, 808 bp, Homo sapiens
aagctggaagcacaaaactaacggctaggtacgaggctgggtgttgggtcagcacctggggcgggcagagctcggcatgggtgactccaccagccagtcccccccaattaagaggtcatgcccagatgtgcagatctcatggaaccaagggattgacttgtggtggcatgagctcatgcaagaggcaggggatgagtgtgagcccgagtggtgtgatgccgaggacccactcttcatcctgtacaccagtggctccacaggcaaacccaagggtgtggttcacacagttgggggctacatgctctatgtagccacaaccttcaagtatgtgtttgacttccatgcagaggatgtgttctggtgcacggcagacattggttggatcactggtcattcctacgtcacctatgggccactggccaatggtgccaccagtgttttgtttgaggggattcccacatatccggacgtgaaccgcctgtggagcattgtggacaaatacaaggtgaccaagttctacacagcacccacagccatccgtctgctcatgaagtttggagatgagcctgtcaccaagcatagccgggcatccttgcaggtgttaggcacagtgggtgaacccatcaaccctgaggcctggctatggtaccaccgggtggtaggtgcccagcgctgccccatcgtggacaccttctggcaaacagagacaggtggccacatgttgactccccttcctggtgccacacccatgaaacccggttctgctactttccattcttgggttatccggatcgataatcgggaaatg

SEQ ID NO: 440961 - DNA, 2954 bp, Homo sapiens
agttcggcctgttttctcagtcccggcacccgccgcgaccgcaaaggcggccgcggttctaggaacttgacgtgatggggcttcctgaggagcgggtccggagcggcagcgggagccggggccaggaggaagctggagccggaggccgggcgcggagttggtctccgccgcccgaggtcagccgctccgcgcacgtcccctcgctgcagcgctaccgcgagctgcaccggcgctccgtggaggagccgcgggaattctggggagacattgccaaggaattttactggaagactccatgccctggcccattccttcggtacaactttgatgtgactaaagggaaaatcttcattgagtggatgaaaggagcaactaccaacatctgctacaatgtactggatcgaaatgtccatgagaaaaagcttggagataaagttgctttttactgggagggcaatgagccaggggagaccactcagatcacataccatcagcttctggtccaagtgtgtcagttcagcaatgttctccgaaaacagggcattcagaagggggaccgagtggccatctacatgcctatgatcccagagcttgtggtggccatgctggcatgtgcccgcattggggctttgcactccattgtgtttgcaggcttctcttcagagtctctatgtgaacggatcttggattccagctgcagtcttctcatcactacagatgccttctacaggggggaaaagcttgtgaacctgaaggagctggctgacgaggccctgcagaagtgtcaggagaagggtttcccagtaagatgctgcattgtggtcaagcacctggggcgggcagagctcggcatgggtgactccaccagccagtcccccccaattaagaggtcatgcccagatgtgcagatctcatggaaccaagggattgacttgtggtggcatgagctcatgcaagaggcaggggatgagtgtgagcccgagtggtgtgatgccgaggacccactcttcatcctgtacaccagtggctccacaggcaaacccaagggtgtggttcacacagttgggggctacatgctctatgtagccacaaccttcaagtatgtgtttgacttccatgcagaggatgtgttctggtgcacggcagacattggttggatcactggtcattcctacgtcacctatgggccactggccaatggtgccaccagtgttttgtttgaggggattcccacatatccggacgtgaaccgcctgtggagcattgtggacaaatacaaggtgaccaagttctacacagcacccacagccatccgtctgctcatgaagtttggagatgagcctgtcaccaagcatagccgggcatccttgcaggtgttaggcacagtgggtgaacccatcaaccctgaggcctggctatggtaccaccgggtggtaggtgcccagcgctgccccatcgtggacaccttctggcaaacagagacaggtggccacatgttgactccccttcctggtgccacacccatgaaacccggttctgctactttcccattctttggtgtagctcctgcaatcctgaatgagtccggggaagagttggaaggtgaagctgaaggttatctggtgttcaagcagccctggccagggatcatgcgcacagtctatgggaaccacgaacgctttgagacaacctactttaagaagtttcctggatactatgttacaggagatggctgccagcgggaccaggatggctattactggatcactggcaggattgatgacatgctcaatgtatctggacacctgctgagtacagcagaggtggagtcagcacttgtggaacatgaggctgttgcagaggcagctgtggtgggccaccctcatcctgtgaagggtgaatgcctctactgctttgtcaccttgtgtgatggccacaccttcagccccaagctcaccgaggagctcaagaagcagattagagaaaagattggccccattgccacaccagactacatccagaatgcacctggcttgcctaaaacccgctcagggaaaatcatgaggcgagtgcttcggaagattgctcagaatgaccatgacctcggggacatgtctactgtggctgacccatctgtcatcagtcacctcttcagccaccgctgcctgaccatccagtgaacatgatcctgacctttacctaggattcctcctgctccaaactttgcccatcctctttgccccctcaggagtgctgagggccagtgttgacccacactaccctcccttgaccagctgtctgggaccggaaaccagctttgtctccaggtagagacaacatcctgtgactgccaggcagaaaggacagggcccaggtcagcctcagtctgctgtgcctccagactgcagagctctcagaacccagaacagagacgaaaaggctacctctcctacccaagttaagtgttcaaaggggatgtgagggcctccactgaagcagggaggcagctgtgtaatcctatgtcagctctcttaggaagccccagtacttatattgggcatgcacttgcccttaaaaacaatgatttgtgagtccaggaacaatttactatttttaaaatattttgctgcttctgttctgggtctgaattcccttttgtgccagatgccagtactgtctgcccattggctccaggggctgtatgggcagattcagtctccagagggtattcagatcatctgcttctttgaaggagtaaatgtgttttgttcctagggccagaggagcttgtcttccttgtcctctgttcccaccctcccctgaacagaacccagcccataagagacattctcagatgaaactctgttttcttgccccagtcaggctcaagccctgtggttgtaggaataaagcctgtgatctcaaaaaaagtgacttgttttcttaggtatctg

SEQ ID NO: 440962 - DNA, 2834 bp, Homo sapiens
caggaggtgggagctgcccgcttcaggcctcagaatcactcttggagttagatatttaagaatccttcctgccttgacagccagtctgtgaaatgatggtgaggtgggcacttctttgtggtgagtgcagatctggatggagatttgtgaaggcaaggagattgaagacatgtcctcataagagggagaaaatctgagctggttccaggaattctggggagacattgccaaggaattttactggaagactccatgccctggcccattccttcggtacaactttgatgtgactaaagggaaaatcttcattgagtggatgaaaggagcaactaccaacatctgctacaatgtactggatcgaaatgtccatgagaaaaagcttggagataaagttgctttttactgggagggcaatgagccaggggagaccactcagatcacataccatcagcttctggtccaagtgtgtcagttcagcaatgttctccgaaaacaggagcttgtggtggccatgctggcatgtgcccgcattggggctttgcactccattgtgtttgcaggcttctcttcagagtctctatgtgaacggatcttggattccagctgcagtcttctcatcactacagatgccttctacaggggggaaaagcttgtgaacctgaaggagctggctgacgaggccctgcagaagtgtcaggagaagggtttcccagtaagatgctgcattgtggtcaagcacctggggcgggcagagctcggcatgggtgactccaccagccagtcccccccaattaagaggtcatgcccagatgtgcagatctcatggaaccaagggattgacttgtggtggcatgagctcatgcaagaggcaggggatgagtgtgagcccgagtggtgtgatgccgaggacccactcttcatcctgtacaccagtggctccacaggcaaacccaagggtgtggttcacacagttgggggctacatgctctatgtagccacaaccttcaagtatgtgtttgacttccatgcagaggatgtgttctggtgcacggcagacattggttggatcactggtcattcctacgtcacctatgggccactggccaatggtgccaccagtgttttgtttgaggggattcccacatatccggacgtgaaccgcctgtggagcattgtggacaaatacaaggtgaccaagttctacacagcacccacagccatccgtctgctcatgaagtttggagatgagcctgtcaccaagcatagccgggcatccttgcaggtgttaggcacagtgggtgaacccatcaaccctgaggcctggctatggtaccaccgggtggtaggtgcccagcgctgccccatcgtggacaccttctggcaaacagagacaggtggccacatgttgactccccttcctggtgccacacccatgaaacccggttctgctactttcccattctttggtgtagctcctgcaatcctgaatgagtccggggaagagttggaaggtgaagctgaaggttatctggtgttcaagcagccctggccagggatcatgcgcacagtctatgggaaccacgaacgctttgagacaacctactttaagaagtttcctggatactatgttacaggagatggctgccagcgggaccaggatggctattactggatcactggcaggattgatgacatgctcaatgtatctggacacctgctgagtacagcagaggtggagtcagcacttgtggaacatgaggctgttgcagaggcagctgtggtgggccaccctcatcctgtgaagggtgaatgcctctactgctttgtcaccttgtgtgatggccacaccttcagccccaagctcaccgaggagctcaagaagcagattagagaaaagattggccccattgccacaccagactacatccagaatgcacctggcttgcctaaaacccgctcagggaaaatcatgaggcgagtgcttcggaagattgctcagaatgaccatgacctcggggacatgtctactgtggctgacccatctgtcatcagtcacctcttcagccaccgctgcctgaccatccagtgaacatgatcctgacctttacctaggattcctcctgctccaaactttgcccatcctctttgccccctcaggagtgctgagggccagtgttgacccacactaccctcccttgaccagctgtctgggaccggaaaccagctttgtctccaggtagagacaacatcctgtgactgccaggcagaaaggacagggcccaggtcagcctcagtctgctgtgcctccagactgcagagctctcagaacccagaacagagacgaaaaggctacctctcctacccaagttaagtgttcaaaggggatgtgagggcctccactgaagcagggaggcagctgtgtaatcctatgtcagctctcttaggaagccccagtacttatattgggcatgcacttgcccttaaaaacaatgatttgtgagtccaggaacaatttactatttttaaaatattttgctgcttctgttctgggtctgaattcccttttgtgccagatgccagtactgtctgcccattggctccaggggctgtatgggcagattcagtctccagagggtattcagatcatctgcttctttgaaggagtaaatgtgttttgttcctagggccagaggagcttgtcttccttgtcctctgttcccaccctcccctgaacagaacccagcccataagagacattctcagatgaaactctgttttcttgccccagtcaggctcaagccctgtggttgtaggaataaagcctgtgatctcaa

SEQ ID NO: 440963 - DNA, 2452 bp, Homo sapiens
ggtaattcatcctacagatatacttgcagggagggcaatgagccaggggagaccactcagatcacataccatcagcttctggtccaagtgtgtcagttcagcaatgttctccgaaaacagggcattcagaagggggaccgagtggccatctacatgcctatgatcccagagcttgtggtggccatgctggcatgtgcccgcattggggctttgcactccattgtgtttgcaggcttctcttcagagtctctatgtgaacggatcttggattccagctgcagtcttctcatcactacagatgccttctacaggggggaaaagggtttcccagtaagatgctgcattgtggtcaagcacctggggcgggcagagctcggcatgggtgactccaccagccagtcccccccaattaagaggtcatgcccagatgtgcagatctcatggaaccaagggattgacttgtggtggcatgagctcatgcaagaggcaggggatgagtgtgagcccgagtggtgtgatgccgaggacccactcttcatcctgtacaccagtggctccacaggcaaacccaagggtgtggttcacacagttgggggctacatgctctatgtagccacaaccttcaagtatgtgtttgacttccatgcagaggatgtgttctggtgcacggcagacattggttggatcactggtcattcctacgtcacctatgggccactggccaatggtgccaccagtgttttgtttgaggggattcccacatatccggacgtgaaccgcctgtggagcattgtggacaaatacaaggtgaccaagttctacacagcacccacagccatccgtctgctcatgaagtttggagatgagcctgtcaccaagcatagccgggcatccttgcaggtgttaggcacagtgggtgaacccatcaaccctgaggcctggctatggtaccaccgggtggtaggtgcccagcgctgccccatcgtggacaccttctggcaaacagagacaggtggccacatgttgactccccttcctggtgccacacccatgaaacccggttctgctactttcccattctttggtgtagctcctgcaatcctgaatgagtccggggaagagttggaaggtgaagctgaaggttatctggtgttcaagcagccctggccagggatcatgcgcacagtctatgggaaccacgaacgctttgagacaacctactttaagaagtttcctggatactatgttacaggagatggctgccagcgggaccaggatggctattactggatcactggcaggattgatgacatgctcaatgtatctggacacctgctgagtacagcagaggtggagtcagcacttgtggaacatgaggctgttgcagaggcagctgtggtgggccaccctcatcctgtgaagggtgaatgcctctactgctttgtcaccttgtgtgatggccacaccttcagccccaagctcaccgaggagctcaagaagcagattagagaaaagattggccccattgccacaccagactacatccagaatgcacctggcttgcctaaaacccgctcagggaaaatcatgaggcgagtgcttcggaagattgctcagaatgaccatgacctcggggacatgtctactgtggctgacccatctgtcatcagtcacctcttcagccaccgctgcctgaccatccagtgaacatgatcctgacctttacctaggattcctcctgctccaaactttgcccatcctctttgccccctcaggagtgctgagggccagtgttgacccacactaccctcccttgaccagctgtctgggaccggaaaccagctttgtctccaggtagagacaacatcctgtgactgccaggcagaaaggacagggcccaggtcagcctcagtctgctgtgcctccagactgcagagctctcagaacccagaacagagacgaaaaggctacctctcctacccaagttaagtgttcaaaggggatgtgagggcctccactgaagcagggaggcagctgtgtaatcctatgtcagctctcttaggaagccccagtacttatattgggcatgcacttgcccttaaaaacaatgatttgtgagtccaggaacaatttactatttttaaaatattttgctgcttctgttctgggtctgaattcccttttgtgccagatgccagtactgtctgcccattggctccaggggctgtatgggcagattcagtctccagagggtattcagatcatctgcttctttgaaggagtaaatgtgttttgttcctagggccagaggagcttgtcttccttgtcctctgttcccaccctcccctgaacagaacccagcccataagagacattctcagatgaaactctgttttcttgccccagtcaggctcaagccctgtggttgtaggaataaagcctgtgatctcaa

SEQ ID NO: 440964 - DNA, 2880 bp, Homo sapiens
agttcggcctgttttctcagtcccggcacccgccgcgaccgcaaaggcggccgcggttctaggaacttgacgtgatggggcttcctgaggagcgggtccggagcggcagcgggagccggggccaggaggaagctggagccggaggccgggcgcggagttggtctccgccgcccgaggtcagccgctccgcgcacgtcccctcgctgcagcgctaccgcgagctgcaccggcgctccgtggaggagccgcgggaattctggggagacattgccaaggaattttactggaagactccatgccctggcccattccttcggtacaactttgatgtgactaaagggaaaatcttcattgagtggatgaaaggagcaactaccaacatctgctacaatgtactggatcgaaatgtccatgagaaaaagcttggagataaagttgctttttactgggagggcaatgagccaggggagaccactcagatcacataccatcagcttctggtccaagtgtgtcagttcagcaatgttctccgaaaacagggcattcagaagggggaccgagtggccatctacatgcctatgatcccagagcttgtggtggccatgctggcatgtgcccgcattggggctttgcactccattgtgtttgcaggcttctcttcagagtctctatgtgaacggatcttggattccagctgcagtcttctcatcactacagatgccttctacaggggggaaaagcttgtgaacctgaaggagctggctgacgaggccctgcagaagtgtcaggagaagggtttcccagtaagatgctgcattgtggtcaagcacctggggcgggcagagctcggcatgggtgactccaccagccagtcccccccaattaagaggtcatgcccagatgtgcagatctcatggaaccaagggattgacttgtggtggcatgagctcatgcaagaggcaggggatgagtgtgagcccgagtggtgtgatgccgaggacccactcttcatcctgtacaccagtggctccacaggcaaacccaagggtgtggttcacacagttgggggctacatgctctatgtagccacaaccttcaagtatgtgtttgacttccatgcagaggatgtgttctggtgcacggcagacattggttggatcactggtcattcctacgtcacctatgggccactggccaatggtgccaccagtgttttgtttgaggggattcccacatatccggacgtgaaccgcctgtggagcattgtggacaaatacaaggtgaccaagttctacacagcacccacagccatccgtctgctcatgaagtttggagatgagcctgtcaccaagcatagccgggcatccttgcaggtgttaggcacagtgggtgaacccatcaaccctgaggcctggctatggtaccaccgggtggtaggtgcccagcgctgccccatcgtggacaccttctggcaaacagagacaggtggccacatgttgactccccttcctggtgccacacccatgaaacccggttctgctactttcccattctttggtgtagctcctgcaatcctgaatgagtccggggaagagttggaaggtgaagctgaaggttatctggtgttcaagcagccctggccagggatcatgcgcacagtctatgggaaccacgaacgctttgagacaacctactttaagaagtttcctggatactatgttacaggagatggctgccagcgggaccaggatggctattactggatcactggcaggattgatgacatgctcaatgtatctggacacctgctgagtacagcagaggtggagtcagcacttgtggaacatgaggctgttgcagaggcagctgtggtgggccaccctcatcctgtgaagggtgaatgcctctactgctttgtcaccttgtgtgatggccacaccttcagccccaagctcaccgaggagctcaagaagcagattagagaaaagattggccccattgccacaccagactacatccagaatgcacctggcttgcctaaaacccgctcagggaaaatcatgaggcgagtgcttcggaagattgctcagaatgaccatgacctcggggacatgtctactgtggctgacccatctgtcatcagtcacctcttcagccaccgctgcctgaccatccagtgaacatgatcctgacctttacctaggattcctcctgctccaaactttgcccatcctctttgccccctcaggagtgctgagggccagtgttgacccacactaccctcccttgaccagctgtctgggaccggaaaccagctttgtctccaggtagagacaacatcctgtgactgccaggcagaaaggacagggcccaggtcagcctcagtctgctgtgcctccagactgcagagctctcagaacccagaacagagacgaaaaggctacctctcctacccaagttaagtgttcaaaggggatgtgagggcctccactgaagcagggaggcagctgtgtaatcctatgtcagctctcttaggaagccccagtacttatattgggcatgcacttgcccttaaaaacaatgatttgtgagtccaggaacaatttactatttttaaaatattttgctgcttctgttctgggtctgaattcccttttgtgccagattcagtctccagagggtattcagatcatctgcttctttgaaggagtaaatgtgttttgttcctagggccagaggagcttgtcttccttgtcctctgttcccaccctcccctgaacagaacccagcccataagagacattctcagatgaaactctgttttcttgccccagtcaggctcaagccctgtggttgtaggaataaagcctgtgatctcaa

SEQ ID NO: 440965 - DNA, 2249 bp, Homo sapiens
caggcagatcacctgaggtcgggagttcgagaccaggctgaccaacatggagaccccgtctctactaaaaatacaaaattagccaggcgtggtggtggacgtctgtaatcccagctacacgggaggctgagacaggagaatcacttgaaccggggaggtggaggttgtattgagccgaaattgtgccattgcacttcatcctgggcaacaagagcaaaattccgtctcagaaaaaaataatgcctttgtctcctatggttgcttgcttgattgagttagataatccacatgaaggggttagcagagaaactaacaattagtacttgataaacattagctgttgtgattattgtattcatacttgcaggagcctcacctgtcccttcaaccccaccccatttcactttcccaagagcaagttagtaacagggacagggcttacatccaggccttctgactcagcctagaattccatccattccatcgatctgctgccaaagaatgttactgattgggcaataattatttacttggtgtgtgggcaccactgttttttaaatgagtgttttcatttgtatcaaactggacctgctttcctcaaggattgcccaaaaggagacacaaatttactaaacacttatcaataatagaacaccgtgctaggcaatttccatatactattaatttaatcctcacaataactttggaagacagaaagtattttctctgatttacagatgaggatcctgaagctcagaggggtaaagttacttctctgaggtcacctagctagtaagtggtagagctgggattccaagccaggatcctctgtctccaaagcctgtacttcattcaggacactttcccccacatttagaaaagctgtaattatcttccagtgagacagcatagcaaatgtgatcactgtcccttcctcactccccaggtgttcaagcagccctggccagggatcatgcgcacagtctatgggaaccacgaacgctttgagacaacctactttaagaagtttcctggatactatgttacaggagatggctgccagcgggaccaggatggctattactggatcactggcaggattgatgacatgctcaatgtatctggacacctgctgagtacagcagaggtggagtcagcacttgtggaacatgaggctgttgcagaggcagctgtggtgggccaccctcatcctgtgaagggtgaatgcctctactgctttgtcaccttgtgtgatggccacaccttcagccccaagctcaccgaggagctcaagaagcagattagagaaaagattggccccattgccacaccagactacatccagaatgcacctggcttgcctaaaacccgctcagggaaaatcatgaggcgagtgcttcggaagattgctcagaatgaccatgacctcggggacatgtctactgtggctgacccatctgtcatcagtcacctcttcagccaccgctgcctgaccatccagtgaacatgatcctgacctttacctaggattcctcctgctccaaactttgcccatcctctttgccccctcaggagtgctgagggccagtgttgacccacactaccctcccttgaccagctgtctgggaccggaaaccagctttgtctccaggtagagacaacatcctgtgactgccaggcagaaaggacagggcccaggtcagcctcagtctgctgtgcctccagactgcagagctctcagaacccagaacagagacgaaaaggctacctctcctacccaagttaagtgttcaaaggggatgtgagggcctccactgaagcagggaggcagctgtgtaatcctatgtcagctctcttaggaagccccagtacttatattgggcatgcacttgcccttaaaaacaatgatttgtgagtccaggaacaatttactatttttaaaatattttgctgcttctgttctgggtctgaattcccttttgtgccagatgccagtactgtctgcccattggctccaggggctgtatgggcagattcagtctccagagggtattcagatcatctgcttctttgaaggagtaaatgtgttttgttcctagggccagaggagcttgtcttccttgtcctctgttcccaccctcccctgaacagaacccagcccataagagacattctcagatgaaactctgttttcttgccccagtcaggctcaagccctgtggttgtaggaataaagcctgtgatctcaa

SEQ ID NO: 440966 - DNA, 1642 bp, Homo sapiens
agttcggcctgttttctcagtcccggcacccgccgcgaccgcaaaggcggccgcggttctaggaacttgacgtgatggggcttcctgaggagcgggtccggagcggcagcgggagccggggccaggaggaagctggagccggaggccgggcgcggagttggtctccgccgcccgaggtcagccgctccgcgcacgtcccctcgctgcagcgctaccgcgagctgcaccggcgctccgtggaggagccgcgggaattctggggagacattgccaaggaattttactggaagactccatgccctggcccattccttcggtacaactttgatgtgactaaagggaaaatcttcattgagtggatgaaaggagcaactaccaacatctgctacaatgtactggatcgaaatgtccatgagaaaaagcttggagataaagttgctttttactggctgccagcgggaccaggatggctattactggatcactggcaggattgatgacatgctcaatgtatctggacacctgctgagtacagcagaggtggagtcagcacttgtggaacatgaggctgttgcagaggcagctgtggtgggccaccctcatcctgtgaagggtgaatgcctctactgctttgtcaccttgtgtgatggccacaccttcagccccaagctcaccgaggagctcaagaagcagattagagaaaagattggccccattgccacaccagactacatccagaatgcacctggcttgcctaaaacccgctcagggaaaatcatgaggcgagtgcttcggaagattgctcagaatgaccatgacctcggggacatgtctactgtggctgacccatctgtcatcagtcacctcttcagccaccgctgcctgaccatccagtgaacatgatcctgacctttacctaggattcctcctgctccaaactttgcccatcctctttgccccctcaggagtgctgagggccagtgttgacccacactaccctcccttgaccagctgtctgggaccggaaaccagctttgtctccaggtagagacaacatcctgtgactgccaggcagaaaggacagggcccaggtcagcctcagtctgctgtgcctccagactgcagagctctcagaacccagaacagagacgaaaaggctacctctcctacccaagttaagtgttcaaaggggatgtgagggcctccactgaagcagggaggcagctgtgtaatcctatgtcagctctcttaggaagccccagtacttatattgggcatgcacttgcccttaaaaacaatgatttgtgagtccaggaacaatttactatttttaaaatattttgctgcttctgttctgggtctgaattcccttttgtgccagatgccagtactgtctgcccattggctccaggggctgtatgggcagattcagtctccagagggtattcagatcatctgcttctttgaaggagtaaatgtgttttgttcctagggccagaggagcttgtcttccttgtcctctgttcccaccctcccctgaacagaacccagcccataagagacattctcagatgaaactctgttttcttgccccagtcaggctcaagccctgtggttgtaggaataaagcctgtgatctcaa

SEQ ID NO: 440967 - DNA, 978 bp, Homo sapiens
agttcggcctgttttctcagtcccggcacccgccgcgaccgcaaaggcggccgcggttctaggaacttgacgtgatggggcttcctgaggagcgggtccggagcggcagcgggagccggggccaggaggaagctggagccggaggccgggcgcggagttggtctccgccgcccgaggtcagccgctccgcgcacgtcccctcgctgcagcgctaccgcgagctgcaccggcgctccgtggaggagccgcgggaattctggggagacattgccaaggaattttactggaagactccatgccctggcccattccttcggtacaactttgatgtgactaaagggaaaatcttcattgagtggatgaaaggagcaactaccaacatctgctacaatgtactggatcgaaatgtccatgagaaaaagcttggagataaagttgctttttactgggagggcaatgagccaggggagaccactcagatcacataccatcagcttctggtccaagtgtgtcagttcagcaatgttctccgaaaacagggcattcagaagggggaccgagtggccatctacatgcctatgatcccagagcttgtggtggccatgctggcatgtgcccgcattggggctttgcactccattgtgtttgcaggcttctcttcagagtctctatgtgaacggatcttggattccagctgcagtcttctcatcactacagatgccagtactgtctgcccattggctccaggggctgtatgggcagattcagtctccagagggtattcagatcatctgcttctttgaaggagtaaatgtgttttgttcctagggccagaggagcttgtcttccttgtcctctgttcccaccctcccctgaacagaacccagcccataagagacattctcagatgaaactctgttttcttgccccagtcaggctcaagccctgtggttgtaggaataaagcctgtgatctcaa

SEQ ID NO: 440968 - DNA, 360 bp, Homo sapiens
gacacctgctgagtacagcagaggtggagtcagcacttgtggaacatgaggctgttgcagaggcagctgtggtgggccaccctcatcctgtgaagggtgaatgcctctactgctttgtcaccttgtgtgatggccacaccttcagccccaagctcaccgaggagctcaagaagcagagtaaggagcctccctgggcagggactatagggtctgtcttggaggcccagttatcactgcaagttgttggggaggggctagagcaagctgctccccaaaccacaaacagattccagggggccccatgggctgattgccctcttcctgttcagtctccactagtctcccactaggataataata

SEQ ID NO: 440969 - DNA, 781 bp, Homo sapiens
ctctagtcgactgcgtgtatagggcaagctcaataaactctagaatcccaaagcacggattagtatgttgggattgtccaccatctgcaccgcgttatgaagtgatgctaactatgtcaccgtctgtactgctcgctctgcgtgatattacatgtgatcttgaagattcatctgacactgattagtggggagtagagctagtcctcccgtccttcattgcttgatttggttgtatacattaagaaatagttgtagaaagggtacgactgtggtcgatgaattagctggaaactcgtgggctgcagtaagtggatagacgcatacttatattcctcgtcctatcgatgctcacaataatctacctaatacacgtatttggtttcccgctcctatcagtgatcaatataatggcttgtgatgtctcgtagcaggtactagtagagataccacaacaaatataccaatcttaagtaaagggacatacagttgcaaatactcactgcaagaaggcaagattcccaagggagatgtgatagctgatcaggcttcccagacacctccttcccaaacgaccgtccatttcaaaagaaccgtcctttccaccaaacaccttcctttcccccaaaagccattcacatatacccaaatacatttcttccacaaaaaccctccatttaccaaaaacgccgtccgttcccccatacaattcctttccgagaaacatcatttctcagaaaacatccttcccaaacaacctccttcccaaaaacctcttttccag

SEQ ID NO: 440970 - DNA, 3186 bp, Homo sapiens
catttaatggaacaaagttctccaggatttaggcaaactcacctacaagatttatcagaagccactcaagatgtgaaggaagagaatcattatcttactcctcgaagtgttcttttagagttggataatatcattgcttccagtgattctggtgaatccattgaaactgatggtccagaccaggtctctggaagaattgagtgtcattatgagccaatggaatcctattttttcaaagagacatcccatgagtctgtggatagcagcaaagaggaaccccagacccttccagagacccaggatggggacctccacctgcaagaacaaggctcaggaattgattggtgtctttcccctgccgatgtggaagcacagaccacaaatgaccaaaaggggtcggcctcactaactgttgtgcaattgtctatattaatcaataatatccccgatgaaagccaagtggagaaactgaacgttttcctttctcctcctgatgtcatcaactatcttgctctcacagaagccacaggacggatatgtgtgtctcagtgggaaggccccccacgtttgggatgcatattttgccacggagatcatcttctggcagtgaatgacctgaaaccccagagcctggaggaggtctccctgtttcttacccggtccatccagaaggagaaattaaagcttaccatcggcaggatcccaaattcagagacattccatgccgcatcctgtatgtgtccctcaaaatgccaaagtgctgcaccttctcagctggataagcctagactgaacagagctcccaagaggagtccggccattaaaaagagccagcagaaaggagccagggagtaacgcaccccagacccatggcagcagaaccaggatggagctgggactgtccagctctgccccctgctgctgccatgtgataggagacagtcggcacccccctctgaatttctgtatctgcatcttaacaatggggatgactatcccctctctggttattgtatcagagatgttaagagggtcatgtggcatgattggagaacctgggggaattggaaggccttattatctcagctattgtcccaaacaccacagacacagattgggtcagtccttcatgtaatacatgctgtgttctgtgaggatgtggtccacacaattccttctttgttaagggacatacagttgcaaatactcactgcaagaaggcaagattcccaagggagatgtgatagctgatcaggcttcccagacacctccttcccaaacacctccttcccaacacctccttccccaacatccttccccaacacctccttccccaacacttccttcccaacacctccttcccaaacccctccttccccaacatccttcccaacacctccttcccaaacacctccttcccaaacacctccttcccaaacacctccttcccaacacctccttccccaacacctccttcccaaacacctctttcccaaacacctccttcccagacacctccttcccaacaccgccttcccaacacctccttcccaaacccctttcccaaacatctccttcccaaacacctgcctctcttcaaccccacaggccagagtgctgagacagagtggccttttggattcaataagtatcttgttctcttaaagactcagcaacgattttagaagtcgcagcagttttacatcacatgcagccaagatcagcttgctctacaagcaataacagaactacttagcacttcaaggttgaaagttcttcactaatggatccattgactaattgatcctggaaggccaaaggaataaaattcttttatataaataggaaaacaaaggcagagagctaaagcactaatcaaatcggggggtgttagagcaaaaacaggcttcagaaagagtattttaccatgcttcacatggaaaaaatcgagccccggagcgatgaaaggcatattttctttgtttctccaagtttcataaccgttcagttgcagaaccaagaatctaaaaccagctctgggaaacaaatgtccagatgccagcctcatagttgaacttggatttgaaaataccttcagcacttagaagagacattcaaatacatttcatttcctgttacccagattgttcggaaagtattaaaaatttttcatttacctgctgatacggtttggatctgtgtccctaacaaatcccatgtcgagctgtggtccccggtgttggagatggagcctggtgggaggcagctggatcgtgaggtcatgggggtggagttctcacgaaggagttagcatcatccccttggcgctattctcgtgagagtaagttctcgtgagatctggttgtttaaaagtgtgcagcacctctccgctcactctcttcctcctgctcctgccgtgtaagatgcctgctccatctgccgcaagtgaaagcttcctgaggtctccccggaagcagatgctgccacgcttcctgtacagcctgcagaactgtggaccaatcaaacctcttttcttataaattacctggtcttggggatttctttatttaatgtgagaacgcatgcccttttggatctactgtttctacttttataaatttatcctgcagaaatacacaaatacacaaagatacatgtaaaaaaagtagtttactgcagtactgtttgtaataataaaaaatcaggctggacctggtggttcatgcctataattccaaccctttgggaggccgggacaggtggatcacctgaggtctggagctcgagaacaacctgaccaacatggagaaaccctgtctctactaaaaatacaaaactagctgggcattgtggcacatgcctgcaatcccagctacttgagaggctggggcaggagaatcactagaaccgggaggcggaagttgcagtgagccaagatcatgccattgcactccagcctgggcaacaagaggaaaacccagtctcaaaaaacaaaaaaaaaaatcatgtgggtattgcttaattctgatttcatatcattgaacactgtagatattaaaatgttcagcaggcacagttctgtaaaattgttcgtgatacattaagaatgaaagaatcaagttgtataataaggataacatcatcccacttttgtacaaataaatgtttggtgtttgtgtgtatgta

SEQ ID NO: 440971 - DNA, 989 bp, Homo sapiens
catttaatggaacaaagttctccaggatttaggcaaactcacctacaagatttatcagaagccactcaagatgtgaaggaagagaatcattatcttactcctcgaagtgttcttttagagttggataatatcattgcttccagtgattctggtgaatccattgaaactgatggtccagaccaggtctctggaagaattgagtgtcattatgagccaatggaatcctattttttcaaagagacatcccatgagtctgtggatagcagcaaagaggaaccccagacccttccagagacccaggatggggacctccacctgcaagaacaaggctcaggaattgattggtgtctttcccctgccgatgtggaagcacagaccacaaatgaccaaaaggggtcggcctcactaactgttgtgcaattgtctatattaatcaataatatccccgatgaaagccaagtggagaaactgaacgttttcctttctcctcctgatgtcatcaactatcttgctctcacagaagccacaggacggatatgtgtgtctcagtgggaaggccccccacgtttgggatgcatattttgccacggagatcatcttctggcagtgaatgacctgaaaccccagagcctggaggaggtctccctgtttcttacccggtccatccagaaggaggactctttcaggattctttcatatcaagtagcatttggagaaggcactgagctaagagacagagcacctgggttcaggacctcagatcggcatgatgtagcaaaaagagcttgcatggaatcagactggtgcagggattccaaaacagctccttcaaccaatttgtgcctcagttttcttttctgtaaaattatgactaatgatggtgctggttgttggataattaaatgaggtaatatgtgtaacgtgcttacaaaggtgactggcacatattaggtgctcaataaagctactagttacttttacttctaaaa

SEQ ID NO: 440972 - DNA, 506 bp, Homo sapiens
tctccctgtttcttacccggtccatccagaaggaggtgagtcgtactgaccagccctgaacagggcaaatcagtaccagaaggaaaaagatcagggtcttagatggagtctgagaagtaccctgaatacaaataaggttcctcattcttccaccatcaagtgcaaataacagaatgtgctttcaggactctttcaggattctttcatatcaagtagcatttggagaaggcactgagctaagagacagagcacctgggttcaggacctcagatcggcatgatgtagcaaaaagagcttgcatggaatcagactggtgcagggattccaaaacagctccttcaaccaatttgtgcctcagttttcttttctgtaaaattatgactaatgatggtgctggttgttggataattaaatgaggtaatatgtgtaacgtgcttacaaaggtgactggcacatattaggtgctcaataaagctactagttacttttacttctaaaacaactga

SEQ ID NO: 440973 - DNA, 228 bp, Homo sapiens
ttggataatatcattgcttccagtgattctggtgaatccattgaaactgatggtccagaccaggtctctggaagaattgagtgtcattatgagccaatggaatcctagtaagtcaaaatgccgtttcaaaatttgatgtttgctcatctgctgttaaggaacaatgattgtcagttcatttcaatagttgataaactgatgccaaacattaccagagaccagtttcca

SEQ ID NO: 440974 - DNA, 3144 bp, Homo sapiens
catttaatggaacaaagttctccaggatttaggcaaactcacctacaagatttatcagaagccactcaagatgtgaaggaagagaatcattatcttactcctcgaagtgttcttttagagttggataatatcattgcttccagtgattctggtgaatccattgaaactgatggtccagaccaggtctctggaagaattgagtgtcattatgagccaatggaatcctattttttcaaagagacatcccatgagtctgtggatagcagcaaagaggaaccccagacccttccagagacccaggatggggacctccacctgcaagaacaaggctcaggaattgattggtgtctttcccctgccgatgtggaagcacagaccacaaatgaccaaaagggtaatatccccgatgaaagccaagtggagaaactgaacgttttcctttctcctcctgatgtcatcaactatcttgctctcacagaagccacaggacggatatgtgtgtctcagtgggaaggccccccacgtttgggatgcatattttgccacggagatcatcttctggcagtgaatgacctgaaaccccagagcctggaggaggtctccctgtttcttacccggtccatccagaaggagaaattaaagcttaccatcggcaggatcccaaattcagagacattccatgccgcatcctgtatgtgtccctcaaaatgccaaagtgctgcaccttctcagctggataagcctagactgaacagagctcccaagaggagtccggccattaaaaagagccagcagaaaggagccagggagtaacgcaccccagacccatggcagcagaaccaggatggagctgggactgtccagctctgccccctgctgctgccatgtgataggagacagtcggcacccccctctgaatttctgtatctgcatcttaacaatggggatgactatcccctctctggttattgtatcagagatgttaagagggtcatgtggcatgattggagaacctgggggaattggaaggccttattatctcagctattgtcccaaacaccacagacacagattgggtcagtccttcatgtaatacatgctgtgttctgtgaggatgtggtccacacaattccttctttgttaagggacatacagttgcaaatactcactgcaagaaggcaagattcccaagggagatgtgatagctgatcaggcttcccagacacctccttcccaaacacctccttcccaacacctccttccccaacatccttccccaacacctccttccccaacacttccttcccaacacctccttcccaaacccctccttccccaacatccttcccaacacctccttcccaaacacctccttcccaaacacctccttcccaaacacctccttcccaacacctccttccccaacacctccttcccaaacacctctttcccaaacacctccttcccagacacctccttcccaacaccgccttcccaacacctccttcccaaacccctttcccaaacatctccttcccaaacacctgcctctcttcaaccccacaggccagagtgctgagacagagtggccttttggattcaataagtatcttgttctcttaaagactcagcaacgattttagaagtcgcagcagttttacatcacatgcagccaagatcagcttgctctacaagcaataacagaactacttagcacttcaaggttgaaagttcttcactaatggatccattgactaattgatcctggaaggccaaaggaataaaattcttttatataaataggaaaacaaaggcagagagctaaagcactaatcaaatcggggggtgttagagcaaaaacaggcttcagaaagagtattttaccatgcttcacatggaaaaaatcgagccccggagcgatgaaaggcatattttctttgtttctccaagtttcataaccgttcagttgcagaaccaagaatctaaaaccagctctgggaaacaaatgtccagatgccagcctcatagttgaacttggatttgaaaataccttcagcacttagaagagacattcaaatacatttcatttcctgttacccagattgttcggaaagtattaaaaatttttcatttacctgctgatacggtttggatctgtgtccctaacaaatcccatgtcgagctgtggtccccggtgttggagatggagcctggtgggaggcagctggatcgtgaggtcatgggggtggagttctcacgaaggagttagcatcatccccttggcgctattctcgtgagagtaagttctcgtgagatctggttgtttaaaagtgtgcagcacctctccgctcactctcttcctcctgctcctgccgtgtaagatgcctgctccatctgccgcaagtgaaagcttcctgaggtctccccggaagcagatgctgccacgcttcctgtacagcctgcagaactgtggaccaatcaaacctcttttcttataaattacctggtcttggggatttctttatttaatgtgagaacgcatgcccttttggatctactgtttctacttttataaatttatcctgcagaaatacacaaatacacaaagatacatgtaaaaaaagtagtttactgcagtactgtttgtaataataaaaaatcaggctggacctggtggttcatgcctataattccaaccctttgggaggccgggacaggtggatcacctgaggtctggagctcgagaacaacctgaccaacatggagaaaccctgtctctactaaaaatacaaaactagctgggcattgtggcacatgcctgcaatcccagctacttgagaggctggggcaggagaatcactagaaccgggaggcggaagttgcagtgagccaagatcatgccattgcactccagcctgggcaacaagaggaaaacccagtctcaaaaaacaaaaaaaaaaatcatgtgggtattgcttaattctgatttcatatcattgaacactgtagatattaaaatgttcagcaggcacagttctgtaaaattgttcgtgatacattaagaatgaaagaatcaagttgtataataaggataacatcatcccacttttgtacaaataaatgtttggtgtttgtgtgtatgta

SEQ ID NO: 440975 - DNA, 565 bp, Homo sapiens
atccctttgaatcaggcctctctcttctcatcagtctgtagggaccttcccctactctgcctcttcctccatactaggttggaaaaatctggtttagcccactttttgcaacactcctgccaagtggtcttctacccattgcttgaaaatctctcttgacagggagctcactacctcacaaggcaggtcatttcattgtgggatctatagaaggttaagtaccacattctcctctaaaccttgcctacgacatgtttaatacttcatctacatagcagcccttcagataatcacaaccactttgcccccaagttttcaggttaagtagcatgaatttggtcattccttaaagacagggtttcaatttccacacatgatctctgcaaacaggcactgggttttcagtgtcctttttgaagggtcatataaaaataaggtaacaccacagtgccactacaccttctggggctggacttgtttcagcagctttggttgcactgaatttgggggagctgcatggtaccaggggtttattgggttgcagatatataaatgccctaaactt

SEQ ID NO: 440976 - DNA, 3697 bp, Homo sapiens
atgcagctcttggcttcgttcaaacggaccgcctttgctagcacccaatcagaacgctcgatcttcggctctcgtccaatgaacgcgcgtattggggaggggaaaaaagacggcgtgaagcccaatcgcagcgccattacacttgagggcaaagaggttaggaagccggcatggcgctccggtcaataaaatcgatagctggaagctgcctgtgttccaggcaaaggcggtgcggtagcagcgccgccattttccccgaaggcatcttccggtgcctttcacccaagttcgggcaggagtttcctgaataacagcaaaaggtttccgttagccccgcgggcgaccaattccgattccctccgggcctccccggccacgctcagccctggtccggcaggggctcctcgatcccaggggccgccagcgcccgagggccgaggcctggacacggaaggccgtggcgccggcttctcgggtcccatggcgccaccttcggctccgctccctgcgcagggaccaggaaaggccagacccagtcggaaaaggggcaggaggccgagggctctgaagttcgtggacgtggccgtgtacttctccccggaggagtggggctgcctgcggcccgcgcagagggccctgtaccgggacgtgatgcgggagacctacggtcacctgggcgcgctcgggtgcgcaggtcccaaaccagccctcatctcctggttggaacgaaacaccgatgactgggaaccggctgctctagatccgcaggagtacccgagagggctaacagtccagagaaaaagcagaaccagaaagaagaatggggagaaggaagtattcccgcctaaggaggcaccccgaaaggggaagcgaggccggaggcccagcaaaccccgactgattcctaggcagacgtccgggggccccatctgccctgactgcggctgtaccttccctgatcatcaggccctggagagccacaagtgcgcccagaatctaaaaaagccttacccttgcccagactgtgggcgccgcttttcctatccatccctgctggtcagtcaccggcgggcacactccggcgagtgcccctatgtttgtgaccagtgtggcaaacgtttctcccagcgcaagaacctctcccagcaccaggtcatccatacaggggagaagccctatcactgccctgactgtggtcgctgcttccggaggagccggtccttggccaatcaccggaccacacacacaggtgaaaaaccccaccagtgccctagctgtggacgtcgcttcgcctacccctccctgctagccatccaccagcgtacacacacgggagagaagccctacacttgcctcgagtgcaaccgccgcttccgccagcgcacggccctcgtcatccaccagcgcatccacacgggcgagaagccctacccgtgcccggactgcgagcggcgcttctcctcctcctctcgcctggtcagtcaccggcgtgtgcactctggggagcgtccctatgcctgcgagcactgtgaggcccgcttctcccagcgcagcacgctgctccagcaccagctcttgcacaccggagagaagccctacccctgcccagactgtgggcgtgccttccggcggagcggctccctggccatccatcgcagcacgcacacagaggagaagctgcacgcctgcgacgactgtggtcgccgctttgcctacccctcactgctggccagccaccggcgcgtgcactcgggcgagcggccctatgcctgcgacctttgctccaagcgttttgctcagtggagccacctggcccagcaccagctgctgcacacgggggagaagcctttcccctgcctcgagtgtggccggtgcttccgccagaggtggtctctggctgtccacaagtgtagccccaaggccccaaactgtagccctagatctgctatcgggggctccagtcagaggggcaacgcccattagaaggggaaggactgcctacgttcatttcattttatggagggtcccagaaaagggaaggaggagccccaggtcatacagggcagagtcagaactaaacccgggtctcctgctgcacagagctgaactttgtatcttgcaatgcgctggctgcctccctgtgcgtgtctggaacagtcccattaggagaggtgacgtcatttgcttaaagttttccaagctaccctatcctaaaatagtttgtgtggatatcagggctaaaagttctccccatctattttaggggctgtctgcttttctagtctgtccacacagggattacctgtcatcttgcatgcaatcaggagaatctcataggggcaggaccttcccctactctgcctcttcctccatactaggttggaaaaatctggtttagcccactttttgcaacactcctgccaagtggtcttctacccattgcttgaaaatctctcttgacagggagctcactacctcacaaggcaggtcatttcattgtgggatctatagaaggttaagtaccacattctcctctaaaccttgcctacgacatgtttaatacttcatctacatagcagcccttcagataatcacaaccactttgcccccaagttttcaggttaagtagcatgaatttggtcattccttaaagacagggtttcaatttccacacatgatctctgcaaacaggcactgggttttcagtgtcctttttgaagggtcatataaaaataaggtaacaccacagtgccactacaccttctggggctggacttgtttcagcagctttggttgcactgaatttgggggagctgcatggtaccaggggtttattgggttgcagatatataaatgccctaaacttaaaaaaaaaaaaaaagctataaaactaagtcttcatcttgtatttggaaaattggttcaagctgggtatgagacataagtgtagtcagctctgggagaaggttgctcttaaggagaagcagggacctgtggtttagcagcaggaagtgcaaatgggactggcttgtgctctacctggcagacctggattggcttcaggcagccagtgcctggaaaagcctggagaattgggccgtacttgaccctgattctcatcaggcacagatgaatcacaggcacctaagaatcggcacagaacttccatgaggcctcagtcagcattttttcacaaaatgagctgaggccattcaaggaggctagaaagagggaactgaatccagagaggaagagtctatagtcatcaagttgtatccatgccagcctccctccacagaggtggcagcagcgtggctcaatctgatccacctccatggcacccactgggtaggtgcttcataaagctttaccgagttaaatgtgaacaaggcctaccactttgccttgggcagctgcaccaaattagaatttccagatgtgactcatctcatattccaacagctggagtgggtcatcctttacccctgtggctccttcctacagctctcctgatctcagcacaagcaggggagcagctgggggaacacagctttatgtaattacctctgttcaatatttagcaagttgcattgtaacattgtaactgtttgtttctccttggatgatgagctacccccaagaaggggtcatatcagattgggtctcattaaaatgtctgatgaatgaaaaaaaatcc

SEQ ID NO: 440977 - DNA, 3425 bp, Homo sapiens
gctagaagcaaggagccccctgaccccttccttaaaacagatccttttgtctttgtcttcatttctgcgtttgtcctccttcattcagtcccaaaccaacagccacaagtggtgcctaatcagggacgtgaaggaagaagatctgctggagcagagaaactgaaactgaccagatgagtgagaaaccccaggacaaatctgctggcagaggatataagggcaaacaaagaagataaccattctccaaagtcaaggatgctctgagaacaccagtaaaaggaactcaggataatctcagctctaactcggccagagtggctccatcgctcaaatcgttccctccttcagtgattggctgagcctgccagagtcgaacagcggaaagcagccccggggcctcttgctgcccccagggtgcgcaggtcccaaaccagccctcatctcctggttggaacgaaacaccgatgactgggaaccggctgctctagatccgcaggagtacccgagagggctaacagtccagagaaaaagcagaaccagaaagaagaatggggagaaggaagtattcccgcctaaggaggcaccccgaaaggggaagcgaggccggaggcccagcaaaccccgactgattcctaggcagacgtccgggggccccatctgccctgactgcggctgtaccttccctgatcatcaggccctggagagccacaagtgcgcccagaatctaaaaaagccttacccttgcccagactgtgggcgccgcttttcctatccatccctgctggtcagtcaccggcgggcacactccggcgagtgcccctatgtttgtgaccagtgtggcaaacgtttctcccagcgcaagaacctctcccagcaccaggtcatccatacaggggagaagccctatcactgccctgactgtggtcgctgcttccggaggagccggtccttggccaatcaccggaccacacacacaggtgaaaaaccccaccagtgccctagctgtggacgtcgcttcgcctacccctccctgctagccatccaccagcgtacacacacgggagagaagccctacacttgcctcgagtgcaaccgccgcttccgccagcgcacggccctcgtcatccaccagcgcatccacacgggcgagaagccctacccgtgcccggactgcgagcggcgcttctcctcctcctctcgcctggtcagtcaccggcgtgtgcactctggggagcgtccctatgcctgcgagcactgtgaggcccgcttctcccagcgcagcacgctgctccagcaccagctcttgcacaccggagagaagccctacccctgcccagactgtgggcgtgccttccggcggagcggctccctggccatccatcgcagcacgcacacagaggagaagctgcacgcctgcgacgactgtggtcgccgctttgcctacccctcactgctggccagccaccggcgcgtgcactcgggcgagcggccctatgcctgcgacctttgctccaagcgttttgctcagtggagccacctggcccagcaccagctgctgcacacgggggagaagcctttcccctgcctcgagtgtggccggtgcttccgccagaggtggtctctggctgtccacaagtgtagccccaaggccccaaactgtagccctagatctgctatcgggggctccagtcagaggggcaacgcccattagaaggggaaggactgcctacgttcatttcattttatggagggtcccagaaaagggaaggaggagccccaggtcatacagggcagagtcagaactaaacccgggtctcctgctgcacagagctgaactttgtatcttgcaatgcgctggctgcctccctgtgcgtgtctggaacagtcccattaggagaggtgacgtcatttgcttaaagttttccaagctaccctatcctaaaatagtttgtgtggatatcagggctaaaagttctccccatctattttaggggctgtctgcttttctagtctgtccacacagggattacctgtcatcttgcatgcaatcaggagaatctcataggggcaggaccttcccctactctgcctcttcctccatactaggttggaaaaatctggtttagcccactttttgcaacactcctgccaagtggtcttctacccattgcttgaaaatctctcttgacagggagctcactacctcacaaggcaggtcatttcattgtgggatctatagaaggttaagtaccacattctcctctaaaccttgcctacgacatgtttaatacttcatctacatagcagcccttcagataatcacaaccactttgcccccaagttttcaggttaagtagcatgaatttggtcattccttaaagacagggtttcaatttccacacatgatctctgcaaacaggcactgggttttcagtgtcctttttgaagggtcatataaaaataaggtaacaccacagtgccactacaccttctggggctggacttgtttcagcagctttggttgcactgaatttgggggagctgcatggtaccaggggtttattgggttgcagatatataaatgccctaaacttaaaaaaaaaaaaaaagctataaaactaagtcttcatcttgtatttggaaaattggttcaagctgggtatgagacataagtgtagtcagctctgggagaaggttgctcttaaggagaagcagggacctgtggtttagcagcaggaagtgcaaatgggactggcttgtgctctacctggcagacctggattggcttcaggcagccagtgcctggaaaagcctggagaattgggccgtacttgaccctgattctcatcaggcacagatgaatcacaggcacctaagaatcggcacagaacttccatgaggcctcagtcagcattttttcacaaaatgagctgaggccattcaaggaggctagaaagagggaactgaatccagagaggaagagtctatagtcatcaagttgtatccatgccagcctccctccacagaggtggcagcagcgtggctcaatctgatccacctccatggcacccactgggtaggtgcttcataaagctttaccgagttaaatgtgaacaaggcctaccactttgccttgggcagctgcaccaaattagaatttccagatgtgactcatctcatattccaacagctggagtgggtcatcctttacccctgtggctccttcctacagctctcctgatctcagcacaagcaggggagcagctgggggaacacagctttatgtaattacctctgttcaatatttagcaagttgcattgtaacattgtaactgtttgtttctccttggatgatgagctacccccaagaaggggtcatatcagattgggtctcattaaaatgtctgatgaatgaaaaaaaatcc

SEQ ID NO: 440978 - DNA, 3230 bp, Homo sapiens
gctagaagcaaggagccccctgaccccttccttaaaacagatccttttgtctttgtcttcatttctgcgtttgtcctccttcattcagtcccaaaccaacagccacaagtggtgcctaatcagggacgtgaaggaagaagatctgctggagcagagaaactgaaactgaccagatgagtgagaaaccccaggacaaatctgctggcagaggatataagggtgcgcaggtcccaaaccagccctcatctcctggttggaacgaaacaccgatgactgggaaccggctgctctagatccgcaggagtacccgagagggctaacagtccagagaaaaagcagaaccagaaagaagaatggggagaaggaagtattcccgcctaaggaggcaccccgaaaggggaagcgaggccggaggcccagcaaaccccgactgattcctaggcagacgtccgggggccccatctgccctgactgcggctgtaccttccctgatcatcaggccctggagagccacaagtgcgcccagaatctaaaaaagccttacccttgcccagactgtgggcgccgcttttcctatccatccctgctggtcagtcaccggcgggcacactccggcgagtgcccctatgtttgtgaccagtgtggcaaacgtttctcccagcgcaagaacctctcccagcaccaggtcatccatacaggggagaagccctatcactgccctgactgtggtcgctgcttccggaggagccggtccttggccaatcaccggaccacacacacaggtgaaaaaccccaccagtgccctagctgtggacgtcgcttcgcctacccctccctgctagccatccaccagcgtacacacacgggagagaagccctacacttgcctcgagtgcaaccgccgcttccgccagcgcacggccctcgtcatccaccagcgcatccacacgggcgagaagccctacccgtgcccggactgcgagcggcgcttctcctcctcctctcgcctggtcagtcaccggcgtgtgcactctggggagcgtccctatgcctgcgagcactgtgaggcccgcttctcccagcgcagcacgctgctccagcaccagctcttgcacaccggagagaagccctacccctgcccagactgtgggcgtgccttccggcggagcggctccctggccatccatcgcagcacgcacacagaggagaagctgcacgcctgcgacgactgtggtcgccgctttgcctacccctcactgctggccagccaccggcgcgtgcactcgggcgagcggccctatgcctgcgacctttgctccaagcgttttgctcagtggagccacctggcccagcaccagctgctgcacacgggggagaagcctttcccctgcctcgagtgtggccggtgcttccgccagaggtggtctctggctgtccacaagtgtagccccaaggccccaaactgtagccctagatctgctatcgggggctccagtcagaggggcaacgcccattagaaggggaaggactgcctacgttcatttcattttatggagggtcccagaaaagggaaggaggagccccaggtcatacagggcagagtcagaactaaacccgggtctcctgctgcacagagctgaactttgtatcttgcaatgcgctggctgcctccctgtgcgtgtctggaacagtcccattaggagaggtgacgtcatttgcttaaagttttccaagctaccctatcctaaaatagtttgtgtggatatcagggctaaaagttctccccatctattttaggggctgtctgcttttctagtctgtccacacagggattacctgtcatcttgcatgcaatcaggagaatctcataggggcaggaccttcccctactctgcctcttcctccatactaggttggaaaaatctggtttagcccactttttgcaacactcctgccaagtggtcttctacccattgcttgaaaatctctcttgacagggagctcactacctcacaaggcaggtcatttcattgtgggatctatagaaggttaagtaccacattctcctctaaaccttgcctacgacatgtttaatacttcatctacatagcagcccttcagataatcacaaccactttgcccccaagttttcaggttaagtagcatgaatttggtcattccttaaagacagggtttcaatttccacacatgatctctgcaaacaggcactgggttttcagtgtcctttttgaagggtcatataaaaataaggtaacaccacagtgccactacaccttctggggctggacttgtttcagcagctttggttgcactgaatttgggggagctgcatggtaccaggggtttattgggttgcagatatataaatgccctaaacttaaaaaaaaaaaaaaagctataaaactaagtcttcatcttgtatttggaaaattggttcaagctgggtatgagacataagtgtagtcagctctgggagaaggttgctcttaaggagaagcagggacctgtggtttagcagcaggaagtgcaaatgggactggcttgtgctctacctggcagacctggattggcttcaggcagccagtgcctggaaaagcctggagaattgggccgtacttgaccctgattctcatcaggcacagatgaatcacaggcacctaagaatcggcacagaacttccatgaggcctcagtcagcattttttcacaaaatgagctgaggccattcaaggaggctagaaagagggaactgaatccagagaggaagagtctatagtcatcaagttgtatccatgccagcctccctccacagaggtggcagcagcgtggctcaatctgatccacctccatggcacccactgggtaggtgcttcataaagctttaccgagttaaatgtgaacaaggcctaccactttgccttgggcagctgcaccaaattagaatttccagatgtgactcatctcatattccaacagctggagtgggtcatcctttacccctgtggctccttcctacagctctcctgatctcagcacaagcaggggagcagctgggggaacacagctttatgtaattacctctgttcaatatttagcaagttgcattgtaacattgtaactgtttgtttctccttggatgatgagctacccccaagaaggggtcatatcagattgggtctcattaaaatgtctgatgaatgaaaaaaaatcc

SEQ ID NO: 440979 - DNA, 2953 bp, Homo sapiens
ctcctataacgttctacctctaacggctctgtccagagttttggttgggctagggaaagcagaaccagaaagaagaatggggagaaggaagtattcccgcctaaggaggcaccccgaaaggggaagcgaggccggaggcccagcaaaccccgactgattcctaggcagacgtccgggggccccatctgccctgactgcggctgtaccttccctgatcatcaggccctggagagccacaagtgcgcccagaatctaaaaaagccttacccttgcccagactgtgggcgccgcttttcctatccatccctgctggtcagtcaccggcgggcacactccggcgagtgcccctatgtttgtgaccagtgtggcaaacgtttctcccagcgcaagaacctctcccagcaccaggtcatccatacaggggagaagccctatcactgccctgactgtggtcgctgcttccggaggagccggtccttggccaatcaccggaccacacacacaggtgaaaaaccccaccagtgccctagctgtggacgtcgcttcgcctacccctccctgctagccatccaccagcgtacacacacgggagagaagccctacacttgcctcgagtgcaaccgccgcttccgccagcgcacggccctcgtcatccaccagcgcatccacacgggcgagaagccctacccgtgcccggactgcgagcggcgcttctcctcctcctctcgcctggtcagtcaccggcgtgtgcactctggggagcgtccctatgcctgcgagcactgtgaggcccgcttctcccagcgcagcacgctgctccagcaccagctcttgcacaccggagagaagccctacccctgcccagactgtgggcgtgccttccggcggagcggctccctggccatccatcgcagcacgcacacagaggagaagctgcacgcctgcgacgactgtggtcgccgctttgcctacccctcactgctggccagccaccggcgcgtgcactcgggcgagcggccctatgcctgcgacctttgctccaagcgttttgctcagtggagccacctggcccagcaccagctgctgcacacgggggagaagcctttcccctgcctcgagtgtggccggtgcttccgccagaggtggtctctggctgtccacaagtgtagccccaaggccccaaactgtagccctagatctgctatcgggggctccagtcagaggggcaacgcccattagaaggggaaggactgcctacgttcatttcattttatggagggtcccagaaaagggaaggaggagccccaggtcatacagggcagagtcagaactaaacccgggtctcctgctgcacagagctgaactttgtatcttgcaatgcgctggctgcctccctgtgcgtgtctggaacagtcccattaggagaggtgacgtcatttgcttaaagttttccaagctaccctatcctaaaatagtttgtgtggatatcagggctaaaagttctccccatctattttaggggctgtctgcttttctagtctgtccacacagggattacctgtcatcttgcatgcaatcaggagaatctcataggggcaggaccttcccctactctgcctcttcctccatactaggttggaaaaatctggtttagcccactttttgcaacactcctgccaagtggtcttctacccattgcttgaaaatctctcttgacagggagctcactacctcacaaggcaggtcatttcattgtgggatctatagaaggttaagtaccacattctcctctaaaccttgcctacgacatgtttaatacttcatctacatagcagcccttcagataatcacaaccactttgcccccaagttttcaggttaagtagcatgaatttggtcattccttaaagacagggtttcaatttccacacatgatctctgcaaacaggcactgggttttcagtgtcctttttgaagggtcatataaaaataaggtaacaccacagtgccactacaccttctggggctggacttgtttcagcagctttggttgcactgaatttgggggagctgcatggtaccaggggtttattgggttgcagatatataaatgccctaaacttaaaaaaaaaaaaaaagctataaaactaagtcttcatcttgtatttggaaaattggttcaagctgggtatgagacataagtgtagtcagctctgggagaaggttgctcttaaggagaagcagggacctgtggtttagcagcaggaagtgcaaatgggactggcttgtgctctacctggcagacctggattggcttcaggcagccagtgcctggaaaagcctggagaattgggccgtacttgaccctgattctcatcaggcacagatgaatcacaggcacctaagaatcggcacagaacttccatgaggcctcagtcagcattttttcacaaaatgagctgaggccattcaaggaggctagaaagagggaactgaatccagagaggaagagtctatagtcatcaagttgtatccatgccagcctccctccacagaggtggcagcagcgtggctcaatctgatccacctccatggcacccactgggtaggtgcttcataaagctttaccgagttaaatgtgaacaaggcctaccactttgccttgggcagctgcaccaaattagaatttccagatgtgactcatctcatattccaacagctggagtgggtcatcctttacccctgtggctccttcctacagctctcctgatctcagcacaagcaggggagcagctgggggaacacagctttatgtaattacctctgttcaatatttagcaagttgcattgtaacattgtaactgtttgtttctccttggatgatgagctacccccaagaaggggtcatatcagattgggtctcattaaaatgtctgatgaatgaaaaaaaatcc

SEQ ID NO: 440980 - DNA, 2744 bp, Homo sapiens
atgcagctcttggcttcgttcaaacggaccgcctttgctagcacccaatcagaacgctcgatcttcggctctcgtccaatgaacgcgcgtattggggaggggaaaaaagacggcgtgaagcccaatcgcagcgccattacacttgagggcaaagaggttaggaagccggcatggcgctccggtcaataaaatcgatagctggaagctgcctgtgttccaggcaaaggcggtgcggtagcagcgccgccattttccccgaaggcatcttccggtgcctttcacccaagttcgggcaggagtttcctgaataacagcaaaaggtttccgttagccccgcgggcgaccaattccgattccctccgggcctccccggccacgctcagccctggtccggcaggggctcctcgatcccaggggccgccagcgcccgagggccgaggcctggacacggaaggccgtggcgccggcttctcgggtcccatggcgccaccttcggctccgctccctgcgcagggaccaggaaaggccagacccagtcggaaaaggggcaggaggccgagggctctgaagttcgtggacgtggccgtgtacttctccccggaggagtggggctgcctgcggcccgcgcagagggccctgtaccgggacgtgatgcgggagacctacggtcacctgggcgcgctcgggtgcgcaggtcccaaaccagccctcatctcctggttggaacgaaacaccgatgactgggaaccggctgctctagatccgcaggagtacccgagagggctaacagtccagagaaaaagcagaaccagaaagaagaatggggagaaggaagtattcccgcctaaggaggcaccccgaaaggggaagcgaggccggaggcccagcaaaccccgactgattcctaggcagacgtccgggggccccatctgccctgactgcggctgtaccttccctgatcatcaggccctggagagccacaagtgcgcccagaatctaaaaaagccttacccttgcccagactgtgggcgccgcttttcctatccatccctgctggtcagtcaccggcgggcacactccggcgagtgcccctatgtttgtgaccagtgtggcaaacgtttctcccagcgcaagaacctctcccagcaccaggtcatccatacaggggagaagccctatcactgccctgactgtggtcgctgcttccggaggagccggtccttggccaatcaccggaccacacacacaggtgaaaaaccccaccagtgccctagctgtggacgtcgcttcgcctacccctccctgctagccatccaccagcgtacacacacgggagagaagccctacacttgcctcgagtgcaaccgccgcttccgccagcgcacggccctcgtcatccaccagcgcatccacacgggcgagaagccctacccgtgcccggactgcgagcggcgcttctcctcctcctctcgcctggtcagtcaccggcgtgtgcactctggggagcgtccctatgcctgcgagcactgtgaggcccgcttctcccagcgcagcacgctgctccagcaccagctcttgcacaccggagagaagccctacccctgcccagactgtgggcgtgccttccggcggagcggctccctggccatccatcgcagcacgcacacagaggagaagctgcacgcctgcgacgactgtggtcgccgctttgcctacccctcactgctggccagccaccggcgcgtgcactcgggcgagcggccctatgcctgcgacctttgctccaagcgttttgctcagtggagccacctggcccagcaccagctgctgcacacgggggagaagcctttcccctgcctcgagtgtggccggtgcttccgccagaggtggtctctggctgtccacaagtgtagccccaaggccccaaactgtagccctagatctgctatcgggggctccagtcagaggggcaacgcccattagaaggggaaggactgcctacgttcatttcattttatggagggtcccagaaaagggaaggaggagccccaggtcatacagggcagagtcagaactaaacccgggtctcctgctgcacagagctgaactttgtatcagtgcctggaaaagcctggagaattgggccgtacttgaccctgattctcatcaggcacagatgaatcacaggcacctaagaatcggcacagaacttccatgaggcctcagtcagcattttttcacaaaatgagctgaggccattcaaggaggctagaaagagggaactgaatccagagaggaagagtctatagtcatcaagttgtatccatgccagcctccctccacagaggtggcagcagcgtggctcaatctgatccacctccatggcacccactgggtaggtgcttcataaagctttaccgagttaaatgtgaacaaggcctaccactttgccttgggcagctgcaccaaattagaatttccagatgtgactcatctcatattccaacagctggagtgggtcatcctttacccctgtggctccttcctacagctctcctgatctcagcacaagcaggggagcagctgggggaacacagctttatgtaattacctctgttcaatatttagcaagttgcattgtaacattgtaactgtttgtttctccttggatgatgagctacccccaagaaggggtcatatcagattgggtctcattaaaatgtctgatgaatgaaaaaaaatcc

SEQ ID NO: 440981 - DNA, 2866 bp, Homo sapiens
atgcagctcttggcttcgttcaaacggaccgcctttgctagcacccaatcagaacgctcgatcttcggctctcgtccaatgaacgcgcgtattggggaggggaaaaaagacggcgtgaagcccaatcgcagcgccattacacttgagggcaaagaggttaggaagccggcatggcgctccggtcaataaaatcgatagctggaagctgcctgtgttccaggcaaaggcggtgcggtagcagcgccgccattttccccgaaggcatcttccggtgcctttcacccaagttcgggcaggagtttcctgaataacagcaaaaggtttccgttagccccgcgggcgaccaattccgattccctccgggcctccccggccacgctcagccctggtccggcaggggctcctcgatcccaggggccgccagcgcccgagggccgaggcctggacacggaaggccgtggcgccggcttctcgggtcccatggcgccaccttcggctccgctccctgcgcagggaccaggaaaggccagacccagtcggaaaaggggcaggaggccgagggctctgaagttcgtggacgtggccgtgtacttctccccggaggagtggggctgcctgcggcccgcgcagagggccctgtaccgggacgtgatgcgggagacctacggtcacctgggcgcgctcgggtgcgcaggtcccaaaccagccctcatctcctggttggaacgaaacaccgatgactgggaaccggctgctctagatccgcaggagtacccgagagggctaacagtccagagaaaaagcagaaccagaaagaagaatggggagaaggaagtattcccgcctaaggaggcaccccgaaaggggaagcgaggccggaggcccagcaaaccccgactgattcctaggcagacgtccgggggccccatctgccctgactgcggctgtaccttccctgatcatcaggccctggagagccacaagtgcgcccagaatctaaaaaagccttacccttgcccagactgtgggcgccgcttttcctatccatccctgctggtcagtcaccggcgggcacactccggcgagtgcccctatgtttgtgaccagtgtggcaaacgtttctcccagcgcaagaacctctcccagcaccaggtcatccatacaggggagaagccctatcactgccctgactgtggtcgctgcttccggaggagccggtccttggccaatcaccggaccacacacacaggtgaaaaaccccaccagtgccctagctgtggacgtcgcttcgcctacccctccctgctagccatccaccagcgtacacacacgggagagaagccctacacttgcctcgagtgcaaccgccgcttccgccagcgcacggccctcgtcatccaccagcgcatccacacgggcgagaagccctacccgtgcccggactgcgagcggcgcttctcctcctcctctcgcctggtcagtcaccggcgtgtgcactctggggagcgtccctatgcctgcgagcactgtgaggcccgcttctcccagcgcagcacgctgctccagcaccagctcttgcacaccggagagaagccctacccctgcccagactgtgggcgtgccttccggcggagcggctccctggccatccatcgcagcacgcacacagaggagaagctgcacgcctgcgacgactgtggtcgccgctttgcctacccctcactgctggccagccaccggcgcgtgcactcgggcgagcggccctatgcctgcgacctttgctccaagcgttttgctcagtggagccacctggcccagcaccagctgctgcacacgggggagaagcctttcccctgcctcgagtgtggccggtgcttccgccagaggtggtctctggctgtccacaagtgtagccccaaggccccaaactgtagccctagatctgctatcgggggctccagtcagaggggcaacgcccattagaaggggaaggactgcctacgttcatttcattttatggagggtcccagaaaagggaaggaggagccccaggtcatacagggcagagtcagaactaaacccgggtctcctgctgcacagagctgaactttgtatcttgcaatgcgctggctgcctccctgtgcgtgtctggaacagtcccattaggagaggtgacgtcatttgcttaaagttttccaagctaccctatcctaaaatagtttgtgtggatatcagggctaaaagttctccccatctattttaggggctgtctgcttttctagtctgtccacacagggattacctgtcatcttgcatgcaatcaggagaatctcataggggcaggaccttcccctactctgcctcttcctccatactaggttggaaaaatctggtttagcccactttttgcaacactcctgccaagtggtcttctacccattgcttgaaaatctctcttgacagggagctcactacctcacaaggcaggtcatttcattgtgggatctatagaaggttaagtaccacattctcctctaaaccttgcctacgacatgtttaatacttcatctacatagcagcccttcagataatcacaaccactttgcccccaagttttcaggttaagtagcatgaatttggtcattccttaaagacagggtttcaatttccacacatgatctctgcaaacaggcactgggttttcagtgtcctttttgaagggtcatataaaaataaggtaacaccacagtgccactacaccttctggggctggacttgtttcagcagctttggttgcactgaatttgggggagctgcatggtaccaggggtttattgggttgcagatatataaatgccctaaactt

SEQ ID NO: 440982 - DNA, 3168 bp, Homo sapiens
atgcagctcttggcttcgttcaaacggaccgcctttgctagcacccaatcagaacgctcgatcttcggctctcgtccaatgaacgcgcgtattggggaggggaaaaaagacggcgtgaagcccaatcgcagcgccattacacttgagggcaaagagggtgcgcaggtcccaaaccagccctcatctcctggttggaacgaaacaccgatgactgggaaccggctgctctagatccgcaggagtacccgagagggctaacagtccagagaaaaagcagaaccagaaagaagaatggggagaaggaagtattcccgcctaaggaggcaccccgaaaggggaagcgaggccggaggcccagcaaaccccgactgattcctaggcagacgtccgggggccccatctgccctgactgcggctgtaccttccctgatcatcaggccctggagagccacaagtgcgcccagaatctaaaaaagccttacccttgcccagactgtgggcgccgcttttcctatccatccctgctggtcagtcaccggcgggcacactccggcgagtgcccctatgtttgtgaccagtgtggcaaacgtttctcccagcgcaagaacctctcccagcaccaggtcatccatacaggggagaagccctatcactgccctgactgtggtcgctgcttccggaggagccggtccttggccaatcaccggaccacacacacaggtgaaaaaccccaccagtgccctagctgtggacgtcgcttcgcctacccctccctgctagccatccaccagcgtacacacacgggagagaagccctacacttgcctcgagtgcaaccgccgcttccgccagcgcacggccctcgtcatccaccagcgcatccacacgggcgagaagccctacccgtgcccggactgcgagcggcgcttctcctcctcctctcgcctggtcagtcaccggcgtgtgcactctggggagcgtccctatgcctgcgagcactgtgaggcccgcttctcccagcgcagcacgctgctccagcaccagctcttgcacaccggagagaagccctacccctgcccagactgtgggcgtgccttccggcggagcggctccctggccatccatcgcagcacgcacacagaggagaagctgcacgcctgcgacgactgtggtcgccgctttgcctacccctcactgctggccagccaccggcgcgtgcactcgggcgagcggccctatgcctgcgacctttgctccaagcgttttgctcagtggagccacctggcccagcaccagctgctgcacacgggggagaagcctttcccctgcctcgagtgtggccggtgcttccgccagaggtggtctctggctgtccacaagtgtagccccaaggccccaaactgtagccctagatctgctatcgggggctccagtcagaggggcaacgcccattagaaggggaaggactgcctacgttcatttcattttatggagggtcccagaaaagggaaggaggagccccaggtcatacagggcagagtcagaactaaacccgggtctcctgctgcacagagctgaactttgtatcttgcaatgcgctggctgcctccctgtgcgtgtctggaacagtcccattaggagaggtgacgtcatttgcttaaagttttccaagctaccctatcctaaaatagtttgtgtggatatcagggctaaaagttctccccatctattttaggggctgtctgcttttctagtctgtccacacagggattacctgtcatcttgcatgcaatcaggagaatctcataggggcaggaccttcccctactctgcctcttcctccatactaggttggaaaaatctggtttagcccactttttgcaacactcctgccaagtggtcttctacccattgcttgaaaatctctcttgacagggagctcactacctcacaaggcaggtcatttcattgtgggatctatagaaggttaagtaccacattctcctctaaaccttgcctacgacatgtttaatacttcatctacatagcagcccttcagataatcacaaccactttgcccccaagttttcaggttaagtagcatgaatttggtcattccttaaagacagggtttcaatttccacacatgatctctgcaaacaggcactgggttttcagtgtcctttttgaagggtcatataaaaataaggtaacaccacagtgccactacaccttctggggctggacttgtttcagcagctttggttgcactgaatttgggggagctgcatggtaccaggggtttattgggttgcagatatataaatgccctaaacttaaaaaaaaaaaaaaagctataaaactaagtcttcatcttgtatttggaaaattggttcaagctgggtatgagacataagtgtagtcagctctgggagaaggttgctcttaaggagaagcagggacctgtggtttagcagcaggaagtgcaaatgggactggcttgtgctctacctggcagacctggattggcttcaggcagccagtgcctggaaaagcctggagaattgggccgtacttgaccctgattctcatcaggcacagatgaatcacaggcacctaagaatcggcacagaacttccatgaggcctcagtcagcattttttcacaaaatgagctgaggccattcaaggaggctagaaagagggaactgaatccagagaggaagagtctatagtcatcaagttgtatccatgccagcctccctccacagaggtggcagcagcgtggctcaatctgatccacctccatggcacccactgggtaggtgcttcataaagctttaccgagttaaatgtgaacaaggcctaccactttgccttgggcagctgcaccaaattagaatttccagatgtgactcatctcatattccaacagctggagtgggtcatcctttacccctgtggctccttcctacagctctcctgatctcagcacaagcaggggagcagctgggggaacacagctttatgtaattacctctgttcaatatttagcaagttgcattgtaacattgtaactgtttgtttctccttggatgatgagctacccccaagaaggggtcatatcagattgggtctcattaaaatgtctgatgaatgaaaaaaaatcc

SEQ ID NO: 440983 - DNA, 2220 bp, Homo sapiens
taggctagtagagctgggtgttaatcggccgtccctatgcctgcgagcactgtgaggcccgcttctcccagcgcagcacgctgctccagcaccagctcttgcacaccggagagaagccctacccctgcccagactgtgggcgtgccttccggcggagcggctccctggccatccatcgcagcacgcacacagaggagaagctgcacgcctgcgacgactgtggtcgccgctttgcctacccctcactgctggccagccaccggcgcgtgcactcgggcgagcggccctatgcctgcgacctttgctccaagcgttttgctcagtggagccacctggcccagcaccagctgctgcacacgggggagaagcctttcccctgcctcgagtgtggccggtgcttccgccagaggtggtctctggctgtccacaagtgtagccccaaggccccaaactgtagccctagatctgctatcgggggctccagtcagaggggcaacgcccattagaaggggaaggactgcctacgttcatttcattttatggagggtcccagaaaagggaaggaggagccccaggtcatacagggcagagtcagaactaaacccgggtctcctgctgcacagagctgaactttgtatcttgcaatgcgctggctgcctccctgtgcgtgtctggaacagtcccattaggagaggtgacgtcatttgcttaaagttttccaagctaccctatcctaaaatagtttgtgtggatatcagggctaaaagttctccccatctattttaggggctgtctgcttttctagtctgtccacacagggattacctgtcatcttgcatgcaatcaggagaatctcataggggcaggaccttcccctactctgcctcttcctccatactaggttggaaaaatctggtttagcccactttttgcaacactcctgccaagtggtcttctacccattgcttgaaaatctctcttgacagggagctcactacctcacaaggcaggtcatttcattgtgggatctatagaaggttaagtaccacattctcctctaaaccttgcctacgacatgtttaatacttcatctacatagcagcccttcagataatcacaaccactttgcccccaagttttcaggttaagtagcatgaatttggtcattccttaaagacagggtttcaatttccacacatgatctctgcaaacaggcactgggttttcagtgtcctttttgaagggtcatataaaaataaggtaacaccacagtgccactacaccttctggggctggacttgtttcagcagctttggttgcactgaatttgggggagctgcatggtaccaggggtttattgggttgcagatatataaatgccctaaacttaaaaaaaaaaaaaaagctataaaactaagtcttcatcttgtatttggaaaattggttcaagctgggtatgagacataagtgtagtcagctctgggagaaggttgctcttaaggagaagcagggacctgtggtttagcagcaggaagtgcaaatgggactggcttgtgctctacctggcagacctggattggcttcaggcagccagtgcctggaaaagcctggagaattgggccgtacttgaccctgattctcatcaggcacagatgaatcacaggcacctaagaatcggcacagaacttccatgaggcctcagtcagcattttttcacaaaatgagctgaggccattcaaggaggctagaaagagggaactgaatccagagaggaagagtctatagtcatcaagttgtatccatgccagcctccctccacagaggtggcagcagcgtggctcaatctgatccacctccatggcacccactgggtaggtgcttcataaagctttaccgagttaaatgtgaacaaggcctaccactttgccttgggcagctgcaccaaattagaatttccagatgtgactcatctcatattccaacagctggagtgggtcatcctttacccctgtggctccttcctacagctctcctgatctcagcacaagcaggggagcagctgggggaacacagctttatgtaattacctctgttcaatatttagcaagttgcattgtaacattgtaactgtttgtttctccttggatgatgagctacccccaagaaggggtcatatcagattgggtctcattaaaatgtctgatgaatgaaaaaaaatcc

SEQ ID NO: 440984 - DNA, 562 bp, Homo sapiens
cggaggagtggggctgcctgcggcccgcgcagagggccctgtaccgggacgtgatgcgggagacctacggtcacctgggcgcgctcggtgaggccggccccatccgctgccgcggggcgcgaagggatgcaggagccggagagggtgtaggcagggaggccacggtcctggcaggcgaccaggttgtcaggggaggtgggcaggggcttagcaggaggtgccgtcggggagatactactcggcgtgatctaggagctggccttctgatttgttctctttccccagggtgcgcaggtcccaaaccagccctcatctcctggttggaacgaaacaccgatgactgggaaccggctgctctagatccgcaggagtacccgagagggctaacagtccagagaagtgagtgctaaataaccacgcagagcctgcagccctcctataacgttctacctctaacggctctgtccagagttttggttgggctaggggtgggtgccgcgtatttagtatattcatcttcccagcctcttgtgtctggtggtgtggggccggtccaccacac

SEQ ID NO: 440985 - DNA, 350 bp, Homo sapiens
tttaagaattagtttcattgaagtacggggacttatacaacccagtattagttttgagcgtacagacatatgtggaactattcttggaaagtctacaaagtgaaatctatcgagttatttctcatttgcaaagtgatcctttgagtcatttctcataatctataatctgaatgttaatactgatatttttaaaagccctacatcccaacagaccaggccatctagatatttcagcgtggtgtctcaggatgagtaaacaaacagctaaaaatatatgacttatgtaaactagagttacaggagttactagcttttctgaaagggatatattctaagtattttttcttaaa

SEQ ID NO: 440986 - DNA, 2995 bp, Homo sapiens
ccctcgtctgggccgagcccgcccagctggctgagacgcgtggagcctggcggcgagtgggggcgtgcgacggttactctggttactggggccgcgccgcgctggcgagagccgccgcccgcgagggatgctggtgaggaagccgtcgggagccgccgccgccatctgagggaggtaccctggaaaccaccttttatcggtggggaagtgcagtcgcggtgggcggctctgggggccagcgaaacgggaggcctctaaatctttaggttggggctgcattgccctggagccgcactcttgagtccgaggccatcttttgttggagaaggcgtcggcgttggcgttttcccgaggttgggctgtacagtgtctccgtccgcggaaaaagaagcctctgaacccgcgccggcccgcagcccccgtgccttccggccgctgctcgccgtcgccagaggctaggccacgtttcccccagtgccgaggtgtttctgtgaccctccctccactcccattcccttctgaaagggcacctgctcttggtgagaaaagaaattatagcacgaagagccagtatcagaagagtatccatcacccgcagcaaccgctcagggaacaccatcaaaaaagaaaaaaagggaatatctggatttcctgggcgaggaggagcgagtctgctcgggagctgttccagcaggcgatttttaaatactgctttctacgccctatacaacttggcttcacatacttttacactaactttatatgatttttaaaaactggtctgatcggacttctcgtcctgggacactgtttactggagtctggccggctctccgtgctcctcttggtacctcattttggggagaaccttaaacccactcgagcagataatctccgccttgaccgggtgccaccaaagaagccttggaaccatgtggacttttctgggcattgccactttcacctatttttataagaagttcggggacttcatcactttggccaacagggaggtcctgttgtgcgtgctggtgttcctctcgctgggcctggtgctctcctaccgctgtcgccaccgaaacgggggtctcctcgggcgccagcagagcggctcccagttcgccctcttctcggatattctctcaggcctgcctttcattggcttcttctgggccaaatccccccctgaatcagaaaataaggagcagctcgaggccaggaggcgcagaaaaggaaccaatatttcagaaacaagcttaataggaacagctgcctgtacatcaacatcttctcagaatgacccagaagttatcatcgtgggagctggcgtgcttggctctgctttggcagctgtgctttccagagatggaagaaaggtgacagtcattgagagagacttaaaagagcctgacagaatagttggagaattcctgcagccgggtggttatcatgttctcaaagaccttggtcttggagatacagtggaaggtcttgatgcccaggttgtaaatggttacatgattcatgatcaggaaagcaaatcagaggttcagattccttaccctctgtcagaaaacaatcaagtgcagagtggaagagctttccatcacggaagattcatcatgagtctccggaaagcagctatggcagagcccaatgcaaagtttattgaaggtgttgtgttacagttattagaggaagatgatgttgtgatgggagttcagtacaaggataaagagactggagatatcaaggaactccatgctccactgactgttgttgcagatgggcttttctccaagttcaggaaaagcctggtctccaataaagtttctgtatcatctcattttgttggctttcttatgaagaatgcaccacagtttaaagcaaatcatgctgaacttattttagctaacccgagtccagttctcatctaccagatttcatccagtgaaactcgagtacttgttgacattagaggagaaatgccaaggaatttaagagaatacatggttgaaaaaatttacccacaaatacctgatcacctgaaagaaccattcttagaagccactgacaattctcatctgaggtccatgccagcaagcttccttcctccttcatcagtgaagaaacgaggtgttcttcttttgggagacgcatataatatgaggcatccacttactggtggaggaatgactgttgcttttaaagatataaaactatggagaaaactgctaaagggtatccctgacctttatgatgatgcagctattttcgaggccaaaaaatcattttactgggcaagaaaaacatctcattcctttgtcgtgaatatccttgctcaggctctttatgaattattttctgccacagatgattccctgcatcaactaagaaaagcctgttttctttatttcaaacttggtggcgaatgtgttgcgggtcctgttgggctgctttctgtattgtctcctaaccctctagttttaattggacacttctttgctgttgcaatctatgccgtgtatttttgctttaagtcagaaccttggattacaaaacctcgagcccttctcagtagtggtgctgtattgtacaaagcgtgttctgtaatatttcctctaatttactcagaaatgaagtatatggttcattaagcttaaaggggaaccatttgtgaatgaatatttggaacttaccaagtcctaagagacttttggaagaggatatatatagcatagtaccataccacttataaagtggaaactcttggaccaagatttggattaatttgtttttgaagttttttgtatataaatatgtaaatacatgctttaatttgcaatttaaaatgaaggggttaaataagttagacatttaaaagaaatgattgttaccataaattagtgctaatgctgaggagaactacagtttttcttttgaatttagtatttgagatgagttgttgggacatgcaaataaaatgaagaatgaa

SEQ ID NO: 440987 - DNA, 3164 bp, Homo sapiens
ccctcgtctgggccgagcccgcccagctggctgagacgcgtggagcctggcggcgagtgggggcgtgcgacggttactctggttactggggccgcgccgcgctggcgagagccgccgcccgcgagggatgctggtgaggaagccgtcgggagccgccgccgccatctgagggaggtaccctggaaaccaccttttatcggtggggaagtgcagtcgcggtgggcggctctgggggccagcgaaacgggaggcctctaaatctttaggttggggctgcattgccctggagccgcactcttgagtccgaggccatcttttgttggagaaggcgtcggcgttggcgttttcccgaggttgggctgtacagtgtctccgtccgcggaaaaagaagcctctgaacccgcgccggcccgcagcccccgtgccttccggccgctgctcgccgtcgccagaggctaggccacgtttcccccagtgccgaggtgtttctgtgaccctccctccactcccattcccttctgaaagggcacctgctcttggtgagaaaagaaattatagcacgaagagccagtatcagaagagtatccatcacccgcagcaaccgctcagggaacaccatcaaaaaagaaaaaaagggaatatctggatttcctgggcgaggaggagcgagtctgctcgggagctgttccagcaggcgatttttaaatactgctttctacgccctatacaacttggcttcacatacttttacactaactttatatgatttttaaaaactggtctgatcggacttctcgtcctgggacactgtttactggagtctggccggctctccgtgctcctcttggtacctcattttggggagaaccttaaacccactcgagcagataatctccgccttgaccgggtgccaccaaagaagccttggaaccatgtggacttttctgggcattgccactttcacctatttttataagaagttcggggacttcatcactttggccaacagggaggtcctgttgtgcgtgctggtgttcctctcgctgggcctggtgctctcctaccgctgtcgccaccgaaacgggggtctcctcgggcgccagcagagcggctcccagttcgccctcttctcggatattctctcaggcctgcctttcattggcttcttctgggccaaatccccccctgaatcagaaaataaggagcagctcgaggccaggaggcgcagaaaaggaaccaatatttcagaaacaagcttaataggaacagctgcctgtacatcaacatcttctcagaatgacccagaagttatcatcgtgggagctggcgtgcttggctctgctttggcagctgtgctttccagagatggaagaaaggtgacagtcattgagagagacttaaaagagcctgacagaatagttggagaattcctgcagccgggtggttatcatgttctcaaagaccttggtcttggagatacagtggaaggtcttgatgcccaggttgtaaatggttacatgattcatgatcaggaaagcaaatcagaggttcagattccttaccctctgtcagaaaacaatcaagtgcagagtggaagagctttccatcacggaagattcatcatgagtctccggaaagcagctatggcagagcccaatgcaaagtttattgaaggtgttgtgttacagttattagaggaagatgatgttgtgatgggagttcagtacaaggataaagagactggagatatcaaggaactccatgctccactgactgttgttgcagatgggcttttctccaagttcaggaaaagcctggtctccaataaagtttctgtatcatctcattttgttggctttcttatgaagaatgcaccacagtttaaagcaaatcatgctgaacttattttagctaacccgagtccagttctcatctaccagatttcatccagtgaaactcgagtacttgttgacattagaggagaaatgccaaggaatttaagagaatacatggttgaaaaaatttacccacaaatacctgatcacctgaaagaaccattcttagaagccactgacaattctcatctgaggtccatgccagcaagcttccttcctccttcatcagtgaagaaacgaggtgttcttcttttgggagacgcatataatatgaggcatccacttactggtggaggaatgactgttgcttttaaagatataaaactatggagaaaactgctaaagggtatccctgacctttatgatgatgcagctattttcgaggccaaaaaatcattttactgggcaagaaaaacatctcattcctttgtcgtgaatatccttgctcaggctctttatgaattattttctgccacagatgattccctgcatcaactaagaaaagcctgttttctttatttcaaacttggtggcgaatgtgttgcgggtcctgttgggctgctttctgtattgtctcctaaccctctagttttaattggacacttctttgctgttgcaatctatgccgtgtatttttgctttaagtcagaaccttggattacaaaacctcgagcccttctcagtagtggtgctgtattgtacaaagcgtgttctgtaatatttcctctaatttactcagaaatgaagtatatggttcattaagcttaaaggggaaccatttgtgaatgaatatttggaacttaccaagtcctaagagacttttggaagaggatatatatagcatagtaccataccacttataaagtggaaactcttggaccaagatttggattaatttgtttttgaagttttttgtatataaatatgtaaatacatgctttaatttgcaatttaaaatgaaggggttaaataagttagacatttaaaagaaatgattgttaccataaattagtgctaatgctgaggagaactacagtttttcttttgaatttagtatttgagatgagttgttgggacatgcaaataaaatgaagaatgaaaaaaaaaaaaagggggggggtaagtattctgaggggcagttaggtacagtttgtcaaggctatgggggtaaaagcagacgggccgtaaagtgtgtggaatgtcggtttggaggacttttggtgcttgactcgatagcggaaatagttggtaccgttcggatgtgtaaat

SEQ ID NO: 440988 - DNA, 3424 bp, Homo sapiens
ccctcgtctgggccgagcccgcccagctggctgagacgcgtggagcctggcggcgagtgggggcgtgcgacggttactctggttactggggccgcgccgcgctggcgagagccgccgcccgcgagggatgctggtgaggaagccgtcgggagccgccgccgccatctgagggaggtaccctggaaaccaccttttatcggtggggaagtgcagtcgcggtgggcggctctgggggccagcgaaacgggaggcctctaaatctttaggttggggctgcattgccctggagccgcactcttgagtccgaggccatcttttgttggagaaggcgtcggcgttggcgttttcccgaggttgggctgtacagtgtctccgtccgcggaaaaagaagcctctgaacccgcgccggcccgcagcccccgtgccttccggccgctgctcgccgtcgccagaggctaggccacgtttcccccagtgccgaggtgtttctgtgaccctccctccactcccattcccttctgaaagggcacctgctcttggtgagaaaagaaattatagcacgaagagccagtatcagaagagtatccatcacccgcagcaaccgctcagggaacaccatcaaaaaagaaaaaaagggaatatctggatttcctgggcgaggaggagcgagtctgctcgggagctgttccagcaggcgatttttaaatactgctttctacgccctatacaacttggcttcacatacttttacactaactttatatgatttttaaaaactggtctgatcggacttctcgtcctgggacactgtttactggagtctggccggctctccgtgctcctcttggtacctcattttggggagaaccttaaacccactcgagcagataatctccgccttgaccgggtgccaccaaagaagccttggaaccatgtggacttttctgggcattgccactttcacctatttttataagaagttcggggacttcatcactttggccaacagggaggtcctgttgtgcgtgctggtgttcctctcgctgggcctggtgctctcctaccgctgtcgccaccgaaacgggggtctcctcgggcgccagcagagcggctcccagttcgccctcttctcggatattctctcaggcctgcctttcattggcttcttctgggccaaatccccccctgaatcagaaaataaggagcagctcgaggccaggaggcgcagaaaaggaaccaatatttcagaaacaagcttaataggaacagctgcctgtacatcaacatcttctcagaatgacccagaagttatcatcgtgggagctggcgtgcttggctctgctttggcagctgtgctttccagagatggaagaaaggtgacagtcattgagagagacttaaaagagcctgacagaatagttggagaattcctgcagccgggtggttatcatgttctcaaagaccttggtcttggagatacagtggaaggtcttgatgcccaggttgtaaatggttacatgattcatgatcaggaaagcaaatcagaggttcagattccttaccctctgtcagaaaacaatcaagtgcagagtggaagagctttccatcacggaagattcatcatgagtctccggaaagcagctatggcagagcccaatgcaaagtttattgaaggtgttgtgttacagttattagaggaagatgatgttgtgatgggagttcagtacaaggataaagagactggagatatcaaggaactccatgctccactgactgttgttgcagatgggcttttctccaagttcaggaaaagcctggtctccaataaagtttctgtatcatctcattttgttggctttcttatgaagaatgcaccacagtttaaagcaaatcatgctgaacttattttagctaacccgagtccagttctcatctaccagatttcatccagtgaaactcgagtacttgttgacattagaggagaaatgccaaggaatttaagagaatacatggttgaaaaaatttacccacaaatacctgatcacctgaaagaaccattcttagaagccactgacaattctcatctgaggtccatgccagcaagcttccttcctccttcatcagtgaagaaacgaggtgttcttcttttgggagacgcatataatatgaggcatccacttactggtggaggaatgactgttgcttttaaagatataaaactatggagaaaactgctaaagggtatccctgacctttatgatgatgcagctattttcgaggtaagatcaattattttgacaaaaatgtctcaaaatggatttatttctgggggttaagagcagtggggctctgatggggagatctgtactaaggaacctgatgctttataatagctcttaggcatcttgcttaggcttaaagaacctgacttgcaacctgtgaatcttagagaatttctaaatttgaatattatgtaacacttgattgctatgggccacttagctcatagtggttgtaaatttagcttcagtgtcatataacccattgctctgaaggtgattttttattttttttgtaaatgataaacataaggcaatattacttgcagatagtccttagaaggataagtatcagtttgaggggattataaacatcagtttgtgcttttttatccttaccatataataaatgagctatttcttttttaggccaaaaaatcattttactgggcaagaaaaacatctcattcctttgtcgtgaatatccttgctcaggctctttatgaattattttctgccacagatgattccctgcatcaactaagaaaagcctgttttctttatttcaaacttggtggcgaatgtgttgcgggtcctgttgggctgctttctgtattgtctcctaaccctctagttttaattggacacttctttgctgttgcaatctatgccgtgtatttttgctttaagtcagaaccttggattacaaaacctcgagcccttctcagtagtggtgctgtattgtacaaagcgtgttctgtaatatttcctctaatttactcagaaatgaagtatatggttcattaagcttaaaggggaaccatttgtgaatgaatatttggaacttaccaagtcctaagagacttttggaagaggatatatatagcatagtaccataccacttataaagtggaaactcttggaccaagatttggattaatttgtttttgaagttttttgtatataaatatgtaaatacatgctttaatttgcaatttaaaatgaaggggttaaataagttagacatttaaaagaaatgattgttaccataaattagtgctaatgctgaggagaactacagtttttcttttgaatttagtatttgagatgagttgttgggacatgcaaataaaatgaagaatgaa

SEQ ID NO: 440989 - DNA, 2941 bp, Homo sapiens
ccctcgtctgggccgagcccgcccagctggctgagacgcgtggagcctggcggcgagtgggggcgtgcgacggttactctggttactggggccgcgccgcgctggcgagagccgccgcccgcgagggatgctggtgaggaagccgtcgggagccgccgccgccatctgagggaggtaccctggaaaccaccttttatcggtggggaagtgcagtcgcggtgggcggctctgggggccagcgaaacgggaggcctctaaatctttaggttggggctgcattgccctggagccgcactcttgagtccgaggccatcttttgttggagaaggcgtcggcgttggcgttttcccgaggttgggctgtacagtgtctccgtccgcggaaaaagaagcctctgaacccgcgccggcccgcagcccccgtgccttccggccgctgctcgccgtcgccagaggctaggccacgtttcccccagtgccgaggtgtttctgtgaccctccctccactcccattcccttctgaaagggcacctgctcttggtgagaaaagaaattatagcacgaagagccagtatcagaagagtatccatcacccgcagcaaccgctcagggaacaccatcaaaaaagaaaaaaagggaatatctggatttcctgggcgaggaggagcgagtctgctcgggagctgttccagcaggcgatttttaaatactgctttctacgccctatacaacttggcttcacatacttttacactaactttatatgatttttaaaaactggtctgatcggacttctcgtcctgggacactgtttactggagtctggccggctctccgtgctcctcttggtacctcattttggggagaaccttaaacccactcgagcagataatctccgccttgaccgggtgccaccaaagaagccttggaaccatgtggacttttctgggcattgccactttcacctatttttataagaagttcggggacttcatcactttggccaacagggaggtcctgttgtgcgtgctggtgttcctctcgctgggcctggtgctctcctaccgctgtcgccaccgaaacgggggtctcctcgggcgccagcagagcggctcccagttcgccctcttctcggatattctctcaggcctgcctttcattggcttcttctgggccaaatccccccctgaatcagaaaataaggagcagctcgaggccaggaggcgcagaaaaggaaccaatatttcagaaacaagcttaataggaacagctgcctgtacatcaacatcttctcagaatgacccagaagttatcatcgtgggagctggcgtgcttggctctgctttggcagctgtgctttccagagatggaagaaaggtgacagtcattgagagagacttaaaagagcctgacagaatagttggagaattcctgcagccgggtggttatcatgttctcaaagaccttggtcttggagatacagtggaaggtcttgatgcccaggttgtaaatggttacatgattcatgatcaggaaagcaaatcagaggttcagattccttaccctctgtcagaaaacaatcaagtgcagagtggaagagctttccatcacggaagattcatcatgagtctccggaaagcagctatggcagagcccaatgcaaagtttattgaaggtgttgtgttacagttattagaggaagatgatgttgtgatgggagttcagtacaaggataaagagactggagatatcaaggaactccatgctccactgactgttgttgcagatgggcttttctccaagttcaggaaaagcctggtctccaataaagtttctgtatcatctcattttgttggctttcttatgaagaatgcaccacagtttaaagcaaatcatgctgaacttattttagctaacccgagtccagttctcatctaccagatttcatccagtgaaactcgagtacttgttgacattagaggagaaatgccaaggaatttaagagaatacatggttgaaaaaatttacccacaaatacctgatcacctgaaagaaccattcttagaagccactgacaattctcatctgaggtccatgccagcaagcttccttcctccttcatcagtgaagaaacgaggtgttcttcttttgggagacgcatataatatgaggcatccacttactggtggaggaatgactgttgcttttaaagatataaaactatggagaaaactgctaaagggtatccctgacctttatgatgatgcagctattttcgaggccaaaaaatcattttactgggcaagaaaaacatctcattcctttgtcgtgaatatccttgctcaggctctttatgaattattttctgccacagatgattccctgcatcaactaagtgggctgctttctgtattgtctcctaaccctctagttttaattggacacttctttgctgttgcaatctatgccgtgtatttttgctttaagtcagaaccttggattacaaaacctcgagcccttctcagtagtggtgctgtattgtacaaagcgtgttctgtaatatttcctctaatttactcagaaatgaagtatatggttcattaagcttaaaggggaaccatttgtgaatgaatatttggaacttaccaagtcctaagagacttttggaagaggatatatatagcatagtaccataccacttataaagtggaaactcttggaccaagatttggattaatttgtttttgaagttttttgtatataaatatgtaaatacatgctttaatttgcaatttaaaatgaaggggttaaataagttagacatttaaaagaaatgattgttaccataaattagtgctaatgctgaggagaactacagtttttcttttgaatttagtatttgagatgagttgttgggacatgcaaataaaatgaagaatgaa

SEQ ID NO: 440990 - DNA, 2118 bp, Homo sapiens
ccctcgtctgggccgagcccgcccagctggctgagacgcgtggagcctggcggcgagtgggggcgtgcgacggttactctggttactggggccgcgccgcgctggcgagagccgccgcccgcgagggatgctggtgaggaagccgtcgggagccgccgccgccatctgagggagcattggttgagcctcagatggaggttggatatttgattatgaaagatggaacgaaatgttagaatttcattttgaaggagaagaacaaccactttccatgatgaaaaagtttttaaaaagttcttgggtaaggattggatttgtgcctgaggaagaaagaaacgtgctgcggcgcagaaaaggaaccaatatttcagaaacaagcttaataggaacagctgcctgtacatcaacatcttctcagaatgacccagaagttatcatcgtgggagctggcgtgcttggctctgctttggcagctgtgctttccagagatggaagaaaggtgacagtcattgagagagacttaaaagagcctgacagaatagttggagaattcctgcagccgggtggttatcatgttctcaaagaccttggtcttggagatacagtggaaggtcttgatgcccaggttgtaaatggttacatgattcatgatcaggaaagcaaatcagaggttcagattccttaccctctgtcagaaaacaatcaagtgcagagtggaagagctttccatcacggaagattcatcatgagtctccggaaagcagctatggcagagcccaatgcaaagtttattgaaggtgttgtgttacagttattagaggaagatgatgttgtgatgggagttcagtacaaggataaagagactggagatatcaaggaactccatgctccactgactgttgttgcagatgggcttttctccaagttcaggaaaagcctggtctccaataaagtttctgtatcatctcattttgttggctttcttatgaagaatgcaccacagtttaaagcaaatcatgctgaacttattttagctaacccgagtccagttctcatctaccagatttcatccagtgaaactcgagtacttgttgacattagaggagaaatgccaaggaatttaagagaatacatggttgaaaaaatttacccacaaatacctgatcacctgaaagaaccattcttagaagccactgacaattctcatctgaggtccatgccagcaagcttccttcctccttcatcagtgaagaaacgaggtgttcttcttttgggagacgcatataatatgaggcatccacttactggtggaggaatgactgttgcttttaaagatataaaactatggagaaaactgctaaagggtatccctgacctttatgatgatgcagctattttcgaggccaaaaaatcattttactgggcaagaaaaacatctcattcctttgtcgtgaatatccttgctcaggctctttatgaattattttctgccacagatgattccctgcatcaactaagaaaagcctgttttctttatttcaaacttggtggcgaatgtgttgcgggtcctgttgggctgctttctgtattgtctcctaaccctctagttttaattggacacttctttgctgttgcaatctatgccgtgtatttttgctttaagtcagaaccttggattacaaaacctcgagcccttctcagtagtggtgctgtattgtacaaagcgtgttctgtaatatttcctctaatttactcagaaatgaagtatatggttcattaagcttaaaggggaaccatttgtgaatgaatatttggaacttaccaagtcctaagagacttttggaagaggatatatatagcatagtaccataccacttataaagtggaaactcttggaccaagatttggattaatttgtttttgaagttttttgtatataaatatgtaaatacatgctttaatttgcaatttaaaatgaaggggttaaataagttagacatttaaaagaaatgattgttaccataaattagtgctaatgctgaggagaactacagtttttcttttgaatttagtatttgagatgagttgttgggacatgcaaataaaatgaagaatgaa

SEQ ID NO: 440991 - DNA, 2523 bp, Homo sapiens
ccctcgtctgggccgagcccgcccagctggctgagacgcgtggagcctggcggcgagtgggggcgtgcgacggttactctggttactggggccgcgccgcgctggcgagagccgccgcccgcgagggatgctggtgaggaagccgtcgggagccgccgccgccatctgagggaggtaccctggaaaccaccttttatcggtggggaagtgcagtcgcggtgggcggctctgggggccagcgaaacgggaggcctctaaatctttaggttggggctgcattgccctggagccgcactcttgagtccgaggccatcttttgttggagaaggcgtcggcgttggcgttttcccgaggttgggctgtacagtgtctccgtccgcggaaaaagaagcctctgaacccgcgccggcccgcagcccccgtgccttccggccgctgctcgccgtcgccagaggctaggccacgtttcccccagtgccgaggtgtttctgtgaccctccctccactcccattcccttctgaaagggcacctgctcttggtgagaaaagaaattatagcacgaagagccagtatcagaagagtatccatcacccgcagcaaccgctcagggaacaccatcaaaaaagaaaaaaagggaatatctggatttcctgggcgaggaggagcgagtctgctcgggagctgttccagcaggcgatttttaaatactgctttctacgccctatacaacttggcttcacatacttttacactaactttatatgatttttaaaaactggtctgatcggacttctcgtcctgggacactgtttactggagtctggccggctctccgtgctcctcttggtacctcattttggggagaaccttaaacccactcgagcagataatctccgccttgaccgggtgccaccaaagaagccttggaaccatgtggacttttctgggcattgccactttcacctatttttataagaagttcggggacttcatcactttggccaacagggaggtcctgttgtgcgtgctggtgttcctctcgctgggcctggtgctctcctaccgctgtcgccaccgaaacgggggtctcctcgggcgccagcagagcggctcccagttcgccctcttctcggatattctctcaggcctgcctttcattggcttcttctgggccaaatccccccctgaatcagaaaataaggagcagctcgaggccaggaggcgcagaaaaggaaccaatatttcagaaacaagcttaataggaacagctgcctgtacatcaacatcttctcagaatgacccagaagttatcatcgtgggagctggcgtgcttggctctgctttggcagctgtgctttccagagatggaagaaaggtgacagtcattgagagagacttaaaagagcctgacagaatagttggagaattcctgcagccgggtggttatcatgttctcaaagaccttggtcttggagatacagtggaaggtcttgatgcccaggttgtaaatggttacatgattcatgatcaggaaagcaaatcagaggttcagattccttaccctctgtcagaaaacaatcaagtgcagagtggaagagctttccatcacggaagattcatcatgagtctccggaaagcagctatggcagagcccaatgcaaagtttattgaaggtgttgtgttacagttattagaggaagatgatgttgtgatgggagttcagtacaaggataaagagactggagatatcaaggaactccatgctccactgactgttgttgcagatgggcttttctccaagttcaggaaaagcctggtctccaataaagtttctgtatcatctcattttgttggctttcttatgaagaatgcaccacagtttaaagcaaatcatgctgaacttattttagctaacccgagtccagttctcatctaccagatttcatccagtgaaactcgagtacttgttgacattagaggagaaatgccaaggaatttaagagaatacatggttgaaaaaatttacccacaaatacctgatcacctgaaagaaccattcttagaagccactgacaattctcatctgaggtccatgccagcaagcttccttcctccttcatcagtgaagaaacgaggtgttcttcttttgggagacgcatataatatgaggcatccacttactggtggaggaatgactgttgcttttaaagatataaaactatggagaaaactgctaaagggtatccctgacctttatgatgatgcagctattttcgaggccaaaaaatcattttactgggcaagaaaaacatctcattcctttgtcgtgaatatccttgctcaggctctttatgaattattttctgccacagatgattccctgcatcaactaagaaaagcctgttttctttatttcaaacttggtggcgaatgtgttgcgggtcctgttgggctgctttctgtattgtctcctaaccctctagttttaattggatcttacttacgggggatgctctagagtc

SEQ ID NO: 440992 - DNA, 1250 bp, Homo sapiens
  misc_feature (96)..(96): n is a, c, g, or t
  misc_feature (120)..(120): n is a, c, g, or t
aagggtactcactgagcgtcctggatctgtgaagggtactcactgagcgacctggaatctgtgaagggtactcactgagcgactcaggtgagtctnccgacatgtcctggccccgatgtnctccatgcaccacagtttaaagcaaatcacgctgaacttattttagctaacccgagtccagttctcatctaccagatttcatccagtgaaactcgagtacttgttgacattagaggagaaatgccaaggaatttaagagaatacatggttgaaaaaatttacccacaaatacctgatcacctgaaagaaccattcttagaagccactgacaattctcatctgaggtccatgccagcaagcttccttcctccttcatcagtgaagaaacgaggtgttcttcttttgggagacgcatataatatgaggcatccacttactggtggaggaatgactgttgcttttaaagatataaaactatggagaaaactgctaaagggtatccctgacctttatgatgatgcagctattttcgaggccaaaaaatcattttactgggcaagaaaaacatctcattcctttgtcgtgaatatccttgctcaggctctttatgaattattttctgccacagatgattccctgcatcaactaagaaaagcctgttttctttatttcaaacttggtggcgaatgtgttgcgggtcctgttgggctgctttctgtattgtctcctaaccctctagttttaattggacacttctttgctgttgcaatctatgccgtgtatttttgctttaagtcagaaccttggattacaaaacctcgagcccttctcagtagtggtgctgtattgtacaaagcgtgttctgtaatatttcctctaatttactcagaaatgaagtatatggttcattaagcttaaaggggaaccatttgtgaatgaatatttggaacttaccaagtcctaagagacttttggaagaggatatatatagcatagtaccataccacttataaagtggaaactcttggaccaagatttggattaatttgtttttgaagttttttgtatataaatatgtaaatacatgctttaatttgcaatttaaaatgaaggggttaaataagttagacatttaaaagaaatgattgttaccataaattagtgctaatgctgaggagaactacagtttttcttttgaatttagtatttgagatgagttgttgggacatgcaaataaaatgaagaatgaa

SEQ ID NO: 440993 - DNA, 734 bp, Homo sapiens
tgattatggaattcagaagaaatcctggttgttgaaattctaggactagatatttaaaaattatctgcaagatgtagcgtttgttatttctcattttttctgatatatcattagcatcctacataagtgtgtacacatatttgattattttacaattttattttagattccctgcatcaactaagaaaagcctgttttctttatttcaaacttggtggcgaatgtgttgcgggtcctgttgggctgctttctgtgtaagttgtgatggcacagaggatacaaacctgccagattttcttaggactgttcagttgatgaattactgcaaatctttcttccttacacattttgatattttattatctgttagtatcccaatgagaaggtggcccaaagaaatgaagaaacgcaatatttagtactgttttctttctagggaacagcagttaaaggtggtggtagaggaagctataacccttgattaaaatagaagcttgttttttgcctatggatttatccatatgttctggtctgtgggagccaggaataattgagaaattttaatttaagaattagtttcattgaagtacggggacttatacaacccagtattagttttgagcgtacagacatatgtggaactattcttggaaagtctacaaagtgaaatctatcgagttatttctcatttgcaaagtgatcctttgagtcatttctcataatctataatctga

SEQ ID NO: 440994 - DNA, 2298 bp, Homo sapiens
gagcggccgcccgggcaggtacgccctatacaacttggcttcacatacttttacactaactttatatgatttttaaaaactggtctgatcggacttctcgtcctgggacactgtttactggagtctggccggctctccgtgctcctcttggtacctcattttggggagaaccttaaacccactcgagcagataatctccgccttgaccgggtgccaccaaagaagccttggaaccatgtggacttttctgggcattgccactttcacctatttttataagaagttcggggacttcatcactttggccaacagggaggtcctgttgtgcgtgctggtgttcctctcgctgggcctggtgctctcctaccgctgtcgccaccgaaacgggggtctcctcgggcgccagcagagcggctcccagttcgccctcttctcggatattctctcaggcctgcctttcattggcttcttctgggccaaatccccccctgaatcagaaaataaggagcagctcgaggccaggaggcgcagaaaaggaaccaatatttcagaaacaagcttaataggaacagctgcctgtacatcaacatcttctcagaatgacccagaagttatcatcgtgggagctggcgtgcttggctctgctttggcagctgtgctttccagagatggaagaaaggtgacagtcattgagagagacttaaaagagcctgacagaatagttggagaattcctgcagccgggtggttatcatgttctcaaagaccttggtcttggagatacagtggaaggtcttgatgcccaggttgtaaatggttacatgattcatgatcaggaaagcaaatcagaggttcagattccttaccctctgtcagaaaacaatcaagtgcagagtggaagagctttccatcacggaagattcatcatgagtctccggaaagcagctatggcagagcccaatgcaaagtttattgaaggtgttgtgttacagttattagaggaagatgatgttgtgatgggagttcagtacaaggataaagagactggagatatcaaggaactccatgctccactgactgttgttgcagatgggcttttctccaagttcaggaaaagcctggtctccaataaagtttctgtatcatctcattttgttggctttcttatgaagaatgcaccacagtttaaagcaaatcatgctgaacttattttagctaacccgagtccagttctcatctaccagatttcatccagtgaaactcgagtacttgttgacattagaggagaaatgccaaggaatttaagagaatacatggttgaaaaaatttacccacaaatacctgatcacctgaaagaaccattcttagaagccactgacaattctcatctgaggtccatgccagcaagcttccttcctccttcatcagtgaagaaacgaggtgttcttcttttgggagacgcatataatatgaggcatccacttactggtggaggaatgactgttgcttttaaagatataaaactatggagaaaactgctaaagggtatccctgacctttatgatgatgcagctattttcgaggccaaaaaatcattttactgggcaagaaaaacatctcattcctttgtcgtgaatatccttgctcaggctctttatgaattattttctgccacagatgattccctgcatcaactaagaaaagcctgttttctttatttcaaacttggtggcgaatgtgttgcgggtcctgttgggctgctttctgtattgtctcctaaccctctagttttaattggacacttctttgctgttgcaatctatgccgtgtatttttgctttaagtcagaaccttggattacaaaacctcgagcccttctcagtagtggtgctgtattgtacaaagcgtgttctgtaatatttcctctaatttactcagaaatgaagtatatggttcattaagcttaaaggggaaccatttgtgaatgaatatttggaacttaccaagtcctaagagacttttggaagaggatatatatagcatagtaccataccacttataaagtggaaactcttggaccaagatttggattaatttgtttttgaagttttttgtatataaatatgtaaatacatgctttaatttgcaatttaaaatgaaggggttaaataagttagacatttaaaagaaatgattgttaccataaattagtgctaatgctgaggagaactacagtttttcttttgaatttagtatttgagatgagttgttgggacatgcaaataaaatgaagaatgaa

SEQ ID NO: 440995 - DNA, 2937 bp, Homo sapiens
ccctcgtctgggccgagcccgcccagctggctgagacgcgtggagcctggcggcgagtgggggcgtgcgacggttactctggttactggggccgcgccgcgctggcgagagccgccgcccgcgagggatgctggtgaggaagccgtcgggagccgccgccgccatctgagggaggtaccctggaaaccaccttttatcggtggggaagtgcagtcgcggtgggcggctctgggggccagcgaaacgggaggcctctaaatctttaggttggggctgcattgccctggagccgcactcttgagtccgaggccatcttttgttggagaaggcgtcggcgttggcgttttcccgaggttgggctgtacagtgtctccgtccgcggaaaaagaagcctctgaacccgcgccggcccgcagcccccgtgccttccggccgctgctcgccgtcgccagaggctaggccacgtttcccccagtgccgaggtgtttctgtgaccctccctccactcccattcccttctgaaagggcacctgctcttggtgagaaaagaaattatagcacgaagagccagtatcagaagagtatccatcacccgcagcaaccgctcagggaacaccatcaaaaaagttccagcaggcgatttttaaatactgctttctacgccctatacaacttggcttcacatacttttacactaactttatatgatttttaaaaactggtctgatcggacttctcgtcctgggacactgtttactggagtctggccggctctccgtgctcctcttggtacctcattttggggagaaccttaaacccactcgagcagataatctccgccttgaccgggtgccaccaaagaagccttggaaccatgtggacttttctgggcattgccactttcacctatttttataagaagttcggggacttcatcactttggccaacagggaggtcctgttgtgcgtgctggtgttcctctcgctgggcctggtgctctcctaccgctgtcgccaccgaaacgggggtctcctcgggcgccagcagagcggctcccagttcgccctcttctcggatattctctcaggcctgcctttcattggcttcttctgggccaaatccccccctgaatcagaaaataaggagcagctcgaggccaggaggcgcagaaaaggaaccaatatttcagaaacaagcttaataggaacagctgcctgtacatcaacatcttctcagaatgacccagaagttatcatcgtgggagctggcgtgcttggctctgctttggcagctgtgctttccagagatggaagaaaggtgacagtcattgagagagacttaaaagagcctgacagaatagttggagaattcctgcagccgggtggttatcatgttctcaaagaccttggtcttggagatacagtggaaggtcttgatgcccaggttgtaaatggttacatgattcatgatcaggaaagcaaatcagaggttcagattccttaccctctgtcagaaaacaatcaagtgcagagtggaagagctttccatcacggaagattcatcatgagtctccggaaagcagctatggcagagcccaatgcaaagtttattgaaggtgttgtgttacagttattagaggaagatgatgttgtgatgggagttcagtacaaggataaagagactggagatatcaaggaactccatgctccactgactgttgttgcagatgggcttttctccaagttcaggaaaagcctggtctccaataaagtttctgtatcatctcattttgttggctttcttatgaagaatgcaccacagtttaaagcaaatcatgctgaacttattttagctaacccgagtccagttctcatctaccagatttcatccagtgaaactcgagtacttgttgacattagaggagaaatgccaaggaatttaagagaatacatggttgaaaaaatttacccacaaatacctgatcacctgaaagaaccattcttagaagccactgacaattctcatctgaggtccatgccagcaagcttccttcctccttcatcagtgaagaaacgaggtgttcttcttttgggagacgcatataatatgaggcatccacttactggtggaggaatgactgttgcttttaaagatataaaactatggagaaaactgctaaagggtatccctgacctttatgatgatgcagctattttcgaggccaaaaaatcattttactgggcaagaaaaacatctcattcctttgtcgtgaatatccttgctcaggctctttatgaattattttctgccacagatgattccctgcatcaactaagaaaagcctgttttctttatttcaaacttggtggcgaatgtgttgcgggtcctgttgggctgctttctgtattgtctcctaaccctctagttttaattggacacttctttgctgttgcaatctatgccgtgtatttttgctttaagtcagaaccttggattacaaaacctcgagcccttctcagtagtggtgctgtattgtacaaagcgtgttctgtaatatttcctctaatttactcagaaatgaagtatatggttcattaagcttaaaggggaaccatttgtgaatgaatatttggaacttaccaagtcctaagagacttttggaagaggatatatatagcatagtaccataccacttataaagtggaaactcttggaccaagatttggattaatttgtttttgaagttttttgtatataaatatgtaaatacatgctttaatttgcaatttaaaatgaaggggttaaataagttagacatttaaaagaaatgattgttaccataaattagtgctaatgctgaggagaactacagtttttcttttgaatttagtatttgagatgagttgttgggacatgcaaataaaatgaagaatgaa

SEQ ID NO: 440996 - DNA, 2955 bp, Homo sapiens
ccctcgtctgggccgagcccgcccagctggctgagacgcgtggagcctggcggcgagtgggggcgtgcgacggttactctggttactggggccgcgccgcgctggcgagagccgccgcccgcgagggatgctggtgaggaagccgtcgggagccgccgccgccatctgagggaggtaccctggaaaccaccttttatcggtggggaagtgcagtcgcggtgggcggctctgggggccagcgaaacgggaggcctctaaatctttaggttggggctgcattgccctggagccgcactcttgagtccgaggccatcttttgttggagaaggcgtcggcgttggcgttttcccgaggttgggctgtacagtgtctccgtccgcggaaaaagaagcctctgaacccgcgccggcccgcagcccccgtgccttccggccgctgctcgccgtcgccagaggctaggccacgtttcccccagtgccgaggtgtttctgtgaccctccctccactcccattcccttctgaaagggcacctgctcttggtgagaaaagaaattatagcacgaagagccagtatcagaagagtatccatcacccgcagcaaccgctcagggaacaccatcaaaaaagaaaaaaagggaatatctggatttcctgggcgaggaggagcgagtctgctcgggagctgttccagcaggcgatttttaaatactgctttctacgccctatacaacttggcttcacatacttttacactaactttatatgatttttaaaaactggtctgatcggacttctcgtcctgggacactgtttactggagtctggccggctctccgtgctcctcttggtacctcattttggggagaaccttaaacccactcgagcagataatctccgccttgaccgggtgccaccaaagaagccttggaaccatgtggacttttctgggcattgccactttcacctatttttataagaagttcggggacttcatcactttggccaacagggaggtcctgttgtgcgtgctggtgttcctctcgctgggcctggtgctctcctaccgctgtcgccaccgaaacgggggtctcctcgggcgccagcagagcggctcccagttcgccctcttctcggatattctctcaggcctgcctttcattggcttcttctgggccaaatccccccctgaatcagaaaataaggagcagctcgaggccaggaggcgcagaaaaggaaccaatatttcagaaacaagcttaataggaacagctgcctgtacatcaacatcttctcagaatgacccagaagttatcatcgtgggagctggcgtgcttggctctgctttggcagctgtgctttccagagatggaagaaaggtgacagtcattgagagagacttaaaagagcctgacagaatagttggagaattcctgcagccgggtggttatcatgttctcaaagaccttggtcttggagatacagtggaaggtcttgatgcccaggttgtaaatggttacatgattcatgatcaggaaagcaaatcagaggttcagattccttaccctctgtcagaaaacaatcaagtgcagagtggaagagctttccatcacggaagattcatcatgagtctccggaaagcagctatggcagagcccaatgcaaagtttattgaaggtgttgtgttacagttattagaggaagatgatgttgtgatgggagttcagtacaaggataaagagactggagatatcaagtctccaagttcaggaaaagcctggtctccaataaagtttctgtatcatctcattttgttggctttcttatgaagaatgcaccacagtttaaagcaaatcatgctgaacttattttagctaacccgagtccagttctcatctaccagatttcatccagtgaaactcgagtacttgttgacattagaggagaaatgccaaggaatttaagagaatacatggttgaaaaaatttacccacaaatacctgatcacctgaaagaaccattcttagaagccactgacaattctcatctgaggtccatgccagcaagcttccttcctccttcatcagtgaagaaacgaggtgttcttcttttgggagacgcatataatatgaggcatccacttactggtggaggaatgactgttgcttttaaagatataaaactatggagaaaactgctaaagggtatccctgacctttatgatgatgcagctattttcgaggccaaaaaatcattttactgggcaagaaaaacatctcattcctttgtcgtgaatatccttgctcaggctctttatgaattattttctgccacagatgattccctgcatcaactaagaaaagcctgttttctttatttcaaacttggtggcgaatgtgttgcgggtcctgttgggctgctttctgtattgtctcctaaccctctagttttaattggacacttctttgctgttgcaatctatgccgtgtatttttgctttaagtcagaaccttggattacaaaacctcgagcccttctcagtagtggtgctgtattgtacaaagcgtgttctgtaatatttcctctaatttactcagaaatgaagtatatggttcattaagcttaaaggggaaccatttgtgaatgaatatttggaacttaccaagtcctaagagacttttggaagaggatatatatagcatagtaccataccacttataaagtggaaactcttggaccaagatttggattaatttgtttttgaagttttttgtatataaatatgtaaatacatgctttaatttgcaatttaaaatgaaggggttaaataagttagacatttaaaagaaatgattgttaccataaattagtgctaatgctgaggagaactacagtttttcttttgaatttagtatttgagatgagttgttgggacatgcaaataaaatgaagaatgaa

SEQ ID NO: 440997 - DNA, 2844 bp, Homo sapiens
ccctcgtctgggccgagcccgcccagctggctgagacgcgtggagcctggcggcgagtgggggcgtgcgacggttactctggttactggggccgcgccgcgctggcgagagccgccgcccgcgagggatgctggtgaggaagccgtcgggagccgccgccgccatctgagggaggtaccctggaaaccaccttttatcggtggggaagtgcagtcgcggtgggcggctctgggggccagcgaaacgggaggcctctaaatctttaggttggggctgcattgccctggagccgcactcttgagtccgaggccatcttttgttggagaaggcgtcggcgttggcgttttcccgaggttgggctgtacagtgtctccgtccgcggaaaaagaagcctctgaacccgcgccggcccgcagcccccgtgccttccggccgctgctcgccgtcgccagaggctaggccacgtttcccccagtgccgaggtgtttctgtgaccctccctccactcccattcccttctgaaagggcacctgctcttggtgagaaaagaaattatagcacgaagagccagtatcagaagagtatccatcacccgcagcaaccgctcagggaacaccatcaaaaaagaaaaaaagggaatatctggatttcctgggcgaggaggagcgagtctgctcgggagctgttccagcaggcgatttttaaatactgctttctacgccctatacaacttggcttcacatacttttacactaactttatatgatttttaaaaactggtctgatcggacttctcgtcctgggacactgtttactggagtctggccggctctccgtgctcctcttggtacctcattttggggagaaccttaaacccactcgagcagataatctccgccttgaccgggtgccaccaaagaagccttggaaccatgtggacttttctgggcattgccactttcacctatttttataagaagttcggggacttcatcactttggccaacagggaggtcctgttgtgcgtgctggtgttcctctcgctgggcctggtgctctcctaccgctgtcgccaccgaaacgggggtctcctcgggcgccagcagagcggctcccagttcgccctcttctcggatattctctcaggcctgcctttcattggcttcttctgggccaaatccccccctgaatcagaaaataaggagcagctcgaggccaggaggcgcagaaaaggaaccaatatttcagaaacaagcttaataggaacagctgcctgtacatcaacatcttctcagaatgacccagaagttatcatcgtgggagctggcgtgcttggctctgctttggcagctgtgctttccagagatggaagaaaggtgacagtcattgagagagacttaaaagagcctgacagaatagttggagaattcctgcagccgggtggttatcatgttctcaaagaccttggtcttggagatacagtggaaggtcttgatgcccaggttgtaaatggttacatgattcatgatcaggaaagcaaatcagaggttcagattccttaccctctgtcagaaaacaatcaagtgcagagtggaagagctttccatcacggaagattcatcatgagtctccggaaagcagctatggcagagcccaatgcaaagtttattgaaggtgttgtgttacagttattagaggaagatgatgttgtgatgggagttcagtacaaggataaagagactggagatatcaaggaactccatgctccactgactgttgttgcagatgggcttttctccaagttcaggaaaagcctggtctccaataaagtttctgtatcatctcattttgttggctttcttatgaagaatgcaccacagtttaaagcaaatcatgctgaacttattttagctaacccgagtccagttctcatctaccagatttcatccagtgaaactcgagtacttgttgacattagaggagaaatgccaaggaatttaagagaatacatggttgaaaaaatttacccacaaatacctgatcacctgaaagaaccattcttagaagccactgacaattctcatctgaggtccatgccagcaagcttccttcctccttcatcagtgaagaaacgaggtgttcttcttttgggagacgcatataatatgaggcatccacttactggtggaggaatgactgttgcttttaaagatataaaactatggagaaaactgctaaagggtatccctgacctttatgatgatgcagctattttcgagattccctgcatcaactaagtgggctgctttctgtattgtctcctaaccctctagttttaattggacacttctttgctgttgcaatctatgccgtgtatttttgctttaagtcagaaccttggattacaaaacctcgagcccttctcagtagtggtgctgtattgtacaaagcgtgttctgtaatatttcctctaatttactcagaaatgaagtatatggttcattaagcttaaaggggaaccatttgtgaatgaatatttggaacttaccaagtcctaagagacttttggaagaggatatatatagcatagtaccataccacttataaagtggaaactcttggaccaagatttggattaatttgtttttgaagttttttgtatataaatatgtaaatacatgctttaatttgcaatttaaaatgaaggggttaaataagttagacatttaaaagaaatgattgttaccataaattagtgctaatgctgaggagaactacagtttttcttttgaatttagtatttgagatgagttgttgggacatgcaaataaaatgaagaatgaa

SEQ ID NO: 440998 - DNA, 1969 bp, Homo sapiens
aagtgatttatagcaatccaggccagaaatggtgggacagtgagacattttgtcatgctactcagaacagcaggcagtttaaaacttagaaattatttctggagttttctatttacatcacaatgcctacatcatttatttcatttcatatcatcatgaagccattgtactatttcatcattacctcaagaagaaagcgcagaaaaggaaccaatatttcagaaacaagcttaataggaacagctgcctgtacatcaacatcttctcagaatgacccagaagttatcatcgtgggagctggcgtgcttggctctgctttggcagctgtgctttccagagatggaagaaaggtgacagtcattgagagagacttaaaagagcctgacagaatagttggagaattcctgcagccgggtggttatcatgttctcaaagaccttggtcttggagatacagtggaaggtcttgatgcccaggttgtaaatggttacatgattcatgatcaggaaagcaaatcagaggttcagattccttaccctctgtcagaaaacaatcaagtgcagagtggaagagctttccatcacggaagattcatcatgagtctccggaaagcagctatggcagagcccaatgcaaagtttattgaaggtgttgtgttacagttattagaggaagatgatgttgtgatgggagttcagtacaaggataaagagactggagatatcaaggaactccatgctccactgactgttgttgcagatgggcttttctccaagttcaggaaaagcctggtctccaataaagtttctgtatcatctcattttgttggctttcttatgaagaatgcaccacagtttaaagcaaatcatgctgaacttattttagctaacccgagtccagttctcatctaccagatttcatccagtgaaactcgagtacttgttgacattagaggagaaatgccaaggaatttaagagaatacatggttgaaaaaatttacccacaaatacctgatcacctgaaagaaccattcttagaagccactgacaattctcatctgaggtccatgccagcaagcttccttcctccttcatcagtgaagaaacgaggtgttcttcttttgggagacgcatataatatgaggcatccacttactggtggaggaatgactgttgcttttaaagatataaaactatggagaaaactgctaaagggtatccctgacctttatgatgatgcagctattttcgaggccaaaaaatcattttactgggcaagaaaaacatctcattcctttgtcgtgaatatccttgctcaggctctttatgaattattttctgccacagatgattccctgcatcaactaagaaaagcctgttttctttatttcaaacttggtggcgaatgtgttgcgggtcctgttgggctgctttctgtattgtctcctaaccctctagttttaattggacacttctttgctgttgcaatctatgccgtgtatttttgctttaagtcagaaccttggattacaaaacctcgagcccttctcagtagtggtgctgtattgtacaaagcgtgttctgtaatatttcctctaatttactcagaaatgaagtatatggttcattaagcttaaaggggaaccatttgtgaatgaatatttggaacttaccaagtcctaagagacttttggaagaggatatatatagcatagtaccataccacttataaagtggaaactcttggaccaagatttggattaatttgtttttgaagttttttgtatataaatatgtaaatacatgctttaatttgcaatttaaaatgaaggggttaaataagttagacatttaaaagaaatgattgttaccataaattagtgctaatgctgaggagaactacagtttttcttttgaatttagtatttgagatgagttgttgggacatgcaaataaaatgaagaatgaa

SEQ ID NO: 440999 - DNA, 2991 bp, Homo sapiens
ccctcgtctgggccgagcccgcccagctggctgagacgcgtggagcctggcggcgagtgggggcgtgcgacggttactctggttactggggccgcgccgcgctggcgagagccgccgcccgcgagggatgctggtgaggaagccgtcgggagccgccgccgccatctgagggaggtaccctggaaaccaccttttatcggtggggaagtgcagtcgcggtgggcggctctgggggccagcgaaacgggaggcctctaaatctttaggttggggctgcattgccctggagccgcactcttgagtccgaggccatcttttgttggagaaggcgtcggcgttggcgttttcccgaggttgggctgtacagtgtctccgtccgcggaaaaagaagcctctgaacccgcgccggcccgcagcccccgtgccttccggccgctgctcgccgtcgccagaggctaggccacgtttcccccagtgccgaggtgtttctgtgaccctccctccactcccattcccttctgaaagggcacctgctcttggtgagaaaagaaattatagcacgaagagccagtatcagaagagtatccatcacccgcagcaaccgctcagggaacaccatcaaaaaagaaaaaaagggaatatctggatttcctgggcgaggaggagcgagtctgctcgggagctgttccagcaggcgatttttaaatactgctttctacgccctatacaacttggcttcacatacttttacactaactttatatgatttttaaaaactggtctgatcggacttctcgtcctgggacactgtttactggagtctggccggctctccgtgctcctcttggtacctcattttggggagaaccttaaacccactcgagcagataatctccgccttgaccgggtgccaccaaagaagccttggaaccatgtggacttttctgggcattgccactttcacctatttttataagaagttcggggacttcatcactttggccaacagggaggtcctgttgtgcgtgctggtgttcctctcgctgggcctggtgctctcctaccgctgtcgccaccgaaacgggggtctcctcgggcgccagcagagcggctcccagttcgccctcttctcggatattctctcaggcctgcctttcattggcttcttctgggccaaatccccccctgaatcagaaaataaggagcagctcgaggccaggaggcgcagaaaaggaaccaatatttcagaaacaagcttaataggaacagctgcctgtacatcaacatcttctcagaatgacccagaagttatcatcgtgggagctggcgtgcttggctctgctttggcagctgtgctttccagagatggaagaaaggtgacagtcattgagagagacttaaaagagcctgacagaatagttggagaattcctgcagccgggtggttatcatgttctcaaagaccttggtcttggagatacagtggaaggtcttgatgcccaggttgtaaatggttacatgattcatgatcaggaaagcaaatcagaggttcagattccttaccctctgtcagaaaacaatcaagtgcagagtggaagagctttccatcacggaagattcatcatgagtctccggaaagcagctatggcagagcccaatgcaaagtttattgaaggtgttgtgttacagttattagaggaagatgatgttgtgatgggagttcagtacaaggataaagagactggagatatcaaggaactccatgctccactgactgttgttgcagatgggcttttctccaagttcaggaaaagcctggtctccaataaagtttctgtatcatctcattttgttggctttcttatgaagaatgcaccacagtttaaagcaaatcatgctgaacttattttagctaacccgagtccagttctcatctaccagatttcatccagtgaaactcgagtacttgttgacattagaggagaaatgccaaggaatttaagagaatacatggttgaaaaaatttacccacaaatacctgatcacctgaaagaaccattcttagaagccactgacaattctcatctgaggtccatgccagcaagcttccttcctccttcatcagtgaagaaacgaggtgttcttcttttgggagacgcatataatatgaggcatccacttactggtggaggaatgactgttgcttttaaagatataaaactatggagaaaactgctaaagggtatccctgacctttatgatgatgcagctattttcgaggtaagatcaattattttgacaaaaatgtctcaaaatggatttatttctgggggttaagagcagtggggctctgatggggagatctgtactaaggaacctgatgctttataatagctcttaggcatcttgcttaggcttaaagaacctgacttgcaacctgtgaatcttagagaatttctaaatttgaatattatgtaacacttgattgctatgggccacttagctcatagtggttgtaaatttagcttcagtgtcatataacccattgctctgaaggtgattttttattttttttgtaaatgataaacataaggcaatattacttgcagatagtccttagaaggataagtatcagtttgaggggattataaacatcagtttgtgcttttttatccttaccatataataaatgagctatttcttttttaggccaaaaaatcattttactgggcaagaaaaacatctcattcctttgtcgtgaatatccttgctcaggctctttatgaattattttctgccacagatggtaagtgtagacactttttagtgaatattactcaattgcagatttttagcgtaggaaaggaataaacaagttagtgatttgtccagaaataaaaatgttacctgagtttgctaactcccaagttggtagttttttaaaattccattttgagcaatagttgtagttttagttttagtttggaaggta

SEQ ID NO: 441000 - DNA, 1679 bp, Homo sapiens
  misc_feature (96)..(96): n is a, c, g, or t
  misc_feature (120)..(120): n is a, c, g, or t
aagggtactcactgagcgtcctggatctgtgaagggtactcactgagcgacctggaatctgtgaagggtactcactgagcgactcaggtgagtctnccgacatgtcctggccccgatgtnctccatgcaccacagtttaaagcaaatcacgctgaacttattttagctaacccgagtccagttctcatctaccagatttcatccagtgaaactcgagtacttgttgacattagaggagaaatgccaaggaatttaagagaatacatggttgaaaaaatttacccacaaatacctgatcacctgaaagaaccattcttagaagccactgacaattctcatctgaggtccatgccagcaagcttccttcctccttcatcagtgaagaaacgaggtgttcttcttttgggagacgcatataatatgaggcatccacttactggtggaggaatgactgttgcttttaaagatataaaactatggagaaaactgctaaagggtatccctgacctttatgatgatgcagctattttcgaggtaagatcaattattttgacaaaaatgtctcaaaatggatttatttctgggggttaagagcagtggggctctgatggggagatctgtactaaggaacctgatgctttataatagctcttaggcatcttgcttaggcttaaagaacctgacttgcaacctgtgaatcttagagaatttctaaatttgaatattatgtaacacttgattgctatgggccacttagctcatagtggttgtaaatttagcttcagtgtcatataacccattgctctgaaggtgattttttattttttttgtaaatgataaacataaggcaatattacttgcagatagtccttagaaggataagtatcagtttgaggggattataaacatcagtttgtgcttttttatccttaccatataataaatgagctatttcttttttaggccaaaaaatcattttactgggcaagaaaaacatctcattcctttgtcgtgaatatccttgctcaggctctttatgaattattttctgccacagatgattccctgcatcaactaagaaaagcctgttttctttatttcaaacttggtggcgaatgtgttgcgggtcctgttgggctgctttctgtattgtctcctaaccctctagttttaattggacacttctttgctgttgcaatctatgccgtgtatttttgctttaagtcagaaccttggattacaaaacctcgagcccttctcagtagtggtgctgtattgtacaaagcgtgttctgtaatatttcctctaatttactcagaaatgaagtatatggttcattaagcttaaaggggaaccatttgtgaatgaatatttggaacttaccaagtcctaagagacttttggaagaggatatatatagcatagtaccataccacttataaagtggaaactcttggaccaagatttggattaatttgtttttgaagttttttgtatataaatatgtaaatacatgctttaatttgcaatttaaaatgaaggggttaaataagttagacatttaaaagaaatgattgttaccataaattagtgctaatgctgaggagaactacagtttttcttttgaatttagtatttgagatgagttgttgggacatgcaaataaaatgaagaatgaa

SEQ ID NO: 441001 - DNA, 914 bp, Homo sapiens
gtgtatcccccgggctgcaggattcggcacgagcttcttggcgcgatgaggttccggttctgtggtgatctggactgtcccgactgggtcctggcagaaatcagcacgctggccaagatgtcctctgtgaagttgcggctgctctgcagccagggtactaaaggagctgctgggacaggggattgattatgagaagatcctgaagctcacggctgacgccaagtttgagtcaggcgatgtgaaggccacagtggcagtgctgagtttcatcctctccagtgcggccaagcacagtgtcgatggcgaatccttgtccagtgaactgcagcagctggggctgcccaaagagcacgcggccagcctgtgccgctgttatgaggagaagcaaagccccttgcagaagcacttgcgggtctgcagcctacgcatgaataggttggcaggtgtgggctggcgggtggactacaccctgagctccagcctgctgcaatccgtggaagagcccatggtgcacctgcggctggaggtggcagctgccccagggaccccagcccagcctgttgccatgtccctctcagcagacaagttccaggtcctcctggcagaactgaagcaggcccagaccctgatgagctccctgggctgaggagaagggtgttccaggcctgtgtggagccgccctgcccgtatggagtcacgccctctgaactgctcttcgggaggcagccctggttctaggatgctgaggccctggcccggactctggcctcccagatccccagctgcctcacttctctcttgagaacttggctcagggctcctgaggacctttcccagcattaccttcccttcccttgaaaggcaattgttggctgttttcataagcaggaaaaataaacagaagtataaaggaa

SEQ ID NO: 441002 - DNA, 845 bp, Homo sapiens
aagtggtacggctgcgattggtcggggagaaatcagcacgctggcaagatgtcctctgtgaagttgcggctgctctgcagccagggtactaaaggagctgctgggacaggggattgattatgagaagatcctgaagctcacggctgacgccaagtttgagtcaggcgatgtgaaggccacagtggcagtgctgagtttcatcctctccagtgcggccaagcacagtgtcgatggcgaatccttgtccagtgaactgcagcagctggggctgcccaaagagcacgcggccagcctgtgccgctgttatgaggagaagcaaagccccttgcagaagcacttgcgggtctgcagcctacgcatgaataggttggcaggtgtgggctggcgggtggactacaccctgagctccagcctgctgcaatccgtggaagagcccatggtgcacctgcggctggaggtggcagctgccccagggaccccagcccagcctgttgccatgtccctctcagcagacaagttccaggtcctcctggcagaactgaagcaggcccagaccctgatgagctccctgggctgaggagaagggtgttccaggcctgtgtggagccgccctgcccgtatggagtcacgccctctgaactgctcttcgggaggcagccctggttctaggatgctgaggccctggcccggactctggcctcccagatccccagctgcctcacttctctcttgagaacttggctcagggctcctgaggacctttcccagcattaccttcccttcccttgaaaggcaattgttggctgttttcataagcaggaaaaataaacagaagtataaaggaa

SEQ ID NO: 441003 - DNA, 951 bp, Homo sapiens
gtgtatcccccgggctgcaggattcggcacgagcttcttggcgcgatgaggttccggttctgtggtgatctggactgtcccgactgggtcctggcagaaatcagcacgctggccaagatgtcctctgtgaagttgcggctgctctgcagccagggtactaaaggagctgctgggacaggggattgattatgagaagatcctgaagctcacggctgacgccaagtttgagtcaggcgatgtgaaggccacagtggcagtgctgagtttcatcctctccagtgcggccaagcacagtgtcgatggcgaatccttgtccagtgaactgcagcagctggggctgcccaaagagcacgcggccagcctgtgccgctgttatgaggagaagcaaagccccttgcagaagcacttgcgggtctgcagcctacgcatgaataggttggcaggtgtgggctggcgggtggactacaccctgagctccagcctgctgcaatccgtggaagagcccatggtgcacctgcggctggaggtggcagctgccccagggaccccagcccagcctgttgccatgtccctctcagcagacaagttccaggtcctcctggcagaactgaagcaggcccagaccctgatgagctccctgggctgaggagaagggtgttccaggcctgtgtggagccgccctgcccgtatggagtcacgccctctgaactgctcttcgggaggcagccctggttctaggatgctgaggccctggcccggactctggcctcccagatccccagctgcctcacttctctcttgagaacttggctcagggctcctgaggacctttcccagcattaccttcccttcccttgaaaggcaattgttggctgttttcataagcaggaaaaataaacagaagtataaaggaaaaaaacaacaccaccacagcaaacacaacaacacctt

SEQ ID NO: 441004 - DNA, 1976 bp, Homo sapiens
cggacgcgtgggtcgacccacgcgtccgaagaaattcccgggccctggcttcttggcgcgatgaggttccggttctgtggtgatctggactgtcccgactgggtcctggcagaaatcagcacgctggccaagatgtcctctgtgaagttgcggctgctctgcagccagggtactaaaggagctgctgggacaggggattgattatgagaagatcctgaagctcacggctgacgccaagtttgagtcaggcgatgtgaaggccacagtggcagtgctgagtttcatcctctccagtgcggccaagcacagtgtcgatggcgaatccttgtccagtgaactgcagcagctggggctgcccaaagagcacgcggccagcctgtgccgctgttatgaggagaagcaaagccccttgcagaagcacttgcgggtctgcagcctacgcatgaataggttggcaggtgtgggctggcgggtggactacaccctgagctccagcctgctgcaatccgtggaagagcccatggtgcacctgcggctggaggtggcagctgccccagggaccccagcccagcctgttgccatgtccctctcagcagacaagttccaggtcctcctggcagaactgaagcaggcccagaccctgatgagctccctgggctgaggagaagggtgttccaggcctgtgtggagccgccctgcccgtatggagtcacgccctctgaactgctcttcgggaggcagccctggttctaggatgctgaggccctggcccggactctggcctcccagatccccagctgcctcacttctctcttgagaacttggctcagggctcctgaggacctttcccagcattaccttcccttcccttgaaaggtagagatgaggtttctccatgttggtcaggctggtctcgaactcctgacctcaggtgatccacccaccttgccctcccaaagtgctgggattacaggcgtaagccactgcgcccagccactgccatcatctttaggaagagagaagtgaccatgcctgaaccagtcattggcaagaggaacggtgttatggactgaatgttcatgttcctccagaattcatatgctgaagcctctgtccacacatgcacaccagatgagggccatgtgcgcacacgaggtggctgtctacaaggccagaaagagggctgtcaacaggaactgcgtctgctggcaccttgatcttgaacttcccagcctccagaactgtgagaaagaaatctctatggtgtaagccactagtctgtggcattgttatagcagctcgagaagactaaggcagatgggcttccaggactggcccagaccagccagggctccttgtagaaaaggctgatgccagggttggcacatggagggtacaaggaggactcgcctggagtatcttaaggaacctatcgaagaataatggcttgttccactggccaaagatgggacaatttgaacatcaaaagagatacttactgactccactcctgacttctgcttctgaaaaaatgaagtaggtgttttccctattcctcccactaagtacagttaacaaccctggatgttacatataaaacaaacaaaaagactccgagcgatggagagaaggcaccctagcctggctgggatcctcaggacctgaggctccacagagagaaattcctggaatctggaccccatggcccagtcaggttacacaaaactgatcatcacagatctgtagaactatacaaaagtgctaacattcatgattagggtctcagaaggtaaggaggaagagagtggaatggaaaaagtattcaaaaaaataatcactaaaggccaggtgcagtggcccatgcctgtaatcccagcactttgggaggtgggacaattgctttagaccttgcaactggcctgagcaacacagggagactcagtttctccaaaaaaataaaaaattagccgatcatg

SEQ ID NO: 441005 - DNA, 786 bp, Homo sapiens
cccagaggcagttagtccaagtcacgtgatcgtcgactcagctgaccctgcgggaccggaaaaagaaattcccgggccctggcttcttggcgcgatgaggttccggttctgtggtgatctggactgtcccgactgggtcctggcagaaatcagcacgctggccaagatgtcctctgtgaagttgcggctgctctgcagccagggtactaaaggagctgctgggacaggggattgattatgagaagatcctgaagctcacggctgacgccaagtttgagtcaggcgatgtgaaggccacagtggcagtgctgagtttcatcctctccagtgcggccaagcacagtgtcgatggcgaatccttgtccagtgaactgcagcagctggggctgcccaaagagcacgcggccagcctgtgccgctgttatgaggagaagcaaagccccttgcagaagcacttgcgggtctgcagcctacgcaaactgaagcaggcccagaccctgatgagctccctgggctgaggagaagggtgttccaggcctgtgtggagccgccctgcccgtatggagtcacgccctctgaactgctcttcgggaggcagccctggttctaggatgctgaggccctggcccggactctggcctcccagatccccagctgcctcacttctctcttgagaacttggctcagggctcctgaggacctttcccagcattaccttcccttcccttgaaaggcaattgttggctgttttcataagcaggaaaaataaacagaagtataaaggaa

SEQ ID NO: 441006 - DNA, 731 bp, Homo sapiens
cccagaggcagttagtccaagtcacgtgatcgtcgactcagctgaccctgcgggaccggaaaaagaaattcccgggccctggcttcttggcgcgatgaggttccggttctgtggtgatctggactgtcccgactgggtcctggcagaaatcagcacgctggccaagatgtcctctgtgaagttgcggctgctctgcagccagggtactaaaggagctgctgggacaggggattgattatgagaagatcctgaagctcacggctgacgccaagtttgggccaagcacagtgtcgatggcgaatccttgtccagtgaactgcagcagctggggctgcccaaagagcacgcggccagcctgtgccgctgttatgaggagaagcaaagccccttgcagaagcacttgcgggtctgcagcctacgcaaactgaagcaggcccagaccctgatgagctccctgggctgaggagaagggtgttccaggcctgtgtggagccgccctgcccgtatggagtcacgccctctgaactgctcttcgggaggcagccctggttctaggatgctgaggccctggcccggactctggcctcccagatccccagctgcctcacttctctcttgagaacttggctcagggctcctgaggacctttcccagcattaccttcccttcccttgaaaggcaattgttggctgttttcataagcaggaaaaataaacagaagtataaaggaa

SEQ ID NO: 441007 - DNA, 401 bp, Homo sapiens
gcggccgcctactactactgctcgaattcaagcttctaacgatgtacggggacatgtccctctcagcagacacaaaacggtcctcctggcagaactgaagcaggcccagaccctgatgagctccctgggctgaggagaagggtgttccaggcctgtgtggagccgccctgcccgtatggagtcacgccctctgaactgctcttcgggaggcagccctggttctaggatgctgaggccctggcccggactctggcctcccagatccccagctgcctcacttctctcttgagaacttggctcagggctcctgaggacctttcccagcattaccttcccttcccttgaaaggcaattgttggctgttttcataagcaggaaaaataaacagaagtataaaggaa

SEQ ID NO: 441008 - DNA, 963 bp, Homo sapiens
cccagaggcagttagtccaagtcacgtgatcgtcgactcagctgaccctgcgggaccggaaaaagaaattcccgggccctggcttcttggcgcgatgaggttccggttctgtggtgatctggactgtcccgactgggtcctggcagaaatcagcacgctggccaagatgtcctctgtgaagttgcggctgctctgcagccagggtactaaaggagctgctgggacaggggattgattatgagaagatcctgaagctcacggctgacgccaagtttgagtcaggcgatgtgaaggccacagtggcagtgctgagtttcatcctctccagtgcggccaagcacagtgtcgatggcgaatccttgtccagtgaactgcagcagctggggctgcccaaagagcacgcggccagcctgtgccgctgttatgaggagaagcaaagccccttgcagaagcacttgcgggtctgcagcctacgcatgaataggttggcaggtgtgggctggcgggtggactacaccctgagctccagcctgctgcaatccgtggaagagcccatggtgcacctgcggctggaggtggcagctgccccagggaccccagcccagcctgttgccatgtccctctcagcagacaagttccaggtcctcctggcagaactgaagcaggcccagaccctgatgagctccctgggctgaggagaagggtgttccaggcctgtgtggagccgccctgcccgtatggagtcacgccctctgaactgctcttcgggaggcagccctggttctaggatgctgaggccctggcccggactctggcctcccagatccccagctgcctcacttctctcttgagaacttggctcagggctcctgaggacctttcccagcattaccttcccttcccttgaaaggcaattgttggctgttttcataagcaggaaaaataaacagaagtataaaggaa

SEQ ID NO: 441009 - DNA, 991 bp, Homo sapiens
ggcactaggggcgaagcgaggcttgggctgctggagcgggaatgagggggcgccaagtggctccggaaactgggggaggttgtactggcctctccgcaaacacagtgtgtgcgggcgtgagggctaggttccggttctgtggtgatctggactgtcccgactgggtcctggcagaaatcagcacgctggccaagatgtcctctgtgaagttgcggctgctctgcagccagggtactaaaggagctgctgggacaggggattgattatgagaagatcctgaagctcacggctgacgccaagtttgagtcaggcgatgtgaaggccacagtggcagtgctgagtttcatcctctccagtgcggccaagcacagtgtcgatggcgaatccttgtccagtgaactgcagcagctggggctgcccaaagagcacgcggccagcctgtgccgctgttatgaggagaagcaaagccccttgcagaagcacttgcgggtctgcagcctacgcatgaataggttggcaggtgtgggctggcgggtggactacaccctgagctccagcctgctgcaatccgtggaagagcccatggtgcacctgcggctggaggtggcagctgccccagggaccccagcccagcctgttgccatgtccctctcagcagacaagttccaggtcctcctggcagaactgaagcaggcccagaccctgatgagctccctgggctgaggagaagggtgttccaggcctgtgtggagccgccctgcccgtatggagtcacgccctctgaactgctcttcgggaggcagccctggttctaggatgctgaggccctggcccggactctggcctcccagatccccagctgcctcacttctctcttgagaacttggctcagggctcctgaggacctttcccagcattaccttcccttcccttgaaaggcaattgttggctgttttcataagcaggaaaaataaacagaagtataaaggaa

SEQ ID NO: 441010 - DNA, 987 bp, Homo sapiens
  misc_feature (864)..(864): n is a, c, g, or t
  misc_feature (871)..(871): n is a, c, g, or t
  misc_feature (873)..(875): n is a, c, g, or t
gtgtatcccccgggctgcaggattcggcacgagcttcttggcgcgatgaggttccggttctgtggtgatctggactgtcccgactgggtcctggcagaaatcagcacgctggccaagatgtcctctgtgaagttgcggctgctctgcagccagggtactaaaggagctgctgggacaggggattgattatgagaagatcctgaagctcacggctgacgccaagtttgagtcaggcgatgtgaaggccacagtggcagtgctgagtttcatcctctccagtgcggccaagcacagtgtcgatggcgaatccttgtccagtgaactgcagcagctggggctgcccaaagagcacgcggccagcctgtgccgctgttatgaggagaagcaaagccccttgcagaagcacttgcgggtctgcagcctacgcatgaataggttggcaggtgtgggctggcgggtggactacaccctgagctccagcctgctgcaatccgtggaagagcccatggtgcacctgcggctggaggtggcagctgccccagggaccccagcccagcctgttgccatgtccctctcagcagacaagttccaggtcctcctggcagaactgaagcaggcccagaccctgatgagctccctgggctgaggagaagggtgttccaggcctgtgtggagccgccctgcccgtatggagtcacgccctctgaactgctcttcgggaggcagccctggttctaggatgctgaggccctggcccggactctggcctcccagatccccagctgcctcacttctctcttgagaacttggctcagggctcctgaggacctttcccagcattaccttcccttcccttgaaagggnggtgttncnnncagacaataccggagttaaaaaaacacaaacggggcctgtcggggaaaagttgatgcggcttgtccggcctttgaaagggaaggggccaagggatatcgacgcgtaaaaaag

SEQ ID NO: 441011 - DNA, 1387 bp, Homo sapiens
  misc_feature (936)..(936): n is a, c, g, or t
  misc_feature (946)..(946): n is a, c, g, or t
  misc_feature (952)..(952): n is a, c, g, or t
  misc_feature (954)..(954): n is a, c, g, or t
  misc_feature (957)..(957): n is a, c, g, or t
  misc_feature (962)..(962): n is a, c, g, or t
  misc_feature (979)..(979): n is a, c, g, or t
gtgtatcccccgggctgcaggattcggcacgagcttcttggcgcgatgaggttccggttctgtggtgatctggactgtcccgactgggtcctggcagaaatcagcacgctggccaagatgtcctctgtgaagttgcggctgctctgcagccagggtactaaaggagctgctgggacaggggattgattatgagaagatcctgaagctcacggctgacgccaagtttgagtcaggcgatgtgaaggccacagtggcagtgctgagtttcatcctctccagtgcggccaagcacagtgtcgatggcgaatccttgtccagtgaactgcagcagctggggctgcccaaagagcacgcggccagcctgtgccgctgttatgaggagaagcaaagccccttgcagaagcacttgcgggtctgcagcctacgcatgaataggttggcaggtgtgggctggcgggtggactacaccctgagctccagcctgctgcaatccgtggaagagcccatggtgcacctgcggctggaggtggcagctgccccagggaccccagcccagcctgttgccatgtccctctcagcagacaagttccaggtcctcctggcagaactgaagcaggcccagaccctgatgagctccctgggctgaggagaagggtgttccaggcctgtgtggagccgccctgcccgtatggagtcacgccctctgaactgctcttcgggaggcagccctggttctaggatgctgaggccctggcccggactctggcctcccagatccccagctgcctcacttctctcttgagaacttggctcagggctcctgaggacctttcccagcattaccttcccttcccttgaaaggcaattgttggctgttttcataagcaggaaaaataaacagaagtataaaggaaaaaaaaaaaaaaaaaaaaaaanaaaaaaaaanaaaaananaanaaaanaaaaaaaaaaaaaaaanaaaaaaaaagcgggcgcggcgcgcgcgccccccgccccccccccgggcgcgcgccccccccccggcacacccacgatttatttttgaaaaagagggcggcctcctactatgagggaggcagttaattatataatgacgaggagcgcggcgccgcgctcgcgttgctactcaacaccacacacgccggttgtgcggtgtgacatacagaaagtgctctcgacgtgcccgtcggactatctttctcttgtggacagagacacccaccatatcttgtgggtgggtgggcgtgcgaaacaactctaagtgtatggagcgaccacaacctccccacacgcgagcaaatagttatcggtcgtctttgggggaggggaaataaaaacaaacatcttgtatgatgatgcatctagc

SEQ ID NO: 441012 - DNA, 896 bp, Homo sapiens
cccagaggcagttagtccaagtcacgtgatcgtcgactcagctgaccctgcgggaccggaaaaagaaattcccgggccctggcttcttggcgcgatgaggttccggttctgtggtgatctggactgtcccgactgggtcctggcagaaatcagcacgctggccaagatgtatgagaagatcctgaagctcacggctgacgccaagtttgagtcaggcgatgtgaaggccacagtggcagtgctgagtttcatcctctccagtgcggccaagcacagtgtcgatggcgaatccttgtccagtgaactgcagcagctggggctgcccaaagagcacgcggccagcctgtgccgctgttatgaggagaagcaaagccccttgcagaagcacttgcgggtctgcagcctacgcatgaataggttggcaggtgtgggctggcgggtggactacaccctgagctccagcctgctgcaatccgtggaagagcccatggtgcacctgcggctggaggtggcagctgccccagggaccccagcccagcctgttgccatgtccctctcagcagacaagttccaggtcctcctggcagaactgaagcaggcccagaccctgatgagctccctgggctgaggagaagggtgttccaggcctgtgtggagccgccctgcccgtatggagtcacgccctctgaactgctcttcgggaggcagccctggttctaggatgctgaggccctggcccggactctggcctcccagatccccagctgcctcacttctctcttgagaacttggctcagggctcctgaggacctttcccagcattaccttcccttcccttgaaaggcaattgttggctgttttcataagcaggaaaaataaacagaagtataaaggaa

SEQ ID NO: 441013 - DNA, 1708 bp, Homo sapiens
cccagaggcagttagtccaagtcacgtgatcgtcgactcagctgaccctgcgggaccggaaaaagaaattcccgggccctggcttcttggcgcgatgaggttccggttctgtggtgatctggactgtcccgactgggtcctggcagaaatcagcacgctggccaagatggttgagtgcacagggtctagtctgggtggaggaggggtgttgggggtggggattgtgggtgtagaggatggtgaggtttctctggggctagggcctcagtgctctcagcctgtgctaccatgctttgtgaccttgatcagtggctggcctgctctgagccagtccccaggaaggaggggtgaggtttgccagcctggctgatgtaaggacttcccttccagtcctctgtgaagttgcggctgctctgcagccagggtactaaaggagctgctgggacaggggattgatgtgagtacaagatccagcaccccattgtcccatgaccttatgaccaccactgccctgaaactctgcactaggcccagggagacgggtgagccagcctctcaacctctctgggcacctcccttccttctttccagcctgtctgttccttatcgcaggatccaggctgggggtgaggggctggtgagcaggggcctggcaccccctgaaggtctcctttccccatagtatgagaagatcctgaagctcacggctgacgccaagtttggtgagtatcccgctgagtctataggccccaggcaaccctgggaacttggcctggtgcctggtacagaggggccccccacccctcccagcagcatccttaacttaccttccctagtggaggagcatgagggaaagaaagaccgacagtcccaccttcctgtcctctgccagctcctggtggagcagtagcagtgcctgtggctccaggaggcctgggggctttgagctaaagttaatagggcaacagggaggtggctggacccacagtgacaccccctgccccacccacgggtccctcagagtcaggcgatgtgaaggccacagtggcagtgctgagtttcatcctctccagtgcggccaagcacagtgtcgatggcgaatccttgtccagtgaactgcagcagctggggctgcccaaagagcacgcggccagcctgtgccgctgttatgaggagaagcaaagccccttgcagaagcacttgcgggtctgcagcctacgcatgaataggttggcaggtgtgggctggcgggtggactacaccctgagctccagcctgctgcaatccgtggaagagcccatggtgcacctgcggctggaggtggcagctgccccagggaccccagcccagcctgttgccatgtccctctcagcagacaagttccaggtcctcctggcagaactgaagcaggcccagaccctgatgagctccctgggctgaggagaagggtgttccaggcctgtgtggagccgccctgcccgtatggagtcacgccctctgaactgctcttcgggaggcagccctggttctaggatgctgaggccctggcccggactctggcctcccagatccccagctgcctcacttctctcttgagaacttggctcagggctcctgaggacctttcccagcattaccttcccttcccttgaaaggcaattgttggctgttttcataagcaggaaaaataaacagaagtataaaggaa

SEQ ID NO: 441014 - DNA, 1434 bp, Homo sapiens
gtgtatcccccgggctgcaggattcggcacgagcttcttggcgcgatgaggttccggttctgtggtgatctggactgtcccgactgggtcctggcagaaatcagcacgctggccaagatggttgagtgcacagggtctagtctgggtggaggaggggtgttgggggtggggattgtgggtgtagaggatggtgaggtttctctggggctagggcctcagtgctctcagcctgtgctaccatgctttgtgaccttgatcagtggctggcctgctctgagccagtccccaggaaggaggggtgaggtttgccagcctggctgatgtaaggacttcccttccagtcctctgtgaagttgcggctgctctgcagccagggtactaaaggagctgctgggacaggggattgattatgagaagatcctgaagctcacggctgacgccaagtttggtgagtatcccgctgagtctataggccccaggcaaccctgggaacttggcctggtgcctggtacagaggggccccccacccctcccagcagcatccttaacttaccttccctagtggaggagcatgagggaaagaaagaccgacagtcccaccttcctgtcctctgccagctcctggtggagcagtagcagtgcctgtggctccaggaggcctgggggctttgagctaaagttaatagggcaacagggaggtggctggacccacagtgacaccccctgccccacccacgggtccctcagagtcaggcgatgtgaaggccacagtggcagtgctgagtttcatcctctccagtgcggccaagcacagtgtcgatggcgaatccttgtccagtgaactgcagcagctggggctgcccaaagagcacgcggccagcctgtgccgctgttatgaggagaagcaaagccccttgcagaagcacttgcgggtctgcagcctacgcatgaataggttggcaggtgtgggctggcgggtggactacaccctgagctccagcctgctgcaatccgtggaagagcccatggtgcacctgcggctggaggtggcagctgccccagggaccccagcccagcctgttgccatgtccctctcagcagacaagttccaggtcctcctggcagaactgaagcaggcccagaccctgatgagctccctgggctgaggagaagggtgttccaggcctgtgtggagccgccctgcccgtatggagtcacgccctctgaactgctcttcgggaggcagccctggttctaggatgctgaggccctggcccggactctggcctcccagatccccagctgcctcacttctctcttgagaacttggctcagggctcctgaggacctttcccagcattaccttcccttcccttgaaaggcaattgttggctgttttcataagcaggaaaaataaacagaagtataaaggaa

SEQ ID NO: 441015 - DNA, 873 bp, Homo sapiens
cagggagactatagaatatcccgaattcactacgcggcttgtttcagctagaaatcagcacgctgcccacgatggcctctgcgaagtcgcagctgatctgccgccagacactaaaggagctgctgtgacagccaaatgattatgagaagatcctgcagctcacggctgacgccaagcttgagacatagtcaggcgatgtgaaggccacagtggcagtgctgagtttcatcctctccagtgcggccaagcacagtgtcgatggcgaatccttgtccagtgaactgcagcagctggggctgcccaaagagcacgcggccagcctgtgccgctgttatgaggagaagcaaagccccttgcagaagcacttgcgggtctgcagcctacgcatgaataggttggcaggtgtgggctggcgggtggactacaccctgagctccagcctgctgcaatccgtggaagagcccatggtgcacctgcggctggaggtggcagctgccccagggaccccagcccagcctgttgccatgtccctctcagcagacaagttccaggtcctcctggcagaactgaagcaggcccagaccctgatgagctccctgggctgaggagaagggtgttccaggcctgtgtggagccgccctgcccgtatggagtcacgccctctgaactgctcttcgggaggcagccctggttctaggatgctgaggccctggcccggactctggcctcccagatccccagctgcctcacttctctcttgagaacttggctcagggctcctgaggacctttcccagcattaccttcccttcccttgaaaggcaattgttggctgttttcataagcaggaaaaataaacagaagtataaaggaa

SEQ ID NO: 441016 - DNA, 1073 bp, Homo sapiens
gtgtatcccccgggctgcaggattcggcacgagcttcttggcgcgatgaggttccggttctgtggtgatctggactgtcccgactgggtcctggcagaaatcagcacgctggccaagatgtcctctgtgaagttgcggctgctctgcagccagggtactaaaggagctgctgggacaggggattgattatgagaagatcctgaagctcacggctgacgccaagtttgagtcaggcgatgtgaaggccacagtggcagtgctgagtttcatcctctccagtgcggccaagcacagtgtcgatggcgaatccttgtccagtgaactgcagcagctggggctgcccaaaggtacgggttgtgggtgggcagctgggcagcctgtgggccaagggctgctagagaaggggacaggccctgtgaccctgaggtgtacctgccctgtctgggccaggagcccaagccaggccccgacatgctacctccagagctactccattctacccccagagcacgcggccagcctgtgccgctgttatgaggagaagcaaagccccttgcagaagcacttgcgggtctgcagcctacgcatgaataggttggcaggtgtgggctggcgggtggactacaccctgagctccagcctgctgcaatccgtggaagagcccatggtgcacctgcggctggaggtggcagctgccccagggaccccagcccagcctgttgccatgtccctctcagcagacaagttccaggtcctcctggcagaactgaagcaggcccagaccctgatgagctccctgggctgaggagaagggtgttccaggcctgtgtggagccgccctgcccgtatggagtcacgccctctgaactgctcttcgggaggcagccctggttctaggatgctgaggccctggcccggactctggcctcccagatccccagctgcctcacttctctcttgagaacttggctcagggctcctgaggacctttcccagcattaccttcccttcccttgaaaggcaattgttggctgttttcataagcaggaaaaataaacagaagtataaaggaa

SEQ ID NO: 441017 - DNA, 1294 bp, Homo sapiens
gtgtatcccccgggctgcaggattcggcacgagcttcttggcgcgatgaggttccggttctgtggtgatctggactgtcccgactgggtcctggcagaaatcagcacgctggccaagatggttgagtgcacagggtctagtctgggtggaggaggggtgttgggggtggggattgtgggtgtagaggatggtgaggtttctctggggctagggcctcagtgctctcagcctgtgctaccatgctttgtgaccttgatcagtggctggcctgctctgagccagtccccaggaaggaggggtgaggtttgccagcctggctgatgtaaggacttcccttccagtcctctgtgaagttgcggctgctctgcagccagggtactaaaggagctgctgggacaggggattgattatgagaagatcctgaagctcacggctgacgccaagtttgagtcaggcgatgtgaaggccacagtggcagtgctgagtttcatcctctccagtgcggccaagcacagtgtcgatggcgaatccttgtccagtgaactgcagcagctggggctgcccaaaggtacgggttgtgggtgggcagctgggcagcctgtgggccaagggctgctagagaaggggacaggccctgtgaccctgaggtgtacctgccctgtctgggccaggagcccaagccaggccccgacatgctacctccagagctactccattctacccccagagcacgcggccagcctgtgccgctgttatgaggagaagcaaagccccttgcagaagcacttgcgggtctgcagcctacgcatgaataggttggcaggtgtgggctggcgggtggactacaccctgagctccagcctgctgcaatccgtggaagagcccatggtgcacctgcggctggaggtggcagctgccccagggaccccagcccagcctgttgccatgtccctctcagcagacaagttccaggtcctcctggcagaactgaagcaggcccagaccctgatgagctccctgggctgaggagaagggtgttccaggcctgtgtggagccgccctgcccgtatggagtcacgccctctgaactgctcttcgggaggcagccctggttctaggatgctgaggccctggcccggactctggcctcccagatccccagctgcctcacttctctcttgagaacttggctcagggctcctgaggacctttcccagcattaccttcccttcccttgaaaggcaattgttggctgttttcataagcaggaaaaataaacagaagtataaaggaa

SEQ ID NO: 441018 - DNA, 1651 bp, Homo sapiens
gtgtatcccccgggctgcaggattcggcacgagcttcttggcgcgatgaggttccggttctgtggtgatctggactgtcccgactgggtcctggcagaaatcagcacgctggccaagatggttgagtgcacagggtctagtctgggtggaggaggggtgttgggggtggggattgtgggtgtagaggatggtgaggtttctctggggctagggcctcagtgctctcagcctgtgctaccatgctttgtgaccttgatcagtggctggcctgctctgagccagtccccaggaaggaggggtgaggtttgccagcctggctgatgtaaggacttcccttccagtcctctgtgaagttgcggctgctctgcagccagggtactaaaggagctgctgggacaggggattgattatgagaagatcctgaagctcacggctgacgccaagtttgagtcaggcgatgtgaaggccacagtggcagtgctgagtttcatcctctccagtgcggccaagcacagtgtcgatggcgaatccttgtccagtgaactgcagcagctggggctgcccaaaggtacgggttgtgggtgggcagctgggcagcctgtgggccaagggctgctagagaaggggacaggccctgtgaccctgaggtgtacctgccctgtctgggccaggagcccaagccaggccccgacatgctacctccagagctactccattctacccccagagcacgcggccagcctgtgccgctgttatgaggagaagcaaagccccttgcagaagcacttgcgggtctgcagcctacgcagtaagtatgaggccagccagggtccgggctcattctagaaggtgcacgcagcacacaaagtgcatggagagtccagggagacgacttaaccacggtcacatggttactagcagccgtagagctgggacctggccctgggtctcctgactccccccaaggtttcttgtcactgaggtctgctgtgggtgatcagaactgattatcgggcacctgccctgttctgagcctgggtcagcaggatgggagcttcttagaggccacatagccttgaatggttgagagctgagccagggtgtcggctgaggtctacttggcttgcctgctttgatcctgagagccacccaccccatctcacagtgaataggttggcaggtgtgggctggcgggtggactacaccctgagctccagcctgctgcaatccgtggaagagcccatggtgcacctgcggctggaggtggcagctgccccagggaccccagcccagcctgttgccatgtccctctcagcagacaagttccaggtcctcctggcagaactgaagcaggcccagaccctgatgagctccctgggctgaggagaagggtgttccaggcctgtgtggagccgccctgcccgtatggagtcacgccctctgaactgctcttcgggaggcagccctggttctaggatgctgaggccctggcccggactctggcctcccagatccccagctgcctcacttctctcttgagaacttggctcagggctcctgaggacctttcccagcattaccttcccttcccttgaaaggcaattgttggctgttttcataagcaggaaaaataaacagaagtataaaggaa

SEQ ID NO: 441019 - DNA, 1237 bp, Homo sapiens
gtgtatcccccgggctgcaggattcggcacgagcttcttggcgcgatgaggttccggttctgtggtgatctggactgtcccgactgggtcctggcagaaatcagcacgctggccaagatgtcctctgtgaagttgcggctgctctgcagccagggtactaaaggagctgctgggacaggggattgattatgagaagatcctgaagctcacggctgacgccaagtttgagtcaggcgatgtgaaggccacagtggcagtgctgagtttcatcctctccagtgcggccaagcacagtgtcgatggcgaatccttgtccagtgaactgcagcagctggggctgcccaaagagcacgcggccagcctgtgccgctgttatgaggagaagcaaagccccttgcagaagcacttgcgggtctgcagcctacgcatgaataggttggcaggtgtgggctggcgggtggactacaccctgagctccagcctgctgcaatccgtggaagagcccatggtgcacctgcggctggaggtggcagctgccccagggaccccagcccagcctgttgccatgtccctctcagcagacaagttccaggtcctcctggcaggtgaggctcagctattcctcgacgggtgagaggctctcccagatccgcctgactgcctcccacctgcccacctcttccctctgcagaactgaagcaggcccagaccctgatgagctccctgggctgaggagaagggtgttccaggcctgtgtggagccgccctgcccgtatggagtcacgccctctgaactgctcttcgggaggcagccctggttctaggatgctgaggccctggcccggactctggcctcccagatccccagctgcctcacttctctcttgagaacttggctcagggctcctgaggacctttcccagcattaccttcccttcccttgaaaggcaattgttggctgttttcataagcaggaaaaataaacagaagtataaaggaagaatgtgtgcagggggttctgtttgggttcagatcaagggtttttgtgagagaaacacaagtgacatacaggccttcttggtccatcactcattttcttttctcaattgctgattgagggaggtcataggtaaggccaactgaggaccaaaatgcatctgcttgtctggtgagaagaaaatcagggttctagctcccagatctgggatgctcttggctctgctgtctttgccccctg

SEQ ID NO: 441020 - DNA, 2310 bp, Homo sapiens
cccagaggcagttagtccaagtcacgtgatcgtcgactcagctgaccctgcgggaccggaaaaagaaattcccgggccctggcttcttggcgcgatgaggttccggttctgtggtgatctggactgtcccgactgggtcctggcagaaatcagcacgctggccaagatggttgagtgcacagggtctagtctgggtggaggaggggtgttgggggtggggattgtgggtgtagaggatggtgaggtttctctggggctagggcctcagtgctctcagcctgtgctaccatgctttgtgaccttgatcagtggctggcctgctctgagccagtccccaggaaggaggggtgaggtttgccagcctggctgatgtaaggacttcccttccagtcctctgtgaagttgcggctgctctgcagccagggtactaaaggagctgctgggacaggggattgatgtgagtacaagatccagcaccccattgtcccatgaccttatgaccaccactgccctgaaactctgcactaggcccagggagacgggtgagccagcctctcaacctctctgggcacctcccttccttctttccagcctgtctgttccttatcgcaggatccaggctgggggtgaggggctggtgagcaggggcctggcaccccctgaaggtctcctttccccatagtatgagaagatcctgaagctcacggctgacgccaagtttggtgagtatcccgctgagtctataggccccaggcaaccctgggaacttggcctggtgcctggtacagaggggccccccacccctcccagcagcatccttaacttaccttccctagtggaggagcatgagggaaagaaagaccgacagtcccaccttcctgtcctctgccagctcctggtggagcagtagcagtgcctgtggctccaggaggcctgggggctttgagctaaagttaatagggcaacagggaggtggctggacccacagtgacaccccctgccccacccacgggtccctcagagtcaggcgatgtgaaggccacagtggcagtgctgagtttcatcctctccagtgcggccaagcacagtgtcgatggcgaatccttgtccagtgaactgcagcagctggggctgcccaaaggtacgggttgtgggtgggcagctgggcagcctgtgggccaagggctgctagagaaggggacaggccctgtgaccctgaggtgtacctgccctgtctgggccaggagcccaagccaggccccgacatgctacctccagagctactccattctacccccagagcacgcggccagcctgtgccgctgttatgaggagaagcaaagccccttgcagaagcacttgcgggtctgcagcctacgcagtaagtatgaggccagccagggtccgggctcattctagaaggtgcacgcagcacacaaagtgcatggagagtccagggagacgacttaaccacggtcacatggttactagcagccgtagagctgggacctggccctgggtctcctgactccccccaaggtttcttgtcactgaggtctgctgtgggtgatcagaactgattatcgggcacctgccctgttctgagcctgggtcagcaggatgggagcttcttagaggccacatagccttgaatggttgagagctgagccagggtgtcggctgaggtctacttggcttgcctgctttgatcctgagagccacccaccccatctcacagtgaataggttggcaggtgtgggctggcgggtggactacaccctgagctccagcctgctgcaatccgtggaagagcccatggtgcacctgcggctggaggtggcagctgccccagggaccccagcccagcctgttgccatgtccctctcagcagacaagttccaggtcctcctggcaggtgaggctcagctattcctcgacgggtgagaggctctcccagatccgcctgactgcctcccacctgcccacctcttccctctgcagaactgaagcaggcccagaccctgatgagctccctgggctgaggagaagggtgttccaggcctgtgtggagccgccctgcccgtatggagtcacgccctctgaactgctcttcgggaggcagccctggttctaggatgctgaggccctggcccggactctggcctcccagatccccagctgcctcacttctctcttgagaacttggctcagggctcctgaggacctttcccagcattaccttcccttcccttgaaaggcaattgttggctgttttcataagcaggaaaaataaacagaagtataaaggaa

SEQ ID NO: 441021 - DNA, 1690 bp, Homo sapiens
cccagaggcagttagtccaagtcacgtgatcgtcgactcagctgaccctgcgggaccggaaaaagaaattcccgggccctggcttcttggcgcgatgaggttccggttctgtggtgatctggactgtcccgactgggtcctggcagaaatcagcacgctggccaagatggttgagtgcacagggtctagtctgggtggaggaggggtgttgggggtggggattgtgggtgtagaggatggtgaggtttctctggggctagggcctcagtgctctcagcctgtgctaccatgctttgtgaccttgatcagtggctggcctgctctgagccagtccccaggaaggaggggtgaggtttgccagcctggctgatgtaaggacttcccttccagtcctctgtgaagttgcggctgctctgcagccagggtactaaaggagctgctgggacaggggattgatgtgagtacaagatccagcaccccattgtcccatgaccttatgaccaccactgccctgaaactctgcactaggcccagggagacgggtgagccagcctctcaacctctctgggcacctcccttccttctttccagcctgtctgttccttatcgcaggatccaggctgggggtgaggggctggtgagcaggggcctggcaccccctgaaggtctcctttccccatagtatgagaagatcctgaagctcacggctgacgccaagtttggtgagtatcccgctgagtctataggccccaggcaaccctgggaacttggcctggtgcctggtacagaggggccccccacccctcccagcagcatccttaacttaccttccctagtggaggagcatgagggaaagaaagaccgacagtcccaccttcctgtcctctgccagctcctggtggagcagtagcagtgcctgtggctccaggaggcctgggggctttgagctaaagttaatagggcaacagggaggtggctggacccacagtgacaccccctgccccacccacgggtccctcagagtcaggcgatgtgaaggccacagtggcagtgctgagtttcatcctctccagtgcggccaagcacagtgtcgatggcgaatccttgtccagtgaactgcagcagctggggctgcccaaaggtacgggttgtgggtgggcagctgggcagcctgtgggccaagggctgctagagaaggggacaggccctgtgaccctgaggtgtacctgccctgtctgggccaggagcccaagccaggccccgacatgctacctccagagctactccattctacccccagagcacgcggccagcctgtgccgctgttatgaggagaagcaaagccccttgcagaagcacttgcgggtctgcagcctacgcaaactgaagcaggcccagaccctgatgagctccctgggctgaggagaagggtgttccaggcctgtgtggagccgccctgcccgtatggagtcacgccctctgaactgctcttcgggaggcagccctggttctaggatgctgaggccctggcccggactctggcctcccagatccccagctgcctcacttctctcttgagaacttggctcagggctcctgaggacctttcccagcattaccttcccttcccttgaaaggcaattgttggctgttttcataagcaggaaaaataaacagaagtataaaggaa

SEQ ID NO: 441022 - DNA, 1054 bp, Homo sapiens
cccagaggcagttagtccaagtcacgtgatcgtcgactcagctgaccctgcgggaccggaaaaagaaattcccgggccctggcttcttggcgcgatgaggttccggttctgtggtgatctggactgtcccgactgggtcctggcagaaatcagcacgctggccaagatgtcctctgtgaagttgcggctgctctgcagccagggtactaaaggagctgctgggacaggggattgattatgagaagatcctgaagctcacggctgacgccaagtttgggccaagcacagtgtcgatggcgaatccttgtccagtgaactgcagcagctggggctgcccaaagagcacgcggccagcctgtgccgctgttatgaggagaagcaaagccccttgcagaagcacttgcgggtctgcagcctacgcatgaataggttggcaggtgtgggctggcgggtggactacaccctgagctccagcctgctgcaatccgtggaagagcccatggtgcacctgcggctggaggtggcagctgccccagggaccccagcccagcctgttgccatgtccctctcagcagacaagttccaggtcctcctggcagaactgaagcaggcccagaccctgatgagctccctgggctgaggagaagggtgttccaggcctgtgtggagccgccctgcccgtatggagtcacgccctctgaactgctcttcgggaggcagccctggttctaggatgctgaggccctggcccggactctggcctcccagatccccagctgcctcacttctctcttgagaacttggctcagggctcctgaggacctttcccagcattaccttcccttcccttgaaaggggatgtggtgtctcatagcggaaataccagagtttacgaaaaaaaaaagggggggtaaaattcctggggccagttacggtccagtttttgtcaagggctaaggaggattaagaagggggggttaaagtggcgggaagtctgattgggggaccttgggggaatggacagtagccggaaatagttgtgacctggggcagg

SEQ ID NO: 441023 - DNA, 363 bp, Homo sapiens
ggacatggccaccggctgggctggggtccctggggcagctgccacctccagccgcaggtgcaccatgggctcttccacggattgcagccggctggagctcagggtgttccaggcctgtgtggagccgccctgcccgtatggagtcacgccctctgaactgctcttcgggaggcagccctggttctaggatgctgaggccctggcccggactctggcctcccagatccccagctgcctcacttctctcttgagaacttggctcagggctcctgaggacctttcccagcattaccttcccttcccttgaaaggcaattgttggctgttttcataagcaggaaaaataaacagaagtataaaggaa

SEQ ID NO: 441024 - DNA, 1772 bp, Homo sapiens
gtgtatcccccgggctgcaggattcggcacgagcttcttggcgcgatgaggttccggttctgtggtgatctggactgtcccgactgggtcctggcagaaatcagcacgctggccaagatggttgagtgcacagggtctagtctgggtggaggaggggtgttgggggtggggattgtgggtgtagaggatggtgaggtttctctggggctagggcctcagtgctctcagcctgtgctaccatgctttgtgaccttgatcagtggctggcctgctctgagccagtccccaggaaggaggggtgaggtttgccagcctggctgatgtaaggacttcccttccagtcctctgtgaagttgcggctgctctgcagccagggtactaaaggagctgctgggacaggggattgatgtgagtacaagatccagcaccccattgtcccatgaccttatgaccaccactgccctgaaactctgcactaggcccagggagacgggtgagccagcctctcaacctctctgggcacctcccttccttctttccagcctgtctgttccttatcgcaggatccaggctgggggtgaggggctggtgagcaggggcctggcaccccctgaaggtctcctttccccatagtatgagaagatcctgaagctcacggctgacgccaagtttgtagagatgaggtttctccatgttggtcaggctggtctcgaactcctgacctcaggtgatccacccaccttgccctcccaaagtgctgggattacaggcgtaagccactgcgcccagccactgccatcatctttaggaagagagaagtgaccatgcctgaaccagtcattggcaagaggaacggtgttatggactgaatgttcatgttcctccagaattcatatgctgaagcctctgtccacacatgcacaccagatgagggccatgtgcgcacacgaggtggctgtctacaaggccagaaagagggctgtcaacaggaactgcgtctgctggcaccttgatcttgaacttcccagcctccagaactgtgagaaagaaatctctatggtgtaagccactagtctgtggcattgttatagcagctcgagaagactaaggcagatgggcttccaggactggcccagaccagccagggctccttgtagaaaaggctgatgccagggttggcacatggagggtacaaggaggactcgcctggagtatcttaaggaacctatcgaagaataatggcttgttccactggccaaagatgggacaatttgaacatcaaaagagatacttactgactccactcctgacttctgcttctgaaaaaatgaagtaggtgttttccctattcctcccactaagtacagttaacaaccctggatgttacatataaaacaaacaaaaagactccgagcgatggagagaaggcaccctagcctggctgggatcctcaggacctgaggctccacagagagaaattcctggaatctggaccccatggcccagtcaggttacacaaaactgatcatcacagatctgtagaactatacaaaagtgctaacattcatgattagggtctcagaaggtaaggaggaagagagtggaatggaaaaagtattcaaaaaaataatcactaaaggccaggtgcagtggcccatgcctgtaatcccagcactttgggaggtgggacaattgctttagaccttgcaactggcctgagcaacacagggagactcagtttctccaaaaaaataaaaaattagccgatcatg

SEQ ID NO: 441025 - DNA, 914 bp, Homo sapiens
  misc_feature (803)..(803): n is a, c, g, or t
cccagaggcagttagtccaagtcacgtgatcgtcgactcagctgaccctgcgggaccggaaaaagaaattcccgggccctggcttcttggcgcgatgaggttccggttctgtggtgatctggactgtcccgactgggtcctggcagaaatcagcacgctggccaagatgtcctctgtgaagttgcggctgctctgcagccagggtactaaaggagctgctgggacaggggattgattatgagaagatcctgaagctcacggctgacgccaagtttgagtcaggcgatgtgaaggccacagtggcagtgctgagtttcatcctctccagtgcggccaagcacagtgtcgatggcgaatccttgtccagtgaactgcagcagctggggctgcccaaagagcacgcggccagcctgtgccgctgttatgaggagaagcaaagccccttgcagaagcacttgcgggtctgcagcctacgcaaactgaagcaggcccagaccctgatgagctccctgggctgaggagaagggtgttccaggcctgtgtggagccgccctgcccgtatggagtcacgccctctgaactgctcttcgggaggcagccctggttctaggatgctgaggccctggcccggactctggcctcccagatccccagctgcctcacttctctcttgagaacttggctcagggctcctgaggacctttcccagcattaccttcccttcccttgaaaggcaattgttggctgttttcataagcaggaaaaataaacagaagtataaaggaacaaccaaacaaaaaaanccggggctttttctcggggggcaaaagggaggaagggcagggcaacggtcccacccctttctgccaaggggaagccgcggcccaaggggggaaattaaacggacgaaaacg

SEQ ID NO: 441026 - DNA, 705 bp, Homo sapiens
cccagaggcagttagtccaagtcacgtgatcgtcgactcagctgaccctgcgggaccggaaaaagaaattcccgggccctggcttcttggcgcgatgaggttccggttctgtggtgatctggactgtcccgactgggtcctggcagaaatcagcacgctggccaagatgtcctctgtgaagttgcggctgctctgcagccagggtactaaaggagctgctgggacaggggattgattatgagaagatcctgaagctcacggctgacgccaagtttgagtcaggcgatgtgaaggccacagtggcagtgctgagtttcatcctctccagtgcggccaagcacagtgtcgatggcgaatccttgtccagtgaactgcagcagctggggctgcccaaagaactgaagcaggcccagaccctgatgagctccctgggctgaggagaagggtgttccaggcctgtgtggagccgccctgcccgtatggagtcacgccctctgaactgctcttcgggaggcagccctggttctaggatgctgaggccctggcccggactctggcctcccagatccccagctgcctcacttctctcttgagaacttggctcagggctcctgaggacctttcccagcattaccttcccttcccttgaaaggcaattgttggctgttttcataagcaggaaaaataaacagaagtataaaggaa

SEQ ID NO: 441027 - DNA, 929 bp, Homo sapiens
cggacgcgtgggtcgacccacgcgtccgaagaaattcccgggccctggcttcttggcgcgatgaggttccggttctgtggtgatctggactgtcccgactgggtcctggcagaaatcagcacgctggccaagatgtcctctgtgaagttgcggctgctctgcagccagggtactaaaggagctgctgggacaggggattgattatgagaagatcctgaagctcacggctgacgccaagtttgagtcaggcgatgtgaaggccacagtggcagtgctgagtttcatcctctccagtgcggccaagcacagtgtcgatggcgaatccttgtccagtgaactgcagcagctggggctgcccaaagagcacgcggccagcctgtgccgctgttatgaggagaagcaaagccccttgcagaagcacttgcgggtctgcagcctacgcatgaataggttggcaggtgtgggctggcgggtggactacaccctgagctccagcctgctgcaatccgtggaagagcccatggtgcacctgcggctggaggtggcagctgccccagggaccccagcccagcctgttgccatgtccctctcagcagacaagttccaggtcctcctggcagaactgaagcaggcccagaccctgatgagctccctgggctgaggagaagggtgttccaggcctgtgtggagccgccctgcccgtatggagtcacgccctctgaactgctcttcgggaggcagccctggttctaggatgctgaggccctggcccggactctggcctcccagatccccagctgcctcacttctctcttgagaacttggctcagggctcctgaggacctttcccagcattaccttcccttcccttgaaaggcaattgttggctgttttcataagcaggaaaaataaacagaagtataaaggaa

SEQ ID NO: 441028 - DNA, 1408 bp, Homo sapiens
  misc_feature (957)..(957): n is a, c, g, or t
  misc_feature (967)..(967): n is a, c, g, or t
  misc_feature (973)..(973): n is a, c, g, or t
  misc_feature (975)..(975): n is a, c, g, or t
  misc_feature (978)..(978): n is a, c, g, or t
  misc_feature (983)..(983): n is a, c, g, or t
  misc_feature (1000)..(1000): n is a, c, g, or t
gtgtatcccccgggctgcaggattcggcacgagcttcttggcgcgatgaggttccggttctgtggtgatctggactgtcccgactgggtcctggcagaaatcagcacgctggccaagatgtcctctgtgaagttgcggctgctctgcagccagggtactaaaggagctgctgggacaggggattgattatgagaagatcctgaagctcacggctgacgccaagtttgagtcaggcgatgtgaaggccacagtggcagtgctgagtttcatcctctccagtgcggccaagcacagtgtcgatggcgaatccttgtccagtgaactgcagcagctggggctgcccaaagagcacgcggccagcctgtgccgctgttatgaggagaagcaaagccccttgcagaagcacttgcgggtctgcagcctacgcatgaataggttggcaggtgtgggctggcgggtggactacaccctgagctccagcctgctgcaatccgtggaagagcccatggtgcacctgcggctggaggtggcagctgccccagggaccccagcccagcctgttgccatgtccctctcagcagacaagttccaggtcctcctggcagaactgaagcaggcccagaccctgatgagctccctgggctgaggagaagggtgttccaggcctgtgtggagccgccctgcccgtatggagtcacgccctctgaactgctcttcgggaggcagccctggttctaggatgctgaggccctggcccggactctggcctcccagatccccagctgcctcacttctctcttgagaacttggctcagggctcctgaggacctttcccagcattaccttcccttcccttgaaaggcaattgttggctgttttcataagcaggaaaaataaacagaagtataaaggaaaaaaaaaaaaccacaaaaaacaaaaaaaaaaaaaaaaaaaaanaaaaaaaaanaaaaananaanaaaanaaaaaaaaaaaaaaaanaaaaaaaaagcgggcgcggcgcgcgcgccccccgccccccccccgggcgcgcgccccccccccggcacacccacgatttatttttgaaaaagagggcggcctcctactatgagggaggcagttaattatataatgacgaggagcgcggcgccgcgctcgcgttgctactcaacaccacacacgccggttgtgcggtgtgacatacagaaagtgctctcgacgtgcccgtcggactatctttctcttgtggacagagacacccaccatatcttgtgggtgggtgggcgtgcgaaacaactctaagtgtatggagcgaccacaacctccccacacgcgagcaaatagttatcggtcgtctttgggggaggggaaataaaaacaaacatcttgtatgatgatgcatctagc

SEQ ID NO: 441029 - DNA, 1135 bp, Homo sapiens
gtgtatcccccgggctgcaggattcggcacgagcttcttggcgcgatgaggttccggttctgtggtgatctggactgtcccgactgggtcctggcagaaatcagcacgctggccaagatggttgagtgcacagggtctagtctgggtggaggaggggtgttgggggtggggattgtgggtgtagaggatggtgaggtttctctggggctagggcctcagtgctctcagcctgtgctaccatgctttgtgaccttgatcagtggctggcctgctctgagccagtccccaggaaggaggggtgaggtttgccagcctggctgatgtaaggacttcccttccagtcctctgtgaagttgcggctgctctgcagccagggtactaaaggagctgctgggacaggggattgattatgagaagatcctgaagctcacggctgacgccaagtttgagtcaggcgatgtgaaggccacagtggcagtgctgagtttcatcctctccagtgcggccaagcacagtgtcgatggcgaatccttgtccagtgaactgcagcagctggggctgcccaaagagcacgcggccagcctgtgccgctgttatgaggagaagcaaagccccttgcagaagcacttgcgggtctgcagcctacgcatgaataggttggcaggtgtgggctggcgggtggactacaccctgagctccagcctgctgcaatccgtggaagagcccatggtgcacctgcggctggaggtggcagctgccccagggaccccagcccagcctgttgccatgtccctctcagcagacaagttccaggtcctcctggcagaactgaagcaggcccagaccctgatgagctccctgggctgaggagaagggtgttccaggcctgtgtggagccgccctgcccgtatggagtcacgccctctgaactgctcttcgggaggcagccctggttctaggatgctgaggccctggcccggactctggcctcccagatccccagctgcctcacttctctcttgagaacttggctcagggctcctgaggacctttcccagcattaccttcccttcccttgaaaggcaattgttggctgttttcataagcaggaaaaataaacagaagtataaaggaa

SEQ ID NO: 441030 - DNA, 929 bp, Homo sapiens
cccagaggcagttagtccaagtcacgtgatcgtcgactcagctgaccctgcgggaccggaaaaagaaattcccgggccctggcttcttggcgcgatgaggttccggttctgtggtgatctggactgtcccgactgggtcctggcagaaatcagcacgctggccaagatgtcctctgtgaagttgcggctgctctgcagccagtatgagaagatcctgaagctcacggctgacgccaagtttgagtcaggcgatgtgaaggccacagtggcagtgctgagtttcatcctctccagtgcggccaagcacagtgtcgatggcgaatccttgtccagtgaactgcagcagctggggctgcccaaagagcacgcggccagcctgtgccgctgttatgaggagaagcaaagccccttgcagaagcacttgcgggtctgcagcctacgcatgaataggttggcaggtgtgggctggcgggtggactacaccctgagctccagcctgctgcaatccgtggaagagcccatggtgcacctgcggctggaggtggcagctgccccagggaccccagcccagcctgttgccatgtccctctcagcagacaagttccaggtcctcctggcagaactgaagcaggcccagaccctgatgagctccctgggctgaggagaagggtgttccaggcctgtgtggagccgccctgcccgtatggagtcacgccctctgaactgctcttcgggaggcagccctggttctaggatgctgaggccctggcccggactctggcctcccagatccccagctgcctcacttctctcttgagaacttggctcagggctcctgaggacctttcccagcattaccttcccttcccttgaaaggcaattgttggctgttttcataagcaggaaaaataaacagaagtataaaggaa

SEQ ID NO: 441031 - DNA, 1867 bp, Homo sapiens
cccagaggcagttagtccaagtcacgtgatcgtcgactcagctgaccctgcgggaccggaaaaagaaattcccgggccctggcttcttggcgcgatgaggttccggttctgtggtgatctggactgtcccgactgggtcctggcagaaatcagcacgctggccaagatggttgagtgcacagggtctagtctgggtggaggaggggtgttgggggtggggattgtgggtgtagaggatggtgaggtttctctggggctagggcctcagtgctctcagcctgtgctaccatgctttgtgaccttgatcagtggctggcctgctctgagccagtccccaggaaggaggggtgaggtttgccagcctggctgatgtaaggacttcccttccagtcctctgtgaagttgcggctgctctgcagccagggtactaaaggagctgctgggacaggggattgatgtgagtacaagatccagcaccccattgtcccatgaccttatgaccaccactgccctgaaactctgcactaggcccagggagacgggtgagccagcctctcaacctctctgggcacctcccttccttctttccagcctgtctgttccttatcgcaggatccaggctgggggtgaggggctggtgagcaggggcctggcaccccctgaaggtctcctttccccatagtatgagaagatcctgaagctcacggctgacgccaagtttggtgagtatcccgctgagtctataggccccaggcaaccctgggaacttggcctggtgcctggtacagaggggccccccacccctcccagcagcatccttaacttaccttccctagtggaggagcatgagggaaagaaagaccgacagtcccaccttcctgtcctctgccagctcctggtggagcagtagcagtgcctgtggctccaggaggcctgggggctttgagctaaagttaatagggcaacagggaggtggctggacccacagtgacaccccctgccccacccacgggtccctcagagtcaggcgatgtgaaggccacagtggcagtgctgagtttcatcctctccagtgcggccaagcacagtgtcgatggcgaatccttgtccagtgaactgcagcagctggggctgcccaaaggtacgggttgtgggtgggcagctgggcagcctgtgggccaagggctgctagagaaggggacaggccctgtgaccctgaggtgtacctgccctgtctgggccaggagcccaagccaggccccgacatgctacctccagagctactccattctacccccagagcacgcggccagcctgtgccgctgttatgaggagaagcaaagccccttgcagaagcacttgcgggtctgcagcctacgcatgaataggttggcaggtgtgggctggcgggtggactacaccctgagctccagcctgctgcaatccgtggaagagcccatggtgcacctgcggctggaggtggcagctgccccagggaccccagcccagcctgttgccatgtccctctcagcagacaagttccaggtcctcctggcagaactgaagcaggcccagaccctgatgagctccctgggctgaggagaagggtgttccaggcctgtgtggagccgccctgcccgtatggagtcacgccctctgaactgctcttcgggaggcagccctggttctaggatgctgaggccctggcccggactctggcctcccagatccccagctgcctcacttctctcttgagaacttggctcagggctcctgaggacctttcccagcattaccttcccttcccttgaaaggcaattgttggctgttttcataagcaggaaaaataaacagaagtataaaggaa

SEQ ID NO: 441032 - DNA, 1519 bp, Homo sapiens
gtgtatcccccgggctgcaggattcggcacgagcttcttggcgcgatgaggttccggttctgtggtgatctggactgtcccgactgggtcctggcagaaatcagcacgctggccaagatggttgagtgcacagggtctagtctgggtggaggaggggtgttgggggtggggattgtgggtgtagaggatggtgaggtttctctggggctagggcctcagtgctctcagcctgtgctaccatgctttgtgaccttgatcagtggctggcctgctctgagccagtccccaggaaggaggggtgaggtttgccagcctggctgatgtaaggacttcccttccagtcctctgtgaagttgcggctgctctgcagccagggtactaaaggagctgctgggacaggggattgatgtgagtacaagatccagcaccccattgtcccatgaccttatgaccaccactgccctgaaactctgcactaggcccagggagacgggtgagccagcctctcaacctctctgggcacctcccttccttctttccagcctgtctgttccttatcgcaggatccaggctgggggtgaggggctggtgagcaggggcctggcaccccctgaaggtctcctttccccatagtatgagaagatcctgaagctcacggctgacgccaagtttgagtcaggcgatgtgaaggccacagtggcagtgctgagtttcatcctctccagtgcggccaagcacagtgtcgatggcgaatccttgtccagtgaactgcagcagctggggctgcccaaaggtacgggttgtgggtgggcagctgggcagcctgtgggccaagggctgctagagaaggggacaggccctgtgaccctgaggtgtacctgccctgtctgggccaggagcccaagccaggccccgacatgctacctccagagctactccattctacccccagagcacgcggccagcctgtgccgctgttatgaggagaagcaaagccccttgcagaagcacttgcgggtctgcagcctacgcatgaataggttggcaggtgtgggctggcgggtggactacaccctgagctccagcctgctgcaatccgtggaagagcccatggtgcacctgcggctggaggtggcagctgccccagggaccccagcccagcctgttgccatgtccctctcagcagacaagttccaggtcctcctggcagaactgaagcaggcccagaccctgatgagctccctgggctgaggagaagggtgttccaggcctgtgtggagccgccctgcccgtatggagtcacgccctctgaactgctcttcgggaggcagccctggttctaggatgctgaggccctggcccggactctggcctcccagatccccagctgcctcacttctctcttgagaacttggctcagggctcctgaggacctttcccagcattaccttcccttcccttgaaaggcaattgttggctgttttcataagcaggaaaaataaacagaagtataaaggaa

SEQ ID NO: 441033 - DNA, 2224 bp, Homo sapiens
cccagaggcagttagtccaagtcacgtgatcgtcgactcagctgaccctgcgggaccggaaaaagaaattcccgggccctggcttcttggcgcgatgaggttccggttctgtggtgatctggactgtcccgactgggtcctggcagaaatcagcacgctggccaagatggttgagtgcacagggtctagtctgggtggaggaggggtgttgggggtggggattgtgggtgtagaggatggtgaggtttctctggggctagggcctcagtgctctcagcctgtgctaccatgctttgtgaccttgatcagtggctggcctgctctgagccagtccccaggaaggaggggtgaggtttgccagcctggctgatgtaaggacttcccttccagtcctctgtgaagttgcggctgctctgcagccagggtactaaaggagctgctgggacaggggattgatgtgagtacaagatccagcaccccattgtcccatgaccttatgaccaccactgccctgaaactctgcactaggcccagggagacgggtgagccagcctctcaacctctctgggcacctcccttccttctttccagcctgtctgttccttatcgcaggatccaggctgggggtgaggggctggtgagcaggggcctggcaccccctgaaggtctcctttccccatagtatgagaagatcctgaagctcacggctgacgccaagtttggtgagtatcccgctgagtctataggccccaggcaaccctgggaacttggcctggtgcctggtacagaggggccccccacccctcccagcagcatccttaacttaccttccctagtggaggagcatgagggaaagaaagaccgacagtcccaccttcctgtcctctgccagctcctggtggagcagtagcagtgcctgtggctccaggaggcctgggggctttgagctaaagttaatagggcaacagggaggtggctggacccacagtgacaccccctgccccacccacgggtccctcagagtcaggcgatgtgaaggccacagtggcagtgctgagtttcatcctctccagtgcggccaagcacagtgtcgatggcgaatccttgtccagtgaactgcagcagctggggctgcccaaaggtacgggttgtgggtgggcagctgggcagcctgtgggccaagggctgctagagaaggggacaggccctgtgaccctgaggtgtacctgccctgtctgggccaggagcccaagccaggccccgacatgctacctccagagctactccattctacccccagagcacgcggccagcctgtgccgctgttatgaggagaagcaaagccccttgcagaagcacttgcgggtctgcagcctacgcagtaagtatgaggccagccagggtccgggctcattctagaaggtgcacgcagcacacaaagtgcatggagagtccagggagacgacttaaccacggtcacatggttactagcagccgtagagctgggacctggccctgggtctcctgactccccccaaggtttcttgtcactgaggtctgctgtgggtgatcagaactgattatcgggcacctgccctgttctgagcctgggtcagcaggatgggagcttcttagaggccacatagccttgaatggttgagagctgagccagggtgtcggctgaggtctacttggcttgcctgctttgatcctgagagccacccaccccatctcacagtgaataggttggcaggtgtgggctggcgggtggactacaccctgagctccagcctgctgcaatccgtggaagagcccatggtgcacctgcggctggaggtggcagctgccccagggaccccagcccagcctgttgccatgtccctctcagcagacaagttccaggtcctcctggcagaactgaagcaggcccagaccctgatgagctccctgggctgaggagaagggtgttccaggcctgtgtggagccgccctgcccgtatggagtcacgccctctgaactgctcttcgggaggcagccctggttctaggatgctgaggccctggcccggactctggcctcccagatccccagctgcctcacttctctcttgagaacttggctcagggctcctgaggacctttcccagcattaccttcccttcccttgaaaggcaattgttggctgttttcataagcaggaaaaataaacagaagtataaaggaa

SEQ ID NO: 441034 - DNA, 2547 bp, Homo sapiens
cccagaggcagttagtccaagtcacgtgatcgtcgactcagctgaccctgcgggaccggaaaaagaaattcccgggccctggcttcttggcgcgatgaggttccggttctgtggtgatctggactgtcccgactgggtcctggcagaaatcagcacgctggccaagatggttgagtgcacagggtctagtctgggtggaggaggggtgttgggggtggggattgtgggtgtagaggatggtgaggtttctctggggctagggcctcagtgctctcagcctgtgctaccatgctttgtgaccttgatcagtggctggcctgctctgagccagtccccaggaaggaggggtgaggtttgccagcctggctgatgtaaggacttcccttccagtcctctgtgaagttgcggctgctctgcagccagggtactaaaggagctgctgggacaggggattgatgtgagtacaagatccagcaccccattgtcccatgaccttatgaccaccactgccctgaaactctgcactaggcccagggagacgggtgagccagcctctcaacctctctgggcacctcccttccttctttccagcctgtctgttccttatcgcaggatccaggctgggggtgaggggctggtgagcaggggcctggcaccccctgaaggtctcctttccccatagtatgagaagatcctgaagctcacggctgacgccaagtttggtgagtatcccgctgagtctataggccccaggcaaccctgggaacttggcctggtgcctggtacagaggggccccccacccctcccagcagcatccttaacttaccttccctagtggaggagcatgagggaaagaaagaccgacagtcccaccttcctgtcctctgccagctcctggtggagcagtagcagtgcctgtggctccaggaggcctgggggctttgagctaaagttaatagggcaacagggaggtggctggacccacagtgacaccccctgccccacccacgggtccctcagagtcaggcgatgtgaaggccacagtggcagtgctgagtttcatcctctccagtgcggccaagcacagtgtcgatggcgaatccttgtccagtgaactgcagcagctggggctgcccaaaggtacgggttgtgggtgggcagctgggcagcctgtgggccaagggctgctagagaaggggacaggccctgtgaccctgaggtgtacctgccctgtctgggccaggagcccaagccaggccccgacatgctacctccagagctactccattctacccccagagcacgcggccagcctgtgccgctgttatgaggagaagcaaagccccttgcagaagcacttgcgggtctgcagcctacgcagtaagtatgaggccagccagggtccgggctcattctagaaggtgcacgcagcacacaaagtgcatggagagtccagggagacgacttaaccacggtcacatggttactagcagccgtagagctgggacctggccctgggtctcctgactccccccaaggtttcttgtcactgaggtctgctgtgggtgatcagaactgattatcgggcacctgccctgttctgagcctgggtcagcaggatgggagcttcttagaggccacatagccttgaatggttgagagctgagccagggtgtcggctgaggtctacttggcttgcctgctttgatcctgagagccacccaccccatctcacagtgaataggttggcaggtgtgggctggcgggtggactacaccctgagctccagcctgctgcaatccgtggaagagcccatggtgcacctgcggctggaggtggcagctgccccagggaccccagcccagcctgttgccatgtccctctcagcagacaagttccaggtcctcctggcaggtgaggctcagctattcctcgacgggtgagaggctctcccagatccgcctgactgcctcccacctgcccacctcttccctctgcagaactgaagcaggcccagaccctgatgagctccctgggctgaggagaagggtgttccaggcctgtgtggagccgccctgcccgtatggagtcacgccctctgaactgctcttcgggaggcagccctggttctaggatgctgaggccctggcccggactctggcctcccagatccccagctgcctcacttctctcttgagaacttggctcagggctcctgaggacctttcccagcattaccttcccttcccttgaaaggcaattgttggctgttttcataagcaggaaaaataaacagaagtataaaggaagaatgtgtgcagggggttctgtttgggttcagatcaagggtttttgtgagagaaacacaagtgacatacaggccttcttggtccatcactcattttcttttctcaattgctgattgagggaggtcataggtaaggccaactgaggaccaaaatgcatctgcttgtctggtgagaagaaaatcagggttctagctcccagatctgggatgctcttggctctgctgtctttgccccctg

SEQ ID NO: 441035 - DNA, 1280 bp, Homo sapiens
  misc_feature (829)..(829): n is a, c, g, or t
  misc_feature (839)..(839): n is a, c, g, or t
  misc_feature (845)..(845): n is a, c, g, or t
  misc_feature (847)..(847): n is a, c, g, or t
  misc_feature (850)..(850): n is a, c, g, or t
  misc_feature (855)..(855): n is a, c, g, or t
  misc_feature (872)..(872): n is a, c, g, or t
cccagaggcagttagtccaagtcacgtgatcgtcgactcagctgaccctgcgggaccggaaaaagaaattcccgggccctggcttcttggcgcgatgaggttccggttctgtggtgatctggactgtcccgactgggtcctggcagaaatcagcacgctggccaagatgtcctctgtgaagttgcggctgctctgcagccagggtactaaaggagctgctgggacaggggattgattatgagaagatcctgaagctcacggctgacgccaagtttgagtcaggcgatgtgaaggccacagtggcagtgctgagtttcatcctctccagtgcggccaagcacagtgtcgatggcgaatccttgtccagtgaactgcagcagctggggctgcccaaagagcacgcggccagcctgtgccgctgttatgaggagaagcaaagccccttgcagaagcacttgcgggtctgcagcctacgcaaactgaagcaggcccagaccctgatgagctccctgggctgaggagaagggtgttccaggcctgtgtggagccgccctgcccgtatggagtcacgccctctgaactgctcttcgggaggcagccctggttctaggatgctgaggccctggcccggactctggcctcccagatccccagctgcctcacttctctcttgagaacttggctcagggctcctgaggacctttcccagcattaccttcccttcccttgaaaggcaattgttggctgttttcataagcaggaaaaataaacagaagtataaaggaaaaaaaaaaaaccacaaaaaacaaaaaaaaaaaaaaaaaaaaanaaaaaaaaanaaaaananaanaaaanaaaaaaaaaaaaaaaanaaaaaaaaagcgggcgcggcgcgcgcgccccccgccccccccccgggcgcgcgccccccccccggcacacccacgatttatttttgaaaaagagggcggcctcctactatgagggaggcagttaattatataatgacgaggagcgcggcgccgcgctcgcgttgctactcaacaccacacacgccggttgtgcggtgtgacatacagaaagtgctctcgacgtgcccgtcggactatctttctcttgtggacagagacacccaccatatcttgtgggtgggtgggcgtgcgaaacaactctaagtgtatggagcgaccacaacctccccacacgcgagcaaatagttatcggtcgtctttgggggaggggaaataaaaacaaacatcttgtatgatgatgcatctagc

SEQ ID NO: 441036 - DNA, 1229 bp, Homo sapiens
cccagaggcagttagtccaagtcacgtgatcgtcgactcagctgaccctgcgggaccggaaaaagaaattcccgggccctggcttcttggcgcgatgaggttccggttctgtggtgatctggactgtcccgactgggtcctggcagaaatcagcacgctggccaagatggttgagtgcacagggtctagtctgggtggaggaggggtgttgggggtggggattgtgggtgtagaggatggtgaggtttctctggggctagggcctcagtgctctcagcctgtgctaccatgctttgtgaccttgatcagtggctggcctgctctgagccagtccccaggaaggaggggtgaggtttgccagcctggctgatgtaaggacttcccttccagtcctctgtgaagttgcggctgctctgcagccagggtactaaaggagctgctgggacaggggattgatgtgagtacaagatccagcaccccattgtcccatgaccttatgaccaccactgccctgaaactctgcactaggcccagggagacgggtgagccagcctctcaacctctctgggcacctcccttccttctttccagcctgtctgttccttatcgcaggatccaggctgggggtgaggggctggtgagcaggggcctggcaccccctgaaggtctcctttccccatagtatgagaagatcctgaagctcacggctgacgccaagtttggtgagtatcccgctgagtctataggccccaggcaaccctgggaacttggcctggtgcctggtacagaggggccccccacccctcccagcagcatccttaacttaccttccctagtggaggagcatgagggaaagaaagaccgacagtcccaccttcctgtcctctgccagctcctggtggagcagtagcagtgcctgtggctccaggaggcctgggggctttgagctaaagttaatagggcaacagggaggtggctggacccacagtgacaccccctgccccacccacgggtccctcagagtcaggcgatgtgaaggccacagtggcagtgctgagtttcatcctctccagtgctctggcctcccagatccccagctgcctcacttctctcttgagaacttggctcagggctcctgaggacctttcccagcattaccttcccttcccttgaaaggcaattgttggctgttttcataagcaggaaaaataaacagaagtataaaggaa

SEQ ID NO: 441037 - DNA, 437 bp, Homo sapiens
gggaatgagggggcgccaagtggctccggaaactgggggaggttgtactggcctctccgcaaacacagtgtgtgcgggcgtgagggctgtgagtctggtagggaaaagtccaccactctcccgctcccgagacgggggcgggggtacggggcgggtaagacagagcaggccggccggcttagagtcccggtgcttccctggcggaaggaagggcccctgcctcccggggcaggaactagggcttgtctggagctgggagtcctttcaggtcttccccatccccaagaggacctcccaaggatacccccttccccagccctgccgtggggcttgtacaagaaggtgcttagaatcaggctcactcttccacactgttaggaagcccctccgctctttccagagccagaaagtagtagttttggggttgagacttatcc

SEQ ID NO: 441038 - DNA, 259 bp, Homo sapiens
cgctagagaaaaaagcttaaaggcagctagaggaaatggcacatcaggtacaaagggaatctcgtcatcaggctaatagcagactcctcaggagaaaccctacaagccagaaaagactgggggcctattttcatcattcttgaagaggaaactcaaaccaagaatttcaaacctgaccaaactaagcttcataagagtagaataaacatttctagagacaagcaatcactaagggatttcattaccagtagaccagcct

SEQ ID NO: 441039 - DNA, 3988 bp, Homo sapiens
  misc_feature (2260)..(2260): n is a, c, g, or t
gaattccggccagaagaaatctggcctcggaacacgccattctccgcgccgcttccaataaccactaacatccctaacgagcatccgagccgagggctctgctcggaaatcgtcctggcccaactcggcccttcgagctctcgaagattaccgcatctattttttttttcttttttttcttttcctagcgcagataaagtgagcccggaaagggaaggagggggcggggacaccattgccctgaaagaataaataagtaaataaacaaactggctcctcgccgcagctggacgcggtcggttgagtccaggttgggtcggacctgaacccctaaaagcggaaccgcctcccgccctcgccatcccggagctgagtcgccggcggcggtggctgctgccagacccggagtttcctctttcactggatggagctgaactttgggcggccagagcagcacagctgtccggggatcgctgcatgctgagctccctcggcaagacccagcggcggctcgggatttttttgggggggcggggaccagccccgcgccggcaccatgttcctggcgaccctgtacttcgcgctgccgctcttggacttgctcctgtcggccgaagtgagcggcggagaccgcctggattgcgtgaaagccagtgatcagtgcctgaaggagcagagctgcagcaccaagtaccgcacgctaaggcagtgcgtggcgggcaaggagaccaacttcagcctggcatccggcctggaggccaaggatgagtgccgcagcgccatggaggccctgaagcagaagtcgctctacaactgccgctgcaagcggggtatgaagaaggagaagaactgcctgcgcatttactggagcatgtaccagagcctgcagggaaatgatctgctggaggattccccatatgaaccagttaacagcagattgtcagatatattccgggtggtcccattcatatcagatttgcagtggagcacattcccaaagggaacaactgcctggatgcagcgaaggcctgcaacctcgacgacatttgcaagaagtacaggtcggcgtacatcaccccgtgcaccaccagcgtgtccaacgatgtctgcaaccgccgcaagtgccacaaggccctccggcagttctttgacaaggtcccggccaagcacagctacggaatgctcttctgctcctgccgggacatcgcctgcacagagcggaggcgacagaccatcgtgcctgtgtgctcctatgaagagagggagaagcccaactgtttgaatttgcaggactcctgcaagacgaattacatctgcagatctcgccttgcggatttttttaccaactgccagccagagtcaaggtctgtcagcagctgtctaaaggaaaactacgctgactgcctcctcgcctactcggggcttattggcacagtcatgacccccaactacatagactccagtagcctcagtgtggccccatggtgtgactgcagcaacagtgggaacgacctagaagagtgcttgaaatttttgaatttcttcaaggacaatacatgtcttaaaaatgcaattcaagcctttggcaatggctccgatgtgaccgtgtggcagccagccttcccagtacagaccaccactgccactaccaccactgccctccgggttaagaacaagcccctggggccagcagggtctgagaatgaaattcccactcatgttttgccaccgtgtgcaaatttacaggcacagaagctgaaatccaatgtgtcgggcaatacacacctctgtatttccaatggtaattatgaaaaagaaggtctcggtgcttccagccacataaccacaaaatcaatggctgctcctccaagctgtggtctgagcccactgctggtcctggtggtaaccgctctgtccaccctattatctttaacagaaacatcatagctgcattaaaaaaatacaatatggacatgtaaaaagacaaaaaccaagttatctgtttcctgttctcttgtatagctgaaattccagtttaggagctcagttgagaaacagttccattcaactggaacattttttttttttccttttaagaaagcttcttgtgatccttcggggcttctgtgaaaaacctgatgcagtgctccatccaaactcagaaggctttgggatatgctgtattttaaagggacagtttgtaacttgggctgtaaagcaaactggggctgtgttttcgatgatgatgatcatcatgatnatgatgattttaacagttttacttctggcctttcctagctagagaaggagttaatatttctaaggtaactcccatatctcctttaatgacattgatttctaatgatataaatttcagcctacattgatgccaagcttttttgccacaaagaagattcttaccaagagtgggctttgtggaaacagctggtactgatgttcacctttatatatgtactagcattttccacgctgatgtttatgtactgtaaacagttctgcactcttgtacaaaagaaaaaacacctgtcacatccaaatatagtatctgtcttttcgtcaaaatagagagtggggaatgagtgtgccgattcaatacctcaatccctgaacgacactctcctaatcctaagccttacctgagtgagaagccctttacctaacaaaagtccaatatagctgaaatgtcgctctaatactctttacacatatgaggttatatgtagaaaaaaattttactactaaatgatttcaactattggctttctatattttgaaagtaatgatattgtctcatttttttactgatggtttaatacaaaatacacagagcttgtttcccctcataagtagtgttcgctctgatatgaacttcacaaatacagctcatcaaaagcagactctgagaagcctcgtgctgtagcagaaagttctgcatcatgtgactgtggacaggcaggaggaaacagaacagacaagcattgtctttgtcattgctcgaagtgcaagcgtgcatacctgtggagggaactggtggctgcttgtaaatgttctgcagcatctcttgacacacttgtcatgacacaatccagtaccttggttttcaggttatctgacaaaggcagctttgattgggacatggaggcatgggcaggttctcctttcttgggaaacacatccatgctgggatgcacagttcttttcctaaggattgtgtttactcctgactgcaacgtcttggccactgtttggaacagtttggtctgaaggtcattaaggatctgcttgcatcttgtttcatgtcctccgtgacagactgcagaccatgttagaatagaaggaaggtttgtggatcaagagggttgacattaggtttggtgagatgagttgcttggcacagatcagcagaacaggaccctggtgataaggcatctggctttgctaaccacttatcatcttccattattctctttcttaactaagtagacccgaaagtgcacttttgaagtctggtttagatggcgagattccgaatctacaatgatcgagtactggtggccacttttctccaacattaagtaaagaggaggagattccaccttcagaaagtgctgggaagcattggctttcttcccacattggtagaagagatggaggaggaaaccagggtgcacatttctacagatcccctttgcctgctggtgtttgccttgtaagataagtcactggggggaaggggaaatctatgaaatccaagataaaggcatagtctttcagctctattggtgttaaaagtatatttgtgtccaaatgttaatcaacacaaatgtacagtactcagtactgacttttttcacttcaaaatgttttcaagggaaattcagcagacacccaactgtatttaattagtgaaaagatctataaagactcttactttgaataaacacattaagtaagtgtgtcaaaaaaa

SEQ ID NO: 441040 - DNA, 1992 bp, Homo sapiens
gaattccggccagaagaaatctggcctcggaacacgccattctccgcgccgcttccaataaccactaacatccctaacgagcatccgagccgagggctctgctcggaaatcgtcctggcccaactcggcccttcgagctctcgaagattaccgcatctattttttttttcttttttttcttttcctagcgcagataaagtgagcccggaaagggaaggagggggcggggacaccattgccctgaaagaataaataagtaaataaacaaactggctcctcgccgcagctggacgcggtcggttgagtccaggttgggtcggacctgaacccctaaaagcggaaccgcctcccgccctcgccatcccggagctgagtcgccggcggcggtggctgctgccagacccggagtttcctctttcactggatggagctgaactttgggcggccagagcagcacagctgtccggggatcgctgcatgctgagctccctcggcaagacccagcggcggctcgggatttttttgggggggcggggaccagccccgcgccggcaccatgttcctggcgaccctgtacttcgcgctgccgctcttggacttgctcctgtcggccgaagtgagcggcggagaccgcctggattgcgtgaaagccagtgatcagtgcctgaaggagcagagctgcagcaccaagtaccgcacgctaaggcagtgcgtggcgggcaaggagaccaacttcagcctggcatccggcctggaggccaaggatgagtgccgcagcgccatggaggccctgaagcagaagtcgctctacaactgccgctgcaagcggggtatgaagaaggagaagaactgcctgcgcatttactggagcatgtaccagagcctgcagggaaatgatctgctggaggattccccatatgaaccagttaacagcagattgtcagatatattccgggtggtcccattcatatcagatttgcagtggagcacattcccaaagggaacaactgcctggatgcagcgaaggcctgcaacctcgacgacatttgcaagaagtacaggtcggcgtacatcaccccgtgcaccaccagcgtgtccaacgatgtctgcaaccgccgcaagtgccacaaggccctccggcagttctttgacaaggtcccggccaagcacagctacggaatgctcttctgctcctgccgggacatcgcctgcacagagcggaggcgacagaccatcgtgcctgtgtgctcctatgaagagagggagaagcccaactgtttgaatttgcaggactcctgcaagacgaattacatctgcagatctcgccttgcggatttttttaccaactgccagccagagtcaaggtctgtcagcagctgtctaaaggaaaactacgctgactgcctcctcgcctactcggggcttattggcacagtcatgacccccaactacatagactccagtagcctcagtgtggccccatggtgtgactgcagcaacagtgggaacgacctagaagagtgcttgaaatttttgaatttcttcaaggacaatacatgtcttaaaaatgcaattcaagcctttggcaatggctccgatgtgaccgtgtggcagccagccttcccagtacagaccaccactgccactaccaccactgccctccgggttaagaacaagcccctggggccagcagggtctgagaatgaaattcccactcatgttttgccaccgtgtgcaaatttacaggcacagaagctgaaatccaatgtgtcgggcaatacacacctctgtatttccaatggtaattatgaaaaagaaggtctcggtgcttccagccacataaccacaaaatcaatggctgctcctccaagctgtggtctgagcccactgctggtcctggtggtaaccgctctgtccaccctattatctttaacagaaacatcatagctgcattaaaaaaatacaatatggacatgtaaaaagacaaaaacc

SEQ ID NO: 441041 - DNA, 4027 bp, Homo sapiens
  misc_feature (2267)..(2267): n is a, c, g, or t
  misc_feature (2270)..(2270): n is a, c, g, or t
  misc_feature (2299)..(2299): n is a, c, g, or t
gaattccggccagaagaaatctggcctcggaacacgccattctccgcgccgcttccaataaccactaacatccctaacgagcatccgagccgagggctctgctcggaaatcgtcctggcccaactcggcccttcgagctctcgaagattaccgcatctattttttttttcttttttttcttttcctagcgcagataaagtgagcccggaaagggaaggagggggcggggacaccattgccctgaaagaataaataagtaaataaacaaactggctcctcgccgcagctggacgcggtcggttgagtccaggttgggtcggacctgaacccctaaaagcggaaccgcctcccgccctcgccatcccggagctgagtcgccggcggcggtggctgctgccagacccggagtttcctctttcactggatggagctgaactttgggcggccagagcagcacagctgtccggggatcgctgcatgctgagctccctcggcaagacccagcggcggctcgggatttttttgggggggcggggaccagccccgcgccggcaccatgttcctggcgaccctgtacttcgcgctgccgctcttggacttgctcctgtcggccgaagtgagcggcggagaccgcctggattgcgtgaaagccagtgatcagtgcctgaaggagcagagctgcagcaccaagtaccgcacgctaaggcagtgcgtggcgggcaaggagaccaacttcagcctggcatccggcctggaggccaaggatgagtgccgcagcgccatggaggccctgaagcagaagtcgctctacaactgccgctgcaagcggggtatgaagaaggagaagaactgcctgcgcatttactggagcatgtaccagagcctgcagggaaatgatctgctggaggattccccatatgaaccagttaacagcagattgtcagatatattccgggtggtcccattcatatcagatttgcagtggagcacattcccaaagggaacaactgcctggatgcagcgaaggcctgcaacctcgacgacatttgcaagaagtacaggtcggcgtacatcaccccgtgcaccaccagcgtgtccaacgatgtctgcaaccgccgcaagtgccacaaggccctccggcagttctttgacaaggtcccggccaagcacagctacggaatgctcttctgctcctgccgggacatcgcctgcacagagcggaggcgacagaccatcgtgcctgtgtgctcctatgaagagagggagaagcccaactgtttgaatttgcaggactcctgcaagacgaattacatctgcagatctcgccttgcggatttttttaccaactgccagccagagtcaaggtctgtcagcagctgtctaaaggaaaactacgctgactgcctcctcgcctactcggggcttattggcacagtcatgacccccaactacatagactccagtagcctcagtgtggccccatggtgtgactgcagcaacagtgggaacgacctagaagagtgcttgaaatttttgaatttcttcaaggacaatacatgtcttaaaaatgcaattcaagcctttggcaatggctccgatgtgaccgtgtggcagccagccttcccagtacagaccaccactgccactaccaccactgccctccgggttaagaacaagcccctggggccagcagggtctgagaatgaaattcccactcatgttttgccaccgtgtgcaaatttacaggcacagaagctgaaatccaatgtgtcgggcaatacacacctctgtatttccaatggtaattatgaaaaagaaggtctcggtgcttccagccacataaccacaaaatcaatggctgctcctccaagctgtggtctgagcccactgctggtcctggtggtaaccgctctgtccaccctattatctttaacagaaacatcatagctgcattaaaaaaatacaatatggacatgtaaaaagacaaaaaccaagttatctgtttcctgttctcttgtatagctgaaattccagtttaggagctcagttgagaaacagttccattcaactggaacattttttttttttccttttaagaaagcttcttgtgatccttcggggcttctgtgaaaaacctgatgcagtgctccatccaaactcagaaggctttgggatatgctgtattttaaagggacagtttgtaacttgggctgtaaagcaaactggggctgtgttttcgatgatgatgatcatcatgatgatgatcntcntgatcatgatgatgatcatcatgatcatnatgatgattttaacagttttacttctggcctttcctagctagagaaggagttaatatttctaaggtaactcccatatctcctttaatgacattgatttctaatgatataaatttcagcctacattgatgccaagcttttttgccacaaagaagattcttaccaagagtgggctttgtggaaacagctggtactgatgttcacctttatatatgtactagcattttccacgctgatgtttatgtactgtaaacagttctgcactcttgtacaaaagaaaaaacacctgtcacatccaaatatagtatctgtcttttcgtcaaaatagagagtggggaatgagtgtgccgattcaatacctcaatccctgaacgacactctcctaatcctaagccttacctgagtgagaagccctttacctaacaaaagtccaatatagctgaaatgtcgctctaatactctttacacatatgaggttatatgtagaaaaaaattttactactaaatgatttcaactattggctttctatattttgaaagtaatgatattgtctcatttttttactgatggtttaatacaaaatacacagagcttgtttcccctcataagtagtgttcgctctgatatgaacttcacaaatacagctcatcaaaagcagactctgagaagcctcgtgctgtagcagaaagttctgcatcatgtgactgtggacaggcaggaggaaacagaacagacaagcattgtctttgtcattgctcgaagtgcaagcgtgcatacctgtggagggaactggtggctgcttgtaaatgttctgcagcatctcttgacacacttgtcatgacacaatccagtaccttggttttcaggttatctgacaaaggcagctttgattgggacatggaggcatgggcaggttctcctttcttgggaaacacatccatgctgggatgcacagttcttttcctaaggattgtgtttactcctgactgcaacgtcttggccactgtttggaacagtttggtctgaaggtcattaaggatctgcttgcatcttgtttcatgtcctccgtgacagactgcagaccatgttagaatagaaggaaggtttgtggatcaagagggttgacattaggtttggtgagatgagttgcttggcacagatcagcagaacaggaccctggtgataaggcatctggctttgctaaccacttatcatcttccattattctctttcttaactaagtagacccgaaagtgcacttttgaagtctggtttagatggcgagattccgaatctacaatgatcgagtactggtggccacttttctccaacattaagtaaagaggaggagattccaccttcagaaagtgctgggaagcattggctttcttcccacattggtagaagagatggaggaggaaaccagggtgcacatttctacagatcccctttgcctgctggtgtttgccttgtaagataagtcactggggggaaggggaaatctatgaaatccaagataaaggcatagtctttcagctctattggtgttaaaagtatatttgtgtccaaatgttaatcaacacaaatgtacagtactcagtactgacttttttcacttcaaaatgttttcaagggaaattcagcagacacccaactgtatttaattagtgaaaagatctataaagactcttactttgaataaacacattaagtaagtgtgtcaaaaaaa

SEQ ID NO: 441042 - DNA, 2082 bp, Homo sapiens
  misc_feature (1164)..(1164): n is a, c, g, or t
  misc_feature (1171)..(1171): n is a, c, g, or t
agaagcacatatgtttttgtattttgataaaattttagcatacagtctatcctcattatttgtggattctgtatttatgaattcacctacttactaaaatttgtctgtagccctcaaattaatacttacaatgcttttgtggtctttggaagacatgacattttttcacgtgaaaaattttagttgcctgatgcacatgttctcaactgaagtcaaacaaggtgacactgccttcttgtcaactctcatattgtaagcaaatgtcatttttgcagtctttggtgctacatttttctcatctttgtgctttttgtcggtgattccactgtttgagatagcccccaagcatagtgctgaggtgcttctaaatgcaagaagattgtgatttgtcttatggagaaaatatgtgtgttagataagctttgtttaggcatgagttcagtattaatgaattactaatgtatattcagtaagtgcctttaaacataaacacacataaaacatgattatgtattgattggttgacaagaatgtgcccagaggctttcaggaacctgtttccccaaggaacagtggttctgtgttggataatttagtgtctgtagcgacttcatagaacataattgttgtgaataatgagaacctactgtaattggtttcatttctaaacctgtgtattttctgtaaagacatcctgagcctgagtctggtggctcatacctgtaatcccagcactttgggaggccaagacaggaggattgcttgagcccaggagttcaagaccagcctaggcaacatagggagaccccatctctacaaaaaattaaaatatccagacatgttggcacgcacctgtagtcccagccactcgggctgaggtgggagcaagacttggcctgggaggttgaagctgcattgagccatgattgtgccactgcactccagtctgggtgatggagcaagaccctatctcgaaaaaaaaaagtccgccaaagggggtctttggcacacacaaagaaataagaaccattagcccttaatgtagcctgagaaattagatctatcctttttttttattttttatttttattttttaagatggagtctcgctctgtcacccaggctggagttcagtggcacaatctcagctcactgcaacctccnctgcctnggttcaagtgattctcctgcctcagcctcctgagtagctgggattacaggtgtgcgccactacacccagctaatttttgtatttttattagagacgtggtttcaccatgtcagccaggatgttctcaatctcttgacacgtgtctccctccagcttctgcccttatttacctgcctgttggctcttaaaggcatttttggttgagacttttgcatgtaaaataagaactttgccatctttggattcccccatgtttgtttgtttgtttttaataaataatatttaatattaaaaggagctgtggtttttttctctctaaagagcaggaaaggacagagactggtcgctctctgcagtcacacttgaggtgaagaaaccatgggatagaattagctgttagttgagtccctaggttcagaggaagaaagaagaccataccacctggtagggagtgcgaaggaggttccagggactgatccatagaagggtgtcagaacaacttcataataaagagttgccttattttcttggtcaaggggaacttcctgtgtgccttctatcctgatgacaccccctcactgaaatcctggtgttgtttccacagagctgtctggccttttgtccttgatccttggttaaggaaatgaccaaccagtaagacctgtgttgaagggaaaaacatcaattggtctctttgccaagttcaagtccagtaggttttctggatgtgtagtcaagaaactagcatctcattcttgcccggctcctaaagagctgggtgaccctgggtacctagtcaccacagtgttaggtgggactagtgaaatgcaaatactgagaggaggattggttcatccaagtctttaccacaatttagtgagtaatagaagaagcttaaaagatgttgtaca

SEQ ID NO: 441043 - DNA, 500 bp, Homo sapiens
ctactactactactactaaattcgcggccgcgtcgaccttctgcataccctggaaggccatgccatgcccattcgctccttgaccttttccccggactcccagctccttgtcactgcttcagatgatggctacatcaagatctatgatgtgtgtcgcttcttgctgctctcaagccctactccccatgcttctgcttctagcttgctgggagctgggaaactgaccaagcatggaaaactacagcaatgctcataacaggctaaaaggctctggggaagaaggcatttcaacagcagaaaagaggaagaagagggagaagagaaaatggagaaacaagaaataagccaacacaaaagaggggtgaagaaaagagagggtgcaaaagagaacaaagtaaaaacaaaaacaaaacaaaaaggacaaacaaatccccaaagaactctccaacggcaggtttcctggatgctccacccttccttataataaagaaggaaatgga

SEQ ID NO: 441044 - DNA, 886 bp, Homo sapiens
aagtaatccttttaaacagtaaaactcttagttttttcattataaattgaggcttctaccaaagtgactctaaggtagacttgtgttccaatggtaacttaaaatatgtaaatgtttgtaaaatgttgtttatagatcccagtgttggtcaggcctgggatggccaagacagttggaaagcaggagatggacaacttgaaggcattgcacagtgctttagaggcctcctgcgagccttggttttgaagctttaacaggcctccctcccatctggaaataggtagctgtgtctgagactcctggagaacaattaatatgagggccaggcagatcacaatttcaggaaaatggctaccctgtgaggagagaaagccacccaatgatgctgatacctggccatttcctgtaccgaggcatggggttggggggtctgaagttagaagaatgtaagtcatcaaaggatttttggtcgaagtccttccaacttcaaaccgatactaatgttcactttttaaaatagttcgtctgacaaaagtgtaaaagtttgggatgttggaacgaggacttgtgttcacaccttctttgatcaccaggatcaggtctggggagtaaaatacaatggaaatggttcaaaaattgtgtctgttggagatgaccaggaaattcacatctatgattgtccaatttaaacatcaaagtctccaggcttatgctgcaaagagaatgtacggattgatcatgacattccttaccttcttaggcttgtttaaaagaaatatagcatttattgtagcaaagacttaaattttgtagatacaatatgaatcttttcatgttttattggaaatgctgttcatactttaacataaagctttcttaatgcaaa

SEQ ID NO: 441045 - DNA, 304 bp, Homo sapiens
ctactactactactactaaattcgcggccgcgtcgaatggaaatggttcaaaaattgtgtctgttggagatgaccaggaaattcacatctatgattgtccaatttaaacatcaaagtctccaggcttatgctgcaaagagaatgtacggattgatcatgacattccttaccttcttaggcttgtttaaaagaaatatagcatttattgtagcaaagacttaaattttgtagatacaatatgaatcttttcatgttttattggaaatgctgttcatactttaacataaagctttcttaatgcaaa

SEQ ID NO: 441046 - DNA, 1518 bp, Homo sapiens
gatttcactgaatttatttcagcaacagaagttattagctttagtccaatctcaaaagtacaaaatgaaattgcaacacaaacctctaaacctgcagttgccggaagctaaacgtctgcgcttccggaagcaaatttccaactaccactcctctggaagcaggacctggcttcctccctcctctctccgcccaccctcgtcggcgtctgccccgcgcccgccatagcgacggcaacgggcgctgcggagtgctccgagccgtgagggcggggccggcgcgatgccccgccccttcgatagctcatctttgcgcgtcgcagtcgcgcggagcccggcttccgacgtgcagcctggcagtgcagtgagctgtctggccttttgtccttgatccttggttaaggaaatgaccaaccagtacggtattctcttcaaacaagagcaagcccatgatgatgccatttggtcagttgcttgggggacaaacaagaaggaaaactctgagacagtggtcacaggctccctagatgacctggtgaaggtctggaaatggcgtgatgagaggctggacctacagtggagtctggagggacatcagctgggagtggtgtctgtggacatcagccacaccctgcccattgctgcatccagctctcttgatgctcatattcgtctttgggacttggaaaatggcaaacagataaagtccatagatgcaggacctgtggatgcctggactttggccttttctcctgattcccagtatctggccacaggaactcatgtcgggaaagtgaacatttttggtgtggaaagtgggaaaaaggaatattctttggacacgagaggaaaattcattcttagtattgcatatagtcctgatgggaaatacctagccagtggagccatagatggaatcatcaatatttttgatattgcaactggaaaacttctgcataccctggaaggccatgccatgcccattcgctccttgaccttttccccggactcccagctccttgtcactgcttcagatgatggctacatcaagatctatgatgtacaacatgccaatttggctggcacgctgagcggccatgcctcctgggtgctgaacgttgcattctgtcctgatgacactcactttgtttccagttcgtctgacaaaagtgtaaaagtttgggatgttggaacgaggacttgtgttcacaccttctttgatcaccaggatcaggtctggggagtaaaatacaatggaaatggttcaaaaattgtgtctgttggagatgaccaggaaattcacatctatgattgtccaatttaaacatcaaagtctccaggcttatgctgcaaagagaatgtacggattgatcatgacattccttaccttcttaggcttgtttaaaagaaatatagcatttattgtagcaaagacttaaattttgtagatacaatatgaatcttttcatgttttattggaaatgctgttcatactttaacataaagctttcttaatgcaaa

SEQ ID NO: 441047 - DNA, 1676 bp, Homo sapiens
  misc_feature (1527)..(1527): n is a, c, g, or t
gatttcactgaatttatttcagcaacagaagttattagctttagtccaatctcaaaagtacaaaatgaaattgcaacacaaacctctaaacctgcagttgccggaagctaaacgtctgcgcttccggaagcaaatttccaactaccactcctctggaagcaggacctggcttcctccctcctctctccgcccaccctcgtcggcgtctgccccgcgcccgccatagcgacggcaacgggcgctgcggagtgctccgagccgtgagggcggggccggcgcgatgccccgccccttcgatagctcatctttgcgcgtcgcagtcgcgcggagcccggcttccgacgtgcagcctggcagtgcagtgagctgtctggccttttgtccttgatccttggttaaggaaatgaccaaccagtacggtattctcttcaaacaagagcaagcccatgatgatgccatttggtcagttgcttgggggacaaacaagaaggaaaactctgagacagtggtcacaggctccctagatgacctggtgaaggtctggaaatggcgtgatgagaggctggacctacagtggagtctggagggacatcagctgggagtggtgtctgtggacatcagccacaccctgcccattgctgcatccagctctcttgatgctcatattcgtctttgggacttggaaaatggcaaacagataaagtccatagatgcaggacctgtggatgcctggactttggccttttctcctgattcccagtatctggccacaggaactcatgtcgggaaagtgaacatttttggtgtggaaagtgggaaaaaggaatattctttggacacgagaggaaaattcattcttagtattgcatatagtcctgatgggaaatacctagccagtggagccatagatggaatcatcaatatttttgatattgcaactggaaaacttctgcataccctggaaggccatgccatgcccattcgctccttgaccttttccccggactcccagctccttgtcactgcttcagatgatggctacatcaagatctatgatgtacaacatgccaatttggctggcacgctgagcggccatgcctcctgggtgctgaacgttgcattctgtcctgatgacactcactttgtttccagttcgtctgacaaaagtgtaaaagtttgggatgttggaacgaggacttgtgttcacaccttctttgatcaccaggatcaggtctggggagtaaaatacaatggaaatggttcaaaaattgtgtctgttggagatgaccaggaaattcacatctatgattgtccaatttaaacatcaaagtctccaggcttatgctgcaaagagaatgtacggattgatcatgacattccttaccttcttaggcttgtttaaaagaaatatagcatttattgtagcaaagacttaaattttgtagatacaatatgaatcttttcatgttttattggaaatgctgttcatactttaacataaagctttcttaatgcaaaaaaaaaaantagggaaggcggattacattcactggcccggcgtttacaacgtcggaactggggaacccctgggggtacccactttaatggccttgaggaaattcccttttggcagttggggaataacgaaagggccgaaccgtcggcttccaacagga

SEQ ID NO: 441048 - DNA, 2239 bp, Homo sapiens
  misc_feature (1528)..(1528): n is a, c, g, or t
  misc_feature (1533)..(1533): n is a, c, g, or t
  misc_feature (1538)..(1538): n is a, c, g, or t
  misc_feature (1543)..(1543): n is a, c, g, or t
  misc_feature (1548)..(1548): n is a, c, g, or t
  misc_feature (1554)..(1554): n is a, c, g, or t
  misc_feature (1559)..(1559): n is a, c, g, or t
  misc_feature (1564)..(1564): n is a, c, g, or t
  misc_feature (1569)..(1569): n is a, c, g, or t
  misc_feature (1609)..(1609): n is a, c, g, or t
  misc_feature (1613)..(1613): n is a, c, g, or t
  misc_feature (1615)..(1615): n is a, c, g, or t
gatttcactgaatttatttcagcaacagaagttattagctttagtccaatctcaaaagtacaaaatgaaattgcaacacaaacctctaaacctgcagttgccggaagctaaacgtctgcgcttccggaagcaaatttccaactaccactcctctggaagcaggacctggcttcctccctcctctctccgcccaccctcgtcggcgtctgccccgcgcccgccatagcgacggcaacgggcgctgcggagtgctccgagccgtgagggcggggccggcgcgatgccccgccccttcgatagctcatctttgcgcgtcgcagtcgcgcggagcccggcttccgacgtgcagcctggcagtgcagtgagctgtctggccttttgtccttgatccttggttaaggaaatgaccaaccagtacggtattctcttcaaacaagagcaagcccatgatgatgccatttggtcagttgcttgggggacaaacaagaaggaaaactctgagacagtggtcacaggctccctagatgacctggtgaaggtctggaaatggcgtgatgagaggctggacctacagtggagtctggagggacatcagctgggagtggtgtctgtggacatcagccacaccctgcccattgctgcatccagctctcttgatgctcatattcgtctttgggacttggaaaatggcaaacagataaagtccatagatgcaggacctgtggatgcctggactttggccttttctcctgattcccagtatctggccacaggaactcatgtcgggaaagtgaacatttttggtgtggaaagtgggaaaaaggaatattctttggacacgagaggaaaattcattcttagtattgcatatagtcctgatgggaaatacctagccagtggagccatagatggaatcatcaatatttttgatattgcaactggaaaacttctgcataccctggaaggccatgccatgcccattcgctccttgaccttttccccggactcccagctccttgtcactgcttcagatgatggctacatcaagatctatgatgtacaacatgccaatttggctggcacgctgagcggccatgcctcctgggtgctgaacgttgcattctgtcctgatgacactcactttgtttccagttcgtctgacaaaagtgtaaaagtttgggatgttggaacgaggacttgtgttcacaccttctttgatcaccaggatcaggtctggggagtaaaatacaatggaaatggttcaaaaattgtgtctgttggagatgaccaggaaattcacatctatgattgtccaatttaaacatcaaagtctccaggcttatgctgcaaagagaatgtacggattgatcatgacattccttaccttcttaggcttgtttaaaagaaatatagcatttattgtagcaaagacttaaattttgtagatacaatatgaatcttttcatgttttattggaaatgctgttcatactttaacataaagctttcttaatgcaaaaaaaaaaaanaaaanaaaanaaaanaaaanaaaaanaaaanaaaanaaaanaaaaaaaaaaaaaaaaaaaaaaaaaaaaaaaaaaaaacanacananaaaaaaaaaaaaaaaaaaaaaacaaagacaaaaaaaaaaaaaagaaaaaaaaaaaaaaaaaaaaaaaacgatggatgagtgagaagagaagagcataacaagatgagagaaatacgagaggtcagacaccgcccgagaagaggataatgagaaggaaaagagaacgcagatttagtttagagagcaacagcacacacaccgactccacggacgaccggcgcgcagagtcaaaaaagagaggagtaaaaccgaatcacgagaaagtacaaaacaggaagagaacgaagagccagacccaaacgaacgggaaagagatagacgcagagcacaaagtcaaagaaagagaacaaagcagcaggacaagagggaagagcgagaacaagaggaaagacaagtaggaaatccagagagagaatgaaaccaacagaagactacacagcggcagcagagaaacaagagaaaacagaacaaggacacacaaaagcagaaacactacaagccgaagaaacaagacaaaaggcgaaggcaagagaaggaaagagaaagctagaaggcaaccagggaaggaaaacagcacacacaaacaagaagagaacagcaagcgaaaaagaacaacgaaaaaaa

SEQ ID NO: 441049 - DNA, 2929 bp, Homo sapiens
  misc_feature (1164)..(1164): n is a, c, g, or t
  misc_feature (1171)..(1171): n is a, c, g, or t
agaagcacatatgtttttgtattttgataaaattttagcatacagtctatcctcattatttgtggattctgtatttatgaattcacctacttactaaaatttgtctgtagccctcaaattaatacttacaatgcttttgtggtctttggaagacatgacattttttcacgtgaaaaattttagttgcctgatgcacatgttctcaactgaagtcaaacaaggtgacactgccttcttgtcaactctcatattgtaagcaaatgtcatttttgcagtctttggtgctacatttttctcatctttgtgctttttgtcggtgattccactgtttgagatagcccccaagcatagtgctgaggtgcttctaaatgcaagaagattgtgatttgtcttatggagaaaatatgtgtgttagataagctttgtttaggcatgagttcagtattaatgaattactaatgtatattcagtaagtgcctttaaacataaacacacataaaacatgattatgtattgattggttgacaagaatgtgcccagaggctttcaggaacctgtttccccaaggaacagtggttctgtgttggataatttagtgtctgtagcgacttcatagaacataattgttgtgaataatgagaacctactgtaattggtttcatttctaaacctgtgtattttctgtaaagacatcctgagcctgagtctggtggctcatacctgtaatcccagcactttgggaggccaagacaggaggattgcttgagcccaggagttcaagaccagcctaggcaacatagggagaccccatctctacaaaaaattaaaatatccagacatgttggcacgcacctgtagtcccagccactcgggctgaggtgggagcaagacttggcctgggaggttgaagctgcattgagccatgattgtgccactgcactccagtctgggtgatggagcaagaccctatctcgaaaaaaaaaagtccgccaaagggggtctttggcacacacaaagaaataagaaccattagcccttaatgtagcctgagaaattagatctatcctttttttttattttttatttttattttttaagatggagtctcgctctgtcacccaggctggagttcagtggcacaatctcagctcactgcaacctccnctgcctnggttcaagtgattctcctgcctcagcctcctgagtagctgggattacaggtgtgcgccactacacccagctaatttttgtatttttattagagacgtggtttcaccatgtcagccaggatgttctcaatctcttgacacgtgtctccctccagcttctgcccttatttacctgcctgttggctcttaaaggcatttttggttgagacttttgcatgtaaaataagaactttgccatctttggattcccccatgtttgtttgtttgtttttaataaataatatttaatattaaaaggagctgtggtttttttctctctaaagagcaggaaaggacagagactggtcgctctctgcagtcacacttgaggtgaagaaaccatgggatagaattagctgttagttgagtccctaggttcagaggaagaaagaagaccataccacctggtagggagtgcgaaggaggttccagggactgatccatagaagggtgtcagaacaacttcataataaagagttgccttattttcttggtcaaggggaacttcctgtgtgccttctatcctgatgacaccccctcactgaaatcctggtgttgtttccacagagctgtctggccttttgtccttgatccttggttaaggaaatgaccaaccagtacggtattctcttcaaacaagagcaagcccatgatgatgccatttggtcagttgcttgggggacaaacaagaaggaaaactctgagacagtggtcacaggctccctagatgacctggtgaaggtctggaaatggcgtgatgagaggctggacctacagtggagtctggagggacatcagctgggagtggtgtctgtggacatcagccacaccctgcccattgctgcatccagctctcttgatgctcatattcgtctttgggacttggaaaatggcaaacagataaagtccatagatgcaggacctgtggatgcctggactttggccttttctcctgattcccagtatctggccacaggaactcatgtcgggaaagtgaacatttttggtgtggaaagtgggaaaaaggaatattctttggacacgagaggaaaattcattcttagtattgcatatagtcctgatgggaaatacctagccagtggagccatagatggaatcatcaatatttttgatattgcaactggaaaacttctgcataccctggaaggccatgccatgcccattcgctccttgaccttttccccggactcccagctccttgtcactgcttcagatgatggctacatcaagatctatgatgtacaacatgccaatttggctggcacgctgagcggccatgcctcctgggtgctgaacgttgcattctgtcctgatgacactcactttgtttccagttcgtctgacaaaagtgtaaaagtttgggatgttggaacgaggacttgtgttcacaccttctttgatcaccaggatcaggtctggggagtaaaatacaatggaaatggttcaaaaattgtgtctgttggagatgaccaggaaattcacatctatgattgtccaatttaaacatcaaagtctccaggcttatgctgcaaagagaatgtacggattgatcatgacattccttaccttcttaggcttgtttaaaagaaatatagcatttattgtagcaaagacttaaattttgtagatacaatatgaatcttttcatgttttattggaaatgctgttcatactttaacataaagctttcttaatgcaaa

SEQ ID NO: 441050 - DNA, 1581 bp, Homo sapiens
gatttcactgaatttatttcagcaacagaagttattagctttagtccaatctcaaaagtacaaaatgaaattgcaacacaaacctctaaacctgcagttgccggaagctaaacgtctgcgcttccggaagcaaatttccaactaccactcctctggaagcaggacctggcttcctccctcctctctccgcccaccctcgtcggcgtctgccccgcgcccgccatagcgacggcaacgggcgctgcggagtgctccgagccgtgagggcggggccggcgcgatgccccgccccttcgatagctcatctttgcgcgtcgcagtcgcgcggagcccggcttccgacgtgcagcctggcagtgcagtgagctgtctggccttttgtccttgatccttggttaaggaaatgaccaaccagtacggtattctcttcaaacaagagcaagcccatgatgatgccatttggtcagttgcttgggggacaaacaagaaggaaaactctgagacagtggtcacaggctccctagatgacctggtgaaggtctggaaatggcgtgatgagaggctggacctacagtggagtctggagggacatcagctgggagtggtgtctgtggacatcagccacaccctgcccattgctgcatccagctctcttgatgctcatattcgtctttgggacttggaaaatggcaaacagataaagtccatagatgcaggacctgtggatgcctggactttggccttttctcctgattcccagtatctggccacaggaactcatgtcgggaaagtgaacatttttggtgtggaaagtgggaaaaaggaatattctttggacacgagaggaaaattcattcttagtattgcatatagtcctgatgggaaatacctagccagtggagccatagatggaatcatcaatatttttgatattgcaactggaaaacttctgcataccctggaaggccatgccatgcccattcgctccttgaccttttccccggactcccagctccttgtcactgcttcagatgatggctacatcaagatctatgatgtacaacatgccaatttggctggcacgctgagcggccatgcctcctgggtgctgaacgttgcattctgtcctgatgacactcactttgtttccagttcgtctgacaaaagtgtaaaagtttgggatgttggaacgaggacttgtgttcacaccttctttgatcaccaggatcaggtgtcgcttcttgctgctctcaagccctactccccatgcttctgcttctagcttgctgggagctgggaaactgaccaagcatggaaaactacagcaatgctcataacaggctaaaaggctctggggaagaaggcatttcaacagcagaaaagaggaagaagagggagaagagaaaatggagaaacaagaaataagccaacacaaaagaggggtgaagaaaagagagggtgcaaaagagaacaaagtaaaaacaaaaacaaaacaaaaaggacaaacaaatccccaaagaactctccaacggcaggtttcctggatgctccacccttccttataataaagaaggaaatgga

SEQ ID NO: 441051 - DNA, 2981 bp, Homo sapiens
  misc_feature (1164)..(1164): n is a, c, g, or t
  misc_feature (1171)..(1171): n is a, c, g, or t
agaagcacatatgtttttgtattttgataaaattttagcatacagtctatcctcattatttgtggattctgtatttatgaattcacctacttactaaaatttgtctgtagccctcaaattaatacttacaatgcttttgtggtctttggaagacatgacattttttcacgtgaaaaattttagttgcctgatgcacatgttctcaactgaagtcaaacaaggtgacactgccttcttgtcaactctcatattgtaagcaaatgtcatttttgcagtctttggtgctacatttttctcatctttgtgctttttgtcggtgattccactgtttgagatagcccccaagcatagtgctgaggtgcttctaaatgcaagaagattgtgatttgtcttatggagaaaatatgtgtgttagataagctttgtttaggcatgagttcagtattaatgaattactaatgtatattcagtaagtgcctttaaacataaacacacataaaacatgattatgtattgattggttgacaagaatgtgcccagaggctttcaggaacctgtttccccaaggaacagtggttctgtgttggataatttagtgtctgtagcgacttcatagaacataattgttgtgaataatgagaacctactgtaattggtttcatttctaaacctgtgtattttctgtaaagacatcctgagcctgagtctggtggctcatacctgtaatcccagcactttgggaggccaagacaggaggattgcttgagcccaggagttcaagaccagcctaggcaacatagggagaccccatctctacaaaaaattaaaatatccagacatgttggcacgcacctgtagtcccagccactcgggctgaggtgggagcaagacttggcctgggaggttgaagctgcattgagccatgattgtgccactgcactccagtctgggtgatggagcaagaccctatctcgaaaaaaaaaagtccgccaaagggggtctttggcacacacaaagaaataagaaccattagcccttaatgtagcctgagaaattagatctatcctttttttttattttttatttttattttttaagatggagtctcgctctgtcacccaggctggagttcagtggcacaatctcagctcactgcaacctccnctgcctnggttcaagtgattctcctgcctcagcctcctgagtagctgggattacaggtgtgcgccactacacccagctaatttttgtatttttattagagacgtggtttcaccatgtcagccaggatgttctcaatctcttgacacgtgtctccctccagcttctgcccttatttacctgcctgttggctcttaaaggcatttttggttgagacttttgcatgtaaaataagaactttgccatctttggattcccccatgtttgtttgtttgtttttaataaataatatttaatattaaaaggagctgtggtttttttctctctaaagagcaggaaaggacagagactggtcgctctctgcagtcacacttgaggtgaagaaaccatgggatagaattagctgttagttgagtccctaggttcagaggaagaaagaagaccataccacctggtagggagtgcgaaggaggttccagggactgatccatagaagggtgtcagaacaacttcataataaagagttgccttattttcttggtcaaggggaacttcctgtgtgccttctatcctgatgacaccccctcactgaaatcctggtgttgtttccacagagctgtctggccttttgtccttgatccttggttaaggaaatgaccaaccagctcacaattgttgaacagtatctcggcttcattaagtcgtatgcaagaagactttataaatgaagcactttccattctagcccatgatgatgccatttggtcagttgcttgggggacaaacaagaaggaaaactctgagacagtggtcacaggctccctagatgacctggtgaaggtctggaaatggcgtgatgagaggctggacctacagtggagtctggagggacatcagctgggagtggtgtctgtggacatcagccacaccctgcccattgctgcatccagctctcttgatgctcatattcgtctttgggacttggaaaatggcaaacagataaagtccatagatgcaggacctgtggatgcctggactttggccttttctcctgattcccagtatctggccacaggaactcatgtcgggaaagtgaacatttttggtgtggaaagtgggaaaaaggaatattctttggacacgagaggaaaattcattcttagtattgcatatagtcctgatgggaaatacctagccagtggagccatagatggaatcatcaatatttttgatattgcaactggaaaacttctgcataccctggaaggccatgccatgcccattcgctccttgaccttttccccggactcccagctccttgtcactgcttcagatgatggctacatcaagatctatgatgtacaacatgccaatttggctggcacgctgagcggccatgcctcctgggtgctgaacgttgcattctgtcctgatgacactcactttgtttccagttcgtctgacaaaagtgtaaaagtttgggatgttggaacgaggacttgtgttcacaccttctttgatcaccaggatcaggtctggggagtaaaatacaatggaaatggttcaaaaattgtgtctgttggagatgaccaggaaattcacatctatgattgtccaatttaaacatcaaagtctccaggcttatgctgcaaagagaatgtacggattgatcatgacattccttaccttcttaggcttgtttaaaagaaatatagcatttattgtagcaaagacttaaattttgtagatacaatatgaatcttttcatgttttattggaaatgctgttcatactttaacataaagctttcttaatgcaaa

SEQ ID NO: 441052 - DNA, 1615 bp, Homo sapiens
gatttcactgaatttatttcagcaacagaagttattagctttagtccaatctcaaaagtacaaaatgaaattgcaacacaaacctctaaacctgcagttgccggaagctaaacgtctgcgcttccggaagcaaatttccaactaccactcctctggaagcaggacctggcttcctccctcctctctccgcccaccctcgtcggcgtctgccccgcgcccgccatagcgacggcaacgggcgctgcggagtgctccgagccgtgagggcggggccggcgcgatgccccgccccttcgatagctcatctttgcgcgtcgcagtcgcgcggagcccggcttccgacgtgcagcctggcagtgcagtgagctgtctggccttttgtccttgatccttggttaaggaaatgaccaaccagtacggtattctcttcaaacaagagcaagcccatgatgatgccatttggtcagttgcttgggggacaaacaagaaggaaaactctgagacagtggtcacaggctccctagatgacctggtgaaggtctggaaatgaccattggtattgcatagtcacagggacccagaatttcagatgccaggtaaagtgtgttctttgtgaagaaatccatttctctgtcccctgttgaaggcgtgatgagaggctggacctacagtggagtctggagggacatcagctgggagtggtgtctgtggacatcagccacaccctgcccattgctgcatccagctctcttgatgctcatattcgtctttgggacttggaaaatggcaaacagataaagtccatagatgcaggacctgtggatgcctggactttggccttttctcctgattcccagtatctggccacaggaactcatgtcgggaaagtgaacatttttggtgtggaaagtgggaaaaaggaatattctttggacacgagaggaaaattcattcttagtattgcatatagtcctgatgggaaatacctagccagtggagccatagatggaatcatcaatatttttgatattgcaactggaaaacttctgcataccctggaaggccatgccatgcccattcgctccttgaccttttccccggactcccagctccttgtcactgcttcagatgatggctacatcaagatctatgatgtacaacatgccaatttggctggcacgctgagcggccatgcctcctgggtgctgaacgttgcattctgtcctgatgacactcactttgtttccagttcgtctgacaaaagtgtaaaagtttgggatgttggaacgaggacttgtgttcacaccttctttgatcaccaggatcaggtctggggagtaaaatacaatggaaatggttcaaaaattgtgtctgttggagatgaccaggaaattcacatctatgattgtccaatttaaacatcaaagtctccaggcttatgctgcaaagagaatgtacggattgatcatgacattccttaccttcttaggcttgtttaaaagaaatatagcatttattgtagcaaagacttaaattttgtagatacaatatgaatcttttcatgttttattggaaatgctgttcatactttaacataaagctttcttaatgcaaa

SEQ ID NO: 441053 - DNA, 1593 bp, Homo sapiens
gatttcactgaatttatttcagcaacagaagttattagctttagtccaatctcaaaagtacaaaatgaaattgcaacacaaacctctaaacctgcagttgccggaagctaaacgtctgcgcttccggaagcaaatttccaactaccactcctctggaagcaggacctggcttcctccctcctctctccgcccaccctcgtcggcgtctgccccgcgcccgccatagcgacggcaacgggcgctgcggagtgctccgagccgtgagggcggggccggcgcgatgccccgccccttcgatagctcatctttgcgcgtcgcagtcgcgcggagcccggcttccgacgtgcagcctggcagtgcagtgagctgtctggccttttgtccttgatccttggttaaggaaatgaccaaccagtacggtattctcttcaaacaagagcaagcccatgatgatgccatttggtcagttgcttgggggacaaacaagaaggaaaactctgagacagtggtcacaggctccctagatgacctggtgaaggtctggaaatggcgtgatgagaggctggacctacagtggagtctggagggacatcagctgggagtggtgtctgtggacatcagccacaccctgcccattgctgcatccagctctcttgatgctcatattcgtctttgggacttggaaaatggcaaacagataaagtccatagatgcaggacctgtggatgcctggactttggccttttctcctgattcccagtatctggccacaggaactcatgtcgggaaagtgaacatttttggtgtggaaagtgggaaaaaggaatattctttggacacgagaggaaaattcattcttagtattgcatatagtcctgatgggaaatacctagccagtggagccatagatggaatcatcaatatttttgatattgcaactggaaaacttctgcataccctggaaggtggatgaaagtattgtgcccactgtccacaccggtggcctctggaaaggaggactgggtagctaaagaacaggggccatgccatgcccattcgctccttgaccttttccccggactcccagctccttgtcactgcttcagatgatggctacatcaagatctatgatgtacaacatgccaatttggctggcacgctgagcggccatgcctcctgggtgctgaacgttgcattctgtcctgatgacactcactttgtttccagttcgtctgacaaaagtgtaaaagtttgggatgttggaacgaggacttgtgttcacaccttctttgatcaccaggatcaggtctggggagtaaaatacaatggaaatggttcaaaaattgtgtctgttggagatgaccaggaaattcacatctatgattgtccaatttaaacatcaaagtctccaggcttatgctgcaaagagaatgtacggattgatcatgacattccttaccttcttaggcttgtttaaaagaaatatagcatttattgtagcaaagacttaaattttgtagatacaatatgaatcttttcatgttttattggaaatgctgttcatactttaacataaagctttcttaatgcaaa

SEQ ID NO: 441054 - DNA, 2201 bp, Homo sapiens
  misc_feature (1164)..(1164): n is a, c, g, or t
  misc_feature (1171)..(1171): n is a, c, g, or t
agaagcacatatgtttttgtattttgataaaattttagcatacagtctatcctcattatttgtggattctgtatttatgaattcacctacttactaaaatttgtctgtagccctcaaattaatacttacaatgcttttgtggtctttggaagacatgacattttttcacgtgaaaaattttagttgcctgatgcacatgttctcaactgaagtcaaacaaggtgacactgccttcttgtcaactctcatattgtaagcaaatgtcatttttgcagtctttggtgctacatttttctcatctttgtgctttttgtcggtgattccactgtttgagatagcccccaagcatagtgctgaggtgcttctaaatgcaagaagattgtgatttgtcttatggagaaaatatgtgtgttagataagctttgtttaggcatgagttcagtattaatgaattactaatgtatattcagtaagtgcctttaaacataaacacacataaaacatgattatgtattgattggttgacaagaatgtgcccagaggctttcaggaacctgtttccccaaggaacagtggttctgtgttggataatttagtgtctgtagcgacttcatagaacataattgttgtgaataatgagaacctactgtaattggtttcatttctaaacctgtgtattttctgtaaagacatcctgagcctgagtctggtggctcatacctgtaatcccagcactttgggaggccaagacaggaggattgcttgagcccaggagttcaagaccagcctaggcaacatagggagaccccatctctacaaaaaattaaaatatccagacatgttggcacgcacctgtagtcccagccactcgggctgaggtgggagcaagacttggcctgggaggttgaagctgcattgagccatgattgtgccactgcactccagtctgggtgatggagcaagaccctatctcgaaaaaaaaaagtccgccaaagggggtctttggcacacacaaagaaataagaaccattagcccttaatgtagcctgagaaattagatctatcctttttttttattttttatttttattttttaagatggagtctcgctctgtcacccaggctggagttcagtggcacaatctcagctcactgcaacctccnctgcctnggttcaagtgattctcctgcctcagcctcctgagtagctgggattacaggtgtgcgccactacacccagctaatttttgtatttttattagagacgtggtttcaccatgtcagccaggatgttctcaatctcttgacacgtgtctccctccagcttctgcccttatttacctgcctgttggctcttaaaggcatttttggttgagacttttgcatgtaaaataagaactttgccatctttggattcccccatgtttgtttgtttgtttttaataaataatatttaatattaaaaggagctgtggtttttttctctctaaagagcaggaaaggacagagactggtcgctctctgcagtcacacttgaggtgaagaaaccatgggatagaattagctgttagttgagtccctaggttcagaggaagaaagaagaccataccacctggtagggagtgcgaaggaggttccagggactgatccatagaagggtgtcagaacaacttcataataaagagttgccttattttcttggtcaaggggaacttcctgtgtgccttctatcctgatgacaccccctcactgaaatcctggtgttgtttccacagagctgtctggccttttgtccttgatccttggttaaggaaatgaccaaccagctcacaattgttgaacagtatctcggcttcattaagtcgtatgcaagaagactttataaatgaagcactttccattctagcccatgatgatgccatttggtcagttgcttgggggacaaacaagaaggaaaactctgagacagtggtcacaggctccctagatgacctggtgaaggtctggaaatggtgagtgcctctcccctaacatacagccttggaaaattgggggctgaggttttgcttctgaactctccagttgcagtccgggaaatacttttttctaggcaagaaagcaatagcaatatggtggtataaaacagcagcttatttttcccacttgttttcctgttactctgtattaaagccctaaagtta

SEQ ID NO: 441055 - DNA, 770 bp, Homo sapiens
  misc_feature (441)..(441): n is a, c, g, or t
  misc_feature (508)..(508): n is a, c, g, or t
  misc_feature (513)..(513): n is a, c, g, or t
  misc_feature (518)..(518): n is a, c, g, or t
  misc_feature (523)..(523): n is a, c, g, or t
  misc_feature (528)..(528): n is a, c, g, or t
  misc_feature (534)..(534): n is a, c, g, or t
  misc_feature (539)..(539): n is a, c, g, or t
  misc_feature (544)..(544): n is a, c, g, or t
  misc_feature (549)..(549): n is a, c, g, or t
gatttcactgaatttatttcagcaacagaagttattagctttagtccaatctcaaaagtacaaaatgaaattgcaacacaaacctctaaacctgcagttgccggaagctaaacgtctgcgcttccggaagcaaatttccaactaccactcctctggaagcaggacctggcttcctccctcctctctccgcccaccctcgtcggcgtctgccccgcgcccgccatagcgacggcaacgggcgctgcggagtgctccgagccgtgagggcggggccggcgcgatgccccgccccttcgatagctcatctttgcgcgtcgcagtcgcgcggagcccggcttccgacgtgcagcctggcagtgcagtgagctgtctggccttttgtccttgatccttggttaaggaaatgaccaaccagtacggtattctcttcaaacaagagcnagcccatgatgatgccatttggtcagttgcttgggggacatagcgagactcggtctcaaaaaaaaanaaaanaaaanaaaanaaaanaaaaanaaaanaaaanaaaanaaaacactgccaaactgtttccaaagcatctgcatcgtgtttaatttccataagtaaccgtatgagaattctaggtcctccaaataattagcagtccttcgtagtgtcagtttttgtttcagccttcctttatgggtatgctgtggcatatccctggagattttaattcgcattttccagtgactaaggggtgttgaaccactcgtgccttcctgtgccta

SEQ ID NO: 441056 - DNA, 700 bp, Homo sapiens
aaatacctgcctgcaggcagggccatcacacccttgtgtggctccaaaatcacttttttaattaatccaatcctcagcaatgctcataacaggctaaaaggctctggggaagaaggcatttcaacagcagaaaagaggaagaagagggagaagagaaaatggagaaacaagaaataagccaacacaaaagaggggtgaagaaaagagagggtgcaaaagagaacaaagtaaaaacaaaaacaaaacaaaaaggacaaacaaatccccaaagaactctccaacggcaggtttcctggatgctccacccttccttataataaagaaggaaatggatttcttgggatttgccacttccttccctctggggctctttctccaccaccctcactccatttggctcccggctccctaggctggggtcagctgagacagcaaggaacgctggctcttggtggggcccaggacctcaaatagtccacccctggacaggacaggctttcccaaagaagttacacacagatgcttcccagccccggctcaggagggctaggatctgggctgtgaccacgtaagggcatcttggacacaatgccagggtgttgagctcacaaccagtggtctggagcttcgtgtaaactgtgatcctcaaactcctccttgagggaggaaatgggtgccttgggaggtctatggaagccta

SEQ ID NO: 441057 - DNA, 473 bp, Homo sapiens
gacatgagccaccatacctggcctgtcactatagatttaacctagacatactagttcttgtaacagtgttaagtgcttgtttgggtgaacagacttactttttatttattatatcgtaatctatcacattatgtatgtgtgtgttaatatatatttgctatatgaatgtctcatttctgttattttggattctgatgaactttgtgattggaaacaactttttgttgataatttgaaggtggatgaaagtattgtgcccactgtccacaccggtggcctctggaaaggaggactgggtagctaaagaacaggggtaggttggagggagactttattatgcgtactgttgtgctgttttgaattctaatcaagtgaatttattacgtcctcacattgctatagtttatcctttatactataataaaggatttgatagggaaataataccttaatttgttcaaccttacaaatca

SEQ ID NO: 441058 - DNA, 430 bp, Homo sapiens
aagctgtataggaaagcactttgtaaaatagtaaagcaaatacaaataaatgttacctcacaattgttgaacagtatctcggcttcattaagtcgtatgcaagaagactttataaatgaagcactttccattctagcccatgatgatgccatttggtcagttgcttgggggacaaacaagaaggaaaactctgagacagtggtcacaggctccctagatgacctggtgaaggtctggaaatggtgagtgcctctcccctaacatacagccttggaaaattgggggctgaggttttgcttctgaactctccagttgcagtccgggaaatacttttttctaggcaagaaagcaatagcaatatggtggtataaaacagcagcttatttttcccacttgttttcctgttactctgtattaaagccctaaagtt

SEQ ID NO: 441059 - DNA, 2045 bp, Homo sapiens
  misc_feature (1554)..(1554): n is a, c, g, or t
  misc_feature (1558)..(1558): n is a, c, g, or t
  misc_feature (1560)..(1560): n is a, c, g, or t
gatttcactgaatttatttcagcaacagaagttattagctttagtccaatctcaaaagtacaaaatgaaattgcaacacaaacctctaaacctgcagttgccggaagctaaacgtctgcgcttccggaagcaaatttccaactaccactcctctggaagcaggacctggcttcctccctcctctctccgcccaccctcgtcggcgtctgccccgcgcccgccatagcgacggcaacgggcgctgcggagtgctccgagccgtgagggcggggccggcgcgatgccccgccccttcgatagctcatctttgcgcgtcgcagtcgcgcggagcccggcttccgacgtgcagcctggcagtgcagtgagctgtctggccttttgtccttgatccttggttaaggaaatgaccaaccagtacggtattctcttcaaacaagagcaagcccatgatgatgccatttggtcagttgcttgggggacaaacaagaaggaaaactctgagacagtggtcacaggctccctagatgacctggtgaaggtctggaaatggcgtgatgagaggctggacctacagtggagtctggagggacatcagctgggagtggtgtctgtggacatcagccacaccctgcccattgctgcatccagctctcttgatgctcatattcgtctttgggacttggaaaatggcaaacagataaagtccatagatgcaggacctgtggatgcctggactttggccttttctcctgattcccagtatctggccacaggaactcatgtcgggaaagtgaacatttttggtgtggaaagtgggaaaaaggaatattctttggacacgagaggaaaattcattcttagtattgcatatagtcctgatgggaaatacctagccagtggagccatagatggaatcatcaatatttttgatattgcaactggaaaacttctgcataccctggaaggccatgccatgcccattcgctccttgaccttttccccggactcccagctccttgtcactgcttcagatgatggctacatcaagatctatgatgtacaacatgccaatttggctggcacgctgagcggccatgcctcctgggtgctgaacgttgcattctgtcctgatgacactcactttgtttccagttcgtctgacaaaagtgtaaaagtttgggatgttggaacgaggacttgtgttcacaccttctttgatcaccaggatcaggtctggggagtaaaatacaatggaaatggttcaaaaattgtgtctgttggagatgaccaggaaattcacatctatgattgtccaatttaaacatcaaagtctccaggcttatgctgcaaagagaatgtacggattgatcatgacattccttaccttcttaggcttgtttaaaagaaatatagcatttattgtagcaaagacttaaattttgtagatacaatatgaatcttttcatgttttattggaaatgctgttcatactttaacataaagctttcttaatgcaaaaaaaaaaaaaaaaaaaaaaaaaaaaaaaaaaaacanacananaaaaaaaaaaaaaaaaaaaaaacaaagacaaaaaaaaaaaaaagacacagaaaacaggaacagagtaaggaaacaaatctaccctccccttaacagggaaactactcccaccctggaacctccgtagacctaaacatctactccttacacctagcaggtgtctcctctatcttaggggccatcaatttcatcacaacaattatcaatataaaaccccctgccataacccaataccaaagcccctcttcgtctgatccgtcctaatcacagcagtacctacttctcctaatctctcccagtcctagctgctggcatcactatactactaatagacggaagcttaagaccaccttcttcgaccccgccggagggaggagacacaattctattcaaatctattcaaatttttcggacaacccggaagttaatatgcttaatcaacagggttggaataactccctaggggattaaagaacggaaaggac

SEQ ID NO: 441060 - DNA, 1586 bp, Homo sapiens
gatttcactgaatttatttcagcaacagaagttattagctttagtccaatctcaaaagtacaaaatgaaattgcaacacaaacctctaaacctgcagttgccggaagctaaacgtctgcgcttccggaagcaaatttccaactaccactcctctggaagcaggacctggcttcctccctcctctctccgcccaccctcgtcggcgtctgccccgcgcccgccatagcgacggcaacgggcgctgcggagtgctccgagccgtgagggcggggccggcgcgatgccccgccccttcgatagctcatctttgcgcgtcgcagtcgcgcggagcccggcttccgacgtgcagcctggcagtgcagtggggaacttcctgtgtgccttctatcctgatgacaccccctcactgaaatcctggtgttgtttccacagagctgtctggccttttgtccttgatccttggttaaggaaatgaccaaccagtacggtattctcttcaaacaagagcaagcccatgatgatgccatttggtcagttgcttgggggacaaacaagaaggaaaactctgagacagtggtcacaggctccctagatgacctggtgaaggtctggaaatggcgtgatgagaggctggacctacagtggagtctggagggacatcagctgggagtggtgtctgtggacatcagccacaccctgcccattgctgcatccagctctcttgatgctcatattcgtctttgggacttggaaaatggcaaacagataaagtccatagatgcaggacctgtggatgcctggactttggccttttctcctgattcccagtatctggccacaggaactcatgtcgggaaagtgaacatttttggtgtggaaagtgggaaaaaggaatattctttggacacgagaggaaaattcattcttagtattgcatatagtcctgatgggaaatacctagccagtggagccatagatggaatcatcaatatttttgatattgcaactggaaaacttctgcataccctggaaggccatgccatgcccattcgctccttgaccttttccccggactcccagctccttgtcactgcttcagatgatggctacatcaagatctatgatgtacaacatgccaatttggctggcacgctgagcggccatgcctcctgggtgctgaacgttgcattctgtcctgatgacactcactttgtttccagttcgtctgacaaaagtgtaaaagtttgggatgttggaacgaggacttgtgttcacaccttctttgatcaccaggatcaggtctggggagtaaaatacaatggaaatggttcaaaaattgtgtctgttggagatgaccaggaaattcacatctatgattgtccaatttaaacatcaaagtctccaggcttatgctgcaaagagaatgtacggattgatcatgacattccttaccttcttaggcttgtttaaaagaaatatagcatttattgtagcaaagacttaaattttgtagatacaatatgaatcttttcatgttttattggaaatgctgttcatactttaacataaagctttcttaatgcaaa

SEQ ID NO: 441061 - DNA, 1421 bp, Homo sapiens
gatttcactgaatttatttcagcaacagaagttattagctttagtccaatctcaaaagtacaaaatgaaattgcaacacaaacctctaaacctgcagttgccggaagctaaacgtctgcgcttccggaagcaaatttccaactaccactcctctggaagcaggacctggcttcctccctcctctctccgcccaccctcgtcggcgtctgccccgcgcccgccatagcgacggcaacgggcgctgcggagtgctccgagccgtgagggcggggccggcgcgatgccccgccccttcgatagctcatctttgcgcgtcgcagtcgcgcggagcccggcttccgacgtgcagcctggcagtgcagtgagctgtctggccttttgtccttgatccttggttaaggaaatgaccaaccagtacggtattctcttcaaacaagagcaagcccatgatgatgccatttggtcagttgcttgggggacaaacaagaaggaaaactctgagacagtggtcacaggctccctagatgacctggtgaaggtctggaaatggcgtgatgagaggctggacctacagtggagtctggagggacatcagctgggagtggtgtctgtggacatcagccacaccctgcccattgctgcatccagctctcttgatgctcatattcgtctttgggacttggaaaatggcaaacagataaagtccatagatgcaggacctgtggatgcctggactttggccttttctcctgattcccagtatctggccacaggaactcatgtcgggaaagtgaacatttttggtgtggaaagtgggaaaaaggaatattctttggacacgagaggaaaattcattcttagtattgcatatagtcctgatgggaaatacctagccagtggagccatagatggaatcatcaatatttttgatattgcaactggaaaacttctgcataccctggaaggccatgccatgcccattcgctccttgaccttttccccggactcccagctccttgtcactgcttcagatgatggctacatcaagatctatgatgtacaacatgccaatttggctggcacgctgagcggccatgcctcctgggtgctgaacgttgcattctgtcctgatgacactcactttgtttccagttcgtctgacaaaagtgtaaaagtttgggatgttggaacgaggacttgtgttcacaccttctttgatcaccaggatcaggtctggggagtaaaatacaatggaaatggttcaaaaattgtgtctgttggagatgaccaggaaattcacatctatgattgtccaatttaaacatcaaagtctccaggcttatgctgcaaagatgtcggtggccggactcctactctggctgttaagaatgctttgggcaactattggaacaaggcttcgg

SEQ ID NO: 441062 - DNA, 1183 bp, Homo sapiens
  misc_feature (27)..(27): n is a, c, g, or t
  misc_feature (106)..(106): n is a, c, g, or t
gcaggtagaggccgggtgttaatcggncgagggagctgtctggctttgtccttgatcctggttaggaaatgaccaaccagtacggtattctcttcaaacaagagcnagcccatgatgatgccatttggtcagttgcttgggggacaaacaagaaggaaaactctgagacagtggtcacaggctccctagatgacctggtgaaggtctggaaatggcgtgatgagaggctggacctacagtggagtctggagggacatcagctgggagtggtgtctgtggacatcagccacaccctgcccattgctgcatccagctctcttgatgctcatattcgtctttgggacttggaaaatggcaaacagataaagtccatagatgcaggacctgtggatgcctggactttggccttttctcctgattcccagtatctggccacaggaactcatgtcgggaaagtgaacatttttggtgtggaaagtgggaaaaaggaatattctttggacacgagaggaaaattcattcttagtattgcatatagtcctgatgggaaatacctagccagtggagccatagatggaatcatcaatatttttgatattgcaactggaaaacttctgcataccctggaaggccatgccatgcccattcgctccttgaccttttccccggactcccagctccttgtcactgcttcagatgatggctacatcaagatctatgatgtacaacatgccaatttggctggcacgctgagcggccatgcctcctgggtgctgaacgttgcattctgtcctgatgacactcactttgtttccagttcgtctgacaaaagtgtaaaagtttgggatgttggaacgaggacttgtgttcacaccttctttgatcaccaggatcaggtctggggagtaaaatacaatggaaatggttcaaaaattgtgtctgttggagatgaccaggaaattcacatctatgattgtccaatttaaacatcaaagtctccaggcttatgctgcaaagagaatgtacggattgatcatgacattccttaccttcttaggcttgtttaaaagaaatatagcatttattgtagcaaagacttaaattttgtagatacaatatgaatcttttcatgttttattggaaatgctgttcatactttaacataaagctttcttaatgcaaa

SEQ ID NO: 441063 - DNA, 930 bp, Homo sapiens
gtaattaataaccatccaatttacaatctctatcggtgggtttctttttttatactaattccaatatgatggttgtaatagcacgcatgcgtcacctgagcataatccgctgatgattgacaagaagcataattcgcctgtggatctgacttgcttttctcctgattcccagtatctggccacaggaactcatgtcgggaaagtgaacatttttggtgtggaaagtgggaaaaaggaatattctttggacacgagaggaaaattcattcttagtattgcatatagtcctgatgggaaatacctagccagtggagccatagatggaatcatcaatatttttgatattgcaactggaaaacttctgcataccctggaaggccatgccatgcccattcgctccttgaccttttccccggactcccagctccttgtcactgcttcagatgatggctacatcaagatctatgatgtacaacatgccaatttggctggcacgctgagcggccatgcctcctgggtgctgaacgttgcattctgtcctgatgacactcactttgtttccagttcgtctgacaaaagtgtaaaagtttgggatgttggaacgaggacttgtgttcacaccttctttgatcaccaggatcaggtctggggagtaaaatacaatggaaatggttcaaaaattgtgtctgttggagatgaccaggaaattcacatctatgattgtccaatttaaacatcaaagtctccaggcttatgctgcaaagagaatgtacggattgatcatgacattccttaccttcttaggcttgtttaaaagaaatatagcatttattgtagcaaagacttaaattttgtagatacaatatgaatcttttcatgttttattggaaatgctgttcatactttaacataaagctttcttaatgcaaa

SEQ ID NO: 441064 - DNA, 631 bp, Homo sapiens
aagggcccgggtagatcctactgttgaaaatgaggaaacattcatgaacagagttgaagttaaagtaaagattcctgaatagctaaaaccgtggcttgttgatgactgggacttaattaccaggcaaaaacagctcttttatcttcctgccaagaagaatgtggattccattcttgaggattatgcaaattacaagaaatctcgtggaaacacagataataaggagtatgcggttaatgaagttgtggcagggataaaagaatacttcaacgtaatgttgggtacccagctactctataaatttgagagaccacagtatgccgaaattcttgcagatcatcccgatgcacccatgtcccaggtgtatggagcgccacatctcctgagattatttgtacgaattggagcaatgttggcctatacacctctggatgagaagagccttgctttattactcaattatcttcacgatttcctaaagtacctggcaaagaattctgcaactttgtttagtgccagcgattatgaagtggctcctcctgagtaccatcggaaagctgtgtgagaggcactctcacgcccgtatattcgtatattcctggttacacactgtgttgcccgtgatgtatat

SEQ ID NO: 441065 - DNA, 329 bp, Homo sapiens
tggcgcggaagcaggacccgaagcctaaattccaggagggtgagcgagtgcttgtgtaaaggttgccataaaggacaaacaagtgaaatacttcatacattacagtggttggaataaaaattgggatgaatgggttccggagagcagagtactcaaatacgtggacaccaatttgcagaaacagcgagaacttcaaaaagccaatcaggagcagtatgcagaggggaagatgagaggggctgccccaggaaagaagacatctggtctgcaacagaaaaatgttgaagtgaaaacgaaaaagaacaaacagaaaacacctggaaatggag

SEQ ID NO: 441066 - DNA, 1129 bp, Homo sapiens
aagggcccgggtagatcctactgttgaaaatgaggaaacattcatgaacagagttgaagttaaagtaaagattcctgaatagctaaaaccgtggcttgttgatgactgggacttaattaccaggcaaaaacagctcttttatcttcctgccaagaagaatgtggattccattcttgaggattatgcaaattacaagaaatctcgtggaaacacagataataaggagtatgcggttaatgttgggtacccagctactctataaatttgagagaccacagtatgccgaaattcttgcagatcatcccgatgcacccatgtcccaggtgtatggagcgccacatctcctgagattatttgtacgaattggagcaatgttggcctatacacctctggatgagaagagccttgctttattactcaattatcttcacgatttcctaaagtacctggcaaagaattctgcaactttgtttagtgccagcgattatgaagtggctcctcctgagtaccatcggaaagctgtgtgagaggcactctcactcacttatgtttggatctccgtaaacacatttttgttcttagtctatctcttgtacaaacaatgtgctttgaagatgttagtgtataacaattgatgtttgttttctgtttgattttaaacagagaaaataaaaggggtaatagctccttttttcttttctttttttttttcatttcaaagttgctgccagtgttttcaatgatggacaacagagggatatgctgtagagtgttttattgcctagttgacaaagctgcttttgaatgctggtggttctattcctttgacactacgctataaaacactctacaccatattaccctgcttagagttttcaatacaaagtggatcaaaactacatgctcagtcaacagtggactgcacagtgtgaattatgccaaataaatttaaaacgtagacacaggcacacacatggagctgcaaagggagttatgacatttacatttaggagtagtgggttgtgggttgtggctttggaatgacttggaaataattttggctggagagaaaaggttatattgtagagaactttgagagtcagcccgagattgaatttcctgcctatga

SEQ ID NO: 441067 - DNA, 1167 bp, Homo sapiens
aagggcccgggtagatcctactgttgaaaatgaggaaacattcatgaacagagttgaagttaaagtaaagattcctgaatagctaaaaccgtggcttgttgatgactgggacttaattaccaggcaaaaacagctcttttatcttcctgccaagaagaatgtggattccattcttgaggattatgcaaattacaagaaatctcgtggaaacacagataataaggagtatgcggttaatgaagttgtggcagggataaaagaatacttcaacgtaatgttgggtacccagctactctataaatttgagagaccacagtatgccgaaattcttgcagatcatcccgatgcacccatgtcccaggtgtatggagcgccacatctcctgagattatttgtacgaattggagcaatgttggcctatacacctctggatgagaagagccttgctttattactcaattatcttcacgatttcctaaagtacctggcaaagaattctgcaactttgtttagtgccagcgattatgaagtggctcctcctgagtaccatcggaaagctgtgtgagaggcactctcactcacttatgtttggatctccgtaaacacatttttgttcttagtctatctcttgtacaaacaatgtgctttgaagatgttagtgtataacaattgatgtttgttttctgtttgattttaaacagagaaaataaaaggggtaatagctccttttttcttttctttttttttttcatttcaaagttgctgccagtgttttcaatgatggacaacagagggatatgctgtagagtgttttattgcctagttgacaaagctgcttttgaatgctggtggttctattcctttgacactacgctataaaacactctacaccatattaccctgcttagagttttcaatacaaagtggatcaaaactacatgctcagtcaacagtggactgcacagtgtgaattatgccaaataaatttaaaacgtagacacaggcacacacatggagctgcaaagggagttatgacatttacatttaggagtagtgggttgtgggttgtggctttggaatgacttggaaataattttggctggagagaaaaggttatattgtagagaactttgagagtcagcccgagattgaatttcctgcctatga

SEQ ID NO: 441068 - DNA, 1132 bp, Homo sapiens
tggcgcggaagcaggacccgaagcctaaattccaggagggtgagcgagtgctgtgctttcatgggcctcttctttatgaagcaaagtgtgtaaaggttgccataaaggacaaacaagtgaaatacttcatacattacagtggttggaataaaaattgggatgaatgggttccggagagcagagtactcaaatacgtggacaccaatttgcagaaacagcgagaacttcaaaaagccaatcaggagcagtatgcagaggggaagatgagaggggctgccccaggaaagaagacatctggtctgcaacagaaaaatgttgaagtgaaaacgaaaaagaacaaacatctcctgagattatttgtacgaattggagcaatgttggcctatacacctctggatgagaagagccttgctttattactcaattatcttcacgatttcctaaagtacctggcaaagaattctgcaactttgtttagtgccagcgattatgaagtggctcctcctgagtaccatcggaaagctgtgtgagaggcactctcactcacttatgtttggatctccgtaaacacatttttgttcttagtctatctcttgtacaaacaatgtgctttgaagatgttagtgtataacaattgatgtttgttttctgtttgattttaaacagagaaaataaaaggggtaatagctccttttttcttttctttttttttttcatttcaaagttgctgccagtgttttcaatgatggacaacagagggatatgctgtagagtgttttattgcctagttgacaaagctgcttttgaatgctggtggttctattcctttgacactacgctataaaacactctacaccatattaccctgcttagagttttcaatacaaagtggatcaaaactacatgctcagtcaacagtggactgcacagtgtgaattatgccaaataaatttaaaacgtagacacaggcacacacatggagctgcaaagggagttatgacatttacatttaggagtagtgggttgtgggttgtggctttggaatgacttggaaataattttggctggagagaaaaggttatattgtagagaactttgagagtcagcccgagattgaatttcctgcctatga

SEQ ID NO: 441069 - DNA, 2743 bp, Homo sapiens
aaagaggctttctcaccagccaaagttcaggtactgcccctgtctgagtttggacatgtggcccacagatgccagctgggggctggaatactgtaccttgatcttagggcctggaaaaatcaggtaggtaactctctggtcctaggtggaggtgtaggggaggttgggccagggatgccttcactgtgtctctctggtcttgccaccccagaccgagggacacacaggcactgctgtctgcaacacaagcaatggacctgcggaggcgagactaccacatggaacggccgctgctgaaccaggagcatttggaggagctggggcgctggggctcagcacctaggacccaccagtggcggacctggttgcagtgctcccgtgctcgggcctatgcccttctgctccaacacctcccggttttggtctggttaccccggtatcctgtgcgtgactggctcctgggtgacctgttatccggcctgagtgtggccatcatgcagcttccgcagggcttggcctacgccctcctggctggattgccccccgtgtttggcctctatagctccttctaccctgtcttcatctacttcctgtttggcacttcccggcacatctccgtggggacctttgctgtcatgtctgtgatggtgggcagtgtgacagaatccctggccccgcaggccttgaacgactccatgatcaatgagacagccagagatgctgcccgggtacaggtggcctccacactcagtgtcctggttggcctcttccaggtggggctgggcctgatccacttcggcttcgtggtcacctacctgtcagaacctcttgtccgaggctataccacagctgcagctgtgcaggtcttcgtctcacagctcaagtatgtgtttggcctccatctgagcagccactctgggccactgtccctcatctatacagtgctggaggtctgctggaagctgccccagagcaaggttggcaccgtggtcactgcagctgtggctggggtggtgctcgtggtggtgaagctgttgaatgacaagctgcagcagcagctgcccatgccgatacccggggagctgctcacgctcatcggggccacaggcatctcctatggcatgggtctaaagcacagatttgaggtagatgtcgtgggcaacatccctgcagggctggtgcccccagtggcccccaacacccagctgttctcaaagctcgtgggcagcgccttcaccatcgctgtggttgggtttgccattgccatctcactggggaagatcttcgccctgaggcacggctaccgggtggacagcaaccaggagctggtggccctgggcctcagtaaccttatcggaggcatcttccagtgcttccccgtgagttgctctatgtctcggagcctggtacaggagagcaccgggggcaactcgcaggttgctggagccatctcttcccttttcatcctcctcatcattgtcaaacttggggaactcttccatgacctgcccaaggcggtcctggcagccatcatcattgtgaacctgaagggcatgctgaggcagctcagcgacatgcgctccctctggaaggccaatcgggcggatctgcttatctggctggtgaccttcacggccaccatcttgctgaacctggaccttggcttggtggttgcggtcatcttctccctgctgctcgtggtggtccggacacagatgccccactactctgtcctggggcaggtgccagacacggatatttacagagatgtggcagagtactcagaggccaaggaagtccggggggtgaaggtcttccgctcctcggccaccgtgtactttgccaatgctgagttctacagtgatgcgctgaagcagaggtgtggtgtggatgtcgacttcctcatctcccagaagaagaaactgctcaagaagcaggagcagctgaagctgaagcaactgcagaaagaggagaagcttcggaaacaggctgcctcccccaagggcgcctcagtttccattaatgtcaacaccagccttgaagacatgaggagcaacaacgttgaggactgcaagatgatgagcaggtgagctcaggagataagatggaagatgcaacagccaatggtcaagaagactccaaggccccagatgggtccacactgaaggccctgggcctgcctcagccagacttccacagcctcatcctggacctgggtgccctctcctttgtggacactgtgtgcctcaagagcctgaagaatattttccatgacttccgggagattgaggtggaggtgtacatggcggcctgccacagccctgtggtcagccagcttgaggctgggcacttcttcgatgcatccatcaccaagaagcatctctttgcctctgtccatgatgctgtcacctttgccctccaacacccgaggcctgtccccgacagccctgtttcggtcaccagactctgaacatgctacatcctgcccaagactgcacctctggaggtgcagggcacccttgagaagcccctcacccctaggccgcctccaggtgctacccaggagtcccctccatgtacacacacacaactcagggaaggaggtcctgggactccaagttcagcgctccaggtctgggacagggcctgcatgcagtcaggctggcagtggcgcggtacagggagggaactggtgcatattttagcctcaggaataaagatttgtctgctcaaaaaaaaaaaa

SEQ ID NO: 441070 - DNA, 2630 bp, Homo sapiens
cggcgccgccttccggagcgtagcggcctctagctcgagcagcaggagcagcccgcaccggacaacttgcgagccatggggctggcggatgcgtcgggaccgagggacacacaggcactgctgtctgcaacacaagcaatggacctgcggaggcgagactaccacatggaacggccgctgctgaaccaggagcatttggaggagctggggcgctggggctcagcacctaggacccaccagtggcggacctggttgcagtgctcccgtgctcgggcctatgcccttctgctccaacacctcccggttttggtctggttaccccggtatcctgtgcgtgactggctcctgggtgacctgttatccggcctgagtgtggccatcatgcagcttccgcagggcttggcctacgccctcctggctggattgccccccgtgtttggcctctatagctccttctaccctgtcttcatctacttcctgtttggcacttcccggcacatctccgtggggacctttgctgtcatgtctgtgatggtgggcagtgtgacagaatccctggccccgcaggccttgaacgactccatgatcaatgagacagccagagatgctgcccgggtacaggtggcctccacactcagtgtcctggttggcctcttccaggtggggctgggcctgatccacttcggcttcgtggtcacctacctgtcagaacctcttgtccgaggctataccacagctgcagctgtgcaggtcttcgtctcacagctcaagtatgtgtttggcctccatctgagcagccactctgggccactgtccctcatctatacagtgctggaggtctgctggaagctgccccagagcaaggttggcaccgtggtcactgcagctgtggctggggtggtgctcgtggtggtgaagctgttgaatgacaagctgcagcagcagctgcccatgccgatacccggggagctgctcacgctcatcggggccacaggcatctcctatggcatgggtctaaagcacagatttgaggtagatgtcgtgggcaacatccctgcagggctggtgcccccagtggcccccaacacccagctgttctcaaagctcgtgggcagcgccttcaccatcgctgtggttgggtttgccattgccatctcactggggaagatcttcgccctgaggcacggctaccgggtggacagcaaccaggagctggtggccctgggcctcagtaaccttatcggaggcatcttccagtgcttccccgtgagttgctctatgtctcggagcctggtacaggagagcaccgggggcaactcgcaggttgctggagccatctcttcccttttcatcctcctcatcattgtcaaacttggggaactcttccatgacctgcccaaggcggtcctggcagccatcatcattgtgaacctgaagggcatgctgaggcagctcagcgacatgcgctccctctggaaggccaatcgggcggatctgcttatctggctggtgaccttcacggccaccatcttgctgaacctggaccttggcttggtggttgcggtcatcttctccctgctgctcgtggtggtccggacacagatgccccactactctgtcctggggcaggtgccagacacggatatttacagagatgtggcagagtactcagaggccaaggaagtccggggggtgaaggtcttccgctcctcggccaccgtgtactttgccaatgctgagttctacagtgatgcgctgaagcagaggtgtggtgtggatgtcgacttcctcatctcccagaagaagaaactgctcaagaagcaggagcagctgaagctgaagcaactgcagaaagaggagaagcttcggaaacaggctgcctcccccaagggcgcctcagtttccattaatgtcaacaccagccttgaagacatgaggagcaacaacgttgaggactgcaagatgatgagcaggtgagctcaggagataagatggaagatgcaacagccaatggtcaagaagactccaaggccccagatgggtccacactgaaggccctgggcctgcctcagccagacttccacagcctcatcctggacctgggtgccctctcctttgtggacactgtgtgcctcaagagcctgaagaatattttccatgacttccgggagattgaggtggaggtgtacatggcggcctgccacagccctgtggtcagccagcttgaggctgggcacttcttcgatgcatccatcaccaagaagcatctctttgcctctgtccatgatgctgtcacctttgccctccaacacccgaggcctgtccccgacagccctgtttcggtcaccagactctgaacatgctacatcctgcccaagactgcacctctggaggtgcagggcacccttgagaagcccctcacccctaggccgcctccaggtgctacccaggagtcccctccatgtacacacacacaactcagggaaggaggtcctgggactccaagttcagcgctccaggtctgggacagggcctgcatgcagtcaggctggcagtggcgcggtacagggagggaactggtgcatattttagcctcaggaataaagatttgtctgctcaaaaaaaaaaaa

SEQ ID NO: 441071 - DNA, 400 bp, Homo sapiens
ccccagtgggcccagtgctttctccgctgtctttggataaagctgttctaggggcgggggttggtctgtgtcctttggaaactgactagagcctcccctcctctgcctgctcgtcaccagactctgaacatgctacatcctgcccaagactgcacctctggaggtgcagggcacccttgagaagcccctcacccctaggccgcctccaggtgctacccaggagtcccctccatgtacacacacacaactcagggaaggaggtcctgggactccaagttcagcgctccaggtctgggacagggcctgcatgcagtcaggctggcagtggcgcggtacagggagggaactggtgcatattttagcctcaggaataaagatttgtctgctcaaaaaaaaaaaa

SEQ ID NO: 441072 - DNA, 2601 bp, Homo sapiens
cggcgccgccttccggagcgtagcggcctctagctcgagcagcaggagcagcccgcaccggacaacttgcgagccatggggctggcggatgcgtcgggaccgagggacacacaggcactgctgtctgcaacacaagcaatggacctgcggaggcgagactaccacatggaacggccgctgctgaaccaggagcatttggaggagctggggcgctggggctcagcacctaggacccaccagtggcggacctggttgcagtgctcccgtgctcgggcctatgcccttctgctccaacacctcccggttttggtctggttaccccggtatcctgtgcgtgactggctcctgggtgacctgttatccggcctgagtgtggccatcatgcagcttccgcagggcttggcctacgccctcctggctggattgccccccgtgtttggcctctatagctccttctaccctgtcttcatctacttcctgtttggcacttcccggcacatctccgtggggacctttgctgtcatgtctgtgatggtgggcagtgtgacagaatccctggccccgcaggccttgaacgactccatgatcaatgagacagccagagatgctgcccgggtacaggtggcctccacactcagtgtcctggttggcctcttccaggtggggctgggcctgatccacttcggcttcgtggtcacctacctgtcagaacctcttgtccgaggctataccacagctgcagctgtgcaggtcttcgtctcacagctcaagtatgtgtttggcctccatctgagcagccactctgggccactgtccctcatctatacagtgctggaggtctgctggaagctgccccagagcaaggttggcaccgtggtcactgcagctgtggctggggtggtgctcgtggtggtgaagctgttgaatgacaagctgcagcagcagctgcccatgccgatacccggggagctgctcacgctcatcggggccacaggcatctcctatggcatgggtctaaagcacagatttgaggctggtgcccccagtggcccccaacacccagctgttctcaaagctcgtgggcagcgccttcaccatcgctgtggttgggtttgccattgccatctcactggggaagatcttcgccctgaggcacggctaccgggtggacagcaaccaggagctggtggccctgggcctcagtaaccttatcggaggcatcttccagtgcttccccgtgagttgctctatgtctcggagcctggtacaggagagcaccgggggcaactcgcaggttgctggagccatctcttcccttttcatcctcctcatcattgtcaaacttggggaactcttccatgacctgcccaaggcggtcctggcagccatcatcattgtgaacctgaagggcatgctgaggcagctcagcgacatgcgctccctctggaaggccaatcgggcggatctgcttatctggctggtgaccttcacggccaccatcttgctgaacctggaccttggcttggtggttgcggtcatcttctccctgctgctcgtggtggtccggacacagatgccccactactctgtcctggggcaggtgccagacacggatatttacagagatgtggcagagtactcagaggccaaggaagtccggggggtgaaggtcttccgctcctcggccaccgtgtactttgccaatgctgagttctacagtgatgcgctgaagcagaggtgtggtgtggatgtcgacttcctcatctcccagaagaagaaactgctcaagaagcaggagcagctgaagctgaagcaactgcagaaagaggagaagcttcggaaacaggctgcctcccccaagggcgcctcagtttccattaatgtcaacaccagccttgaagacatgaggagcaacaacgttgaggactgcaagatgatgagcaggtgagctcaggagataagatggaagatgcaacagccaatggtcaagaagactccaaggccccagatgggtccacactgaaggccctgggcctgcctcagccagacttccacagcctcatcctggacctgggtgccctctcctttgtggacactgtgtgcctcaagagcctgaagaatattttccatgacttccgggagattgaggtggaggtgtacatggcggcctgccacagccctgtggtcagccagcttgaggctgggcacttcttcgatgcatccatcaccaagaagcatctctttgcctctgtccatgatgctgtcacctttgccctccaacacccgaggcctgtccccgacagccctgtttcggtcaccagactctgaacatgctacatcctgcccaagactgcacctctggaggtgcagggcacccttgagaagcccctcacccctaggccgcctccaggtgctacccaggagtcccctccatgtacacacacacaactcagggaaggaggtcctgggactccaagttcagcgctccaggtctgggacagggcctgcatgcagtcaggctggcagtggcgcggtacagggagggaactggtgcatattttagcctcaggaataaagatttgtctgctcaaaaaaaaaaaa

SEQ ID NO: 441073 - DNA, 2567 bp, Homo sapiens
cggcgccgccttccggagcgtagcggcctctagctcgagcagcaggagcagcccgcaccggacaacttgcgagccatggggctggcggatgcgtcgggaccgagggacacacaggcactgctgtctgcaacacaagcaatggacctgcggaggcgagactaccacatggaacggccgctgctgaaccaggagcatttggaggagctggggcgctggggctcagcacctaggacccaccagtggcggacctggttgcagtgctcccgtgctcgggcctatgcccttctgctccaacacctcccggttttggtctggttaccccggtatcctgtgcgtgactggctcctgggtgacctgttatccggcctgagtgtggccatcatgcagcttccgcagggcttggcctacgccctcctggctggattgccccccgtgtttggcctctatagctccttctaccctgtcttcatctacttcctgtttggcacttcccggcacatctccgtggggacctttgctgtcatgtctgtgatggtgggcagtgtgacagaatccctggccccgcaggccttgaacgactccatgatcaatgagacagccagagatgctgcccgggtacaggtggcctccacactcagtgtcctggttggcctcttccaggtggggctgggcctgatccacttcggcttcgtggtcacctacctgtcagaacctcttgtccgaggctataccacagctgcagctgtgcaggtcttcgtctcacagctcaagtatgtgtttggcctccatctgagcagccactctgggccactgtccctcatctatacagtgctggaggtctgctggaagctgccccagagcaaggttggcaccgtggtcactgcagctgtggctggggtggtgctcgtggtggtgaagctgttgaatgacaagctgcagcagcagctgcccatgccgatacccggggagctgctcacgctcatcggggccacaggcatctcctatggcatgggtctaaagcacagatttgaggtagatgtcgtgggcaacatccctgcagggctggtgcccccagtggcccccaacacccagctgttctcaaagctcgtgggcagcgccttcaccatcgctgtggttgggtttgccattgccatctcactggggaagatcttcgccctgaggcacggctaccgggtggacagcaaccaggagctggtggccctgggcctcagtaaccttatcggaggcatcttccagtgcttccccgtgagttgctctatgtctcggagcctggtacaggagagcaccgggggcaactcgcaggttgctggagccatctcttcccttttcatcctcctcatcattgtcaaacttggggaactcttccatgacctgcccaaggcggtcctggcagccatcatcattgtgaacctgaagggcatgctgaggcagctcagcgacatgcgctccctctggaaggccaatcgggcggatctgcttatctggctggtgaccttcacggccaccatcttgctgaacctggaccttggcttggtggttgcggtcatcttctccctgctgctcgtggtggtccggacacagatgccccactactctgtcctggggcaggtgccagacacggatatttacagagatgtggcagagtactcagaggccaaggaagtccggggggtgaaggtcttccgctcctcggccaccgtgtactttgccaatgctgagttctacagtgatgcgctgaagcagaggtgtggtgtggatgtcgacttcctcatctcccagaagaagaaactggctgcctcccccaagggcgcctcagtttccattaatgtcaacaccagccttgaagacatgaggagcaacaacgttgaggactgcaagatgatgagcaggtgagctcaggagataagatggaagatgcaacagccaatggtcaagaagactccaaggccccagatgggtccacactgaaggccctgggcctgcctcagccagacttccacagcctcatcctggacctgggtgccctctcctttgtggacactgtgtgcctcaagagcctgaagaatattttccatgacttccgggagattgaggtggaggtgtacatggcggcctgccacagccctgtggtcagccagcttgaggctgggcacttcttcgatgcatccatcaccaagaagcatctctttgcctctgtccatgatgctgtcacctttgccctccaacacccgaggcctgtccccgacagccctgtttcggtcaccagactctgaacatgctacatcctgcccaagactgcacctctggaggtgcagggcacccttgagaagcccctcacccctaggccgcctccaggtgctacccaggagtcccctccatgtacacacacacaactcagggaaggaggtcctgggactccaagttcagcgctccaggtctgggacagggcctgcatgcagtcaggctggcagtggcgcggtacagggagggaactggtgcatattttagcctcaggaataaagatttgtctgctcaaaaaaaaaaaa

SEQ ID NO: 441074 - DNA, 1797 bp, Homo sapiens
tgacagcatctccccatagccgaaatggtgttgcctgtctctcaccctacgtgactttttcccaccctcgaagaaggttttgcccagtatctccctcctcacctcacagtggtttatgtgtccccctgaccatggtgccagcacctgcctccctgactctgtcctctcccacagctcatcggggccacaggcatctcctatggcatgggtctaaagcacagatttgaggctggtgcccccagtggcccccaacacccagctgttctcaaagctcgtgggcagcgccttcaccatcgctgtggttgggtttgccattgccatctcactggggaagatcttcgccctgaggcacggctaccgggtggacagcaaccaggagctggtggccctgggcctcagtaaccttatcggaggcatcttccagtgcttccccgtgagttgctctatgtctcggagcctggtacaggagagcaccgggggcaactcgcaggttgctggagccatctcttcccttttcatcctcctcatcattgtcaaacttggggaactcttccatgacctgcccaaggcggtcctggcagccatcatcattgtgaacctgaagggcatgctgaggcagctcagcgacatgcgctccctctggaaggccaatcgggcggatctgcttatctggctggtgaccttcacggccaccatcttgctgaacctggaccttggcttggtggttgcggtcatcttctccctgctgctcgtggtggtccggacacagatgccccactactctgtcctggggcaggtgccagacacggatatttacagagatgtggcagagtactcagaggccaaggaagtccggggggtgaaggtcttccgctcctcggccaccgtgtactttgccaatgctgagttctacagtgatgcgctgaagcagaggtgtggtgtggatgtcgacttcctcatctcccagaagaagaaactgctcaagaagcaggagcagctgaagctgaagcaactgcagaaagaggagaagcttcggaaacaggctgcctcccccaagggcgcctcagtttccattaatgtcaacaccagccttgaagacatgaggagcaacaacgttgaggactgcaagatgatgagcaggtgagctcaggagataagatggaagatgcaacagccaatggtcaagaagactccaaggccccagatgggtccacactgaaggccctgggcctgcctcagccagacttccacagcctcatcctggacctgggtgccctctcctttgtggacactgtgtgcctcaagagcctgaagaatattttccatgacttccgggagattgaggtggaggtgtacatggcggcctgccacagccctgtggtcagccagcttgaggctgggcacttcttcgatgcatccatcaccaagaagcatctctttgcctctgtccatgatgctgtcacctttgccctccaacacccgaggcctgtccccgacagccctgtttcggtcaccagactctgaacatgctacatcctgcccaagactgcacctctggaggtgcagggcacccttgagaagcccctcacccctaggccgcctccaggtgctacccaggagtcccctccatgtacacacacacaactcagggaaggaggtcctgggactccaagttcagcgctccaggtctgggacagggcctgcatgcagtcaggctggcagtggcgcggtacagggagggaactggtgcatattttagcctcaggaataaagatttgtctgctcaaaaaaaaaaaa

SEQ ID NO: 441075 - DNA, 2452 bp, Homo sapiens
cggcgccgccttccggagcgtagcggcctctagctcgagcagcaggagcagcccgcaccggacaacttgcgagccatggggctggcggatgcgtcgggaccgagggacacacaggcactgctgtctgcaacacaagcaatggacctgcggaggcgagactaccacatggaacggccgctgctgaaccaggagcatttggaggagctggggcgctggggctcagcacctaggacccaccagtggcggacctggttgcagtgctcccgtgctcgggcctatgcccttctgctccaacacctcccggttttggtctggttaccccggtatcctgtgcgtgactggctcctgggtgacctgttatccggcctgagtgtggccatcatgcagcttccgcagggcttggcctacgccctcctggctggattgccccccgtgtttggcctctatagctccttctaccctgtcttcatctacttcctgtttggcacttcccggcacatctccgtggggacctttgctgtcatgtctgtgatggtgggcagtgtgacagaatccctggccccgcaggccttgaacgactccatgatcaatgagacagccagagatgctgcccgggtacaggtggcctccacactcagtgtcctggttggcctcttccaggtggggctgggcctgatccacttcggcttcgtggtcacctacctgtcagaacctcttgtccgaggctataccacagctgcagctgtgcaggtcttcgtctcacagctcaagtatgtgtttggcctccatctgagcagccactctgggccactgtccctcatctatacagtgctggaggtctgctggaagctgccccagagcaaggttggcaccgtggtcactgcagctgtggctggggtggtgctcgtggtggtgaagctgttgaatgacaagctgcagcagcagctgcccatgccgatacccggggagctgctcacgctcatcggggccacaggcatctcctatggcatgggtctaaagcacagatttgaggtagatgtcgtgggcaacatccctgcagggctggtgcccccagtggcccccaacacccagctgttctcaaagctcgtgggcagcgccttcaccatcgctgtggttgggtttgccattgccatctcactggggaagatcttcgccctgaggcacggctaccgggtggacagcaaccaggagctggtggccctgggcctcagtaaccttatcggaggcatcttccagtgcttccccgtgagttgctctatgtctcggagcctggtacaggagagcaccgggggcaactcgcaggttgctggagccatctcttcccttttcatcctcctcatcattgtcaaacttggggaactcttccatgacctgcccaaggcggtcctggcagccatcatcattgtgaacctgaagggcatgctgaggcagctcagcgacatgcgctccctctggaaggccaatcgggcggatctgcttatctggctggtgaccttcacggccaccatcttgctgaacctggaccttggcttggtggttgcggtcatcttctccctgctgctcgtggtggtccggacacagatgccccactactctgtcctggggcaggtgccagacacggatatttacagagatgtggcagagtactcagaggccaaggaagtccggggggtgaaggtcttccgctcctcggccaccgtgtactttgccaatgctgagttctacagtgatgcgctgaagcagaggtgtggtgtggatgtcgacttcctcatctcccagaagaagaaactgctcaagaagcaggagcagctgaagctgaagcaactgcagaaagaggagaagcttcggaaacaggctgcctcccccaagggcgcctcagtttccattaatgtcaacaccagccttgaagacatgaggagcaacaacgttgaggactgcaagatgatgagcaggtgagctcaggagataagatggaagatgcaacagccaatggtcaagaagactccaaggccccagatgggtccacactgaaggccctgggcctgcctcagccagacttccacagcctcatcctggacctgggtgccctctcctttgtggacactgtgtgcctcaagagcctgaagaatattttccatgacttccgggagattgaggtggaggtgtacatggcggcctgccacagccctgtggtcagccagcttgaggctgggcacttcttcgatgcatccatcaccaagaagcatctctttgcctctctccatgtacacacacacaactcagggaaggaggtcctgggactccaagttcagcgctccaggtctgggacagggcctgcatgcagtcaggctggcagtggcgcggtacagggagggaactggtgcatattttagcctcaggaataaagatttgtctgctcaaaaaaaaaaaa

SEQ ID NO: 441076 - DNA, 2094 bp, Homo sapiens
cggcgccgccttccggagcgtagcggcctctagctcgagcagcaggagcagcccgcaccggacaacttgcgagccatggggctggcggatgcgtcgggaccgagggacacacaggcactgctgtctgcaacacaagcaatggacctgcggaggcgagactaccacatggaacggccgctgctgaaccaggagcatttggaggagctggggcgctggggctcagcacctaggacccaccagtggcggacctggttgcagtgctcccgtgctcgggcctatgcccttctgctccaacacctcccggttttggtctggttaccccggtatcctgtgcgtgactggctcctgggtgacctgttatccggcctgagtgtggccatcatgcagcttccgcagggcttggcctacgccctcctggctggattgccccccgtgtttggcctctatagctccttctaccctgtcttcatctacttcctgtttggcacttcccggcacatctccgtggggacctttgctgtcatgtctgtgatggtgggcagtgtgacagaatccctggccccgcaggccttgaacgactccatgatcaatgagacagccagagatgctgcccgggtacaggtggcctccacactcagtgtcctggttggcctcttccaggtggggctgggcctgatccacttcggcttcgtggtcacctacctgtcagaacctcttgtccgaggctataccacagctgcagctgtgcaggtcttcgtctcacagctcaagtatgtgtttggcctccatctgagcagccactctgggccactgtccctcatctatacagtgctggaggtctgctggaagctgccccagagcaaggttggcaccgtggtcactgcagctgtggctggggtggtgctcgtggtggtgaagctgttgaatgacaagctgcagcagcagctgcccatgccgatacccggggagctgctcacgctcatcggggccacaggcatctcctatggcatgggtctaaagcacagatttgaggtagatgtcgtgggcaacatccctgcagggctggtgcccccagtggcccccaacacccagctgttctcaaagctcgtgggcagcgccttcaccatcgctgtggttgggtttgccattgccatctcactggggaagatcttcgccctgaggcacggctaccgggtggacagcaaccaggagctggtggccctgggcctcagtaaccttatcggaggcatcttccagtgcttccccgtgagttgctctatgtctcggagcctggtacaggagagcaccgggggcaactcgcaggttgctggagccatctcttcccttttcatcctcctcatcattgtcaaacttggggaactcttccatgacctgcccaaggcggtcctggcagccatcatcattgtgaacctgaagggcatgctgaggcagctcagcgacatgcgctccctctggaaggccaatcgggcggatctgcttatctggctggtgaccttcacggccaccatcttgctgaacctggaccttggcttggtggttgcggtcatcttctccctgctgctcgtggtggtccggacacagatgccccactactctgtcctggggcaggtgccagacacggatatttacagagatgtggcagagtactcagaggccaaggaagtccggggggtgaaggtcttccgctcctcggccaccgtgtactttgccaatgctgagttctacagtgatgcgctgaagcagaggtgtggtgtggatgtcgacttcctcatctcccagaagaagaaactgctcaagaagcaggagcagctgaagctgaagcaactgcagaaagaggagaagcttcggaaacaggctgcctcccccaagggcgcctcagtttccattaatgtcaacaccagccttgaagacatgaggagcaacaacgttgaggactgcaagatgatggtgagactggaggtgggaaaggaggtgacagctgtgagctgcagagatgcaggatccacatgtctcatgaggaatgccatggacccagcagctgtgggctcgagggtgttgcgccgatggcaggag

SEQ ID NO: 441077 - DNA, 658 bp, Homo sapiens
cactagggaaggaaaggcaggagaacaggatgcagccaggagagaggagattcagccaccaccagttctgcctcatccccaggccaaggaagtccggggggtgaaggtcttccgctcctcggccaccgtgtactttgccaatgctgagttctacagtgatgcgctgaagcagagggtgagacggagtccccaggatgggtgtcaggccccagctcccagagagctcaccaacccttctctgatgtttgcctccagtgtggtgtggatgtcgacttcctcatctcccagaagaagaaactgctcaagaagcaggagcagctgaagctgaagcaactgcagaaagaggagaagcttcggaaacaggcagggccccttttgtctggtgacccccatctcctgccccctgttccctgccccagcctttctcctggcccccgactcctccctcgtcctcactcctcatcccttcccctttctccctcatgctcccagggaccctgcttcactcccctagcaggtccgggctctaggcagcattttctctcccatcatctgaaccagtgacagtgagaaccgtcacagtcctcttccctttcacggctgttccaggagcttcagcctggctgctgcaggtcccacagcttctggtcctggccca

SEQ ID NO: 441078 - DNA, 1171 bp, Homo sapiens
ggagctcggggctgcagtgcgctctaatggtgcctgtgaataaccactgcattcagcctgggcaatgaagcgagaccccgtctctaaaaaaaaaattgaggggtcaaagaggatgccaaacttaattagagactgagacagggcagggtgccgaggtgtctgcatgcgtttcatgtggatgcccgtgtctattctggcctgctcctgggccccctccccactcagccctggctgatgagaatgggacagggactcccttctcgtgtccctgtgcagcgtcggcccaggaggtagcagagcagtatatgcacatctgggtgtgccctcctgcatgtccccacacatctgtcattcctgtctttgcacacctatgtgactcccgcatgtttgtgtccttatgtgtcccatgcatgctccccatctgaccttgcgtgttctcgcgtgtctgtgtgcggccagtcctgccttcactctctcatgggtggccctggcagcatgtctggctccccagcaggtgagctcaggagataagatggaagatgcaacagccaatggtcaagaagactccaaggccccagatgggtccacactgaaggccctgggcctgcctcagccagacttccacagcctcatcctggacctgggtgccctctcctttgtggacactgtgtgcctcaagagcctgaagaatattttccatgacttccgggagattgaggtggaggtgtacatggcggcctgccacagccctgtggtcagccagcttgaggctgggcacttcttcgatgcatccatcaccaagaagcatctctttgcctctgtccatgatgctgtcacctttgccctccaacacccgaggcctgtccccgacagccctgtttcggtcaccagactctgaacatgctacatcctgcccaagactgcacctctggaggtgcagggcacccttgagaagcccctcacccctaggccgcctccaggtgctacccaggagtcccctccatgtacacacacacaactcagggaaggaggtcctgggactccaagttcagcgctccaggtctgggacagggcctgcatgcagtcaggctggcagtggcgcggtacagggagggaactggtgcatattttagcctcaggaataaagatttgtctgctcaaaaaaaaaaaa

SEQ ID NO: 441079 - DNA, 2556 bp, Homo sapiens
cggcgccgccttccggagcgtagcggcctctagctcgagcagcaggagcagcccgcaccggacaacttgcgagccatggggctggcggatgcgtcgggaccgagggacacacaggcactgctgtctgcaacacaagcaatggacctgcggaggcgagactaccacatggaacggccgctgctgaaccaggagcatttggaggagctggggcgctggggctcagcacctaggacccaccagtggcggacctggttgcagtgctcccgtgctcgggcctatgcccttctgctccaacacctcccggttttggtctggttaccccggtatcctgtgcgtgactggctcctgggtgacctgttatccggcctgagtgtggccatcatgcagcttccgcagggcttggcctacgccctcctggctggattgccccccgtgtttggcctctatagctccttctaccctgtcttcatctacttcctgtttggcacttcccggcacatctccgtggggacctttgctgtcatgtctgtgatggtgggcagtgtgacagaatccctggccccgcaggccttgaacgactccatgatcaatgagacagccagagatgctgcccgggtacaggtggcctccacactcagtgtcctggttggcctcttccaggtggggctgggcctgatccacttcggcttcgtggtcacctacctgtcagaacctcttgtccgaggctataccacagctgcagctgtgcaggtcttcgtctcacagctcaagtatgtgtttggcctccatctgagcagccactctgggccactgtccctcatctatacagtgctggaggtctgctggaagctgccccagagcaaggttggcaccgtggtcactgcagctgtggctggggtggtgctcgtggtggtgaagctgttgaatgacaagctgcagcagcagctgcccatgccgatacccggggagctgctcacgctcatcggggccacaggcatctcctatggcatgggtctaaagcacagatttgaggtagatgtcgtgggcaacatccctgcagggctggtgcccccagtggcccccaacacccagctgttctcaaagctcgtgggcagcgccttcaccatcgctgtggttgggtttgccattgccatctcactggggaagatcttcgccctgaggcacggctaccgggtggacagcaaccaggagctggtggccctgggcctcagtaaccttatcggaggcatcttccagtgcttccccgtgagttgctctatgtctcggagcctggtacaggagagcaccgggggcaactcgcaggttgctggagccatctcttcccttttcatcctcctcatcattgtcaaacttggggaactcttccatgacctgcccaaggcggtcctggcagccatcatcattgtgaacctgaagggcatgctgaggcagctcagcgacatgcgctccctctggaaggccaatcgggcggatctgcttatctggctggtgaccttcacggccaccatcttgctgaacctggaccttggcttggtggttgcggtcatcttctccctgctgctcgtggtggtccggacacagatgccccactactctgtcctggggcaggtgccagacacggatatttacagagatgtggcagagtactcagaggccaaggaagtccggggggtgaaggtcttccgctcctcggccaccgtgtactttgccaatgctgagttctacagtgatgcgctgaagcagaggtgtggtgtggatgtcgacttcctcatctcccagaagaagaaactgctcaagaagcaggagcagctgaagctgaagcaactgcagaaagaggagaagcttcggaaacaggcagggccccttttgtctgagcaggtgagctcaggagataagatggaagatgcaacagccaatggtcaagaagactccaaggccccagatgggtccacactgaaggccctgggcctgcctcagccagacttccacagcctcatcctggacctgggtgccctctcctttgtggacactgtgtgcctcaagagcctgaagaatattttccatgacttccgggagattgaggtggaggtgtacatggcggcctgccacagccctgtggtcagccagcttgaggctgggcacttcttcgatgcatccatcaccaagaagcatctctttgcctctgtccatgatgctgtcacctttgccctccaacacccgaggcctgtccccgacagccctgtttcggtcaccagactctgaacatgctacatcctgcccaagactgcacctctggaggtgcagggcacccttgagaagcccctcacccctaggccgcctccaggtgctacccaggagtcccctccatgtacacacacacaactcagggaaggaggtcctgggactccaagttcagcgctccaggtctgggacagggcctgcatgcagtcaggctggcagtggcgcggtacagggagggaactggtgcatattttagcctcaggaataaagatttgtctgctcaaaaaaaaaaaa

SEQ ID NO: 441080 - DNA, 2761 bp, Homo sapiens
cggcgccgccttccggagcgtagcggcctctagctcgagcagcaggagcagcccgcaccggacaacttgcgagccatggggctggcggatgcgtcgggaccgagggacacacaggcactgctgtctgcaacacaagcaatggacctgcggaggcgagactaccacatggaacggccgctgctgaaccaggagcatttggaggagctggggcgctggggctcagcacctaggacccaccagtggcggacctggttgcagtgctcccgtgctcgggcctatgcccttctgctccaacacctcccggttttggtctggttaccccggtatcctgtgcgtgactggctcctgggtgacctgttatccggcctgagtgtggccatcatgcagcttccgcagggcttggcctacgccctcctggctggattgccccccgtgtttggcctctatagctccttctaccctgtcttcatctacttcctgtttggcacttcccggcacatctccgtggggacctttgctgtcatgtctgtgatggtgggcagtgtgacagaatccctggccccgcaggccttgaacgactccatgatcaatgagacagccagagatgctgcccgggtacaggtggcctccacactcagtgtcctggttggcctcttccaggtggggctgggcctgatccacttcggcttcgtggtcacctacctgtcagaacctcttgtccgaggctataccacagctgcagctgtgcaggtcttcgtctcacagctcaagtatgtgtttggcctccatctgagcagccactctgggccactgtccctcatctatacagtgctggaggtctgctggaagctgccccagagcaaggttggcaccgtggtcactgcagctgtggctggggtggtgctcgtggtggtgaagctgttgaatgacaagctgcagcagcagctgcccatgccgatacccggggagctgctcacgctcatcggggccacaggcatctcctatggcatgggtctaaagcacagatttgaggctggtgcccccagtggcccccaacacccagctgttctcaaagctcgtgggcagcgccttcaccatcgctgtggttgggtttgccattgccatctcactggggaagatcttcgccctgaggcacggctaccgggtggacagcaaccaggagctggtggccctgggcctcagtaaccttatcggaggcatcttccagtgcttccccgtgagttgctctatgtctcggagcctggtacaggagagcaccgggggcaactcgcaggttgctggagccatctcttcccttttcatcctcctcatcattgtcaaacttggggaactcttccatgacctgcccaaggcggtcctggcagccatcatcattgtgaacctgaagggcatgctgaggcagctcagcgacatgcgctccctctggaaggccaatcgggcggatctgcttatctggctggtgaccttcacggccaccatcttgctgaacctggaccttggcttggtggttgcggtcatcttctccctgctgctcgtggtggtccggacacagatgtgagtccgccatgttggtcccctcattccagctagtgagagagtaccacagggctccccgcagctttccccacatctctggggacttcaggctccttcggacccctctgttatcccctttttctgccccctcttcgtgcattctctctctccttcacaggccccactactctgtcctggggcaggtgccagacacggatatttacagagatgtggcagagtactcagaggccaaggaagtccggggggtgaaggtcttccgctcctcggccaccgtgtactttgccaatgctgagttctacagtgatgcgctgaagcagaggtgtggtgtggatgtcgacttcctcatctcccagaagaagaaactgctcaagaagcaggagcagctgaagctgaagcaactgcagaaagaggagaagcttcggaaacaggctgcctcccccaagggcgcctcagtttccattaatgtcaacaccagccttgaagacatgaggagcaacaacgttgaggactgcaagatgatgagcaggtgagctcaggagataagatggaagatgcaacagccaatggtcaagaagactccaaggccccagatgggtccacactgaaggccctgggcctgcctcagccagacttccacagcctcatcctggacctgggtgccctctcctttgtggacactgtgtgcctcaagagcctgaagaatattttccatgacttccgggagattgaggtggaggtgtacatggcggcctgccacagccctgtggtcagccagcttgaggctgggcacttcttcgatgcatccatcaccaagaagcatctctttgcctctgtccatgatgctgtcacctttgccctccaacacccgaggcctgtccccgacagccctgtttcggtcaccagactctgaacatgctacatcctgcccaagactgcacctctggaggtgcagggcacccttgagaagcccctcacccctaggccgcctccaggtgctacccaggagtcccctccatgtacacacacacaactcagggaaggaggtcctgggactccaagttcagcgctccaggtctgggacagggcctgcatgcagtcaggctggcagtggcgcggtacagggagggaactggtgcatattttagcctcaggaataaagatttgtctgctcaaaaaaaaaaaa

SEQ ID NO: 441081 - DNA, 1265 bp, Homo sapiens
cgaagtatcttggggaactcttccatgacctgcccagcggtcctggcagccatcatcattgtgaacctgaagggcatgctgaggcagctcagcgacatgcgctccctctggaaggccaatcgggcggatctgcttatctggctggtgaccttcacggccaccatcttgctgaacctggaccttggcttggtggttgcggtcatcttctccctgctgctcgtggtggtccggacacagatgccccactactctgtcctggggcaggtgccagacacggatatttacagagatgtggcagagtactcagaggccaaggaagtccggggggtgaaggtcttccgctcctcggccaccgtgtactttgccaatgctgagttctacagtgatgcgctgaagcagaggtgtggtgtggatgtcgacttcctcatctcccagaagaagaaactgctcaagaagcaggagcagctgaagctgaagcaactgcagaaagaggagaagcttcggaaacaggctgcctcccccaagggcgcctcagtttccattaatgtcaacaccagccttgaagacatgaggagcaacaacgttgaggactgcaagatgatgagcaggtgagctcaggagataagatggaagatgcaacagccaatggtcaagaagactccaaggccccagatgggtccacactgaaggccctgggcctgcctcagccagacttccacagcctcatcctggacctgggtgccctctcctttgtggacactgtgtgcctcaagagcctgaagaatattttccatgacttccgggagattgaggtggaggtgtacatggcggcctgccacagccctgtggtcagccagcttgaggctgggcacttcttcgatgcatccatcaccaagaagcatctctttgcctctgtccatgatgctgtcacctttgccctccaacacccgaggcctgtccccgacagccctgtttcggtcaccagactctgaacatgctacatcctgcccaagactgcacctctggaggtgcagggcacccttgagaagcccctcacccctaggccgcctccaggtgctacccaggagtcccctccatgtacacacacacaactcagggaaggaggtcctgggactccaagttcagcgctccaggtctgggacagggcctgcatgcagtcaggctggcagtggcgcggtacagggagggaactggtgcatattttagcctcaggaataaagatttgtctgctcaaaaaaaaaaaa

SEQ ID NO: 441082 - DNA, 2613 bp, Homo sapiens
  misc_feature (2377)..(2377): n is a, c, g, or t
  misc_feature (2427)..(2427): n is a, c, g, or t
  misc_feature (2443)..(2443): n is a, c, g, or t
  misc_feature (2445)..(2445): n is a, c, g, or t
  misc_feature (2480)..(2480): n is a, c, g, or t
  misc_feature (2509)..(2509): n is a, c, g, or t
cggcgccgccttccggagcgtagcggcctctagctcgagcagcaggagcagcccgcaccggacaacttgcgagccatggggctggcggatgcgtcgggaccgagggacacacaggcactgctgtctgcaacacaagcaatggacctgcggaggcgagactaccacatggaacggccgctgctgaaccaggagcatttggaggagctggggcgctggggctcagcacctaggacccaccagtggcggacctggttgcagtgctcccgtgctcgggcctatgcccttctgctccaacacctcccggttttggtctggttaccccggtatcctgtgcgtgactggctcctgggtgacctgttatccggcctgagtgtggccatcatgcagcttccgcagggcttggcctacgccctcctggctggattgccccccgtgtttggcctctatagctccttctaccctgtcttcatctacttcctgtttggcacttcccggcacatctccgtggggacctttgctgtcatgtctgtgatggtgggcagtgtgacagaatccctggccccgcaggccttgaacgactccatgatcaatgagacagccagagatgctgcccgggtacaggtggcctccacactcagtgtcctggttggcctcttccaggtggggctgggcctgatccacttcggcttcgtggtcacctacctgtcagaacctcttgtccgaggctataccacagctgcagctgtgcaggtcttcgtctcacagctcaagtatgtgtttggcctccatctgagcagccactctgggccactgtccctcatctatacagtgctggaggtctgctggaagctgccccagagcaaggttggcaccgtggtcactgcagctgtggctggggtggtgctcgtggtggtgaagctgttgaatgacaagctgcagcagcagctgcccatgccgatacccggggagctgctcacgctcatcggggccacaggcatctcctatggcatgggtctaaagcacagatttgaggtagatgtcgtgggcaacatccctgcagggctggtgcccccagtggcccccaacacccagctgttctcaaagctcgtgggcagcgccttcaccatcgctgtggttgggtttgccattgccatctcactggggaagatcttcgccctgaggcacggctaccgggtggacagcaaccaggagctggtggccctgggcctcagtaaccttatcggaggcatcttccagtgcttccccgtgagttgctctatgtctcggagcctggtacaggagagcaccgggggcaactcgcaggttgctggagccatctcttcccttttcatcctcctcatcattgtcaaacttggggaactcttccatgacctgcccaaggcggtcctggcagccatcatcattgtgaacctgaagggcatgctgaggcagctcagcgacatgcgctccctctggaaggccaatcgggcggatctgcttatctggctggtgaccttcacggccaccatcttgctgaacctggaccttggcttggtggttgcggtcatcttctccctgctgctcgtggtggtccggacacagatgccccactactctgtcctggggcaggtgccagacacggatatttacagagatgtggcagagtactcagaggccaaggaagtccggggggtgaaggtcttccgctcctcggccaccgtgtactttgccaatgctgagttctacagtgatgcgctgaagcagaggtgtggtgtggatgtcgacttcctcatctcccagaagaagaaactgctcaagaagcaggagcagctgaagctgaagcaactgcagaaagaggagaagcttcggaaacaggctgcctcccccaagggcgcctcagtttccattaatgtcaacaccagccttgaagacatgaggagcaacaacgttgaggactgcaagatgatgagcaggtgagctcaggagataagatggaagatgcaacagccaatggtcaagaagactccaaggccccagatgggtccacactgaaggccctgggcctgcctcagccagacttccacagcctcatcctggacctgggtgccctctcctttgtggacactgtgtgcctcaagagcctgaagaatattttccatgacttccgggagattgaggtggaggtgtacatggcggcctgccacagccctgtggtcagccagcttgaggctgggcacttcttcgatgcatccatcaccaagaagcatctctttgcctctgtccatgatgctgtcacctttgccctccaacacccgaggcctgtcatggcagccgggctagctgtttgccattccctgtcttccctggtgtaggctgnctcccccaagggcgcctcagtttccattaatgtcaacaccagccttgaanacatgaggagcaacancnttgaggactgcaagatgatggtgagactggaggtnggaaaggaggtgacagctgtgagctgcanagatgcatgatccacatgtctgatgaggaatagcatggacccatctgctgggggctcgaaggtgttgcgcctatagcaggaggagtggaggaggctggctcatc

SEQ ID NO: 441083 - DNA, 796 bp, Homo sapiens
cggcgccgccttccggagcgtagcggcctctagctcgagcagcaggagcagcccgcaccggacaacttgcgagccatggggctggcggatgcgtcgggaccgagggacacacaggcactgctgtctgcaacacaagcaatggacctgcggaggcgagactaccacatggaacggccgctgctgaaccaggagcatttggaggagctggggcgctggggctcagcacctaggacccaccagtggcggacctggttgcagtgctcccgtgctcgggcctatgcccttctgctccaacacctcccggttttggtctggttaccccggtatcctgtgcgtgactggctcctgggtgacctgttatccggcctgagtgtggccatcatgcagcttccgcagggcttggcctacgccctcctggctggattgccccccgtgtttggcctctatagctccttctaccctgtcttcatctacttcctgtttggcacttcccggcacatctccgtgggtcaccagactctgaacatgctacatcctgcccaagactgcacctctggaggtgcagggcacccttgagaagcccctcacccctaggccgcctccaggtgctacccaggagtcccctccatgtacacacacacaactcagggaaggaggtcctgggactccaagttcagcgctccaggtctgggacagggcctgcatgcagtcaggctggcagtggcgcggtacagggagggaactggtgcatattttagcctcaggaataaagatttgtctgctcaaaaaaaaaaaa

SEQ ID NO: 441084 - DNA, 2059 bp, Homo sapiens
cgaactggccctaggagatgagtatccttattacctcatttgacaggtgaggaaacgggggctccaagtggttaagtaatgtgcccaaggccacagagctaggaaatagatgctggatttgaactaagaatgtgtcattccagaaccagggctcattgccttgacaacatacagcgcaaatcctgtactcaggatgtcaccctcttcagaatgttgctgctgtcactcaagctggctgctctgggccatgatatcccaaggacaggtgaatttgggcctcaaaggtatccctttgcatggtccccaggagagcctcattggtgacacctgcagggccctgacgaccaggccagaactagcattcagccctcttgggcaggcccatggggtggaaatggtgccacctgcagaagtcatcgcccctgtgctgggctggcctctgtgccctccatgtctcagatatgccctgacctgttgggctcacaaggccttgtccacataccaggaaggagggcactcccttgccaggcacctgtttgcttttcacagctgggtctctgtccacccctctagggaggcaggactgagggaggctgggcgccccgtccctcctgcacttgctttccttcagtagggccctggcctcagcacaggtaacttcccccctcatttcagctcccagaggtctcttggttagtgcacttgaacccagccacccccaacccagaagctccaaaaagtgccaatgcctgggacccaccctgcagatactgttgtagttggtctgaggcacagcctggacttggggtttttttaaggttctgcatggggttctacctgctgctgtcacctggtctctgcagctctgttccaaagctgcagcctccaggaagccaccctgacttccccccacctaccttcccccttggaggggacaggttctactcagaagtcacacagccctcggatgggtcttctcgtttccaccgccatctgggacctacccgtccatggtttataacccctgtgttctagcagcaaagctttgtagactctgggtttatgggtgtaggggtgagagctgctggcccaggagaggacctcagggaatggatgtgaatgactgaatgagtaggtccacgctgtaccccgtggtccctatctcagagggtgcagggtttcctaggagcagagttggggagaggaacgagagatggccagacagacccagccagagacaggaagggagagaggccgcaggggagctgcttctggccatccatgctgctctgggcctctagcccctagcttgaggcaaaaggctgtactgtgaaaggagtggggaggtgacaggccatgtgtttctgtctcggtcctgtttccacagttatgacgaggaagcgatggtggaggctgtggccctctacaaccctgtgagctttgcctttgaggtgactcaggacttcatgatgtatagaacgggcatctactccagtacttcctgccataaaactccagataaagtaaaccatgcagtactggctgttgggtatggagaaaaaaatgggatcccttactggatcgtgaaaaactcttggggtccccagtggggaatgaacgggtacttcctcatcgagcgcggaaagaacatgtgtggcctggctgcctgcgcctcctaccccatccctctggtgtgagccgtggcagccgcagcgcagactggcggagaaggagaggaacgggcagcctgggcctgggtggaaatcctgccctggaggaagttgtggggagatccactgggacccccaacattctgccctcacctctgtgcccagcctggaaacctacagacaaggaggagttccaccatgagctcacccgtgtctatgacgcaaagatcaccagccatgtgccttagtgtccttcttaacagactcaaaccacatggaccacgaatattctttctgtccagaagggctactttccacatatagagctccagggactgtcttttctgtattcgctgttcaataaacattgagtgagcacctccccagat

SEQ ID NO: 441085 - DNA, 174 bp, Homo sapiens
gcggccgcctactactactactactgctcgaattcaagcttctaacgatgtacggggacatggaccacgaatattctttctgtccagaagggctactttccacatatagagctccagggactgtcttttctgtattcgctgttcaataaacattgagtgagcacctccccagat

SEQ ID NO: 441086 - DNA, 950 bp, Homo sapiens
accagaccctaagctccttgaggacaaggatgctttaattctctctgaaattatcccatcccccaggccctggcacatcttgttttgtttagtaaatgttattgaactgcgtggggaggctgagacttcgggtccataacctgtatttcatgccctttgcatcctcaacaggatggttattgcaagttccaacctggaaaggccatcggctttgtcaaggatgtagccaacatcacaatcgtgagtgccgatccccctctgggatggggaatgtgtcctgatgaggaggcctctctcatgctgtcggatagccagtgggcccagcaaggcagcccttctggcagcacatccctttgacgagttcatattatccctgggtctcagtcgctgtgatggtggcgaggcaggagatgggagggagagcgcaaactggcaggcaggccctctggttctgaactccagatccacacatgccttcattcttttggttctgttttcttgcttgtaaaatgcaagcaattgtccgcatcctgcagaagagggtatgagcacgtgcttgacacagcgtgtgtgaaactgaggagggtgagtgtgtgtcactcaggatgagccaggttctgttgcaataacaaccgtgcccaatctgcatggctgacaacagtcaaagggtgtgtggcactcctgcgcccatgcacagcttagggagggtggtgtgtgctccgtgtcattggcctcacgccaggactagagggaaagaaggtggtaaatgatgccctagctctaaagccaaaacaagccgcccagtcacagttgacctcaagtgaatagggaagtgtggtcttaccctgcttctcccagagagaactggaacgtgaatgaacgccttcgtgactgcagtgtgcatgcatgcaagtgtgggagggtgtgtgaggagtggaggaatatcgctt

SEQ ID NO: 441087 - DNA, 1487 bp, Homo sapiens
acacgaaacgatctagccaattaggctaggtagaggctggggttgaatcggacgaggacgctctgggccgccacctccgcggaccctgagcgcaagagccaagccgccagcgctgctatgtgggccacgctgccgctgctctgcgccggggcctggctcctgggagtccccgtctgcggtgccgccgaactgtccgtgaactccttagagaagtttcacttcaagtcatggatgtctaagcaccgtaagacctacagtacggaggagtaccaccacaggctgcagacgtttgccagcaactggaggaagataaacgcccacaacaatgggaaccacacatttaaaatggcactgaaccaattttcagacatgagctttgctgaaataaaacacaagtatctctggtcagagcctcagaattgctcagccaccaaaagtaactaccttcgaggtactggtccctacccaccttccgtggactggcggaaaaaaggaaattttgtctcacctgtgaaaaatcagggtgcctgcggcagttgctggactttctccaccactggggccctggagtctgcgatcgccatcgcaaccggaaagatgctgtccttggcggaacagcagctggtggactgcgcccaggacttcaataatcacggctgccaagggggtctccccagccaggctttcgagtatatcctgtacaacaaggggatcatgggtgaagacacctacccctaccagggcaaggatggttattgcaagttccaacctggaaaggccatcggctttgtcaaggatgtagccaacatcacaatctatgacgaggaagcgatggtggaggctgtggccctctacaaccctgtgagctttgcctttgaggtgactcaggacttcatgatgtatagaacgggcatctactccagtacttcctgccataaaactccagataaagtaaaccatgcagtactggctgttgggtatggagaaaaaaatgggatcccttactggatcgtgaaaaactcttggggtccccagtggggaatgaacgggtacttcctcatcgagcgcggaaagaacatgtgtggcctggctgcctgcgcctcctaccccatccctctggtgtgagccgtggcagccgcagcgcagactggcggagaaggagaggaacgggcagcctgggcctgggtggaaatcctgccctggaggaagttgtggggagatccactgggacccccaacattctgccctcacctctgtgcccagcctggaaacctacagacaaggaggagttccaccatgagctcacccgtgtctatgacgcaaagatcaccagccatgtgccttagtgtccttcttaacagactcaaaccacatggaccacgaatattctttctgtccagaagggctactttccacatatagagctccagggactgtcttttctgtattcgctgttcaataaacattgagtgagcacctccccagat

SEQ ID NO: 441088 - DNA, 1464 bp, Homo sapiens
agaacattcatgcaggaggcattctgcatgcaggcagtgactgcagattccaggacctgtggttagcggactcctattgatgtttctgggaactctagacctggaagttcagagaagtttcacttcaagtcatggatgtctaaggaaaacaaaaaggtctccctctagggagctgcagcctgtttccatgacttgctactggcgtgttttgttttagcaccgtaagacctacagtacggaggagtaccaccacaggctgcagacgtttgccagcaactggaggaagataaacgcccacaacaatgggaaccacacatttaaaatggcactgaaccaattttcagacatgagctttgctgaaataaaacacaagtatctctggtcagagcctcagaattgctcagccaccaaaagtaactaccttcgaggtactggtccctacccaccttccgtggactggcggaaaaaaggaaattttgtctcacctgtgaaaaatcagggtgcctgcggcagttgctggactttctccaccactggggccctggagtctgcgatcgccatcgcaaccggaaagatgctgtccttggcggaacagcagctggtggactgcgcccaggacttcaataatcacggctgccaagggggtctccccagccaggctttcgagtatatcctgtacaacaaggggatcatgggtgaagacacctacccctaccagggcaaggatggttattgcaagttccaacctggaaaggccatcggctttgtcaaggatgtagccaacatcacaatctatgacgaggaagcgatggtggaggctgtggccctctacaaccctgtgagctttgcctttgaggtgactcaggacttcatgatgtatagaacgggcatctactccagtacttcctgccataaaactccagataaagtaaaccatgcagtactggctgttgggtatggagaaaaaaatgggatcccttactggatcgtgaaaaactcttggggtccccagtggggaatgaacgggtacttcctcatcgagcgcggaaagaacatgtgtggcctggctgcctgcgcctcctaccccatccctctggtgtgagccgtggcagccgcagcgcagactggcggagaaggagaggaacgggcagcctgggcctgggtggaaatcctgccctggaggaagttgtggggagatccactgggacccccaacattctgccctcacctctgtgcccagcctggaaacctacagacaaggaggagttccaccatgagctcacccgtgtctatgacgcaaagatcaccagccatgtgccttagtgtccttcttaacagactcaaaccacatggaccacgaatattctttctgtccagaagggctactttccacatatagagctccagggactgtcttttctgtattcgctgttcaataaacattgagtgagcacctccccagat

SEQ ID NO: 441089 - DNA, 1560 bp, Homo sapiens
acacgaaacgatctagccaattaggctaggtagaggctggggttgaatcggacgaggacgctctgggccgccacctccgcggaccctgagcgcaagagccaagccgccagcgctgctatgtgggccacgctgccgctgctctgcgccggggcctggctcctgggagtccccgtctgcggtgccgccgaactgtccgtgaactccttagagaagtttcacttcaagtcatggatgtctaaggaaaacaaaaaggtctccctctagggagctgcagcctgtttccatgacttgctactggcgtgttttgttttagcaccgtaagacctacagtacggaggagtaccaccacaggctgcagacgtttgccagcaactggaggaagataaacgcccacaacaatgggaaccacacatttaaaatggcactgaaccaattttcagacatgagctttgctgaaataaaacacaagtatctctggtcagagcctcagaattgctcagccaccaaaagtaactaccttcgaggtactggtccctacccaccttccgtggactggcggaaaaaaggaaattttgtctcacctgtgaaaaatcagggtgcctgcggcagttgctggactttctccaccactggggccctggagtctgcgatcgccatcgcaaccggaaagatgctgtccttggcggaacagcagctggtggactgcgcccaggacttcaataatcacggctgccaagggggtctccccagccaggctttcgagtatatcctgtacaacaaggggatcatgggtgaagacacctacccctaccagggcaaggatggttattgcaagttccaacctggaaaggccatcggctttgtcaaggatgtagccaacatcacaatctatgacgaggaagcgatggtggaggctgtggccctctacaaccctgtgagctttgcctttgaggtgactcaggacttcatgatgtatagaacgggcatctactccagtacttcctgccataaaactccagataaagtaaaccatgcagtactggctgttgggtatggagaaaaaaatgggatcccttactggatcgtgaaaaactcttggggtccccagtggggaatgaacgggtacttcctcatcgagcgcggaaagaacatgtgtggcctggctgcctgcgcctcctaccccatccctctggtgtgagccgtggcagccgcagcgcagactggcggagaaggagaggaacgggcagcctgggcctgggtggaaatcctgccctggaggaagttgtggggagatccactgggacccccaacattctgccctcacctctgtgcccagcctggaaacctacagacaaggaggagttccaccatgagctcacccgtgtctatgacgcaaagatcaccagccatgtgccttagtgtccttcttaacagactcaaaccacatggaccacgaatattctttctgtccagaagggctactttccacatatagagctccagggactgtcttttctgtattcgctgttcaataaacattgagtgagcacctccccagat

SEQ ID NO: 441090 - DNA, 1342 bp, Homo sapiens
gtggagggagcagaagcccaggctctgaagctgtgtttggctgacctcagattgtggctccgctgttactctctgtgtaatgtgggatcgtaaatttgggacaaagccggtacccctctgggtggttgtgaagtttacaagagactctgtagaagcccctgccccattcctgccatctgagggtccagcctggaagccaagtggcactgaaccaattttcagacatgagctttgctgaaataaaacacaagtatctctggtcagagcctcagaattgctcagccaccaaaagtaactaccttcgaggtactggtccctacccaccttccgtggactggcggaaaaaaggaaattttgtctcacctgtgaaaaatcagggtgcctgcggcagttgctggactttctccaccactggggccctggagtctgcgatcgccatcgcaaccggaaagatgctgtccttggcggaacagcagctggtggactgcgcccaggacttcaataatcacggctgccaagggggtctccccagccaggctttcgagtatatcctgtacaacaaggggatcatgggtgaagacacctacccctaccagggcaaggatggttattgcaagttccaacctggaaaggccatcggctttgtcaaggatgtagccaacatcacaatctatgacgaggaagcgatggtggaggctgtggccctctacaaccctgtgagctttgcctttgaggtgactcaggacttcatgatgtatagaacgggcatctactccagtacttcctgccataaaactccagataaagtaaaccatgcagtactggctgttgggtatggagaaaaaaatgggatcccttactggatcgtgaaaaactcttggggtccccagtggggaatgaacgggtacttcctcatcgagcgcggaaagaacatgtgtggcctggctgcctgcgcctcctaccccatccctctggtgtgagccgtggcagccgcagcgcagactggcggagaaggagaggaacgggcagcctgggcctgggtggaaatcctgccctggaggaagttgtggggagatccactgggacccccaacattctgccctcacctctgtgcccagcctggaaacctacagacaaggaggagttccaccatgagctcacccgtgtctatgacgcaaagatcaccagccatgtgccttagtgtccttcttaacagactcaaaccacatggaccacgaatattctttctgtccagaagggctactttccacatatagagctccagggactgtcttttctgtattcgctgttcaataaacattgagtgagcacctccccagat

SEQ ID NO: 441091 - DNA, 1442 bp, Homo sapiens
acacgaaacgatctagccaattaggctaggtagaggctggggttgaatcggacgaggacgctctgggccgccacctccgcggaccctgagcgcaagagccaagccgccagcgctgctatgtgggccacgctgccgctgctctgcgccggggcctggctcctgggagtccccgtctgcggtgccgccgaactgtccgtgaactccttagagaagtttcacttcaagtcatggatgtctaagcaccgtaagacctacagtacggaggagtaccaccacaggctgcagacgtttgccagcaactggaggaagataaacgcccacaacaatgggaaccacacatttaaaatggcactgaaccaattttcagacatgagctttgctgaaataaaacacaagtatctctggtcagagcctcagaattgctcagccaccaaaagtaactaccttcgaggtactggtccctacccaccttccgtggactggcggaaaaaaggaaattttgtctcacctgtgaaaaatcaggagtctgcgatcgccatcgcaaccggaaagatgctgtccttggcggaacagcagctggtggactgcgcccaggacttcaataatcacggctgccaagggggtctccccagccaggctttcgagtatatcctgtacaacaaggggatcatgggtgaagacacctacccctaccagggcaaggatggttattgcaagttccaacctggaaaggccatcggctttgtcaaggatgtagccaacatcacaatctatgacgaggaagcgatggtggaggctgtggccctctacaaccctgtgagctttgcctttgaggtgactcaggacttcatgatgtatagaacgggcatctactccagtacttcctgccataaaactccagataaagtaaaccatgcagtactggctgttgggtatggagaaaaaaatgggatcccttactggatcgtgaaaaactcttggggtccccagtggggaatgaacgggtacttcctcatcgagcgcggaaagaacatgtgtggcctggctgcctgcgcctcctaccccatccctctggtgtgagccgtggcagccgcagcgcagactggcggagaaggagaggaacgggcagcctgggcctgggtggaaatcctgccctggaggaagttgtggggagatccactgggacccccaacattctgccctcacctctgtgcccagcctggaaacctacagacaaggaggagttccaccatgagctcacccgtgtctatgacgcaaagatcaccagccatgtgccttagtgtccttcttaacagactcaaaccacatggaccacgaatattctttctgtccagaagggctactttccacatatagagctccagggactgtcttttctgtattcgctgttcaataaacattgagtgagcacctccccagat

SEQ ID NO: 441092 - DNA, 1978 bp, Homo sapiens
  misc_feature (1553)..(1553): n is a, c, g, or t
cgctcccgccgctcctccacgctcgtgccgccccccccgcgctcccagttgacgctctgggccgccacctccgcggaccctgagcgcaagagccaagccgccagcgctgctatgtgggccacgctgccgctgctctgcgccggggcctggctcctgggagtccccgtctgcggtgccgccgaactgtccgtgaactccttagagaagtttcacttcaagtcatggatgtctaagcaccgtaagacctacagtacggaggagtaccaccacaggctgcagacgtttgccagcaactggaggaagataaacgcccacaacaatgggaaccacacatttaaaatggcactgaaccaattttcagacatgagctttgctgaaataaaacacaagtatctctggtcagagcctcagaattgctcagccaccaaaagtaactaccttcgaggtactggtccctacccaccttccgtggactggcggaaaaaaggaaattttgtctcacctgtgaaaaatcagggtgcctgcggcagttgctggactttctccaccactggggccctggagtctgcgatcgccatcgcaaccggaaagatgctgtccttggcggaacagcagctggtggactgcgcccaggacttcaataatcacggctgccaagggggtctccccagccaggctttcgagtatatcctgtacaacaaggggatcatgggtgaagacacctacccctaccagggcaaggatggttattgcaagttccaacctggaaaggccatcggctttgtcaaggatgtagccaacatcacaatctatgacgaggaagcgatggtggaggctgtggccctctacaaccctgtgagctttgcctttgaggtgactcaggacttcatgatgtatagaacgggcatctactccagtacttcctgccataaaactccagataaagtaaaccatgcagtactggctgttgggtatggagaaaaaaatgggatcccttactggatcgtgaaaaactcttggggtccccagtggggaatgaacgggtacttcctcatcgagcgcggaaagaacatgtgtggcctggctgcctgcgcctcctaccccatccctctggtgtgagccgtggcagccgcagcgcagactggcggagaaggagaggaacgggcagcctgggcctgggtggaaatcctgccctggaggaagttgtggggagatccactgggacccccaacattctgccctcacctctgtgcccagcctggaaacctacagacaaggaggagttccaccatgagctcacccgtgtctatgacgcaaagatcaccagccatgtgccttagtgtccttcttaacagactcaaaccacatggaccacgaatattctttctgtccagaagggctactttccacatatagagctccagggactgtcttttctgtattcgctgttcaataaacattgagtgagcacctccccagataaaaaaaaaaaaaaaaaaaaaaaaaaaaaaaaaaaaaaaaaaaaaaaaaaaaaaaaaaaaaaaaaaaaaaanaaaaaaaaaaaaaaaaaaaaaagaaaaaaaaaaaggggggggagggtaaaaaaataacccacgagaggggacacaaaggaagcgcacgcccagattgtagtacacagagcgggcccaaaaagaggcgcgataaaaaaagagagaaggggacacaataaaaaaagcggcgggggagaaaaacagaaaagagggacacagtgggagagcagcaccacaaatctgtctgggggggcggcacaaaatatcggtggggagaaccaacctcactccgaaagaggattttatcccggcaagtggaggagaacaatagtaagaactatagaggttaataattatgggtggtaacacaaggggaaaagataagcacgggatggaacaaaagattgtgcaatgcaagggaataatgtaaggaaagaatttttacg

SEQ ID NO: 441093 - DNA, 2483 bp, Homo sapiens
cgctcccgccgctcctccacgctcgtgccgccccccccgcgctcccagttgacgctctgggccgccacctccgcggaccctgagcgcaagagccaagccgccagcgctgctatgtgggccacgctgccgctgctctgcgccggggcctggctcctgggagtccccgtctgcggtgccgccgaactgtccgtgaactccttagagaagtttcacttcaagtcatggatgtctaagcaccgtaagacctacagtacggaggagtaccaccacaggctgcagacgtttgccagcaactggaggaagataaacgcccacaacaatgggaaccacacatttaaaatggcactgaaccaattttcagacatgagctttgctgaaataaaacacaagtatctctggtcagagcctcagaattgctcagccaccaaaagtaactaccttcgaggtactggtccctacccaccttccgtggactggcggaaaaaaggaaattttgtctcacctgtgaaaaatcagggtgcctgcggcagttgctggactttctccaccactggggccctggagtctgcgatcgccatcgcaaccggaaagatgctgtccttggcggaacagcagctggtggactgcgcccaggacttcaataatcacggctgccaagggggtctccccagccaggctttcgagtatatcctgtacaacaaggggatcatgggtgaagacacctacccctaccagggcaaggatggttattgcaagttccaacctggaaaggccatcggctttgtcaaggatgtagccaacatcacaatctatgacgaggaagcgatggtggaggctgtggccctctacaaccctgtgagctttgcctttgaggtgactcaggacttcatgatgtatagaacgggcatctactccagtacttcctgccataaaactccagataaagtaaaccatgcagtactggctgttgggtatggagaaaaaaatgggatcccttactggatcgtgaaaaactcttggggtccccagtggggaatgaacgggtacttcctcatcgagcgcggaaagaacatgtgtggcctggctgcctgcgcctcctaccccatccctctggtgtgagccgtggcagccgcagcgcagactggcggagaaggagaggaacgggcagcctgggcctgggtggaaatcctgccctggaggaagttgtggggagatccactgggacccccaacattctgccctcacctctgtgcccagcctggaaacctacagacaaggaggagttccaccatgagctcacccgtgtctatgacgcaaagatcaccagccatgtgccttagtgtccttcttaacagactcaaaccacatggaccacgaatattctttctgtccagaagggctactttccacatatagagctccagggactgtcttttctgtattcgctgttcaataaacattgagtgagcacctccccagatccagatggtaacaaccacaaaaagaacaaaaaaaaacaacacatcaaaataggataacaatcgagaaacatgagaacaaacaatacgaaacaaggctcgcaacgcacacgagagcacaaccagactaccaaacacttaagatcgaaggcgtgcggggcgacctctgtgttgtcattcacatggacgatcaggcatcgatctattgacactgattattcatcttacaccggtgtactcgctctcttctcacttttgtactgtgtgactacgtatccagttctctcatgacgtgcttttatctctcttcatttgacactatttttatatttctctcgtgcccctatctacatcttatcgtttcatatttttgtctactctagatcattactacctatttactatactgcatttgttctcatctatctttcttgttcacatcgcgtaatctcttcactcatcgtactgcgagagatgaagtaacacttcgttaccaagatgtggagatcgcgactacgctcgtcaccactactgctatgaatagatctgtgaagtacgtgcagaagtatctccactcgtaatccacttatatcactgctcgtcgtatcagttctctatattgttcttgctcctgcttcgctctactacttatacgcacagtcttatacattacgttcgatgtcgtggtcgatgttagtgtggagatgcgatctttctgtcatcagtgtcgggagcatcgatgctgtgctcttacttttcctagaagtcatctcgaaatcgatctctcggcagtagcgacgtgacgatgttagagtctcatatacaattgatctatgctgtcttcatcgtttcgagttgttgcttctgttgcgtctcgtattcctgcgtctcagctgggcagcgtatgacttcaactatggaatgctgatttgatgtcgatggttctctgtgacatgttgtaagtcacgattgacgatcttttcgcatgagttaaagtatctgtgt

SEQ ID NO: 441094 - DNA, 1245 bp, Homo sapiens
  misc_feature (396)..(396): n is a, c, g, or t
cctcacagacgcgcccgcacacaatacagagtgagcatgaacctcggcaggacctcagtctgcctgagggaaccaggttggcacctccaccagtgtccgggcagggcggtgctatccctggggacatgaatgccagccctgtcatcagctcctccccactcaggtctgaagctcagggccaagcctccctctctggatctgtcagcagctctggcaccaggcaggaagacgaccttccctggagatgcccctgggccacggcccacagagctcaggagcctcagccagccacgtgggcatccactccttttcctgcaagagatgatggttccattgctcttggcttcatggtgttcctggaaggcagatgagctggtcatttacagactgcgcccnggacttcaataatcacggctgccaagggggtctccccagccaggctttcgagtatatcctgtacaacaaggggatcatgggtgaagacacctacccctaccagggcaaggatggttattgcaagttccaacctggaaaggccatcggctttgtcaaggatgtagccaacatcacaatctatgacgaggaagcgatggtggaggctgtggccctctacaaccctgtgagctttgcctttgaggtgactcaggacttcatgatgtatagaacgggcatctactccagtacttcctgccataaaactccagataaagtaaaccatgcagtactggctgttgggtatggagaaaaaaatgggatcccttactggatcgtgaaaaactcttggggtccccagtggggaatgaacgggtacttcctcatcgagcgcggaaagaacatgtgtggcctggctgcctgcgcctcctaccccatccctctggtgtgagccgtggcagccgcagcgcagactggcggagaaggagaggaacgggcagcctgggcctgggtggaaatcctgccctggaggaagttgtggggagatccactgggacccccaacattctgccctcacctctgtgcccagcctggaaacctacagacaaggaggagttccaccatgagctcacccgtgtctatgacgcaaagatcaccagccatgtgccttagtgtccttcttaacagactcaaaccacatggaccacgaatattctttctgtccagaagggctactttccacatatagagctccagggactgtcttttctgtattcgctgttcaataaacattgagtgagcacctccccagat

SEQ ID NO: 441095 - DNA, 1444 bp, Homo sapiens
cgctcccgccgctcctccacgctcgtgccgccccccccgcgctcccagttgacgctctgggccgccacctccgcggaccctgagcgcaagagccaagccgccagcgctgctatgtgggccacgctgccgctgctctgcgccggggcctggctcctgggagtccccgtctgcggtgccgccgaactgtccgtgaactccttagagaagtttcacttcaagtcatggatgtctaagcaccgtaagacctacagtacggaggagtaccaccacaggctgcagacgtttgccagcaactggaggaagataaacgcccacaacaatgggaaccacacatttaaaatggcactgaaccaattttcagacatgagctttgctgaaataaaacacaagtatctctggtcagagcctcagaattgctcagccaccaaaagtaactaccttcgaggtactggtccctacccaccttccgtggactggcggaaaaaaggaaattttgtctcacctgtgaaaaatcagggtgcctgcggcagttgctggactttctccaccactggggccctggagtctgcgatcgccatcgcaaccggaaagatgctgtccttggcggaacagcagctggtggactgcgcccaggacttcaataatcacggctgccaagggggtctccccagccaggctttcgagtatatcctgtacaacaaggggatcatgggtgaagacacctacccctaccagggcaaggatggttattgcaagttccaacctggaaaggccatcggctttgtcaaggatgtagccaacatcacaatctatgacgaggaagcgatggtggaggctgtggccctctacaaccctgtgagctttgcctttgaggtgactcaggacttcatgatgtatagaacgggcatctactccagtacttcctgccataaaactccagataaagtaaaccatgcagtactggctgttgggtatggagaaaaaaatgggatcccttactggatcgtgaaaaactcttggggtccccagtggggaatgaacgggtacttcctcatcgagcgcggaaagaacatgtgtggcctggctgcctgcgcctcctaccccatccctctggtgtgagccgtggcagccgcagcgcagactggcggagaaggagaggaacgggcagcctgggcctgggtggaaatcctgccctggaggaagttgtggggagatccactgggacccccaacattctgccctcacctctgtgcccagcctggaaacctacagacaaggaggagttccaccatgagctcacccgtgtctatgacgcaaagatcaccagccatgtgccttagtgtccttcttaacagactcaaaccacatggaccacgaatattctttctgtccagaagggctactttccacacttctaaggtaaggggccgagctcgattgatca

SEQ ID NO: 441096 - DNA, 1311 bp, Homo sapiens
acacgaaacgatctagccaattaggctaggtagaggctggggttgaatcggacgaggacgctctgggccgccacctccgcggaccctgagcgcaagagccaagccgccagcgctgctatgtgggccacgctgccgctgctctgcgccggggcctggctcctgggagtccccgtctgcggtgccgccgaactgtccgtgaactccttagagaagtttcacttcaagtcatggatgtctaaggaaaacaaaaaggtctccctctagggagctgcagcctgtttccatgacttgctactggcgtgttttgttttagcaccgtaagacctacagtacggaggagtaccaccacaggctgcagacgtttgccagcaactggaggaagataaacgcccacaacaatgggaaccacacatttaaaatggcactgaaccaattttcagacatgagctttgctgaaataaaacacaagtatctctggtcagagcctcagaattgctcagccaccaaaagtaactaccttcgaggtactggtccctacccaccttccgtggactggcggaaaaaaggaaattttgtctcacctgtgaaaaatcagggtgcctgcggcagttgctggactttctccaccactggggccctgtatgacgaggaagcgatggtggaggctgtggccctctacaaccctgtgagctttgcctttgaggtgactcaggacttcatgatgtatagaacgggcatctactccagtacttcctgccataaaactccagataaagtaaaccatgcagtactggctgttgggtatggagaaaaaaatgggatcccttactggatcgtgaaaaactcttggggtccccagtggggaatgaacgggtacttcctcatcgagcgcggaaagaacatgtgtggcctggctgcctgcgcctcctaccccatccctctggtgtgagccgtggcagccgcagcgcagactggcggagaaggagaggaacgggcagcctgggcctgggtggaaatcctgccctggaggaagttgtggggagatccactgggacccccaacattctgccctcacctctgtgcccagcctggaaacctacagacaaggaggagttccaccatgagctcacccgtgtctatgacgcaaagatcaccagccatgtgccttagtgtccttcttaacagactcaaaccacatggaccacgaatattctttctgtccagaagggctactttccacatatagagctccagggactgtcttttctgtattcgctgttcaataaacattgagtgagcacctccccagat

SEQ ID NO: 441097 - DNA, 1520 bp, Homo sapiens
cgctcccgccgctcctccacgctcgtgccgccccccccgcgctcccagttgacgctctgggccgccacctccgcggaccctgagcgcaagagccaagccgccagcgctgctatgtgggccacgctgccgctgctctgcgccggggcctggctcctgggagtccccgtctgcggtgccgccgaactgtccgtgaactccttagagaagtttcacttcaagtcatggatgtctaagcaccgtaagacctacagtacggaggagtaccaccacaggctgcagacgtttgccagcaactggaggaagataaacgcccacaacaatgggaaccacacatttaaaatggcactgaaccaattttcagacatgagctttgctgaaataaaacacaagtatctctggtcagagcctcagaattgctcagccaccaaaagtaactaccttcgaggtactggtccctacccaccttccgtggactggcggaaaaaaggaaattttgtctcacctgtgaaaaatcagggtgcctgcggcagttgctggactttctccaccactggggccctggagtctgcgatcgccatcgcaaccggaaagatgctgtccttggcggaacagcagctggtggactgcgcccaggacttcaataatcacggctgccaagggggtctccccagccaggctttcgagtatatcctgtacaacaaggggatcatgggtgaagacacctacccctaccagggcaaggatggttattgcaagttccaacctggaaaggccatcggctttgtcaaggatgtagccaacatcacaatcgtgagtgccgatccccctctgggatggggaatgtgtcctgatgaggaggcctctctcatgctgtcggatagccagtgggcccagcaaggcagcccttctggcagcacatccctttgacgagttcatattatccctgggtctcagtcgctgtgatggtggcgaggcaggagatgggagggagagcgcaaactggcaggcaggccctctggttctgaactccagatccacacatgccttcattcttttggttctgttttcttgcttgtaaaatgcaagcaattgtccgcatcctgcagaagagggtatgagcacgtgcttgacacagcgtgtgtgaaactgaggagggtgagtgtgtgtcactcaggatgagccaggttctgttgcaataacaaccgtgcccaatctgcatggctgacaacagtcaaagggtgtgtggcactcctgcgcccatgcacagcttagggagggtggtgtgtgctccgtgtcattggcctcacgccaggactagagggaaagaaggtggtaaatgatgccctagctctaaagccaaaacaagccgcccagtcacagttgacctcaagtgaatagggaagtgtggtcttaccctgcttctcccagagagaactggaacgtgaatgaacgccttcgtgactgcagtgtgcatgcatgcaagtgtgggagggtgtgtgaggagtggaggaatatcgctt

SEQ ID NO: 441098 - DNA, 861 bp, Homo sapiens
  misc_feature (830)..(830): n is a, c, g, or t
  misc_feature (855)..(855): n is a, c, g, or t
  misc_feature (860)..(860): n is a, c, g, or t
cgctcccgccgctcctccacgctcgtgccgccccccccgcgctcccagttgacgctctgggccgccacctccgcggaccctgagcgcaagagccaagccgccagcgctgctatgtgggccacgctgccgctgctctgcgccggggcctggctcctgggagtccccgtctgcggtgccgccgaactgtccgtgaactccttagagaagtttcacttcaagtcatggatgtctaagcaccgtaagacctacagtacggaggagtaccaccacaggctgcagacgtttgccagcaactggaggaagataaacgcccacaacaatgggaaccacacatttaaaatggcactgaaccaattttcagacatgagctttgctgaaataaaacacaagtatctctggtcagagcctcagaattgctcagccaccaaaagtaactaccttcgaggtactggtccctacccaccttccgtggactggcggaaaaaaggaaattttgtctcacctgtgaaaaatcagggtgcctgcggcagttgctggactttctccaccactggggccctggagtctgcgatcgccatcgcaaccggaaagatgctgtccttggcggaacagcagctggtggactgcgcccaggacttcaataatcacggctgccaagggggtctccccagccaggctttcgagtatatcctgtacaacaaggggatcatgggtgaagacacctacccctaccagggcaaggatggttattgcaagttccaacctggaaaggccatcggctttgtcaaggatgtagccaacatcacaatctaatggacgaagggaaaaangcccccccgaaaattttgggggggntttgng

SEQ ID NO: 441099 - DNA, 1011 bp, Homo sapiens
  misc_feature (396)..(396): n is a, c, g, or t
cctcacagacgcgcccgcacacaatacagagtgagcatgaacctcggcaggacctcagtctgcctgagggaaccaggttggcacctccaccagtgtccgggcagggcggtgctatccctggggacatgaatgccagccctgtcatcagctcctccccactcaggtctgaagctcagggccaagcctccctctctggatctgtcagcagctctggcaccaggcaggaagacgaccttccctggagatgcccctgggccacggcccacagagctcaggagcctcagccagccacgtgggcatccactccttttcctgcaagagatgatggttccattgctcttggcttcatggtgttcctggaaggcagatgagctggtcatttacagactgcgcccnggacttcaataatcacggctgccaagggggtctccccagccaggctttcgagtatatcctgtacaacaaggggatcatgggtgaagacacctacccctaccagggcaaggatggttattgcaagttccaacctggaaaggccatcggctttgtcaaggatgtagccaacatcacaatctatgacgaggaagcgatggtggaggctgtggccctctacaaccctgtgagctttgcctttgaggtgactcaggacttcatgatgtatagaacgggcatctactccagtacttcctgccataaaactccagataaagtaaaccatgcagtactggctgttgggtatggagatccactgggacccccaacattctgccctcacctctgtgcccagcctggaaacctacagacaaggaggagttccaccatgagctcacccgtgtctatgacgcaaagatcaccagccatgtgccttagtgtccttcttaacagactcaaaccacatggaccacgaatattctttctgtccagaagggctactttccacatatagagctccagggactgtcttttctgtattcgctgttcaataaacattgagtgagcacctccccagat

SEQ ID NO: 441100 - DNA, 454 bp, Homo sapiens
aatgtcagcccagaagcctgtacttctctgtgtggcctccccagtctcagctgcctactcctactcagactctgccccccacctccacatgagactgcccaccccttcctcaccaaccccttatttatttcaaacgtgcccagatgctcctgtcgtttccacaccatcccttcccttatcttgccttttgagaaatcttgatctctgtttagagggcggccatgaagttgctgctgcttcctgaagcctccgggctctgggatgtctgtagaacaagctggagtccaccagctctttgtcctatggctcacagactttcttaatgataaaagctgtcatcttatttgggcttcctgaaaagctaaaggcttgagaatatttgaaaaatatatatgttcatgataaggcttatttagataatgcaaatatagtttaatttattagaaaattctag

SEQ ID NO: 441101 - DNA, 141 bp, Homo sapiens
aggctgtggccctctacaaccctgtgagctttgcctttgaggtgactcaggacttcatgatgtatagaacgggcatctactccaggtgagtcagggtcccaggagccaggagggacagtggggaggggcttggtgggcctc

SEQ ID NO: 441102 - DNA, 625 bp, Homo sapiens
ccccgcctctatcaggacagccccaggtgggctcacctgtgtgtacttcttgcaggggtctccccagccaggctttcgagtatatcctgtacaacaaggggatcatgggtgaagacacctacccctaccagggcaaggtaactccaacagcctccactctgtcttcttggcgtacagcatgcctagcttcactccctccccagccttggaagacatcccttctccccccacctccctcccgccggaattctcacaattgtctgttctctccaaattcttccttcccctcctccacccacctgagcccactgctctcaccagtccaggggcctctttatcattctcaccccatacccgctctgcggcaccatctctttccttcccgagccagacttctcaggacccctccttccccccacctgccccatcttcctggctcctctccctcctgccacgagcgccatcctctcgcctctgtccatgcagttggcctcttgtgccaaggaccctttgggggcccacccccacccctaccctatcaaggctgctgggcctcccaccatcacctccgcccagcctggccacagccaagtgccttgtctttccccaagacctgttgctcctc

SEQ ID NO: 441103 - DNA, 1481 bp, Homo sapiens
cgctcccgccgctcctccacgctcgtgccgccccccccgcgctcccagttgacgctctgggccgccacctccgcggaccctgagcgcaagagccaagccgccagcgctgctatgtgggccacgctgccgctgctctgcgccggggcctggctcctgggagtccccgtctgcggtgccgccgaactgtccgtgaactccttagagaagtttcacttcaagtcatggatgtctaagcaccgtaagacctacagtacggaggagtaccaccacaggctgcagacgtttgccagcaactggaggaagataaacgcccacaacaatgggaaccacacatttaaaatggcactgaaccaattttcagacatgagctttgctgaaataaaacacaagtatctctggtcagagcctcagaattgctcagccaccaaaagtaactaccttcgaggtactggtccctacccaccttccgtggactggcggaaaaaaggaaattttgtctcacctgtgaaaaatcagggtgcctgcggcagttgctggactttctccaccactggggccctggagtctgcgatcgccatcgcaaccggaaagatgctgtccttggcggaacagcagctggtggactgcgcccaggacttcaataatcacggctgccaagggggtctccccagccaggctttcgagtatatcctgtacaacaaggggatcatgggtgaagacacctacccctaccagggcaaggatggttattgcaagttccaacctggaaaggccatcggctttgtcaaggatgtagccaacatcacaatctatgacgaggaagcgatggtggaggctgtggccctctacaaccctgtgagctttgcctttgaggtgactcaggacttcatgatgtatagaacgggcatctactccagtacttcctgccataaaactccagataaagtaaaccatgcagtactggctgttgggtatggagaaaaaaatgggatcccttactggatcgtgaaaaactcttggggtccccagtggggaatgaacgggtacttcctcatcgagcgcggaaagaacatgtgtggcctggctgcctgcgcctcctaccccatccctctggtgtgagccgtggcagccgcagcgcagactggcggagaaggagaggaacgggcagcctgggcctgggtggaaatcctgccctggaggaagttgtggggagatccactgggacccccaacattctgccctcacctctgtgcccagcctggaaacctacagacaaggaggagttccaccatgagctcacccgtgtctatgacgcaaagatcaccagccatgtgccttagtgtccttcttaacagactcaaaccacatggaccacgaatattctttctgtccagaagggctactttccacatatagagctccagggactgtcttttctgtattcgctgttcaataaacattgagtgagcacctccccagat

SEQ ID NO: 441104 - DNA, 1593 bp, Homo sapiens
cgctcccgccgctcctccacgctcgtgccgccccccccgcgctcccagttgacgctctgggccgccacctccgcggaccctgagcgcaagagccaagccgccagcgctgctatgtgggccacgctgccgctgctctgcgccggggcctggctcctgggagtccccgtctgcggtgccgccgaactgtccgtgaactccttaggtacgcagagggcgcgccgcccgagagggtgctagcaggccctagagtggacgctgggagaacttggccagggcgcactgggctccggaggaacggggcagagctttccccgagaagtttcacttcaagtcatggatgtctaagcaccgtaagacctacagtacggaggagtaccaccacaggctgcagacgtttgccagcaactggaggaagataaacgcccacaacaatgggaaccacacatttaaaatggcactgaaccaattttcagacatgagctttgctgaaataaaacacaagtatctctggtcagagcctcagaattgctcagccaccaaaagtaactaccttcgaggtactggtccctacccaccttccgtggactggcggaaaaaaggaaattttgtctcacctgtgaaaaatcagggtgcctgcggcagttgctggactttctccaccactggggccctggagtctgcgatcgccatcgcaaccggaaagatgctgtccttggcggaacagcagctggtggactgcgcccaggacttcaataatcacggctgccaagggggtctccccagccaggctttcgagtatatcctgtacaacaaggggatcatgggtgaagacacctacccctaccagggcaaggatggttattgcaagttccaacctggaaaggccatcggctttgtcaaggatgtagccaacatcacaatctatgacgaggaagcgatggtggaggctgtggccctctacaaccctgtgagctttgcctttgaggtgactcaggacttcatgatgtatagaacgggcatctactccagtacttcctgccataaaactccagataaagtaaaccatgcagtactggctgttgggtatggagaaaaaaatgggatcccttactggatcgtgaaaaactcttggggtccccagtggggaatgaacgggtacttcctcatcgagcgcggaaagaacatgtgtggcctggctgcctgcgcctcctaccccatccctctggtgtgagccgtggcagccgcagcgcagactggcggagaaggagaggaacgggcagcctgggcctgggtggaaatcctgccctggaggaagttgtggggagatccactgggacccccaacattctgccctcacctctgtgcccagcctggaaacctacagacaaggaggagttccaccatgagctcacccgtgtctatgacgcaaagatcaccagccatgtgccttagtgtccttcttaacagactcaaaccacatggaccacgaatattctttctgtccagaagggctactttccacatatagagctccagggactgtcttttctgtattcgctgttcaataaacattgagtgagcacctccccagat

SEQ ID NO: 441105 - DNA, 1839 bp, Homo sapiens
acacgaaacgatctagccaattaggctaggtagaggctggggttgaatcggacgaggacgctctgggccgccacctccgcggaccctgagcgcaagagccaagccgccagcgctgctatgtgggccacgctgccgctgctctgcgccggggcctggctcctgggagtccccgtctgcggtgccgccgaactgtccgtgaactccttaggtacgcagagggcgcgccgcccgagagggtgctagcaggccctagagtggacgctgggagaacttggccagggcgcactgggctccggaggaacggggcagagctttccccggtgagaggccaggaactctgcgtgctggcacggggaggggtaaactgcattataggcgggggttctcggagggtgggcggcttgtaggaccagaggagcagatgggctgagtgtccagggtcccacctagccaggtggctctccagcctagaataccaaaggagcccgcagctccttccgccttcctcaactggggacacagagtgtcacacagaggactctgatctgtccctgccagagagaagtttcacttcaagtcatggatgtctaagcaccgtaagacctacagtacggaggagtaccaccacaggctgcagacgtttgccagcaactggaggaagataaacgcccacaacaatgggaaccacacatttaaaatggcactgaaccaattttcagacatgagctttgctgaaataaaacacaagtatctctggtcagagcctcagaattgctcagccaccaaaagtaactaccttcgaggtactggtccctacccaccttccgtggactggcggaaaaaaggaaattttgtctcacctgtgaaaaatcagggtgcctgcggcagttgctggactttctccaccactggggccctggagtctgcgatcgccatcgcaaccggaaagatgctgtccttggcggaacagcagctggtggactgcgcccaggacttcaataatcacggctgccaagggggtctccccagccaggctttcgagtatatcctgtacaacaaggggatcatgggtgaagacacctacccctaccagggcaaggatggttattgcaagttccaacctggaaaggccatcggctttgtcaaggatgtagccaacatcacaatctatgacgaggaagcgatggtggaggctgtggccctctacaaccctgtgagctttgcctttgaggtgactcaggacttcatgatgtatagaacgggcatctactccagtacttcctgccataaaactccagataaagtaaaccatgcagtactggctgttgggtatggagaaaaaaatgggatcccttactggatcgtgaaaaactcttggggtccccagtggggaatgaacgggtacttcctcatcgagcgcggaaagaacatgtgtggcctggctgcctgcgcctcctaccccatccctctggtgtgagccgtggcagccgcagcgcagactggcggagaaggagaggaacgggcagcctgggcctgggtggaaatcctgccctggaggaagttgtggggagatccactgggacccccaacattctgccctcacctctgtgcccagcctggaaacctacagacaaggaggagttccaccatgagctcacccgtgtctatgacgcaaagatcaccagccatgtgccttagtgtccttcttaacagactcaaaccacatggaccacgaatattctttctgtccagaagggctactttccacatatagagctccagggactgtcttttctgtattcgctgttcaataaacattgagtgagcacctccccagat

SEQ ID NO: 441106 - DNA, 1869 bp, Homo sapiens
cgctcccgccgctcctccacgctcgtgccgccccccccgcgctcccagttgacgctctgggccgccacctccgcggaccctgagcgcaagagccaagccgccagcgctgctatgtgggccacgctgccgctgctctgcgccggggcctggctcctgggagtccccgtctgcggtgccgccgaactgtccgtgaactccttagagaagtttcacttcaagtcatggatgtctaagcaccgtaagacctacagtacggaggagtaccaccacaggctgcagacgtttgccagcaactggaggaagataaacgcccacaacaatgggaaccacacatttaaaatggcactgaaccaattttcagacatgagctttgctgaaataaaacacaagtatctctggtcagagcctcagaattgctcagccaccaaaagtaactaccttcgaggtactggtccctacccaccttccgtggactggcggaaaaaaggaaattttgtctcacctgtgaaaaatcagggtgcctgcggcagttgctggactttctccaccactggggccctggagtctgcgatcgccatcgcaaccggaaagatgctgtccttggcggaacagcagctggtggactgcgcccaggacttcaataatcacggctgccaagggggtctccccagccaggctttcgagtatatcctgtacaacaaggggatcatgggtgaagacacctacccctaccagggcaaggatggttattgcaagttccaacctggaaaggccatcggctttgtcaaggatgtagccaacatcacaatctatgacgaggaagcgatggtggaggctgtggccctctacaaccctgtgagctttgcctttgaggtgactcaggacttcatgatgtatagaacgggcatctactccagtacttcctgccataaaactccagataaagtaaaccatgcagtactggctgttgggtatggagaaaaaaatgggatcccttactggatcgtgaaaaactcttggggtccccagtggggaatgaacgggtacttcctcatcgagcgcggaaagaacatgtgtggcctggctgcctgcgcctcctaccccatccctctggtgtgagccgtggcagccgcagcgcagactggcggagaaggagaggaacgggcagcctgggcctgggtggaaatcctgccctggaggaagttgtggggagatccactgggacccccaacattctgccctcacctctgtgcccagcctggaaacctacagacaaggaggagttccaccatgagctcacccgtgtctatgacgcaaagatcaccagccatgtgccttagtgtccttcttaacagactcaaaccacatggaccacgaatattctttctgtccagaagggctactttccacatatagagctccagggactgtcttttctgtattcgctgttcaataaacattgagtgagcacctccccagatggagcatgctggtcctgggccatgactcaaaccaggtctgtcctcgccactcagtctcccaggagggaggcatcagggggtgtccaggctctggctgggaggatggtgggggtgctggcggtattatccaccagatggggtatccaggatgaagagcaggcttaatttgagatcttgactatttgtcccaaaccttttgagaaatcttgatctctgtttagagggcggccatgaagttgctgctgcttcctgaagcctccgggctctgggatgtctgtagaacaagctggagtccaccagctctttgtcctatggctcacagactttcttaatgataaaagctgtcatcttatttgggcttcctgaaaagctaaaggcttgagaatat

SEQ ID NO: 441107 - DNA, 2238 bp, Homo sapiens
  misc_feature (2238)..(2238): n is a, c, g, or t
cgctcccgccgctcctccacgctcgtgccgccccccccgcgctcccagttgacgctctgggccgccacctccgcggaccctgagcgcaagagccaagccgccagcgctgctatgtgggccacgctgccgctgctctgcgccggggcctggctcctgggagtccccgtctgcggtgccgccgaactgtccgtgaactccttagagaagtttcacttcaagtcatggatgtctaagcaccgtaagacctacagtacggaggagtaccaccacaggctgcagacgtttgccagcaactggaggaagataaacgcccacaacaatgggaaccacacatttaaaatggcactgaaccaattttcagacatgagctttgctgaaataaaacacaagtatctctggtcagagcctcagaattgctcagccaccaaaagtaactaccttcgaggtactggtccctacccaccttccgtggactggcggaaaaaaggaaattttgtctcacctgtgaaaaatcagggtgcctgcggcagttgctggactttctccaccactggggccctggagtctgcgatcgccatcgcaaccggaaagatgctgtccttggcggaacagcagctggtggactgcgcccaggacttcaataatcacggctgccaagggggtctccccagccaggctttcgagtatatcctgtacaacaaggggatcatgggtgaagacacctacccctaccagggcaaggatggttattgcaagttccaacctggaaaggccatcggctttgtcaaggatgtagccaacatcacaatctatgacgaggaagcgatggtggaggctgtggccctctacaaccctgtgagctttgcctttgaggtgactcaggacttcatgatgtatagaacgggcatctactccagtacttcctgccataaaactccagataaagtaaaccatgcagtactggctgttgggtatggagaaaaaaatgggatcccttactggatcgtgaaaaactcttggggtccccagtggggaatgaacgggtacttcctcatcgagcgcggaaagaacatgtgtggcctggctgcctgcgcctcctaccccatccctctggtgtgagccgtggcagccgcagcgcagactggcggagaaggagaggaacgggcagcctgggcctgggtggaaatcctgccctggaggaagttgtggggagatccactgggacccccaacattctgccctcacctctgtgcccagcctggaaacctacagacaaggaggagttccaccatgagctcacccgtgtctatgacgcaaagatcaccagccatgtgccttagtgtccttcttaacagactcaaaccacatggaccacgaatattctttctgtccagaagggctactttccacatatagagctccagggactgtcttttctgtattcgctgttcaataaacattgagtgagcacctccccagataaaaaaaaaaaaaaaaaaaaaaaaaaaaaaaaaagggggggccctctcaaaagtttctcccccggggggcccaggtttccggcgtaccccagcctttcgtgtcaccaagggggcccccatatagggagctcgccactcatctacagcctacggccacgggcccgacgcgattaacaacgcgccgggacacggggaaaacacggcacacccgggggaactctgggcaagggacccttaccccgcgagcggggcgggcaccacaagatgggggacacaacccacaccccaagacagaagaactctcacacgcgccccctaaggggcacaactactaacacctcccacacccgcggccacaacagggcgctcaaacccctcagccgcgcccaaacgcgcctggcccgccccccgacacacgtccggcgcccccacccggactctctgacatcgccacggcaacgacgctcttgtactcaccccggggacccaccggccgcacaaaacgccccccgcccccacccccaccccgccgcccccccccccccaccccccccgccccccccgagcaccccaccgtggcgcggcagacgcaccccccccccacagctgccacaaacacacgcccgcgaagacacagaccaccacccgcccccgccaacgaccccaacgccacaggcacccgctgccgccaacggccacacgacggccgacccgccccccctgcccccccccgcacgcccacagcccccaccccccn

SEQ ID NO: 441108 - DNA, 1944 bp, Homo sapiens
  misc_feature (1519)..(1519): n is a, c, g, or t
cgctcccgccgctcctccacgctcgtgccgccccccccgcgctcccagttgacgctctgggccgccacctccgcggaccctgagcgcaagagccaagccgccagcgctgctatgtgggccacgctgccgctgctctgcgccggggcctggctcctgggagtccccgtctgcggtgccgccgaactgtccgtgaactccttagagaagtttcacttcaagtcatggatgtctaagcaccgtaagacctacagtacggaggagtaccaccacaggctgcagacgtttgccagcaactggaggaagataaacgcccacaacaatgggaaccacacatttaaaatggcactgaaccaattttcagacatgagctttgctgaaataaaacacaagtatctctggtcagagcctcagaattgctcagccaccaaaagtaactaccttcgaggtactggtccctacccaccttccgtggactggcggaaaaaaggaaattttgtctcacctgtgaaaaatcagggtgcctgcggcagttgctggactttctccaccactggggccctggagtctgcgatcgccatcgcaaccggaaagatgctgtccttggcggaacagcagctggtggactgcgcccaggacttcaataatcacggctgccaagggggtctccccagccaggctttcgagtatatcctgtacaacaaggggatcatgggtgaagacacctacccctaccagggcaaggatggttattgcaagttccaacctggaaaggccatcggctttgtcaaggatgtagccaacatcacaatctatgacgaggaagcgatggtggaggctgtggccctctacaaccctgtgagctttgcctttgaggtgactcaggacttcatgatgtatagaacgggcatctactccagtacttcctgccataaaactccagataaagtaaaccatgcagtactggctgttgggtatggagaaaaaaatgggatcccttactggatcgtgaaaaactcttggggtccccagtggggaatgaacgggtacttcctcatcgagcgcggaaagaacatgtgtggcctggctgcctgcgcctcctaccccatccctctggtgtgagccgtggcagccgcagcgcagactggcggagaaggagaggaacgggcagcctgggcctgggtggaaatcctgccctggaggaagttgtggggagatccactgggacccccaacattctgccctcacctctgtgcccagcctggaaacctacagacaaggaggagttccaccatgagctcacccgtgtctatgacgcaaagatcaccagccatgtgccttagtgtccttcttaacagactcaaaccacatggaccacgaatattctttctgtccagaagggctactttccacatatagagctccagggactgtcttttctgtattcgctgttcaataaacattgagtgagcacctccccagataaaaaaaaaaaaaaaaaaaaaaaaaaaaaaaaaaaaanaaaaaaaaaaaaaaaaaaaaaagaaaaaaaaaaaggggggggagggtaaaaaaataacccacgagaggggacacaaaggaagcgcacgcccagattgtagtacacagagcgggcccaaaaagaggcgcgataaaaaaagagagaaggggacacaataaaaaaagcggcgggggagaaaaacagaaaagagggacacagtgggagagcagcaccacaaatctgtctgggggggcggcacaaaatatcggtggggagaaccaacctcactccgaaagaggattttatcccggcaagtggaggagaacaatagtaagaactatagaggttaataattatgggtggtaacacaaggggaaaagataagcacgggatggaacaaaagattgtgcaatgcaagggaataatgtaaggaaagaatttttacg

SEQ ID NO: 441109 - DNA, 1568 bp, Homo sapiens
cgctcccgccgctcctccacgctcgtgccgccccccccgcgctcccagttgacgctctgggccgccacctccgcggaccctgagcgcaagagccaagccgccagcgctgctatgtgggccacgctgccgctgctctgcgccggggcctggctcctgggagtccccgtctgcggtgccgccgaactgtccgtgaactccttagagaagtttcacttcaagtcatggatgtctaagcaccgtaagacctacagtacggaggagtaccaccacaggctgcagacgtttgccagcaactggaggaagataaacgcccacaacaatgggaaccacacatttaaaatggcactgaaccaattttcagacatgagctttgctgaaataaaacacaagtatctctggtcagagcctcagaattgctcagccaccaaaagtaactaccttcgaggtactggtccctacccaccttccgtggactggcggaaaaaaggaaattttgtctcacctgtgaaaaatcagggtgcctgcggcagttgctggactttctccaccactggggccctggagtctgcgatcgccatcgcaaccggaaagatgctgtccttggcggaacagcagctggtggactgcgcccaggacttcaataatcacggctgccaagggggtctccccagccaggctttcgagtatatcctgtacaacaaggggatcatgggtgaagacacctacccctaccagggcaaggatggttattgcaagttccaacctggaaaggccatcggctttgtcaaggatgtagccaacatcacaatctatgacgaggaagcgatggtggaggctgtggccctctacaaccctgtgagctttgcctttgaggtgactcaggacttcatgatgtatagaacgggcatctactccagtacttcctgccataaaactccagataaagtaaaccatgcagtactggctgttgggtatggagaaaaaaatgggatcccttactggatcgtgaaaaactcttggggtccccagtggggaatgaacgggtacttcctcatcgagcgcggaaagaacatgtgtggcctggctgcctgcgcctcctaccccatccctctggtgtgagccgtggcagccgcagcgcagactggcggagaaggagaggaacgggcagcctgggcctgggtggaaatcctgccctggaggaagttgtggggagatccactgggacccccaacattctgccctcacctctgtgcccagcctggaaacctacagacaaggaggagttccaccatgagctcacccgtgtctatgacgcaaagatcaccagccatgtgccttagtgtccttcttaacagactcaaaccacatggaccacgaatattctttctgtccagaagggctactttccacaacttctaaggttaagcttaaccttagaagttgtggtgatagcattgctttcgtgtaaattatgtaatgcaaaatgtttttaatcttcgccttaatacttgttttattttgttttattttgaatgatgagccttcgtgcccccccttccccctgttgt

SEQ ID NO: 441110 - DNA, 1392 bp, Homo sapiens
cgctcccgccgctcctccacgctcgtgccgccccccccgcgctcccagttgacgctctgggccgccacctccgcggaccctgagcgcaagagccaagccgccagcgctgctatgtgggccacgctgccgctgctctgcgccggggcctggctcctgggagtccccgtctgcggtgccgccgaactgtccgtgaactccttagagaagtttcacttcaagtcatggatgtctaagcaccgtaagacctacagtacggaggagtaccaccacaggctgcagacgtttgccagcaactggaggaagataaacgcccacaacaatgggaaccacacatttaaaatggcactgaaccaattttcagacatgagctttgctgaaataaaacacaagtatctctggtcagagcctcagaattgctcagccaccaaaagtaactaccttcgaggtactggtccctacccaccttccgtggactggcggaaaaaaggaaattttgtctcacctgtgaaaaatcagggtgcctgcggcagttgctggactttctccaccactggggccctggagtctgcgatcgccatcgcaaccggaaagatgctgtccttggcggaacagcagctggtggactgcgcccaggacttcaataatcacggctgccaagggggtctccccagccaggctttcgagtatatcctgtacaacaaggggatcatgggtgaagacacctacccctaccagggcaaggatggttattgcaagttccaacctggaaaggccatcggctttgtcaaggatgtagccaacatcacaatctatgacgaggaagcgatggtggaggctgtggccctctacaaccctgtgagctttgcctttgaggtgactcaggacttcatgatgtatagaacgggcatctactccagtacttcctgccataaaactccagataaagtaaaccatgcagtactggctgttgggtatggagaaaaaaatgggatcccttactggatcgtgaaaaactcttggggtccccagtggggaatgaacgggtacttcctcatcgagcgcggaaagaacatgggcagcctgggcctgggtggaaatcctgccctggaggaagttgtggggagatccactgggacccccaacattctgccctcacctctgtgcccagcctggaaacctacagacaaggaggagttccaccatgagctcacccgtgtctatgacgcaaagatcaccagccatgtgccttagtgtccttcttaacagactcaaaccacatggaccacgaatattctttctgtccagaagggctactttccacatatagagctccagggactgtcttttctgtattcgctgttcaataaacattgagtgagcacctccccagat

SEQ ID NO: 441111 - DNA, 1185 bp, Homo sapiens
  misc_feature (396)..(396): n is a, c, g, or t
cctcacagacgcgcccgcacacaatacagagtgagcatgaacctcggcaggacctcagtctgcctgagggaaccaggttggcacctccaccagtgtccgggcagggcggtgctatccctggggacatgaatgccagccctgtcatcagctcctccccactcaggtctgaagctcagggccaagcctccctctctggatctgtcagcagctctggcaccaggcaggaagacgaccttccctggagatgcccctgggccacggcccacagagctcaggagcctcagccagccacgtgggcatccactccttttcctgcaagagatgatggttccattgctcttggcttcatggtgttcctggaaggcagatgagctggtcatttacagactgcgcccnggacttcaataatcacggctgccaagggggtctccccagccagggcaaggatggttattgcaagttccaacctggaaaggccatcggctttgtcaaggatgtagccaacatcacaatctatgacgaggaagcgatggtggaggctgtggccctctacaaccctgtgagctttgcctttgaggtgactcaggacttcatgatgtatagaacgggcatctactccagtacttcctgccataaaactccagataaagtaaaccatgcagtactggctgttgggtatggagaaaaaaatgggatcccttactggatcgtgaaaaactcttggggtccccagtggggaatgaacgggtacttcctcatcgagcgcggaaagaacatgtgtggcctggctgcctgcgcctcctaccccatccctctggtgtgagccgtggcagccgcagcgcagactggcggagaaggagaggaacgggcagcctgggcctgggtggaaatcctgccctggaggaagttgtggggagatccactgggacccccaacattctgccctcacctctgtgcccagcctggaaacctacagacaaggaggagttccaccatgagctcacccgtgtctatgacgcaaagatcaccagccatgtgccttagtgtccttcttaacagactcaaaccacatggaccacgaatattctttctgtccagaagggctactttccacatatagagctccagggactgtcttttctgtattcgctgttcaataaacattgagtgagcacctccccagat

SEQ ID NO: 441112 - DNA, 1148 bp, Homo sapiens
acacgaaacgatctagccaattaggctaggtagaggctggggttgaatcggacgaggacgctctgggccgccacctccgcggaccctgagcgcaagagccaagccgccagcgctgctatgtgggccacgctgccgctgctctgcgccggggcctggctcctgggagtccccgtctgcggtgccgccgaactgtccgtgaactccttagagaagtttcacttcaagtcatggatgtctaagcaccgtaagacctacagtacggaggagtaccaccacaggctgcagacgtttgccagcaactggaggaagataaacgcccacaacaatgggaaccacacatttaaaatggcactgaaccaattttcagacatgagctttgctgaaataaaacacaagtatctctggtcagagcctcaggtaggtataattcattgcaaccaaatctgaatccttttactgaaacctttggaataaatttggagcctgctctgcttctaggcagattcagtcccatccccagatgcagctgagggtatccccagattctttgggggaaccagaagagtcagctctcagcagttcctcagtccaggcccatggccttagcattgtggacccttaacttagggctaccagattaaaatatagatactcagttaaaaatgaatttcagatacacaacaagtaattctttagcataagtatattctaaatattgcacaggatatacttacactacaaagttatttgttgtttacctgaaattcaaatttaactaggtgagctgtatttttatttgctacatctgtctaccctatcctaatgctctggactctcaaggggacatgtcatttagcacttgggaccagtagacaggagagggaaggttctgagagctgcagcctttcttattctctcttggtgattccatgtttatacatttcttcttcttgttgtcagaaaggtttttggttttgtttattttcctgaaaataatgtgtttggttgttccagaattgctcagccaccaaaagtaactaccttcgaggtactggtccctacccaccttccgtggactggcggaaaaaaggaaattttgtctcacctgtgaaaaatcagggtatgcctggcaatctccatcctctccc

SEQ ID NO: 441113 - DNA, 911 bp, Homo sapiens
acacgaaacgatctagccaattaggctaggtagaggctggggttgaatcggacgaggacgctctgggccgccacctccgcggaccctgagcgcaagagccaagccgccagcgctgctatgtgggccacgctgccgctgctctgcgccggggcctggctcctgggagtccccgtctgcggtgccgccgaactgtccgtgaactccttaggtacgcagagggcgcgccgcccgagagggtgctagcaggccctagagtggacgctgggagaacttggccagggcgcactgggctccggaggaacggggcagagctttccccggtgagaggccaggaactctgcgtgctggcacggggaggggtaaactgcattataggcgggggttctcggagggtgggcggcttgtaggaccagaggagcagatgggctgagtgtccagggtcccacctagccaggtggctctccagcctagaataccaaaggagcccgcagctccttccgccttcctcaactggggacacagagtgtcacacagaggactctgatctgtccctgccagagagaagtttcacttcaagtcatggatgtctaaggtcagtgcccaacttcttctttttgaagtttttcatttcacaaagtttcctgttatcaaaccaaactgtcccagatttgagacaatgaaaaagggaatttccaactttgcctagtggggtctttccagaagttgaactggccaaacactgggaaagatgcagttaagtaaattccttccaaatagtggtcccaagtgattaacttggctgacagccttccaagccctgggattcatttctgtattttgttttcaaagcacattgtggagaatgtaaatgagtacaaccattgtaaaaaaaacagtatggaggttccatc

SEQ ID NO: 441114 - DNA, 4409 bp, Homo sapiens
tgtggcaggagatgtagaataccggtggacagacttatacttgcgaatctgcttggcaccagtaaggatccaaatgattgtttttttgttttttgttttgttttgttttgttttgttttgttttaaattgcattgggattaggcaacagaagggtctaatgcggccgggatgagacaggagagtttttaggagggtagctgcattctaagtaagggactctgcggggggaaaagaggcgcaagcgttgcaagaagggagtgcagggggttgagcaggcacctctacaggaaatggatgctgtccaggtgctggtgggcgccccagggctacgtggcgaagcagctcagccggtccaatcagagtgcgtccagggctcgggtttcgcgatctttaagtgactgaggcagatccccacgcggcacctggccatgctctcagctctcccgccgcgggatggtgccttgagtgaatgacccccttggagaacattcttccgcatccctcgcctcaagccagcctcagacagaaaactgaagattcagcagatccagtgcttcctgctcctcttctgcccaggaacacgcttgccttccccaaggcttccagaagctctgaggcaggaggcaccaagttctacctcatgtttggaggatcttgctagctatggccctcgtactcggctccctgttgctgctggggctgtgcgggaactccttttcaggagggcagccttcatccacagatgctcctaaggcttggaattatgaattgcctgcaacaaattatgagacccaagactcccataaagctggacccattggcattctctttgaactagtgcatatctttctctatgtggtacagccgcgtgatttcccagaagatactttgagaaaattcttacagaaggcatatgaatccaaaattgattatgacaagattgtctactatgaagcagggattattctatgctgtgtcctggggctgctgtttattattctgatgcctctggtggggtatttcttttgtatgtgtcgttgctgtaacaaatgtggtggagaaatgcaccagcgacagaaggaaaatgggcccttcctgaggaaatgctttgcaatctccctgttggtgatttgtataataataagcattggcatcttctatggttttgtggcaaatcaccaggtaagaacccggatcaaaaggagtcggaaactggcagatagcaatttcaaggacttgcgaactctcttgaatgaaactccagagcaaatcaaatatatattggcccagtacaacactaccaaggacaaggcgttcacagatctgaacagtatcaattcagtgctaggaggcggaattcttgaccgactgagacccaacatcatccctgttcttgatgagattaagtccatggcaacagcgatcaaggagaccaaagaggcgttggagaacatgaacagcaccttgaagagcttgcaccaacaaagtacacagcttagcagcagtctgaccagcgtgaaaactagcctgcggtcatctctcaatgaccctctgtgcttggtgcatccatcaagtgaaacctgcaacagcatcagattgtctctaagccagctgaatagcaaccctgaactgaggcagcttccacccgtggatgcagaacttgacaacgttaataacgttcttaggacagatttggatggcctggtccaacagggctatcaatcccttaatgatatacctgacagagtacaacgccaaaccacgactgtcgtagcaggtatcaaaagggtcttgaattccattggttcagatatcgacaatgtaactcagcgtcttcctattcaggatatactctcagcattctctgtttatgttaataacactgaaagttacatccacagaaatttacctacattggaagagtatgattcatactggtggctgggtggcctggtcatctgctctctgctgaccctcatcgtgattttttactacctgggcttactgtgtggcgtgtgcggctatgacaggcatgccaccccgaccacccgaggctgtgtctccaacaccggaggcgtcttcctcatggttggagttggattaagtttcctcttttgctggatattgatgatcattgtggttcttacctttgtctttggtgcaaatgtggaaaaactgatctgtgaaccttacacgagcaaggaattattccgggttttggatacaccctacttactaaatgaagactgggaatactatctctctgggaagctatttaataaatcaaaaatgaagctcacttttgaacaagtttacagtgactgcaaaaaaaatagaggcacttacggcactcttcacctgcagaacagcttcaatatcagtgaacatctcaacattaatgagcatactggaagcataagcagtgaattggaaagtctgaaggtaaatcttaatatctttctgttgggtgcagcaggaagaaaaaaccttcaggattttgctgcttgtggaatagacagaatgaattatgacagctacttggctcagactggtaaatcccccgcaggagtgaatcttttatcatttgcatatgatctagaagcaaaagcaaacagtttgcccccaggaaatttgaggaactccctgaaaagagatgcacaaactattaaaacaattcaccagcaacgagtccttcctatagaacaatcactgagcactctataccaaagcgtcaagatacttcaacgcacagggaatggattgttggagagagtaactaggattctagcttctctggattttgctcagaacttcatcacaaacaatacttcctctgttattattgaggaaactaagaagtatgggagaacaataataggatattttgaacattatctgcagtggatcgagttctctatcagtgagaaagtggcatcgtgcaaacctgtggccaccgctctagatactgctgttgatgtctttctgtgtagctacattatcgaccccttgaatttgttttggtttggcataggaaaagctactgtatttttacttccggctctaatttttgcggtaaaactggctaagtactatcgtcgaatggattcggaggacgtgtacgatgatgttgaaactatacccatgaaaaatatggaaaatggtaataatggttatcataaagatcatgtatatggtattcacaatcctgttatgacaagcccatcacaacattgatagctgatgttgaaactgcttgagcatcaggatactcaaagtggaaaggatcacagatttttggtagtttctgggtctacaaggactttccaaatccaggagcaacgccagtggcaacgtagtgactcaggcgggcaccaaggcaacggcaccattggtctctgggtagtgctttaagaatgaacacaatcacgttatagtccatggtccatcactattcaaggatgactccctcccttcctgtctatttttgttttttacttttttacactgagtttctatttagacactacaacatatggggtgtttgttcccattggatgcatttctatcaaaactctatcaaatgtgatggctagattctaacatattgccatgtgtggagtgtgctgaacacacaccagtttacaggaaagatgcattttgtgtacagtaaacggtgtatataccttttgttaccacagagttttttaaacaaatgagtattataggactttcttctaaatgagctaaataagtcaccattgacttcttggtgctgttgaaaataatccattttcactaaaagtgtgtgaaacctacagcatattcttcacgcagagattttcatctattatactttatcaaagattggccatgttccacttggaaatggcatgcaaaagccatcatagagaaacctgcgtaactccatctgacaaattcaaaagagagagagagatcttgagagagaaatgctgttcgttcaaaagtggagttgttttaacagatgccaattacggtgtacagtttaacagagttttctgttgcattaggataaacattaattggagtgcagctaacatgagtatcatcagactagtatcaagtgttctaaaatgaaatatgagaagatcctgtcacaattcttagatctggtgtccagcatggatgaaacctttgagtttggtccctaaatttgcatgaaagcacaaggtaaatattcatttgcttcaggagtttcatgttggatctgtcattatcaaaagtgatcagcaatgaagaactggtcggacaaaatttaacgttgatgtaatggaattccagatgtaggcattccccccaggtcttttcatgtgcagattgcagttctgattcatttgaataaaaaggaacttggaaaaaaaaaaaaaaa

SEQ ID NO: 441115 - DNA, 4436 bp, Homo sapiens
tgtggcaggagatgtagaataccggtggacagacttatacttgcgaatctgcttggcaccagtaaggatccaaatgattgtttttttgttttttgttttgttttgttttgttttgttttgttttaaattgcattgggattaggcaacagaagggtctaatgcggccgggatgagacaggagagtttttaggagggtagctgcattctaagtaagggactctgcggggggaaaagaggcgcaagcgttgcaagaagggagtgcagggggttgagcaggcacctctacaggaaatggatgctgtccaggtgctggtgggcgccccagggctacgtggcgaagcagctcagccggtccaatcagagtgcgtccagggctcgggtttcgcgatctttaagtgactgaggcagatccccacgcggcacctggccatgctctcagctctcccgccgcgggatggtgccttgagtgaatgacccccttggagaacattcttccgcatccctcgcctcaagccagcctcagacagaaaactgaagattcagcagatccagtgcttcctgctcctcttctgcccaggaacacgcttgccttccccaaggcttccagaagctctgaggcaggaggcaccaagttctacctcatgtttggaggatcttgctagctatggccctcgtactcggctccctgttgctgctggggctgtgcgggaactccttttcaggagggcagccttcatccacagatgctcctaaggcttggaattatgaattgcctgcaacaaattatgagacccaagactcccataaagctggacccattggcattctctttgaactagtgcatatctttctctatgtggtacagccgcgtgatttcccagaagatactttgagaaaattcttacagaaggcatatgaatccaaaattgattatgacaagccagaaactgtaatcttaggtctaaagattgtctactatgaagcagggattattctatgctgtgtcctggggctgctgtttattattctgatgcctctggtggggtatttcttttgtatgtgtcgttgctgtaacaaatgtggtggagaaatgcaccagcgacagaaggaaaatgggcccttcctgaggaaatgctttgcaatctccctgttggtgatttgtataataataagcattggcatcttctatggttttgtggcaaatcaccaggtaagaacccggatcaaaaggagtcggaaactggcagatagcaatttcaaggacttgcgaactctcttgaatgaaactccagagcaaatcaaatatatattggcccagtacaacactaccaaggacaaggcgttcacagatctgaacagtatcaattcagtgctaggaggcggaattcttgaccgactgagacccaacatcatccctgttcttgatgagattaagtccatggcaacagcgatcaaggagaccaaagaggcgttggagaacatgaacagcaccttgaagagcttgcaccaacaaagtacacagcttagcagcagtctgaccagcgtgaaaactagcctgcggtcatctctcaatgaccctctgtgcttggtgcatccatcaagtgaaacctgcaacagcatcagattgtctctaagccagctgaatagcaaccctgaactgaggcagcttccacccgtggatgcagaacttgacaacgttaataacgttcttaggacagatttggatggcctggtccaacagggctatcaatcccttaatgatatacctgacagagtacaacgccaaaccacgactgtcgtagcaggtatcaaaagggtcttgaattccattggttcagatatcgacaatgtaactcagcgtcttcctattcaggatatactctcagcattctctgtttatgttaataacactgaaagttacatccacagaaatttacctacattggaagagtatgattcatactggtggctgggtggcctggtcatctgctctctgctgaccctcatcgtgattttttactacctgggcttactgtgtggcgtgtgcggctatgacaggcatgccaccccgaccacccgaggctgtgtctccaacaccggaggcgtcttcctcatggttggagttggattaagtttcctcttttgctggatattgatgatcattgtggttcttacctttgtctttggtgcaaatgtggaaaaactgatctgtgaaccttacacgagcaaggaattattccgggttttggatacaccctacttactaaatgaagactgggaatactatctctctgggaagctatttaataaatcaaaaatgaagctcacttttgaacaagtttacagtgactgcaaaaaaaatagaggcacttacggcactcttcacctgcagaacagcttcaatatcagtgaacatctcaacattaatgagcatactggaagcataagcagtgaattggaaagtctgaaggtaaatcttaatatctttctgttgggtgcagcaggaagaaaaaaccttcaggattttgctgcttgtggaatagacagaatgaattatgacagctacttggctcagactggtaaatcccccgcaggagtgaatcttttatcatttgcatatgatctagaagcaaaagcaaacagtttgcccccaggaaatttgaggaactccctgaaaagagatgcacaaactattaaaacaattcaccagcaacgagtccttcctatagaacaatcactgagcactctataccaaagcgtcaagatacttcaacgcacagggaatggattgttggagagagtaactaggattctagcttctctggattttgctcagaacttcatcacaaacaatacttcctctgttattattgaggaaactaagaagtatgggagaacaataataggatattttgaacattatctgcagtggatcgagttctctatcagtgagaaagtggcatcgtgcaaacctgtggccaccgctctagatactgctgttgatgtctttctgtgtagctacattatcgaccccttgaatttgttttggtttggcataggaaaagctactgtatttttacttccggctctaatttttgcggtaaaactggctaagtactatcgtcgaatggattcggaggacgtgtacgatgatgttgaaactatacccatgaaaaatatggaaaatggtaataatggttatcataaagatcatgtatatggtattcacaatcctgttatgacaagcccatcacaacattgatagctgatgttgaaactgcttgagcatcaggatactcaaagtggaaaggatcacagatttttggtagtttctgggtctacaaggactttccaaatccaggagcaacgccagtggcaacgtagtgactcaggcgggcaccaaggcaacggcaccattggtctctgggtagtgctttaagaatgaacacaatcacgttatagtccatggtccatcactattcaaggatgactccctcccttcctgtctatttttgttttttacttttttacactgagtttctatttagacactacaacatatggggtgtttgttcccattggatgcatttctatcaaaactctatcaaatgtgatggctagattctaacatattgccatgtgtggagtgtgctgaacacacaccagtttacaggaaagatgcattttgtgtacagtaaacggtgtatataccttttgttaccacagagttttttaaacaaatgagtattataggactttcttctaaatgagctaaataagtcaccattgacttcttggtgctgttgaaaataatccattttcactaaaagtgtgtgaaacctacagcatattcttcacgcagagattttcatctattatactttatcaaagattggccatgttccacttggaaatggcatgcaaaagccatcatagagaaacctgcgtaactccatctgacaaattcaaaagagagagagagatcttgagagagaaatgctgttcgttcaaaagtggagttgttttaacagatgccaattacggtgtacagtttaacagagttttctgttgcattaggataaacattaattggagtgcagctaacatgagtatcatcagactagtatcaagtgttctaaaatgaaatatgagaagatcctgtcacaattcttagatctggtgtccagcatggatgaaacctttgagtttggtccctaaatttgcatgaaagcacaaggtaaatattcatttgcttcaggagtttcatgttggatctgtcattatcaaaagtgatcagcaatgaagaactggtcggacaaaatttaacgttgatgtaatggaattccagatgtaggcattccccccaggtcttttcatgtgcagattgcagttctgattcatttgaataaaaaggaacttggaaaaaaaaaaaaaaa

SEQ ID NO: 441116 - DNA, 3517 bp, Homo sapiens
tgtggcaggagatgtagaataccggtggacagacttatacttgcgaatctgcttggcaccagtaaggatccaaatgattgtttttttgttttttgttttgttttgttttgttttgttttgttttaaattgcattgggattaggcaacagaagggtctaatgcggccgggatgagacaggagagtttttaggagggtagctgcattctaagtaagggactctgcggggggaaaagaggcgcaagcgttgcaagaagggagtgcagggggttgagcaggcacctctacaggaaatggatgctgtccaggtgctggtgggcgccccagggctacgtggcgaagcagctcagccggtccaatcagagtgcgtccagggctcgggtttcgcgatctttaagtgactgaggcagatccccacgcggcacctggccatgctctcagctctcccgccgcgggatggtgccttgagtgaatgacccccttggagaacattcttccgcatccctcgcctcaagccagcctcagacagaaaactgaagattcagcagatccagtgcttcctgctcctcttctgcccaggaacacgcttgccttccccaaggcttccagaagctctgaggcaggaggcaccaagttctacctcatgtttggaggatcttgctagctatggccctcgtactcggctccctgttgctgctggggctgtgcgggaactccttttcaggagggcagccttcatccacagatgctcctaaggcttggaattatgaattgcctgcaacaaattatgagacccaagactcccataaagctggacccattggcattctctttgaactagtgcatatctttctctatgtggtacagccgcgtgatttcccagaagatactttgagaaaattcttacagaaggcatatgaatccaaaattgattatgacaagattgtctactatgaagcagggattattctatgctgtgtcctggggctgctgtttattattctgatgcctctggtggggtatttcttttgtatgtgtcgttgctgtaacaaatgtggtggagaaatgcaccagcgacagaaggaaaatgggcccttcctgaggaaatgctttgcaatctccctgttggtgatttgtataataataagcattggcatcttctatggttttgtggcaaatcaccaggtaagaacccggatcaaaaggagtcggaaactggcagatagcaatttcaaggacttgcgaactctcttgaatgaaactccagagcaaatcaaatatatattggcccagtacaacactaccaaggacaaggcgttcacagatctgaacagtatcaattcagtgctaggaggcggaattcttgaccgactgagacccaacatcatccctgttcttgatgagattaagtccatggcaacagcgatcaaggagaccaaagaggcgttggagaacatgaacagcaccttgaagagcttgcaccaacaaagtacacagcttagcagcagtctgaccagcgtgaaaactagcctgcggtcatctctcaatgaccctctgtgcttggtgcatccatcaagtgaaacctgcaacagcatcagattgtctctaagccagctgaatagcaaccctgaactgaggcagcttccacccgtggatgcagaacttgacaacgttaataacgttcttaggacagatttggatggcctggtccaacagggctatcaatcccttaatgatatacctgacagagtacaacgccaaaccacgactgtcgtagcaggtatcaaaagggtcttgaattccattggttcagatatcgacaatgtaactcagcgtcttcctattcaggatatactctcagcattctctgtttatgttaataacactgaaagttacatccacagaaatttacctacattggaagagtatgattcatactggtggctgggtggcctggtcatctgctctctgctgaccctcatcgtgattttttactacctgggcttactgtgtggcgtgtgcggctatgacaggcatgccaccccgaccacccgaggctgtgtctccaacaccggaggcgtcttcctcatggttggagttggattaagtttcctcttttgctggatattgatgatcattgtggttcttacctttgtctttggtgcaaatgtggaaaaactgatctgtgaaccttacacgagcaaggaattattccgggttttggatacaccctacttactaaatgaagactgggaatactatctctctgggaagctatttaataaatcaaaaatgaagctcacttttgaacaagtttacagtgactgcaaaaaaaatagaggcacttacggcactcttcacctgcagaacagcttcaatatcagtgaacatctcaacattaatgagcatactggaagcataagcagtgaattggaaagtctgaaggtaaatcttaatatctttctgttgggtgcagcaggaagaaaaaaccttcaggattttgctgcttgtggaatagacagaatgaattatgacagctacttggctcagactggtaaatcccccgcaggagtgaatcttttatcatttgcatatgatctagaagcaaaagcaaacagtttgcccccaggaaatttgaggaactccctgaaaagagatgcacaaactattaaaacaattcaccagcaacgagtccttcctatagaacaatcactgagcactctataccaaagcgtcaagatacttcaacgcacagggaatggattgttggagagagtaactaggattctagcttctctggattttgctcagaacttcatcacaaacaatacttcctctgttattattgaggaaactaagaagtatgggagaacaataataggatattttgaacattatctgcagtggatcgagttctctatcagtgagaaagtggcatcgtgcaaacctgtggccaccgctctagatactgctgttgatgtctttctgtgtagctacattatcgaccccttgaatttgttttggtttggcataggaaaagctactgtatttttacttccggctctaatttttgcggtaaaactggctaagtactatcgtcgaatggattcggaggacgtgtacgatgatgttgaaactatacccatgaaaaatatggaaaatggtaataatggttatcataaagatcatgtatatggtattcacaatcctgttatgacaagcccatcacaacattgatagctgatgttgaaactgcttgagcatcaggatactcaaagtggaaaggatcacagatttttggtagtttctgggagattaataagtatttagtttaagaaaacatttagtaagcctgtcctgtgttcccacacaaagggtataacagcaatatattccataagagtaaagcaaagtaagtaaagttattccaagtaaactaaattagaaggctttccatgaactgggcaactgttgagaccaagctgatatggggttgctagctgttgcagtgtgcttccg

SEQ ID NO: 441117 - DNA, 295 bp, Homo sapiens
gcctgggtgacagagcgagactccatctcaaaaaaaaaaaaaaaaagaaagtacacattgttaattgtgttggttattttttctagaatgaaaccattacagtgtaaagacagatttgatggctatcttgtgggaagggaggacacaaggtatgtgatcttgctgcttcatgtaataattttggaaatattatctgtttcttgccagagcactctataccaaagcgtcaagatacttcaacgcacagggaatggattgttggtaagggtttactttgttttctgtcatggggttt

SEQ ID NO: 441118 - DNA, 1913 bp, Homo sapiens
cctccgtgcatgtcctcccccaacctcatgtgtctgatgcagcactgcagtgaggcacggtggatcctgcaggttcagaggggttgtgatccacctgaagtcacagtcgggcagggtgtgccagagttgaaactgccgaccttccagatggagttcactagtctccccctggcgtatacctttttggttgtcaaggccattatcacagagtcactttagaggacactagggctactgttgatggttcacccagagagccacttagaggccgtgtgcactgcctgatcttacacccaggaatttgtagttgtaacaaggtccctgcggaacttccatttgcttctgtcttctgtcctagaagtggactttagaaagactcttgtggtagacatgtgtactgctgtgttgctgctggtctaatgtcttcaacacgtattcttagtgactcttaacacttttaaccttagattgtgaatattcacaattcttacttgtcatagtctgtttatcctctttatcttctatgctgtttttaaaagcaatacaaacagaagctagagtaaccagtgttttgtctgacacattcttcttgataaactttatgaggtgtggtttatattcgtctgtacctttagtcacatgcctgcttcttagcacagaggtgatgaaaccacccacagctttgttgggggtattatatttctttatttttttgttttttagcccatcacaacattgatagctgatgttgaaactgcttgagcatcaggatactcaaagtggaaaggatcacagatttttggtagtttctgggtctacaaggactttccaaatccaggagcaacgccagtggcaacgtagtgactcaggcgggcaccaaggcaacggcaccattggtctctgggtagtgctttaagaatgaacacaatcacgttatagtccatggtccatcactattcaaggatgactccctcccttcctgtctatttttgttttttacttttttacactgagtttctatttagacactacaacatatggggtgtttgttcccattggatgcatttctatcaaaactctatcaaatgtgatggctagattctaacatattgccatgtgtggagtgtgctgaacacacaccagtttacaggaaagatgcattttgtgtacagtaaacggtgtatataccttttgttaccacagagttttttaaacaaatgagtattataggactttcttctaaatgagctaaataagtcaccattgacttcttggtgctgttgaaaataatccattttcactaaaagtgtgtgaaacctacagcatattcttcacgcagagattttcatctattatactttatcaaagattggccatgttccacttggaaatggcatgcaaaagccatcatagagaaacctgcgtaactccatctgacaaattcaaaagagagagagagatcttgagagagaaatgctgttcgttcaaaagtggagttgttttaacagatgccaattacggtgtacagtttaacagagttttctgttgcattaggataaacattaattggagtgcagctaacatgagtatcatcagactagtatcaagtgttctaaaatgaaatatgagaagatcctgtcacaattcttagatctggtgtccagcatggatgaaacctttgagtttggtccctaaatttgcatgaaagcacaaggtaaatattcatttgcttcaggagtttcatgttggatctgtcattatcaaaagtgatcagcaatgaagaactggtcggacaaaatttaacgttgatgtaatggaattccagatgtaggcattccccccaggtcttttcatgtgcagattgcagttctgattcatttgaataaaaaggaacttggaaaaaaaaaaaaaaa

SEQ ID NO: 441119 - DNA, 1561 bp, Homo sapiens
cccgctgtcgcggctactgcggaacattttcccgtgcgtcgagcagacaaactgctctgagcgcgatgcagagcgtgtccgcagtacacacttgttgccaccggactatatactgctgtggctgccttaccgtggtgtctacgttatcggccgccgtctagatgactggccggtcgtgtcataggaaaagctactgtatttttacttccggctctaatttttgcggtaaaactggctaagtactatcgtcgaatggattcggaggacgtgtacgatgatgttgaaactatacccatgaaaaatatggaaaatggtaataatggttatcataaagatcatgtatatggtattcacaatcctgttatgacaagcccatcacaacattgatagctgatgttgaaactgcttgagcatcaggatactcaaagtggaaaggatcacagatttttggtagtttctgggtctacaaggactttccaaatccaggagcaacgccagtggcaacgtagtgactcaggcgggcaccaaggcaacggcaccattggtctctgggtagtgctttaagaatgaacacaatcacgttatagtccatggtccatcactattcaaggatgactccctcccttcctgtctatttttgttttttacttttttacactgagtttctatttagacactacaacatatggggtgtttgttcccattggatgcatttctatcaaaactctatcaaatgtgatggctagattctaacatattgccatgtgtggagtgtgctgaacacacaccagtttacaggaaagatgcattttgtgtacagtaaacggtgtatataccttttgttaccacagagttttttaaacaaatgagtattataggactttcttctaaatgagctaaataagtcaccattgacttcttggtgctgttgaaaataatccattttcactaaaagtgtgtgaaacctacagcatattcttcacgcagagattttcatctattatactttatcaaagattggccatgttccacttggaaatggcatgcaaaagccatcatagagaaacctgcgtaactccatctgacaaattcaaaagagagagagagatcttgagagagaaatgctgttcgttcaaaagtggagttgttttaacagatgccaattacggtgtacagtttaacagagttttctgttgcattaggataaacattaattggagtgcagctaacatgagtatcatcagactagtatcaagtgttctaaaatgaaatatgagaagatcctgtcacaattcttagatctggtgtccagcatggatgaaacctttgagtttggtccctaaatttgcatgaaagcacaaggtaaatattcatttgcttcaggagtttcatgttggatctgtcattatcaaaagtgatcagcaatgaagaactggtcggacaaaatttaacgttgatgtaatggaattccagatgtaggcattccccccaggtcttttcatgtgcagattgcagttctgattcatttgaataaaaaggaacttggaaaaaaaaaaaaaaa

SEQ ID NO: 441120 - DNA, 3078 bp, Homo sapiens
tgtggcaggagatgtagaataccggtggacagacttatacttgcgaatctgcttggcaccagtaaggatccaaatgattgtttttttgttttttgttttgttttgttttgttttgttttgttttaaattgcattgggattaggcaacagaagggtctaatgcggccgggatgagacaggagagtttttaggagggtagctgcattctaagtaagggactctgcggggggaaaagaggcgcaagcgttgcaagaagggagtgcagggggttgagcaggcacctctacaggaaatggatgctgtccaggtgctggtgggcgccccagggctacgtggcgaagcagctcagccggtccaatcagagtgcgtccagggctcgggtttcgcgatctttaagtgactgaggcagatccccacgcggcacctggccatgctctcagctctcccgccgcgggatggtgccttgagtgaatgacccccttggagaacattcttccgcatccctcgcctcaagccagcctcagacagaaaactgaagattcagcagatccagtgcttcctgctcctcttctgcccaggaacacgcttgccttccccaaggcttccagaagctctgaggcaggaggcaccaagttctacctcatgtttggaggatcttgctagctatggccctcgtactcggctccctgttgctgctggggctgtgcgggaactccttttcaggagggcagccttcatccacagatgctcctaaggcttggaattatgaattgcctgcaacaaattatgagacccaagactcccataaagctggacccattggcattctctttgaactagtgcatatctttctctatgtggtacagccgcgtgatttcccagaagatactttgagaaaattcttacagaaggcatatgaatccaaaattgattatgacaagattgtctactatgaagcagggattattctatgctgtgtcctggggctgctgtttattattctgatgcctctggtggggtatttcttttgtatgtgtcgttgctgtaacaaatgtggtggagaaatgcaccagcgacagaaggaaaatgggcccttcctgaggaaatgctttgcaatctccctgttggtgatttgtataataataagcattggcatcttctatggttttgtggcaaatcaccaggtaagaacccggatcaaaaggagtcggaaactggcagatagcaatttcaaggacttgcgaactctcttgaatgaaactccagagcaaatcaaatatatattggcccagtacaacactaccaaggacaaggcgttcacagatctgaacagtatcaattcagtgctaggaggcggaattcttgaccgactgagacccaacatcatccctgttcttgatgagattaagtccatggcaacagcgatcaaggagaccaaagaggcgttggagaacatgaacagcaccttgaagagcttgcaccaacaaagtacacagcttagcagcagtctgaccagcgtgaaaactagcctgcggtcatctctcaatgaccctctgtgcttggtgcatccatcaagtgaaacctgcaacagcatcagattgtctctaagccagctgaatagcaaccctgaactgaggcagcttccacccgtggatgcagaacttgacaacgttaataacgttcttaggacagatttggatggcctggtccaacagggctatcaatcccttaatgatatacctgacagagtacaacgccaaaccacgactgtcgtagcaggtatcaaaagggtcttgaattccattggttcagatatcgacaatgtaactcagcgtcttcctattcaggatatactctcagcattctctgtttatgttaataacactgaaagttacatccacagaaatttacctacattggaagagtatgattcatactggtggctgggtggcctggtcatctgctctctgctgaccctcatcgtgattttttactacctgggcttactgtgtggcgtgtgcggctatgacaggcatgccaccccgaccacccgaggctgtgtctccaacaccggaggcgtcttcctcatggttggagttggattaagtttcctcttttgctggatattgatgatcattgtggttcttacctttgtctttggtgcaaatgtggaaaaactgatctgtgaaccttacacgagcaaggaattattccgggttttggatacaccctacttactaaatgaagactgggaatactatctctctgggaagctatttaataaatcaaaaatgaagctcacttttgaacaagtttacagtgactgcaaaaaaaatagaggcacttacggcactcttcacctgcagaacagcttcaatatcagtgaacatctcaacattaatgagcatactggaagcataagcagtgaattggaaagtctgaaggtaaatcttaatatctttctgttgggtgcagcaggaagaaaaaaccttcaggattttgctgcttgtggaatagacagaatgaattatgacagctacttggctcagactggtaaatcccccgcaggagtgaatcttttatcatttgcatatgatctagaagcaaaagcaaacagtttgcccccaggaaatttgaggaactccctgaaaagagatgcacaaactattaaaacaattcaccagcaacgagtccttcctatagaacaatcactgagcactctataccaaagcgtcaagatacttcaacgcacagggaatggattgttggagagagtaactaggattctagcttctctggattttgctcagaacttcatcacaaacaatacttcctctgttattattgaggaaactaagaagtatgggagaacaataataggatattttgaacattatctgcagtggatcgagttctctgaagtaagtgaaaggacattgatgtgcaggaccaagacttctggggcttcccaccaggtcagaggacagccacctcctggtcccctttgctcacctttgccatatgcagttcttccatttgcttcccaccccctttttcaggtaacaaaggggccaggtaa

SEQ ID NO: 441121 - DNA, 3964 bp, Homo sapiens
  misc_feature (1395)..(1395): n is a, c, g, or t
atatctggcagctggctatgccatcattgccgaaaacaaactcctataatccaatgctctctcatcacatatcacctcacaacaagcggaactatttgccctaaccaagaccctcactctagcaaagggaaagagggtcaacatttacaccaattccaaatatgcataccatgtcctacagtctcacactgtaatctggcaggaaaggggtttttctaactacaaaaagaaccgccataataaatggcaaactcatacacaagccgctggaggcagctaaactaccactagaggccgtcattatccattgcaagggacaccaaaaggctacagatgccataaccaagggaaacttcttagcagattcggcagcctggcaggcagcccttagaacactattgttattgcccattttccctagcatacacccaagaagaaaaaggtgccttgctggctccagggctgttcataacgaaagctgaatttacttagactacaaactcatcctacccaagacccaaaaactttctgttctcacccacatccataaccaattccatgcgggttatctcccgttgctccaatttctaaaaacctgtatacattcccttaccatggccatcagcttggaccgcctcactaaaggttgctctgcctgcagtcagacttcccctcaggggcccttagaccacctccttttccctcccttcaggcccaaaggccagttgccgggacaggattggcaaattgacttcactcatacgttcccccataaagaaagtctgatatctcctcacgatggtagataccttttcaggtggatagaagcctttcttactaccactgaaaaggcacacaccattgcctctaccttcctcacacacatcatcctttgattcagcctcccctcatctatacaactggacaattgaccagcatttatctcccaagtcactcaacaggtttctaagtctttaaacatcatatgggtttttcacattctctatcacccccaatcctcgggtaaatttgaacaggcgaatgccctcttaaaacaacagttaaccaaactttccctagagatcaaaatgaaaactgaatatcacttcttcccttggcccttatgtgcctcagggccctcccccgaaaacctctaaatctaagtccttttgaacttttgtatggacgttctttcgtcctacagaactttgctccatcccctcccttacaggacacctggccagcactgcacctcactcaacacttagtccgacagtacactgacactcacctccccaaacctgaggattcttcccaattcactttcttacccttacagccaggagactgggtctgggtagcacacccctcctcccctttccaacaaaatggaanggtccctatcaggttatattcaccatccccgctgctgcaaagttaacatcctttccctattgtatacaccattccaaatttaaaaaggcacccggcccacaccccgaagtctcctcaccccggaaatattcttcctttcccacaggaccaacctcgctgtgcctaacaagaattccagaagtcacccatccgaaaggcactggcccatgacactctccacttccaatcttaaatcttttacttcataccttgtctcagatctctcctggtaccccttccccacgcccttagataatccatctcaattcctcatgctaattgaggagctatggctgcaaggcaccttccaggatttcacacctacacaaatctcctttttctccttttgccttctctgcttatgggatattctgagtccccacccccaatcactgacagctgggcccccttcatcagcctcacacaccacgtattaagtcagtcacaatctcccctctcctctaactgctggatttgtctttctacacacacccaatgattcacggctcttccggctgacctacttacatggacacagtccaacgtgagcttacacatttcttacttggctataccattcttggctgattcattcctgaaaccggttcataacctggaaactcagctaaacacctttccttcaaactcagctctctcagcatggtttcaggtagggctgttgccctccttcacctaatagcttctggactaacatccatacaaaccaacacagcatcatctaaaccaccaatatgggggtaccatttctactcaaacttccttcatatccccaccccccttatgtctcagccgaacctaccctaatccagcccacgccacaatggtgggacaggttccccagtccctatgtggtcttatttttacccttgcactccctgtagaccatcaattctacaccctaattacaaaatcatatccacctctgcctggcagaaggtgttatgcttttctggctcgcctaccatccacacatccctacacctcaccaccggatcctcttttctttccttccatccaattcctggcttccccgctgccaactctgctctctatgtctccagtttaaaggtgccccctggaaaaaatgtaacaattccctcacctgtgactggtacctgacagccaccacaccggggcagcaatggctaacggttgacaaagacaatttctttctctctccaaaaccaaacagccttcatcaactccctagccaagactccctatcaggcccttacaggtgccgctctggctggcagttacccaatttgggaaaacgaaaataccctatcatggctacctaccttcacctacaacttctgcctgtccacccccagtctcttctttttgtgtgatacaaactgatatctttgcctaccagccaactggtcaggaacttgcaccctggtctttcaggctccaaccatcaacatcctaccccctaaccaaactattctaatttctgtagaagcctctatctcctcttcacccataagaaataaatgggctctacatctcatcaccctgctaacaggattaggcatcactgctgcacttggcactggaatagcaggcataaccacctcaatcacctcataccaaacactattcacaaccctttctaacaccgtagaagatatgcacacttccattaccagtctccaacgacaattagacttcctcgtgggagtcatccttcaaaactggagagtcctggacctcctaaccactgagaaagggggtacctgcatatacctccaggaagaatgctgtttctgtgttaatgaatctggcattgttcatatcgcagttcgtaggcttcatgacagggctgcagagctttgacatcaagtcgctgactcctggtggcaaggatcatcccttctaagatggataccctgggttgcccccttcctaggacccctgatcttcctcttcctgttactaatgattgggccatgcatatttaaccttgtatcccgcttcatttcccaaaggctgaattgttttatccaggcaagcatgcaaaaacacattgataatatatttcacctttgccacgtctaataccagagcctacgaggaaaccattcggaagctccagaacccaggccctaatcacaacgcccctatccagcaggaagcagccagatgatcaacgacgccctttttcctttttatactaaagtaagaaataagaatgttagcccaaactgcactattttgcagacccctaccattttacaaactggtcagagtggaaaattccaccagggcctgagctgtgagaaacatcctgtcaggcaggtcccaggcctaacccctggctgcactaaattccttcattatcagcagccaaacacaccgcccccaccccattttcacaacaatcccagacctctcctgcccgggactgtaactggtccagcctgtaagcgggaagggggctctggcactagctggtaccccctctccgcaggtctttctcccaataaatctgtgttgccattga

SEQ ID NO: 441122 - DNA, 686 bp, Homo sapiens
agttttgtccttactgcccagtctggagtgcaatggcacaatcttggctcaccacaacctccgcctcctgggttcaagcgattctcctgcctcagcatcctgagtcactgggattacaggtcctgcaaccctggttccagtctggcaagcattgtagacctggctgctgaagactgacggggcccagggtccgctgcccccaccgccatcaccacctcggaacccagggtaacgctgtcagtctttgagcctacgaggaaaccattcggaagctccagaacccaggccctaatcacaacgcccctatccagcaggaagcagccagatgatcaacgacgccctttttcctttttatactaaagtaagaaataagaatgttagcccaaactgcactattttgcagacccctaccattttacaaactggtcagagtggaaaattccaccagggcctgagctgtgagaaacatcctgtcaggcaggtcccaggcctaacccctggctgcactaaattccttcattatcagcagccaaacacaccgcccccaccccattttcacaacaatcccagacctctcctgcccgggactgtaactggtccagcctgtaagcgggaagggggctctggcactagctggtaccccctctccgcaggtctttctcccaataaatctgtgttgccattga

SEQ ID NO: 441123 - DNA, 2818 bp, Homo sapiens
ctagtgacgaggctcgtgttaatcggccgaggctggggacgctaggttccggaacctgacctgagctggggcctgtgcttccagcgggtggtggggggcctggtgtgctggcatcaagtaagccgactacctcggcaaaggcttagggacaagagaccagcagcctgaactggctggggcatccggaaggcttagatcttgtggccaagagttcagaccgtggcgaagtggagagtgacatgcagttggatggcggtgactgcgtggtcctgcaaccctggttccagtctggcaagcattgtagacctggctgctgaagactgacggggcccagggtccgctgcccccaccgccatcaccacctcggaacccagggtaacgctgtcagtctttggaccaacctcgctgtgcctaacaagaattccagaagtcacccatccgaaaggcactggcccatgacactctccacttccaatcttaaatcttttacttcataccttgtctcagatctctcctggtaccccttccccacgcccttagataatccatctcaattcctcatgctaattgaggagctatggctgcaaggcaccttccaggatttcacacctacacaaatctcctttttctccttttgccttctctgcttatgggatattctgagtccccacccccaatcactgacagctgggcccccttcatcagcctcacacaccacgtattaagtcagtcacaatctcccctctcctctaactgctggatttgtctttctacacacacccaatgattcacggctcttccggctgacctacttacatggacacagtccaacgtgagcttacacatttcttacttggctataccattcttggctgattcattcctgaaaccggttcataacctggaaactcagctaaacacctttccttcaaactcagctctctcagcatggtttcaggtagggctgttgccctccttcacctaatagcttctggactaacatccatacaaaccaacacagcatcatctaaaccaccaatatgggggtaccatttctactcaaacttccttcatatccccaccccccttatgtctcagccgaacctaccctaatccagcccacgccacaatggtgggacaggttccccagtccctatgtggtcttatttttacccttgcactccctgtagaccatcaattctacaccctaattacaaaatcatatccacctctgcctggcagaaggtgttatgcttttctggctcgcctaccatccacacatccctacacctcaccaccggatcctcttttctttccttccatccaattcctggcttccccgctgccaactctgctctctatgtctccagtttaaaggtgccccctggaaaaaatgtaacaattccctcacctgtgactggtacctgacagccaccacaccggggcagcaatggctaacggttgacaaagacaatttctttctctctccaaaaccaaacagccttcatcaactccctagccaagactccctatcaggcccttacaggtgccgctctggctggcagttacccaatttgggaaaacgaaaataccctatcatggctacctaccttcacctacaacttctgcctgtccacccccagtctcttctttttgtgtgatacaaactgatatctttgcctaccagccaactggtcaggaacttgcaccctggtctttcaggctccaaccatcaacatcctaccccctaaccaaactattctaatttctgtagaagcctctatctcctcttcacccataagaaataaatgggctctacatctcatcaccctgctaacaggattaggcatcactgctgcacttggcactggaatagcaggcataaccacctcaatcacctcataccaaacactattcacaaccctttctaacaccgtagaagatatgcacacttccattaccagtctccaacgacaattagacttcctcgtgggagtcatccttcaaaactggagagtcctggacctcctaaccactgagaaagggggtacctgcatatacctccaggaagaatgctgtttctgtgttaatgaatctggcattgttcatatcgcagttcgtaggcttcatgacagggctgcagagctttgacatcaagtcgctgactcctggtggcaaggatcatcccttctaagatggataccctgggttgcccccttcctaggacccctgatcttcctcttcctgttactaatgattgggccatgcatatttaaccttgtatcccgcttcatttcccaaaggctgaattgttttatccaggcaagcatgcaaaaacacattgataatatatttcacctttgccacgtctaataccagagcctacgaggaaaccattcggaagctccagaacccaggccctaatcacaacgcccctatccagcaggaagcagccagatgatcaacgacgccctttttcctttttatactaaagtaagaaataagaatgttagcccaaactgcactattttgcagacccctaccattttacaaactggtcagagtggaaaattccaccagggcctgagctgtgagaaacatcctgtcaggcaggtcccaggcctaacccctggctgcactaaattccttcattatcagcagccaaacacaccgcccccaccccattttcacaacaatcccagacctctcctgcccgggactgtaactggtccagcctgtaagcgggaagggggctctggcactagctggtaccccctctccgcaggtctttctcccaataaatctgtgttgccattga

SEQ ID NO: 441124 - DNA, 2954 bp, Homo sapiens
ctagtgacgaggctcgtgttaatcggccgaggctggggacgctaggttccggaacctgacctgagctggggcctgtgcttccagcgggtggtggggggcctggtgtgctggcatcaagtaagccgactacctcggcaaaggcttagggacaagagaccagcagcctgaactggctggggcatccggaaggcttagatcttgtggccaagagttcagaccgtggcgaagtggagagtgacatgcagttggatggcggtgactgcgtgcattccacaatcacgggctacttcaattctgcctgctgagctgatttaataatctggaagaggattattctcccccatctggaagaggattattctctataatcccagttagagacacaatgacataaacatcgctgtcctgcaaccctggttccagtctggcaagcattgtagacctggctgctgaagactgacggggcccagggtccgctgcccccaccgccatcaccacctcggaacccagggtaacgctgtcagtctttggaccaacctcgctgtgcctaacaagaattccagaagtcacccatccgaaaggcactggcccatgacactctccacttccaatcttaaatcttttacttcataccttgtctcagatctctcctggtaccccttccccacgcccttagataatccatctcaattcctcatgctaattgaggagctatggctgcaaggcaccttccaggatttcacacctacacaaatctcctttttctccttttgccttctctgcttatgggatattctgagtccccacccccaatcactgacagctgggcccccttcatcagcctcacacaccacgtattaagtcagtcacaatctcccctctcctctaactgctggatttgtctttctacacacacccaatgattcacggctcttccggctgacctacttacatggacacagtccaacgtgagcttacacatttcttacttggctataccattcttggctgattcattcctgaaaccggttcataacctggaaactcagctaaacacctttccttcaaactcagctctctcagcatggtttcaggtagggctgttgccctccttcacctaatagcttctggactaacatccatacaaaccaacacagcatcatctaaaccaccaatatgggggtaccatttctactcaaacttccttcatatccccaccccccttatgtctcagccgaacctaccctaatccagcccacgccacaatggtgggacaggttccccagtccctatgtggtcttatttttacccttgcactccctgtagaccatcaattctacaccctaattacaaaatcatatccacctctgcctggcagaaggtgttatgcttttctggctcgcctaccatccacacatccctacacctcaccaccggatcctcttttctttccttccatccaattcctggcttccccgctgccaactctgctctctatgtctccagtttaaaggtgccccctggaaaaaatgtaacaattccctcacctgtgactggtacctgacagccaccacaccggggcagcaatggctaacggttgacaaagacaatttctttctctctccaaaaccaaacagccttcatcaactccctagccaagactccctatcaggcccttacaggtgccgctctggctggcagttacccaatttgggaaaacgaaaataccctatcatggctacctaccttcacctacaacttctgcctgtccacccccagtctcttctttttgtgtgatacaaactgatatctttgcctaccagccaactggtcaggaacttgcaccctggtctttcaggctccaaccatcaacatcctaccccctaaccaaactattctaatttctgtagaagcctctatctcctcttcacccataagaaataaatgggctctacatctcatcaccctgctaacaggattaggcatcactgctgcacttggcactggaatagcaggcataaccacctcaatcacctcataccaaacactattcacaaccctttctaacaccgtagaagatatgcacacttccattaccagtctccaacgacaattagacttcctcgtgggagtcatccttcaaaactggagagtcctggacctcctaaccactgagaaagggggtacctgcatatacctccaggaagaatgctgtttctgtgttaatgaatctggcattgttcatatcgcagttcgtaggcttcatgacagggctgcagagctttgacatcaagtcgctgactcctggtggcaaggatcatcccttctaagatggataccctgggttgcccccttcctaggacccctgatcttcctcttcctgttactaatgattgggccatgcatatttaaccttgtatcccgcttcatttcccaaaggctgaattgttttatccaggcaagcatgcaaaaacacattgataatatatttcacctttgccacgtctaataccagagcctacgaggaaaccattcggaagctccagaacccaggccctaatcacaacgcccctatccagcaggaagcagccagatgatcaacgacgccctttttcctttttatactaaagtaagaaataagaatgttagcccaaactgcactattttgcagacccctaccattttacaaactggtcagagtggaaaattccaccagggcctgagctgtgagaaacatcctgtcaggcaggtcccaggcctaacccctggctgcactaaattccttcattatcagcagccaaacacaccgcccccaccccattttcacaacaatcccagacctctcctgcccgggactgtaactggtccagcctgtaagcgggaagggggctctggcactagctggtaccccctctccgcaggtctttctcccaataaatctgtgttgccattga

SEQ ID NO: 441125 - DNA, 3290 bp, Homo sapiens
  misc_feature (2996)..(2996): n is a, c, g, or t
  misc_feature (2999)..(3000): n is a, c, g, or t
ctagtgacgaggctcgtgttaatcggccgaggctggggacgctaggttccggaacctgacctgagctggggcctgtgcttccagcgggtggtggggggcctggtgtgctggcatcaagtaagccgactacctcggcaaaggcttagggacaagagaccagcagcctgaactggctggggcatccggaaggcttagatcttgtggccaagagttcagaccgtggcgaagtggagagtgacatgcagttggatggcggtgactgcgtggtatggaagaaaattcagctgaaatttgctagaaaatgagttgttttggaaagagactgtagagaaaggcaaatggaagaagaaagcttctgtgcccccacagataccgactgaaaagtgttagcatgagcaaaagttcctatctaatattatatgctttcctttgctcccaggtcctgcaaccctggttccagtctggcaagcattgtagacctggctgctgaagactgacggggcccagggtccgctgcccccaccgccatcaccacctcggaacccagggtaacgctgtcagtctttggaccaacctcgctgtgcctaacaagaattccagaagtcacccatccgaaaggcactggcccatgacactctccacttccaatcttaaatcttttacttcataccttgtctcagatctctcctggtaccccttccccacgcccttagataatccatctcaattcctcatgctaattgaggagctatggctgcaaggcaccttccaggatttcacacctacacaaatctcctttttctccttttgccttctctgcttatgggatattctgagtccccacccccaatcactgacagctgggcccccttcatcagcctcacacaccacgtattaagtcagtcacaatctcccctctcctctaactgctggatttgtctttctacacacacccaatgattcacggctcttccggctgacctacttacatggacacagtccaacgtgagcttacacatttcttacttggctataccattcttggctgattcattcctgaaaccggttcataacctggaaactcagctaaacacctttccttcaaactcagctctctcagcatggtttcaggtagggctgttgccctccttcacctaatagcttctggactaacatccatacaaaccaacacagcatcatctaaaccaccaatatgggggtaccatttctactcaaacttccttcatatccccaccccccttatgtctcagccgaacctaccctaatccagcccacgccacaatggtgggacaggttccccagtccctatgtggtcttatttttacccttgcactccctgtagaccatcaattctacaccctaattacaaaatcatatccacctctgcctggcagaaggtgttatgcttttctggctcgcctaccatccacacatccctacacctcaccaccggatcctcttttctttccttccatccaattcctggcttccccgctgccaactctgctctctatgtctccagtttaaaggtgccccctggaaaaaatgtaacaattccctcacctgtgactggtacctgacagccaccacaccggggcagcaatggctaacggttgacaaagacaatttctttctctctccaaaaccaaacagccttcatcaactccctagccaagactccctatcaggcccttacaggtgccgctctggctggcagttacccaatttgggaaaacgaaaataccctatcatggctacctaccttcacctacaacttctgcctgtccacccccagtctcttctttttgtgtgatacaaactgatatctttgcctaccagccaactggtcaggaacttgcaccctggtctttcaggctccaaccatcaacatcctaccccctaaccaaactattctaatttctgtagaagcctctatctcctcttcacccataagaaataaatgggctctacatctcatcaccctgctaacaggattaggcatcactgctgcacttggcactggaatagcaggcataaccacctcaatcacctcataccaaacactattcacaaccctttctaacaccgtagaagatatgcacacttccattaccagtctccaacgacaattagacttcctcgtgggagtcatccttcaaaactggagagtcctggacctcctaaccactgagaaagggggtacctgcatatacctccaggaagaatgctgtttctgtgttaatgaatctggcattgttcatatcgcagttcgtaggcttcatgacagggctgcagagctttgacatcaagtcgctgactcctggtggcaaggatcatcccttctaagatggataccctgggttgcccccttcctaggacccctgatcttcctcttcctgttactaatgattgggccatgcatatttaaccttgtatcccgcttcatttcccaaaggctgaattgttttatccaggcaagcatgcaaaaacacattgataatatatttcacctttgccacgtctaataccagagcctacgaggaaaccattcggaagctccagaacccaggccctaatcacaacgcccctatccagcaggaagcagccagatgatcaacgacgccctttttcctttttatactaaagtaagaaataagaatgttagcccaaactgcactattttgcagacccctaccattttacaaactggtcagagtggaaaattccaccagggcctgagctgtgagaaacatcctgtcaggcaggtcccaggcctaacccctggctgcactaaattccttcattatcagcagccaaacacaccgcccccaccccattttcacaacaatcccagacctctcctgcccgggactgtaactggtccagcctgtaagcgggaagggggctctggcactagctggtaccccctctccgcaggtctttctcccaataaatctgtgttgccattgaaaaanaannaaaaaaaaaaagagaaaaaaaagaaaaaaaaaacaaaaagaagacaagctgctacaaaacacgaaagacaagatcaaacgataccagaaacgacagcacaaagaacagcaatcaggaacacaaaacaagaaaaaggcgaggggggagcaaaggagaactcgccgagagaggccacaacgatccgagacccccgcacgtgtagtgagagacacagagtcaaaagaaagtcgaacatacaactgcgcaccgaccacgaacacaaacaaacaccggggagagaacacactgag

SEQ ID NO: 441126 - DNA, 1006 bp, Homo sapiens
ctagtgacgaggctcgtgttaatcggccgaggctggggacgctaggttccggaacctgacctgagctggggcctgtgcttccagcgggtggtggggggcctggtgtgctggcatcaagtaagccgactacctcggcaaaggcttagggacaagagaccagcagcctgaactggctggggcatccggaaggcttagatcttgtggccaagagttcagaccgtggcgaagtggagagtgacatgcagttggatggcggtgactgcgtggtatggaagaaaattcagctgaaatttgctagaaaatgagttgttttggaaagagactgtagagaaaggcaaatggaagaagaaagcttctgtgcccccacagataccgactgaaaagtgttagcatgagcaaaagttcctatctaatattatatgctttcctttgctcccaggtcctgcaaccctggttccagtctggcaagcattgtagacctggctgctgaagactgacggggcccagggtccgctgcccccaccgccatcaccacctcggaacccagggtaacgctgtcagtctttgagcctacgaggaaaccattcggaagctccagaacccaggccctaatcacaacgcccctatccagcaggaagcagccagatgatcaacgacgccctttttcctttttatactaaagtaagaaataagaatgttagcccaaactgcactattttgcagacccctaccattttacaaactggtcagagtggaaaattccaccagggcctgagctgtgagaaacatcctgtcaggcaggtcccaggcctaacccctggctgcactaaattccttcattatcagcagccaaacacaccgcccccaccccattttcacaacaatcccagacctctcctgcccgggactgtaactggtccagcctgtaagcgggaagggggctctggcactagctggtaccccctctccgcaggtctttctcccaataaatctgtgttgccattga

SEQ ID NO: 441127 - DNA, 2140 bp, Homo sapiens
ctagtgacgaggctcgtgttaatcggccgaggctggggacgctaggttccggaacctgacctgagctggggcctgtgcttccagcgggtggtggggggcctggtgtgctggcatcaagtaagccgactacctcggcaaaggcttagggacaagagaccagcagcctgaactggctggggcatccggaaggcttagatcttgtggccaagagttcagaccgtggcgaagtggagagtgacatgcagttggatggcggtgactgcgtggtatggaagaaaattcagctgaaatttgctagaaaatgagttgttttggaaagagactgtagagaaaggcaaatggaagaagaaagcttctgtgcccccacagataccgactgaaaagtgttagcatgagcaaaagttcctatctaatattatatgctttcctttgctcccagaagtgctgggattacaggcgtgagccaccatgctcagccaaagctgttatttttttaagtatgtattcctagatgttttatacttttatagttattgtgaatggaatgatttttttcctagataacttttaatgaatagaaacagttcctgctttatctccaaattctagaacagtcactggcacacaagtgctcagtgtttaagtgacattgttttcctgcacccaaaagtagaatgctgctcctcattggaagcatgttactttagcaaagtgccactaaaatgaccatagtccatgtgctctgatcacttgtcacagatggtgataaaattcattcacagcttcctttctaggcctgcagcatttgggagacaaaactctgctaaacctttggaagaaaaaagagaccagaggccattggtcccgaaaagtggatggaagatagggaggtagaaggaatgttacaggctgagagggcagctcacactcagctccagccacttcacctcgtgcacacactggctgagggttgccagatgtttgagaaaagctaggaatccagaccattgttaaccattggcaactatagggaacatacagaaagcatctgaactggatgtggtagagctcccagatcatgatctgattgagaatgtccatgaacttctgtcctgattgctcagtgcagactgctgcttcttctggcaagactcctctcttcgcattgacctggagttgtcacaaaatctgtttttctcttgctactcccctgagcatggcaccttctgccagagcgctcccttaactgtgtgggcaggctctgcttcacagctccccgcccactctgcccaagcagaagtgagcccctcctgggcagaaagtgcccgcaatgagggctgaaatgtttctattccctgagtaaccaacctttctctgtttccttgtccaggaaacggaggtggagctgtacaacgaatttcctgaacctatcaaactggacaagaatgaccgggccaaggcctcggcagaaagctgcagttgctgagggggcagtgagagttgagcacagagtccttcacaaaccaagaacacacgtaggccttcaacacaattcccctctcctcttccaaacaaaacatacattgatctctcacatccagctgccaaaagaaaaccccatcaaacacagttacaccccacatatctctcacacacacacacacacacagatctgacgtaatcaaactccagcccttgcccgtgatggctccttggggtctgcctgcccacccacatgagcccgcgagtatggcagcaggacaagccagcggtggaagtcattctgatatggagttggcattggaagcttattctttttgttcactggagagagagagaactgtttacagttaatctgtgtctaattatctgattttttttattggtcttgtggtctttttaccccccctttcccctccctccttgaaggctaccccttgggaaggctggtgccccatgccccattacaggctcacacccagtctgatcaggctgagttttgtatgtatctatctgttaatgcttgttacttttaactaatcagatctttttacagtatccatttattatgtaatgcttcttagaaaagaatcttatagtacatgttaatatatgcaaccaattaaaatgtataaattag

SEQ ID NO: 441128 - DNA, 894 bp, Homo sapiens
ctagtgacgaggctcgtgttaatcggccgaggctggggacgctaggttccggaacctgacctgagctggggcctgtgcttccagcgggtggtggggggcctggtgtgctggcatcaagtaagccgactacctcggcaaaggcttagggacaagagaccagcagcctgaactggctggggcatccggaaggcttagatcttgtggccaagagttcagaccgtggcgaagtggagagtgacatgcagttggatggcggtgactgcgtggtcctgcaaccctggttccagtctggcaagcattgtagacctggctgctgaagactgacggggcccagggtccgctgcccccaccgccatcaccacctcggaacccagggtaacgctgtcagtctttgatgatgtcagaagtgggatccaaagtagagcttataatgacacctaggagtgctgagtgaccaagcaaggtacccaccaggccgattatgtccattgttctcttggagcagctggtcatcatggtaagttctctctcagattcagaagctccgcatatttgtgttttgagctctccaagtttctatgagcccatttctaatccaaactgcgtttggaagtcatgccaaaaactgaactgggtccagaatcaaattagatctggtaattaagtggcttggatccagttagaggcctcttacatctgactgggtcagaagaaaaccagtagtaaatggcaataatgcaaggataaaatttggctttcactcttgaacaagattttcatgtaatattaaagaataatgaatgttttttttcaactttgaataaactacaggaaaaaaaaagaaagatacaacaaaagattgtttggaaagctaagtcttccctctattaatga

SEQ ID NO: 441129 - DNA, 546 bp, Homo sapiens
ctagtgacgaggctcgtgttaatcggccgaggctggggacgctaggttccggaacctgacctgagctggggcctgtgcttccagcgggtggtggggggcctggtgtgctggcatcaagtaagccgactacctcggcaaaggcttagggacaagagaccagcagcctgaactggctggggcatccggaaggcttagatcttgtggccaagagttcagaccgtggcgaagtggagagtgacatgcagttggatggcggtgactgcgtggtcctgcaaccctggttccagtctggcaagcattgtagacctggctgctgaagactgacggggcccagggtccgctgcccccaccgccatcaccacctcggaacccagggtaacgctgtcagtctttggtaagcccatgctcttccttttagatctggggactagttactcagttttatcagaatattcttgaccctcctcagttcttctatctctattgtgagagtcaatggaatcccctctaggcacatactggtcccctattatgcaacctattcaa

SEQ ID NO: 441130 - DNA, 2991 bp, Homo sapiens
ctagtgacgaggctcgtgttaatcggccgaggctggggacgctaggttccggaacctgacctgagctggggcctgtgcttccagcgggtggtggggggcctggtgtgctggcatcaagtaagccgactacctcggcaaaggcttagggacaagagaccagcagcctgaactggctggggcatccggaaggcttagatcttgtggccaagagttcagaccgtggcgaagtggagagtgacatgcagttggatggcggtgactgcgtggtatggaagaaaattcagctgaaatttgctagaaaatgagttgttttggaaagagactgtagagaaaggcaaatggaagaagaaagcttctgtgcccccacagataccgactgaaaagtgttagcatgagcaaaagttcctatctaatattatatgctttcctttgctcccaggtcctgcaaccctggttccagtctggcaagcattgtagacctggctgctgaagactgacggggcccagggtccgctgcccccaccgccatcaccacctcggaacccagggtaacgctgtcagtctttggaccaacctcgctgtgcctaacaagaattccagaagtcacccatccgaaaggcactggcccatgacactctccacttccaatcttaaatcttttacttcataccttgtctcagatctctcctggtaccccttccccacgcccttagataatccatctcaattcctcatgctaattgaggagctatggctgcaaggcaccttccaggatttcacacctacacaaatctcctttttctccttttgccttctctgcttatgggatattctgagtccccacccccaatcactgacagctgggcccccttcatcagcctcacacaccacgtattaagtcagtcacaatctcccctctcctctaactgctggatttgtctttctacacacacccaatgattcacggctcttccggctgacctacttacatggacacagtccaacgtgagcttacacatttcttacttggctataccattcttggctgattcattcctgaaaccggttcataacctggaaactcagctaaacacctttccttcaaactcagctctctcagcatggtttcaggtagggctgttgccctccttcacctaatagcttctggactaacatccatacaaaccaacacagcatcatctaaaccaccaatatgggggtaccatttctactcaaacttccttcatatccccaccccccttatgtctcagccgaacctaccctaatccagcccacgccacaatggtgggacaggttccccagtccctatgtggtcttatttttacccttgcactccctgtagaccatcaattctacaccctaattacaaaatcatatccacctctgcctggcagaaggtgttatgcttttctggctcgcctaccatccacacatccctacacctcaccaccggatcctcttttctttccttccatccaattcctggcttccccgctgccaactctgctctctatgtctccagtttaaaggtgccccctggaaaaaatgtaacaattccctcacctgtgactggtacctgacagccaccacaccggggcagcaatggctaacggttgacaaagacaatttctttctctctccaaaaccaaacagccttcatcaactccctagccaagactccctatcaggcccttacaggtgccgctctggctggcagttacccaatttgggaaaacgaaaataccctatcatggctacctaccttcacctacaacttctgcctgtccacccccagtctcttctttttgtgtgatacaaactgatatctttgcctaccagccaactggtcaggaacttgcaccctggtctttcaggctccaaccatcaacatcctaccccctaaccaaactattctaatttctgtagaagcctctatctcctcttcacccataagaaataaatgggctctacatctcatcaccctgctaacaggattaggcatcactgctgcacttggcactggaatagcaggcataaccacctcaatcacctcataccaaacactattcacaaccctttctaacaccgtagaagatatgcacacttccattaccagtctccaacgacaattagacttcctcgtgggagtcatccttcaaaactggagagtcctggacctcctaaccactgagaaagggggtacctgcatatacctccaggaagaatgctgtttctgtgttaatgaatctggcattgttcatatcgcagttcgtaggcttcatgacagggctgcagagctttgacatcaagtcgctgactcctggtggcaaggatcatcccttctaagatggataccctgggttgcccccttcctaggacccctgatcttcctcttcctgttactaatgattgggccatgcatatttaaccttgtatcccgcttcatttcccaaaggctgaattgttttatccaggcaagcatgcaaaaacacattgataatatatttcacctttgccacgtctaataccagagcctacgaggaaaccattcggaagctccagaacccaggccctaatcacaacgcccctatccagcaggaagcagccagatgatcaacgacgccctttttcctttttatactaaagtaagaaataagaatgttagcccaaactgcactattttgcagacccctaccattttacaaactggtcagagtggaaaattccaccagggcctgagctgtgagaaacatcctgtcaggcaggtcccaggcctaacccctggctgcactaaattccttcattatcagcagccaaacacaccgcccccaccccattttcacaacaatcccagacctctcctgcccgggactgtaactggtccagcctgtaagcgggaagggggctctggcactagctggtaccccctctccgcaggtctttctcccaataaatctgtgttgccattga

SEQ ID NO: 441131 - DNA, 1911 bp, Homo sapiens
aaaaaccttacggctaggtacgaggcctgggtggtgtcagcatggtttcaggtagggctgttgccctccttcacctaatagcttctggactaacatccatacaaaccaacacagcatcatctaaaccaccaatatgggggtaccatttctactcaaacttccttcatatccccaccccccttatgtctcagccgaacctaccctaatccagcccacgccacaatggtgggacaggttccccagtccctatgtggtcttatttttacccttgcactccctgtagaccatcaattctacaccctaattacaaaatcatatccacctctgcctggcagaaggtgttatgcttttctggctcgcctaccatccacacatccctacacctcaccaccggatcctcttttctttccttccatccaattcctggcttccccgctgccaactctgctctctatgtctccagtttaaaggtgccccctggaaaaaatgtaacaattccctcacctgtgactggtacctgacagccaccacaccggggcagcaatggctaacggttgacaaagacaatttctttctctctccaaaaccaaacagccttcatcaactccctagccaagactccctatcaggcccttacaggtgccgctctggctggcagttacccaatttgggaaaacgaaaataccctatcatggctacctaccttcacctacaacttctgcctgtccacccccagtctcttctttttgtgtgatacaaactgatatctttgcctaccagccaactggtcaggaacttgcaccctggtctttcaggctccaaccatcaacatcctaccccctaaccaaactattctaatttctgtagaagcctctatctcctcttcacccataagaaataaatgggctctacatctcatcaccctgctaacaggattaggcatcactgctgcacttggcactggaatagcaggcataaccacctcaatcacctcataccaaacactattcacaaccctttctaacaccgtagaagatatgcacacttccattaccagtctccaacgacaattagacttcctcgtgggagtcatccttcaaaactggagagtcctggacctcctaaccactgagaaagggggtacctgcatatacctccaggaagaatgctgtttctgtgttaatgaatctggcattgttcatatcgcagttcgtaggcttcatgacagggctgcagagctttgacatcaagtcgctgactcctggtggcaaggatcatcccttctaagatggataccctgggttgcccccttcctaggacccctgatcttcctcttcctgttactaatgattgggccatgcatatttaaccttgtatcccgcttcatttcccaaaggctgaattgttttatccaggcaagcatgcaaaaacacattgataatatatttcacctttgccacgtctaataccagagcctacgaggaaaccattcggaagctccagaacccaggccctaatcacaacgcccctatccagcaggaagcagccagatgatcaacgacgccctttttcctttttatactaaagtaagaaataagaatgttagcccaaactgcactattttgcagacccctaccattttacaaactggtcagagtggaaaattccaccagggcctgagctgtgagaaacatcctgtcaggcaggtcccaggcctaacccctggctgcactaaattccttcattatcagcagccaaacacaccgcccccaccccattttcacaacaatcccagacctctcctgcccgggactgtaactggtccagcctgtaagcgggaagggggctctggcactagctggtaccccctctccgcaggtctttctcccaataaatctgtgttgccattga

SEQ ID NO: 441132 - DNA, 3048 bp, Homo sapiens
  misc_feature (3012)..(3012): n is a, c, g, or t
ctagtgacgaggctcgtgttaatcggccgaggctggggacgctaggttccggaacctgacctgagctggggcctgtgcttccagcgggtggtggggggcctggtgtgctggcatcaagtaagccgactacctcggcaaaggcttagggacaagagaccagcagcctgaactggctggggcatccggaaggcttagatcttgtggccaagagttcagaccgtggcgaagtggagagtgacatgcagttggatggcggtgactgcgtggtatggaagaaaattcagctgaaatttgctagaaaatgagttgttttggaaagagactgtagagaaaggcaaatggaagaagaaagcttctgtgcccccacagataccgactgaaaagtgttagcatgagcaaaagttcctatctaatattatatgctttcctttgctcccaggtcctgcaaccctggttccagtctggcaagcattgtagacctggctgctgaagactgacggggcccagggtccgctgcccccaccgccatcaccacctcggaacccagggtaacgctgtcagtctttggaccaacctcgctgtgcctaacaagaattccagaagtcacccatccgaaaggcactggcccatgacactctccacttccaatcttaaatcttttacttcataccttgtctcagatctctcctggtaccccttccccacgcccttagataatccatctcaattcctcatgctaattgaggagctatggctgcaaggcaccttccaggatttcacacctacacaaatctcctttttctccttttgccttctctgcttatgggatattctgagtccccacccccaatcactgacagctgggcccccttcatcagcctcacacaccacgtattaagtcagtcacaatctcccctctcctctaactgctggatttgtctttctacacacacccaatgattcacggctcttccggctgacctacttacatggacacagtccaacgtgagcttacacatttcttacttggctataccattcttggctgattcattcctgaaaccggttcataacctggaaactcagctaaacacctttccttcaaactcagctctctcagcatggtttcaggtagggctgttgccctccttcacctaatagcttctggactaacatccatacaaaccaacacagcatcatctaaaccaccaatatgggggtaccatttctactcaaacttccttcatatccccaccccccttatgtctcagccgaacctaccctaatccagcccacgccacaatggtgggacaggttccccagtccctatgtggtcttatttttacccttgcactccctgtagaccatcaattctacaccctaattacaaaatcatatccacctctgcctggcagaaggtgttatgcttttctggctcgcctaccatccacacatccctacacctcaccaccggatcctcttttctttccttccatccaattcctggcttccccgctgccaactctgctctctatgtctccagtttaaaggtgccccctggaaaaaatgtaacaattccctcacctgtgactggtacctgacagccaccacaccggggcagcaatggctaacggttgacaaagacaatttctttctctctccaaaaccaaacagccttcatcaactccctagccaagactccctatcaggcccttacaggtgccgctctggctggcagttacccaatttgggaaaacgaaaataccctatcatggctacctaccttcacctacaacttctgcctgtccacccccagtctcttctttttgtgtgatacaaactgatatctttgcctaccagccaactggtcaggaacttgcaccctggtctttcaggctccaaccatcaacatcctaccccctaaccaaactattctaatttctgtagaagcctctatctcctcttcacccataagaaataaatgggctctacatctcatcaccctgctaacaggattaggcatcactgctgcacttggcactggaatagcaggcataaccacctcaatcacctcataccaaacactattcacaaccctttctaacaccgtagaagatatgcacacttccattaccagtctccaacgacaattagacttcctcgtgggagtcatccttcaaaactggagagtcctggacctcctaaccactgagaaagggggtacctgcatatacctccaggaagaatgctgtttctgtgttaatgaatctggcattgttcatatcgcagttcgtaggcttcatgacagggctgcagagctttgacatcaagtcgctgactcctggtggcaaggatcatcccttctaagatggataccctgggttgcccccttcctaggacccctgatcttcctcttcctgttactaatgattgggccatgcatatttaaccttgtatcccgcttcatttcccaaaggctgaattgttttatccaggcaagcatgcaaaaacacattgataatatatttcacctttgccacgtctaataccagagcctacgaggaaaccattcggaagctccagaacccaggccctaatcacaacgcccctatccagcaggaagcagccagatgatcaacgacgccctttttcctttttatactaaagtaagaaataagaatgttagcccaaactgcactattttgcagacccctaccattttacaaactggtcagagtggaaaattccaccagggcctgagctgtgagaaacatcctgtcaggcaggtcccaggcctaacccctggctgcactaaattccttcattatcagcagccaaacacaccgcccccaccccattttcacaacaatcccagacctctcctgcccgggactgtaactggtccagcctgtaagcgggaagggggctctggcactagctggtaccccctctccgcaggtctttctcccaataaatctgtgttgccattgatgctggtcgcccgaagccggncccccttgtcccgcccaccccccccgcgcgactatt

SEQ ID NO: 441133 - DNA, 552 bp, Homo sapiens
atctgataaattctattattttcccatatcagtagttgagctagtactgatatgggtaatatttatattatggataataaagcttgtacttatgaaatgtaagggaacaagcaaattttatatagaaattgaaaaattagagtttcagtgtattttactcctaacttaaaaaaacccagatatcctcttgaaccactctcagcagctcttctcaagttgcacagccaagtttgcagatggacagcagtgctctgtgccagtttttgacattacacatcagacacctctgtgtgaagaacatgccaaaaaaatggtaagttctgcaacagaggctttcaaactttttgtagctatccactgtaggaagtattttataacttagcacaaactatgtatgtatataaatcactgaaacaagttttgagagaggatttttattcccttaagatacattttattaccttaagatatgtatcttatacatagcagaatttctaaatactctctttgttcctatgtctctaagtttttgctttcttatatacaattcta

SEQ ID NO: 441134 - DNA, 2594 bp, Homo sapiens
ggcacgaggcaatctgcttcatcctgattctgcggcattccaaactgtggtatccttgggggttctcttaacattgctatggtgcagaagatttaaaatcagctgatgttcacaaggaatagagtcacgtgatgtatgaagggaaacatatacacttctctgaggttgacaataagcccttgtgctcatatagccccaaactgtgcaagcagaggcgactcaacggctacgccttctgtatcagacacgttctggaggacaagactgcccccttcaagcaatgtgaatatgtggccaagtataacagccaacgctgcaccaaccccatccccaaatcagaggatcgtaggtactgcaacagccacttgcaggtacttggctttatcccgaaaaaagagaggaagaaaaagaatgatcctatagatgaggtgaaggtcaggcaccagatggataccatggcctttagcctgacagtgcccacgttggccttgaagatgcccaacggactggatggaatgtccctctctccacctggggcaagggtccctctccactacctggaaactgaattggaagacccatttgctttcaatgaggaagatgatgacctaaagaaaggggcaactgtgagaaagaagttgcagagcaagttggcccagaatcggcagcgccagagagagacagagattttaaaagttcgacaagagcactttagtccccctcctgcaccttcacagcagcagcctccgcagcagcactcccacctgtcacctttatctacttctttaaaacctccagcgccaccgcagggttcagtctgcaagtcacctcaacctcagaacaccagcctaccaatgcagggagtggcacccaccacacacactatagcacaagcacggcagttgtctcacaagaggcctctgcccctcctgccatccagtagggctcccactgtggacccacccaggactgaccggatcctcatgaaagccacagccttctctccacacttctcatgtataagccgactgcagagactggtgaaactgtgcacccagaaacatcagttggacactgatctgtttccccatttaggtttggactggtctgaagagagcggagaggaaccagaggactcagagcaggcctcgccctaccaggttgcatggtccatccgggaaaccctcagatatcaaagacatgcgtcagatgatgatgatgcggagagtaggagctccagggtgactcaactttgcacttactttcagcagaaatataagcacctctgccgcctggagcgggcagaatctcgtcaaaagaaatgccggcatacgtttaggaaagctttgctgcaggcggccagtaaagaaccagaatgcactggtcagttaatacaagaactgcggagagctgcatgcagtcgaaccagcataagccggaccaagctgagggaggtggaaccagcagcatgcagtggaaccgtgaagggtgaacagtgcgctaacaaagcccttccattcaccagacattgtttccaacatatcctcttgaaccactctcagcagctcttctcaagttgcacagccaagtttgcagatggacagcagtgctctgtgccagtttttgacattacacatcagacacctctgtgtgaagaacatgccaaaaaaatggataatttcttgagaggagataactcccgtaaagttcagcaccagcagcagaggaaacccaggaaaaaaaccaagcctcctgcactaaccaaaaaacacaagaagaagagaaggcgtggacctcgtcgaccccaaaaacccattccacctgcagtcccccaagggaacctcagcatgcctgccagcgtctcactgccagtggaggcctctcacatccggagcccatccacgccagagctgagtgctgatgagttgccggatgacattgccaatgagatcactgacattccacatgacttggaattgaaccaggaggacttttcagatgtcctgccacggctacctgatgacttacaagattttgatttttttgaagggaagaatggagacctcctcccaactaccgaagaggctgaggagcttgaacgggccttgcaggctgtaacttctctcgagtgcctgagtaccattggggtccttgcccagtcagatggtgtgccagtccaggagttgtcagatagaggaataggggtgttctccacaggtactggagcttcaggaatacaatccttgagccgagaggtgaacacagacctaggggagctattgaatgggcgtatagtacatgataatttttctagtctagagctggatgagaacctgctccgttctgctaccttgtcaaacccacctacacccctggcagggcagatccaggggcagttctctgccccagccaacgttggccttacttctgccactctgatcagccagagtgcacttggggagagagccttcccaggacagtttcatggacttcatgacggcagccatgcctcccagaggccacatcctgcccagctgctgagcaaggcagatgacctaatcacctcacgacagcaatacagcagtgatcactca

SEQ ID NO: 441135 - DNA, 2569 bp, Homo sapiens
tgccttacagggaaaaaaaaaaaaagaattgtggtcggttcttcagtaatgaatatgtgctccactaatattaattttatgccctgctgctctttgtgcctttctacattcacaaaaaattttcctccacacgtagtaccaacagtgtacaaaccttaattcagaaacgatgccagtacaaagaactggaaccgtgtgtgtgcgtgtgtgtgtgtgtgtgtgtgtgtagacagtgtcaactataatgaccatcagcaggctgaccgcaatggtaaaatgccaccaatttaaaatgcttcccaattgcagagatattaaaatgtagatcttggaattgatgaagtttgatgtcttcattattgttatacatagttttgggcatccagtatgttttaggcattatatagaatattaagggatgtaagtattttttaggtagctgtcaggtttatcccagataatctcaatttaaaagcctatttattcattccaaaggataatttcttgagaggagataactcccgtaaagttcagcaccagcagcagaggaaacccaggaaaaaaaccaagcctcctgcactaaccaaaaaacacaagaagaagagaaggcgtggacctcgtcgaccccaaaaacccattccacctgcagtcccccaagggaacctcagcatgcctgccagcgtctcactgccagtggaggcctctcacatccggagcccatccacgccagagctgagtgctgatgagttgccggatgacattgccaatgagatcactgacattccacatgacttggaattgaaccaggaggacttttcagatgtcctgccacggctacctgatgacttacaagattttgatttttttgaagggaagaatggagacctcctcccaactaccgaagaggctgaggagcttgaacgggccttgcaggctgtaacttctctcgagtgcctgagtaccattggggtccttgcccagtcagatggtgtgccagtccaggagttgtcagatagaggaataggggtgttctccacaggtactggagcttcaggaatacaatccttgagccgagaggtgaacacagacctaggggagctattgaatgggcgtatagtacatgataatttttctagtctagagctggatgagaacctgctccgttctgctaccttgtcaaacccacctacacccctggcagggcagatccaggggcagttctctgccccagccaacgttggccttacttctgccactctgatcagccagagtgcacttggggagagagccttcccaggacagtttcatggacttcatgacggcagccatgcctcccagaggccacatcctgcccagctgctgagcaaggcagatgacctaatcacctcacgacagcaatacagcagtgatcactcacactcctcaccccatggaagccattatgatagtgagcatgtgccgtctccctacagtgaccatatcacctctccccacacaacatcgtactctggtgataatatggcagctaccttttcagcagagatgcccatcatggcgcagcacttgctcccaacccaacttgaggtgccacttggaggcgtggtaaaccccagaactcactggggcaatctccctgtcaaccttggagacccctctccatttagcaaccttctcggcgcagatggacatcttctttccacttccctatccacgccacccaccacttcgaactcagagaccacacagcctgccttcgccaccgtgacccccagcagctccagtgtgcttccggggttaccacagaccagcttcagtggcatggggccttctgctgaactaatggcctccacctctcccaagcagcaactccctcagttcagcgcagcctttggccaccagctgagttctcacagtggcattcctaaggacctgcagcccagccacagctctatagcccctcctacaggcttcacagtaacaggtgccacagctacaagtaccaataatgcatcttctccctttccctcccctaactgagggtgtctgtgtgtttgcaggcaggtggggaacccagtgttttctatctttgtttcctctttagcacccctctccccttttcctaaagaagatataacagatggggatcagaggggcaccccccttcccagttcaatgagtggccctgcagtggacctcgctacagtgttcacatgtgctccttagcactggtgctcattccctcctggcaggcccactccgccccagtggtttccttagtggttcagcacagtgactggataggattgatttttagcagcaagtcctagaagtggaagatacctcagaataccagtgccctttactatttcctagtattcagatcagtgctttccattctgttgccaggtttttacataggtggttctagatagaatgatcttattaattgagttcctgtataagagacagcaaatggtgtgtggcaggtcaagattctgacctagcaccaactgctaaacaccacagtgaggccaggattccattcgtaattgtgatcatgtttaactaa

SEQ ID NO: 441136 - DNA, 842 bp, Homo sapiens
gtaagggctaatcatgagaatcaatccttgatttcattaacaggcttggaattttttcttttcttgttttttcttctcttttcttctgtccttcatttctccctccctcccttcctccacctatataaatgttgaattctgggggtaatctaagtaatctatggaatacttttaaagatgaaatatggcaattttttaaaatagagtaataaatttggggaattacttaaagtatgtttgagtgtcttctatttaattgatttcatggacttctagaatttttaaaagattttttttccctcaaagttgctgcttgaagtcttgaaacggatttgtttggtttatggccttataaagtaattcctgacttttctacctagttttctcatttgcctaaatgagagaaatttaaataactaattaggtgttataattaatgatagcaattttggagtttaaaatctatgcctagaagttagtaaaggatatatacttactgaagaaaattttaaaaaactacttgaatcagttagatttatttcctatcagacttctcaccagtgtttggcatgttttataaccttaccttttttggttaaaaagtgttccaaatagagtatgtttgccataatttggaaacactattttcacattaagggtcggttttgccactagaatgatgagtttatgcttcgctaaatttagaaaagagtggaattgtttttaaaggagtcttatactggttattcatctttcatattgttaggaaaattcacactatctttcatatataatctcttctctgtgcttctttttcttcaattctccagaaactatataga

SEQ ID NO: 441137 - DNA, 121 bp, Homo sapiens
gattctgcggcattccaaactgtggtatccttgggggttctcttaacattgctatggtgcagaagatttaaaatcaggtatggctgtggggccagaagtccctcagtgaaattctcaactt

SEQ ID NO: 441138 - DNA, 3747 bp, Homo sapiens
ggcacgaggcaatctgcttcatcctgattctgcggcattccaaactgtggtatccttgggggttctcttaacattgctatggtgcagaagatttaaaatcagctgatgttcacaaggaatagagtcacgtgatgtatgaagggaaacatatacacttctctgaggttgacaataagcccttgtgctcatatagccccaaactgtgcaagcagaggcgactcaacggctacgccttctgtatcagacacgttctggaggacaagactgcccccttcaagcaatgtgaatatgtggccaagtataacagccaacgctgcaccaaccccatccccaaatcagaggatcgtaggtactgcaacagccacttgcaggtacttggctttatcccgaaaaaagagaggaagaaaaagaatgatcctatagatgaggtgaaggtcaggcaccagatggataccatggcctttagcctgacagtgcccacgttggccttgaagatgcccaacggactggatggaatgtccctctctccacctggggcaagggtccctctccactacctggaaactgaattggaagacccatttgctttcaatgaggaagatgatgacctaaagaaaggggcaactgtgagaaagaagttgcagagcaagttggcccagaatcggcagcgccagagagagacagagattttaaaagttcgacaagagcactttagtccccctcctgcaccttcacagcagcagcctccgcagcagcactcccacctgtcacctttatctacttctttaaaacctccagcgccaccgcagggttcagtctgcaagtcacctcaacctcagaacaccagcctaccaatgcagggagtggcacccaccacacacactatagcacaagcacggcagttgtctcacaagaggcctctgcccctcctgccatccagtagggctcccactgtggacccacccaggactgaccggatcctcatgaaagccacagccttctctccacacttctcatgtataagccgactgcagagactggtgaaactgtgcacccagaaacatcagttggacactgatctgtttccccatttaggtttggactggtctgaagagagcggagaggaaccagaggactcagagcaggcctcgccctaccaggttgcatggtccatccgggaaaccctcagatatcaaagacatgcgtcagatgatgatgatgcggagagtaggagctccagggtgactcaactttgcacttactttcagcagaaatataagcacctctgccgcctggagcgggcagaatctcgtcaaaagaaatgccggcatacgtttaggaaagctttgctgcaggcggccagtaaagaaccagaatgcactggtcagttaatacaagaactgcggagagctgcatgcagtcgaaccagcataagccggaccaagctgagggaggtggaaccagcagcatgcagtggaaccgtgaagggtgaacagtgcgctaacaaagcccttccattcaccagacattgtttccaacatatcctcttgaaccactctcagcagctcttctcaagttgcacagccaagtttgcagatggacagcagtgctctgtgccagtttttgacattacacatcagacacctctgtgtgaagaacatgccaaaaaaatggataatttcttgagaggagataactcccgtaaagttcagcaccagcagcagaggaaacccaggaaaaaaaccaagcctcctgcactaaccaaaaaacacaagaagaagagaaggcgtggacctcgtcgaccccaaaaacccattccacctgcagtcccccaagggaacctcagcatgcctgccagcgtctcactgccagtggaggcctctcacatccggagcccatccacgccagagctgagtgctgatgagttgccggatgacattgccaatgagatcactgacattccacatgacttggaattgaaccaggaggacttttcagatgtcctgccacggctacctgatgacttacaagattttgatttttttgaagggaagaatggagacctcctcccaactaccgaagaggctgaggagcttgaacgggccttgcaggctgtaacttctctcgagtgcctgagtaccattggggtccttgcccagtcagatggtgtgccagtccaggagttgtcagatagaggaataggggtgttctccacaggtactggagcttcaggaatacaatccttgagccgagaggtgaacacagacctaggggagctattgaatgggcgtatagtacatgataatttttctagtctagagctggatgagaacctgctccgttctgctaccttgtcaaacccacctacacccctggcagggcagatccaggggcagttctctgccccagccaacgttggccttacttctgccactctgatcagccagagtgcacttggggagagagccttcccaggacagtttcatggacttcatgacggcagccatgcctcccagaggccacatcctgcccagctgctgagcaaggcagatgacctaatcacctcacgacagcaatacagcagtgatcactcacactcctcaccccatggaagccattatgatagtgagcatgtgccgtctccctacagtgaccatatcacctctccccacacaacatcgtactctggtgataatatggcagctaccttttcagcagagatgcccatcatggcgcagcacttgctcccaacccaacttgaggtgccacttggaggcgtggtaaaccccagaactcactggggcaatctccctgtcaaccttggagacccctctccatttagcaaccttctcggcgcagatggacatcttctttccacttccctatccacgccacccaccacttcgaactcagagaccacacagcctgccttcgccaccgtgacccccagcagctccagtgtgcttccggggttaccacagaccagcttcagtggcatggggccttctgctgaactaatggcctccacctctcccaagcagcaactccctcagttcagcgcagcctttggccaccagctgagttctcacagtggcattcctaaggacctgcagcccagccacagctctatagcccctcctacaggcttcacagtaacaggtgccacagctacaagtaccaataatgcatcttctccctttccctcccctaactgagggtgtctgtgtgtttgcaggcaggtggggaacccagtgttttctatctttgtttcctctttagcacccctctccccttttcctaaagaagatataacagatggggatcagaggggcaccccccttcccagttcaatgagtggccctgcagtggacctcgctacagtgttcacatgtgctccttagcactggtgctcattccctcctggcaggcccactccgccccagtggtttccttagtggttcagcacagtgactggataggattgatttttagcagcaagtcctagaagtggaagatacctcagaataccagtgccctttactatttcctagtattcagatcagtgctttccattctgttgccaggtttttacataggtggttctagatagaatgatcttattaattgagttcctgtataagagacagcaaatggtgtgtggcaggtcaagattctgacctagcaccaactgctaaacaccacagtgaggccaggattccattcgtaattgtgatcatgtttaactaa

SEQ ID NO: 441139 - DNA, 8080 bp, Homo sapiens
aaggcgcacgatggcgcgtccctgcagccctcgcccggcgctccagtagcaggacccggtctcgggaccagccggtaatatgcacgtgtcactagctgaggccctggaggttcggggtggaccacttcaggaggaagaaatatgggctgtattaaatcaaagtgctgaaagtctccaagaattattcagaaaagtaagcctagctgatcctgctgcccttggcttcatcatttctccatggtctctgctgttgctgccatctggtagtgtgtcatttacagatgaaaatatttccaatcaggatcttcgagcattcactgcaccagaggttcttcaaaatcagtcactaacttctctctcagatgttgaaaagatccacatttattctcttggaatgacactgtattggggggctgattatgaagtgcctcagagccaacctattaagcttggagatcatctcaacagcatactgcttggaatgtgtgaggatgttatttacgctcgagtttctgttcggactgtgctggatgcttgcagtgcccacattaggaatagcaattgtgcaccctcattttcctacgtgaaacacttggtaaaactggttctgggaaatctttctgggacagatcagctttcctgtaacagtgaacaaaagcctgatcgaagccaggctattcgagatcgattgcgaggaaaaggattaccaacaggaagaagctctacttctgatgtactagacatacaaaagcctccactctctcatcagacctttcttaacaaagggcttagtaaatctatgggatttctgtccatcaaagatacacaagatgagaattatttcaaggacattttatcagataattctggacgtgaagattctgaaaatacattctccccttaccagttcaaaactagtggcccagaaaaaaaacccatccctggcattgatgtgctttctaagaagaagatctgggcttcatccatggacttgctttgtacagctgacagagacttctcttcaggagagactgccacatatcgtcgttgtcaccctgaggcagtaacagtgcggacttcaactactcctagaaaaaaggaggcaagatactcagatggaagtatagccttggatatctttggccctcagaaaatggatccaatatatcacactcgagaattgcccacctcctcagcaatatcaagtgctttggaccgaatccgagagagacaaaagaaacttcaggttctgagggaagccatgaatgtagaagaaccagttcgaagatacaaaacttatcatggtgatgtctttagtacctccagtgaaagtccatctattatttcctctgaatcagatttcagacaagtgagaagaagtgaagcctcaaagaggtttgaatccagcagtggtctcccaggggtagatgaaaccttaagtcaaggccagtcacagagaccgagcagacaatatgaaacaccctttgaaggcaacttaattaatcaagagatcatgctaaaacggcaagaggaagaactgatgcagctacaagccaaaatggcccttagacagtctcggttgagcctatatccaggagacacaatcaaagcgtccatgcttgacatcaccagggatccgttaagagaaattgccctagaaacagccatgactcaaagaaaactgaggaatttctttggccctgagtttgtgaaaatgacaattgaaccatttatatctttggatttgccacggtctattcttactaagaaagggaagaatgaggataaccgaaggaaagtaaacataatgcttctgaacgggcaaagactggaactgacctgtgataccaaaactatatgtaaagatgtgtttgatatggttgtggcacatattggcttagtagagcatcatttgtttgctttagctaccctcaaagataatgaatatttctttgttgatcctgacttaaaattaaccaaagtggccccagagggatggaaagaagaaccaaagaaaaagaccaaagccactgttaattttactttgtttttcagaattaaattttttatggatgatgttagtctaatacaacatactctgacgtgtcatcagtattaccttcagcttcgaaaagatattttggaggaaaggatgcactgtgatgatgagacttccttattgctggcatccttggctctccaggctgagtatggagattatcaaccagaggttcatggtgtgtcttactttagaatggagcactatttgcccgccagagtgatggagaaacttgatttatcctatatcaaagaagagttacccaaattgcataatacctatgtgggagcttctgaaaaagagacagagttagaatttttaaaggtctgccaaagactgacagaatatggagttcattttcaccgagtgcaccctgagaagaagtcacaaacaggaatattgcttggagtctgttctaaaggtgtccttgtgtttgaagttcacaatggagtgcgcacattggtccttcgctttccatggagggaaaccaagaaaatatctttttctaaaaagaaaatcacattgcaaaatacatcagatggaataaaacatggcttccagacagacaacagtaagatatgccagtacctgctgcacctctgctcttaccagcataagttccagctacagatgagagcaagacagagcaaccaagatgcccaagatattgagagagcttcgtttaggagcctgaatctccaagcagagtctgttagaggatttaatatgggacgagcaatcagcactggcagtctggccagcagcaccctcaacaaacttgctgttcgacctttatcagttcaagctgagattctgaagaggctatcctgctcagagctgtcgctttaccagccattgcaaaacagttcaaaagagaagaatgacaaagcttcatgggaggaaaagcctagagagatgagtaaatcataccatgatctcagtcaggcctctctctatccacatcggaaaaatgtcattgttaacatggaacccccaccacaaaccgttgcagagttggtgggaaaaccttctcaccagatgtcaagatctgatgcagaatctttggcaggagtgacaaaacttaataattcaaagtctgttgcgagtttaaatagaagtcctgaaaggaggaaacatgaatcagactcctcatccattgaagaccctgggcaagcatatgttctagatgtgctacacaaaagatggagcatagtatcttcaccagaaagggagatcaccttagtgaacctgaaaaaagatgcaaagtatggcttgggatttcaaattattggtggggagaagatgggaagactggacctaggcatatttatcagttcagttgcccctggaggaccagctgacttggatggatgcttgaagccaggagaccgtttgatatctgtgaatagtgtgagtctggagggagtcagccaccatgctgcaattgaaattttgcaaaatgcacctgaagatgtgacacttgttatctctcagccaaaagaaaagatatccaaagtgccttctactcctgtgcatctcaccaatgagatgaaaaactacatgaagaaatcttcctacatgcaagacagtgctatagattcttcttccaaggatcaccactggtcacgtggtaccctgaggcacatctcggagaactcctttgggccatctgggggcctgcgggaaggaagcctgagttctcaagattccaggactgagagtgccagcttgtctcaaagccaggtcaatggtttctttgccagccatttaggtgaccaaacctggcaggaatcacagcatggcagcccttccccatctgtaatatccaaagccaccgagaaagagactttcactgatagtaaccaaagcaaaactaaaaagccaggcatttctgatgtaactgattactcagaccgtggagattcagacatggatgaagccacttactccagcagtcaggatcatcaaacaccaaaacaggaatcttcctcttcagtgaatacatccaacaagatgaattttaaaactttttcttcatcacctcctaagcctggagatatctttgaggttgaactggctaaaaatgataacagcttggggataagtgtcacgggaggtgtgaatacgagtgtcagacatggtggcatttatgtgaaagctgttattccccagggagcagcagagtctgatggtagaattcacaaaggtgatcgcgtcctagctgtcaatggagttagtctagaaggagccacccataagcaagctgtggaaacactgagaaatacaggacaggtggttcatctgttattagaaaagggacaatctccaacatctaaagaacatgtcccggtaaccccacagtgtaccctttcagatcagaatgcccaaggtcaaggcccagaaaaagtgaagaaaacaactcaggtcaaagactacagctttgtcactgaagaaaatacatttgaggtaaaattatttaaaaatagctcaggtctaggattcagtttttctcgagaagataatcttataccggagcaaattaatgccagcatagtaagggttaaaaagctctttcctggacagccagcagcagaaagtggaaaaattgatgtaggagatgttatcttgaaagtgaatggagcctctttgaaaggactatctcagcaggaagtcatatctgctctcaggggaactgctccagaagtattcttgcttctctgcagacctccacctggtgtgctaccggaaattgatactgcgcttttgaccccacttcagtctccagcacaagtacttccaaacagcagtaaagactcttctcagccatcatgtgtggagcaaagcaccagctcagatgaaaatgaaatgtcagacaaaagcaaaaaacagtgcaagtccccatccagaagagacagttacagtgacagcagtgggagtggagaagatgacttagtgacagctccagcaaacatatcaaattcgacctggagttcagctttgcatcagactctaagcaacatggtatcacaggcacagagtcatcatgaagcacccaagagtcaagaagataccatttgtaccatgttttactatcctcagaaaattcccaataaaccagagtttgaggacagtaatccttcccctctaccaccggatatggctcctgggcagagttatcaaccccaatcagaatctgcttcctctagttcgatggataagtatcatatacatcacatttctgaaccaactagacaagaaaactggacacctttgaaaaatgacttggaaaatcaccttgaagactttgaactggaagtagaactcctcattaccctaattaaatcagaaaaaggaagcctgggttttacagtaaccaaaggcaatcagagaattggttgttatgttcatgatgtcatacaggatccagccaaaagtgatggaaggctaaaacctggggaccggctcataaaggttaatgatacagatgttactaatatgactcatacagatgcagttaatctgctccgggctgcatccaaaacagtcagattagttattggacgagttctagaattacccagaataccaatgttgcctcatttgctaccggacataacactaacgtgcaacaaagaggagttgggtttttccttatgtggaggtcatgacagcctttatcaagtggtatatattagtgatattaatccaaggtccgtcgcagccattgagggtaatctccagctattagatgtcatccattatgtgaacggagtcagcacacaaggaatgaccttggaggaagttaacagagcattagacatgtcacttccttcattggtattgaaagcaacaagaaatgatcttccagtggtccccagctcaaagaggtctgctgtttcagctccaaagtcaaccaaaggcaatggttcctacagtgtggggtcttgcagccagcctgccctcactcctaatgattcattctccacggttgctggggaagaaataaatgaaatatcgtaccccaaaggaaaatgttctacttatcagataaagggatcaccaaacttgactctgcccaaagaatcttatatacaagaagatgacatttatgatgattcccaagaagctgaagttatccagtctctgctggatgttgtggatgaggaagcccagaatcttttaaacgaaaataatgcagcaggatactcctgtggtccaggtacattaaagatgaatgggaagttatcagaagagagaacagaagatacagactgcgatggttcacctttacctgagtattttactgaggccaccaaaatgaatggctgtgaagaatattgtgaagaaaaagtaaaaagtgaaagcttaattcagaagccacaagaaaagaagactgatgatgatgaaataacatggggaaatgatgagttgccaatagagagaacaaaccatgaagattctgataaagatcattcctttctgacaaacgatgagctcgctgtactccctgtcgtcaaagtgcttccctctggtaaatacacgggtgccaacttaaaatcagtcattcgagtcctgcggggtttgctagatcaaggaattccttctaaggagctggagaatcttcaagaattaaaacctttggatcagtgtctaattgggcaaactaaggaaaacagaaggaagaacagatataaaaatatacttccctatgatgctacaagagtgcctcttggagatgaaggtggctatatcaatgccagcttcattaagataccagttgggaaagaagagttcgtttacattgcctgccaaggaccactgcctacaactgttggagacttctggcagatgatttgggagcaaaaatccacagtgatagccatgatgactcaagaagtagaaggagaaaaaatcaaatgccagcgctattggcccaacatcctaggcaaaacaacaatggtcagcaacagacttcgactggctcttgtgagaatgcagcagctgaagggctttgtggtgagggcaatgacccttgaagatattcagaccagagaggtgcgccatatttctcatctgaatttcactgcctggccagaccatgatacaccttctcaaccagatgatctgcttacttttatctcctacatgagacacatccacagatcaggcccaatcattacgcactgcagtgctggcattggacgttcagggaccctgatttgcatagatgtggttctgggattaatcagtcaggatcttgattttgacatctctgatttggtgcgctgcatgagactacaaagacacggaatggttcagacagaggatcaatatattttctgctatcaagtcatcctttatgtcctgacacgtcttcaagcagaagaagagcaaaaacagcagcctcagcttctgaagtgacatgaaaagagcctctggatgcatttccatttctctccttaacctccagcagactcctgctctctatccaaaataaagatcacagagcagcaagttcatacaacatgcatgttctcctctatcttagaggggtattcttcttgaaaataaaaaatattgaaatgctgtatttttacagctactttaacctatgataattatttacaaaattttaacactaaccaaacaatgcagatcttagggatgattaaaggcagcatttgatgatagcagacattgttacaaggacatggtgagtctatttttaatgcaccaatcttgtttatagcaaaaatgttttccaatattttaataaagtagttattttataggggatacttgaaaccagtatttaagctttaaatgacagtaatattggcatagaaaaaagtagcaaatgtttactgtatcaatttctaatgtttactatatagaatttcctgtaatatatttatatactttttcatgaaaatggagttatcagttatctgtttgttactgcatcatctgtttgtaatcattatctcactttgtaaataaaaacacaccttaaaacatgaa

SEQ ID NO: 441140 - DNA, 8137 bp, Homo sapiens
aaggcgcacgatggcgcgtccctgcagccctcgcccggcgctccagtagcaggacccggtctcgggaccagccggtaatatgcacgtgtcactagctgaggccctggaggttcggggtggaccacttcaggaggaagaaatatgggctgtattaaatcaaagtgctgaaagtctccaagaattattcagaaaagtaagcctagctgatcctgctgcccttggcttcatcatttctccatggtctctgctgttgctgccatctggtagtgtgtcatttacagatgaaaatatttccaatcaggatcttcgagcattcactgcaccagaggttcttcaaaatcagtcactaacttctctctcagatgttgaaaagatccacatttattctcttggaatgacactgtattggggggctgattatgaagtgcctcagagccaacctattaagcttggagatcatctcaacagcatactgcttggaatgtgtgaggatgttatttacgctcgagtttctgttcggactgtgctggatgcttgcagtgcccacattaggaatagcaattgtgcaccctcattttcctacgtgaaacacttggtaaaactggttctgggaaatctttctgggacagatcagctttcctgtaacagtgaacaaaagcctgatcgaagccaggctattcgagatcgattgcgaggaaaaggattaccaacaggaagaagctctacttctgatgtactagacatacaaaagcctccactctctcatcagacctttcttaacaaagggcttagtaaatctatgggatttctgtccatcaaagatacacaagatgagaattatttcaaggacattttatcagataattctggacgtgaagattctgaaaatacattctccccttaccagttcaaaactagtggcccagaaaaaaaacccatccctggcattgatgtgctttctaagaagaagatctgggcttcatccatggacttgctttgtacagctgacagagacttctcttcaggagagactgccacatatcgtcgttgtcaccctgaggcagtaacagtgcggacttcaactactcctagaaaaaaggaggcaagatactcagatggaagtatagccttggatatctttggccctcagaaaatggatccaatatatcacactcgagaattgcccacctcctcagcaatatcaagtgctttggaccgaatccgagagagacaaaagaaacttcaggttctgagggaagccatgaatgtagaagaaccagttcgaagatacaaaacttatcatggtgatgtctttagtacctccagtgaaagtccatctattatttcctctgaatcagatttcagacaagtgagaagaagtgaagcctcaaagaggtttgaatccagcagtggtctcccaggggtagatgaaaccttaagtcaaggccagtcacagagaccgagcagacaatatgaaacaccctttgaaggcaacttaattaatcaagagatcatgctaaaacggcaagaggaagaactgatgcagctacaagccaaaatggcccttagacagtctcggttgagcctatatccaggagacacaatcaaagcgtccatgcttgacatcaccagggatccgttaagagaaattgccctagaaacagccatgactcaaagaaaactgaggaatttctttggccctgagtttgtgaaaatgacaattgaaccatttatatctttggatttgccacggtctattcttactaagaaagggaagaatgaggataaccgaaggaaagtaaacataatgcttctgaacgggcaaagactggaactgacctgtgataccaaaactatatgtaaagatgtgtttgatatggttgtggcacatattggcttagtagagcatcatttgtttgctttagctaccctcaaagataatgaatatttctttgttgatcctgacttaaaattaaccaaagtggccccagagggatggaaagaagaaccaaagaaaaagaccaaagccactgttaattttactttgtttttcagaattaaattttttatggatgatgttagtctaatacaacatactctgacgtgtcatcagtattaccttcagcttcgaaaagatattttggaggaaaggatgcactgtgatgatgagacttccttattgctggcatccttggctctccaggctgagtatggagattatcaaccagaggttcatggtgtgtcttactttagaatggagcactatttgcccgccagagtgatggagaaacttgatttatcctatatcaaagaagagttacccaaattgcataatacctatgtgggagcttctgaaaaagagacagagttagaatttttaaaggtctgccaaagactgacagaatatggagttcattttcaccgagtgcaccctgagaagaagtcacaaacaggaatattgcttggagtctgttctaaaggtgtccttgtgtttgaagttcacaatggagtgcgcacattggtccttcgctttccatggagggaaaccaagaaaatatctttttctaaaaagaaaatcacattgcaaaatacatcagatggaataaaacatggcttccagacagacaacagtaagatatgccagtacctgctgcacctctgctcttaccagcataagttccagctacagatgagagcaagacagagcaaccaagatgcccaagatattgagagagcttcgtttaggagcctgaatctccaagcagagtctgttagaggatttaatatgggacgagcaatcagcactggcagtctggccagcagcaccctcaacaaacttgctgttcgacctttatcagttcaagctgagattctgaagaggctatcctgctcagagctgtcgctttaccagccattgcaaaacagttcaaaagagaagaatgacaaagcttcatgggaggaaaagcctagagagatgagtaaatcataccatgatctcagtcaggcctctctctatccacatcggaaaaatgtcattgttaacatggaacccccaccacaaaccgttgcagagttggtgggaaaaccttctcaccagatgtcaagatctgatgcagaatctttggcaggagtgacaaaacttaataattcaaagtctgttgcgagtttaaatagaagtcctgaaaggaggaaacatgaatcagactcctcatccattgaagaccctgggcaagcatatgttctaggaatgactatgcatagttctggaaactcttcatcccaagtacccttaaaagaaaatgatgtgctacacaaaagatggagcatagtatcttcaccagaaagggagatcaccttagtgaacctgaaaaaagatgcaaagtatggcttgggatttcaaattattggtggggagaagatgggaagactggacctaggcatatttatcagttcagttgcccctggaggaccagctgacttggatggatgcttgaagccaggagaccgtttgatatctgtgaatagtgtgagtctggagggagtcagccaccatgctgcaattgaaattttgcaaaatgcacctgaagatgtgacacttgttatctctcagccaaaagaaaagatatccaaagtgccttctactcctgtgcatctcaccaatgagatgaaaaactacatgaagaaatcttcctacatgcaagacagtgctatagattcttcttccaaggatcaccactggtcacgtggtaccctgaggcacatctcggagaactcctttgggccatctgggggcctgcgggaaggaagcctgagttctcaagattccaggactgagagtgccagcttgtctcaaagccaggtcaatggtttctttgccagccatttaggtgaccaaacctggcaggaatcacagcatggcagcccttccccatctgtaatatccaaagccaccgagaaagagactttcactgatagtaaccaaagcaaaactaaaaagccaggcatttctgatgtaactgattactcagaccgtggagattcagacatggatgaagccacttactccagcagtcaggatcatcaaacaccaaaacaggaatcttcctcttcagtgaatacatccaacaagatgaattttaaaactttttcttcatcacctcctaagcctggagatatctttgaggttgaactggctaaaaatgataacagcttggggataagtgtcacgggaggtgtgaatacgagtgtcagacatggtggcatttatgtgaaagctgttattccccagggagcagcagagtctgatggtagaattcacaaaggtgatcgcgtcctagctgtcaatggagttagtctagaaggagccacccataagcaagctgtggaaacactgagaaatacaggacaggtggttcatctgttattagaaaagggacaatctccaacatctaaagaacatgtcccggtaaccccacagtgtaccctttcagatcagaatgcccaaggtcaaggcccagaaaaagtgaagaaaacaactcaggtcaaagactacagctttgtcactgaagaaaatacatttgaggtaaaattatttaaaaatagctcaggtctaggattcagtttttctcgagaagataatcttataccggagcaaattaatgccagcatagtaagggttaaaaagctctttcctggacagccagcagcagaaagtggaaaaattgatgtaggagatgttatcttgaaagtgaatggagcctctttgaaaggactatctcagcaggaagtcatatctgctctcaggggaactgctccagaagtattcttgcttctctgcagacctccacctggtgtgctaccggaaattgatactgcgcttttgaccccacttcagtctccagcacaagtacttccaaacagcagtaaagactcttctcagccatcatgtgtggagcaaagcaccagctcagatgaaaatgaaatgtcagacaaaagcaaaaaacagtgcaagtccccatccagaagagacagttacagtgacagcagtgggagtggagaagatgacttagtgacagctccagcaaacatatcaaattcgacctggagttcagctttgcatcagactctaagcaacatggtatcacaggcacagagtcatcatgaagcacccaagagtcaagaagataccatttgtaccatgttttactatcctcagaaaattcccaataaaccagagtttgaggacagtaatccttcccctctaccaccggatatggctcctgggcagagttatcaaccccaatcagaatctgcttcctctagttcgatggataagtatcatatacatcacatttctgaaccaactagacaagaaaactggacacctttgaaaaatgacttggaaaatcaccttgaagactttgaactggaagtagaactcctcattaccctaattaaatcagaaaaaggaagcctgggttttacagtaaccaaaggcaatcagagaattggttgttatgttcatgatgtcatacaggatccagccaaaagtgatggaaggctaaaacctggggaccggctcataaaggttaatgatacagatgttactaatatgactcatacagatgcagttaatctgctccgggctgcatccaaaacagtcagattagttattggacgagttctagaattacccagaataccaatgttgcctcatttgctaccggacataacactaacgtgcaacaaagaggagttgggtttttccttatgtggaggtcatgacagcctttatcaagtggtatatattagtgatattaatccaaggtccgtcgcagccattgagggtaatctccagctattagatgtcatccattatgtgaacggagtcagcacacaaggaatgaccttggaggaagttaacagagcattagacatgtcacttccttcattggtattgaaagcaacaagaaatgatcttccagtggtccccagctcaaagaggtctgctgtttcagctccaaagtcaaccaaaggcaatggttcctacagtgtggggtcttgcagccagcctgccctcactcctaatgattcattctccacggttgctggggaagaaataaatgaaatatcgtaccccaaaggaaaatgttctacttatcagataaagggatcaccaaacttgactctgcccaaagaatcttatatacaagaagatgacatttatgatgattcccaagaagctgaagttatccagtctctgctggatgttgtggatgaggaagcccagaatcttttaaacgaaaataatgcagcaggatactcctgtggtccaggtacattaaagatgaatgggaagttatcagaagagagaacagaagatacagactgcgatggttcacctttacctgagtattttactgaggccaccaaaatgaatggctgtgaagaatattgtgaagaaaaagtaaaaagtgaaagcttaattcagaagccacaagaaaagaagactgatgatgatgaaataacatggggaaatgatgagttgccaatagagagaacaaaccatgaagattctgataaagatcattcctttctgacaaacgatgagctcgctgtactccctgtcgtcaaagtgcttccctctggtaaatacacgggtgccaacttaaaatcagtcattcgagtcctgcggggtttgctagatcaaggaattccttctaaggagctggagaatcttcaagaattaaaacctttggatcagtgtctaattgggcaaactaaggaaaacagaaggaagaacagatataaaaatatacttccctatgatgctacaagagtgcctcttggagatgaaggtggctatatcaatgccagcttcattaagataccagttgggaaagaagagttcgtttacattgcctgccaaggaccactgcctacaactgttggagacttctggcagatgatttgggagcaaaaatccacagtgatagccatgatgactcaagaagtagaaggagaaaaaatcaaatgccagcgctattggcccaacatcctaggcaaaacaacaatggtcagcaacagacttcgactggctcttgtgagaatgcagcagctgaagggctttgtggtgagggcaatgacccttgaagatattcagaccagagaggtgcgccatatttctcatctgaatttcactgcctggccagaccatgatacaccttctcaaccagatgatctgcttacttttatctcctacatgagacacatccacagatcaggcccaatcattacgcactgcagtgctggcattggacgttcagggaccctgatttgcatagatgtggttctgggattaatcagtcaggatcttgattttgacatctctgatttggtgcgctgcatgagactacaaagacacggaatggttcagacagaggatcaatatattttctgctatcaagtcatcctttatgtcctgacacgtcttcaagcagaagaagagcaaaaacagcagcctcagcttctgaagtgacatgaaaagagcctctggatgcatttccatttctctccttaacctccagcagactcctgctctctatccaaaataaagatcacagagcagcaagttcatacaacatgcatgttctcctctatcttagaggggtattcttcttgaaaataaaaaatattgaaatgctgtatttttacagctactttaacctatgataattatttacaaaattttaacactaaccaaacaatgcagatcttagggatgattaaaggcagcatttgatgatagcagacattgttacaaggacatggtgagtctatttttaatgcaccaatcttgtttatagcaaaaatgttttccaatattttaataaagtagttattttataggggatacttgaaaccagtatttaagctttaaatgacagtaatattggcatagaaaaaagtagcaaatgtttactgtatcaatttctaatgtttactatatagaatttcctgtaatatatttatatactttttcatgaaaatggagttatcagttatctgtttgttactgcatcatctgtttgtaatcattatctcactttgtaaataaaaacacaccttaaaacatgaa

SEQ ID NO: 441141 - DNA, 7564 bp, Homo sapiens
aaggcgcacgatggcgcgtccctgcagccctcgcccggcgctccagtagcaggacccggtctcgggaccagccggtaatatgcacgtgtcactagctgaggccctggaggttcggggtggaccacttcaggaggaagaaatatgggctgtattaaatcaaagtgctgaaagtctccaagaattattcagaaaagtaagcctagctgatcctgctgcccttggcttcatcatttctccatggtctctgctgttgctgccatctggtagtgtgtcatttacagatgaaaatatttccaatcaggatcttcgagcattcactgcaccagaggttcttcaaaatcagtcactaacttctctctcagatgttgaaaagatccacatttattctcttggaatgacactgtattggggggctgattatgaagtgcctcagagccaacctattaagcttggagatcatctcaacagcatactgcttggaatgtgtgaggatgttatttacgctcgagtttctgttcggactgtgctggatgcttgcagtgcccacattaggaatagcaattgtgcaccctcattttcctacgtgaaacacttggtaaaactggttctgggaaatctttctgggacagatcagctttcctgtaacagtgaacaaaagcctgatcgaagccaggctattcgagatcgattgcgaggaaaaggattaccaacaggaagaagctctacttctgatgtactagacatacaaaagcctccactctctcatcagacctttcttaacaaagggcttagtaaatctatgggatttctgtccatcaaagatacacaagatgagaattatttcaaggacattttatcagataattctggacgtgaagattctgaaaatacattctccccttaccagttcaaaactagtggcccagaaaaaaaacccatccctggcattgatgtgctttctaagaagaagatctgggcttcatccatggacttgctttgtacagctgacagagacttctcttcaggagagactgccacatatcgtcgttgtcaccctgaggcagtaacagtgcggacttcaactactcctagaaaaaaggaggcaagatactcagatggaagtatagccttggatatctttggccctcagaaaatggatccaatatatcacactcgagaattgcccacctcctcagcaatatcaagtgctttggaccgaatccgagagagacaaaagaaacttcaggttctgagggaagccatgaatgtagaagaaccagttcgaagatacaaaacttatcatggtgatgtctttagtacctccagtgaaagtccatctattatttcctctgaatcagatttcagacaagtgagaagaagtgaagcctcaaagaggtttgaatccagcagtggtctcccaggggtagatgaaaccttaagtcaaggccagtcacagagaccgagcagacaatatgaaacaccctttgaaggcaacttaattaatcaagagatcatgctaaaacggcaagaggaagaactgatgcagctacaagccaaaatggcccttagacagtctcggttgagcctatatccaggagacacaatcaaagcgtccatgcttgacatcaccagggatccgttaagagaaattgccctagaaacagccatgactcaaagaaaactgaggaatttctttggccctgagtttgtgaaaatgacaattgaaccatttatatctttggatttgccacggtctattcttactaagaaagggaagaatgaggataaccgaaggaaagtaaacataatgcttctgaacgggcaaagactggaactgacctgtgataccaaaactatatgtaaagatgtgtttgatatggttgtggcacatattggcttagtagagcatcatttgtttgctttagctaccctcaaagataatgaatatttctttgttgatcctgacttaaaattaaccaaagtggccccagagggatggaaagaagaaccaaagaaaaagaccaaagccactgttaattttactttgtttttcagaattaaattttttatggatgatgttagtctaatacaacatactctgacgtgtcatcagtattaccttcagcttcgaaaagatattttggaggaaaggatgcactgtgatgatgagacttccttattgctggcatccttggctctccaggctgagtatggagattatcaaccagaggttcatggtgtgtcttactttagaatggagcactatttgcccgccagagtgatggagaaacttgatttatcctatatcaaagaagagttacccaaattgcataatacctatgtgggagcttctgaaaaagagacagagttagaatttttaaaggtctgccaaagactgacagaatatggagttcattttcaccgagtgcaccctgagaagaagtcacaaacaggaatattgcttggagtctgttctaaaggtgtccttgtgtttgaagttcacaatggagtgcgcacattggtccttcgctttccatggagggaaaccaagaaaatatctttttctaaaaagaaaatcacattgcaaaatacatcagatggaataaaacatggcttccagacagacaacagtaagatatgccagtacctgctgcacctctgctcttaccagcataagttccagctacagatgagagcaagacagagcaaccaagatgcccaagatattgatgtgctacacaaaagatggagcatagtatcttcaccagaaagggagatcaccttagtgaacctgaaaaaagatgcaaagtatggcttgggatttcaaattattggtggggagaagatgggaagactggacctaggcatatttatcagttcagttgcccctggaggaccagctgacttggatggatgcttgaagccaggagaccgtttgatatctgtgaatagtgtgagtctggagggagtcagccaccatgctgcaattgaaattttgcaaaatgcacctgaagatgtgacacttgttatctctcagccaaaagaaaagatatccaaagtgccttctactcctgtgcatctcaccaatgagatgaaaaactacatgaagaaatcttcctacatgcaagacagtgctatagattcttcttccaaggatcaccactggtcacgtggtaccctgaggcacatctcggagaactcctttgggccatctgggggcctgcgggaaggaagcctgagttctcaagattccaggactgagagtgccagcttgtctcaaagccaggtcaatggtttctttgccagccatttaggtgaccaaacctggcaggaatcacagcatggcagcccttccccatctgtaatatccaaagccaccgagaaagagactttcactgatagtaaccaaagcaaaactaaaaagccaggcatttctgatgtaactgattactcagaccgtggagattcagacatggatgaagccacttactccagcagtcaggatcatcaaacaccaaaacaggaatcttcctcttcagtgaatacatccaacaagatgaattttaaaactttttcttcatcacctcctaagcctggagatatctttgaggttgaactggctaaaaatgataacagcttggggataagtgtcacgggaggtgtgaatacgagtgtcagacatggtggcatttatgtgaaagctgttattccccagggagcagcagagtctgatggtagaattcacaaaggtgatcgcgtcctagctgtcaatggagttagtctagaaggagccacccataagcaagctgtggaaacactgagaaatacaggacaggtggttcatctgttattagaaaagggacaatctccaacatctaaagaacatgtcccggtaaccccacagtgtaccctttcagatcagaatgcccaaggtcaaggcccagaaaaagtgaagaaaacaactcaggtcaaagactacagctttgtcactgaagaaaatacatttgaggtaaaattatttaaaaatagctcaggtctaggattcagtttttctcgagaagataatcttataccggagcaaattaatgccagcatagtaagggttaaaaagctctttcctggacagccagcagcagaaagtggaaaaattgatgtaggagatgttatcttgaaagtgaatggagcctctttgaaaggactatctcagcaggaagtcatatctgctctcaggggaactgctccagaagtattcttgcttctctgcagacctccacctggtgtgctaccggaaattgatactgcgcttttgaccccacttcagtctccagcacaagtacttccaaacagcagtaaagactcttctcagccatcatgtgtggagcaaagcaccagctcagatgaaaatgaaatgtcagacaaaagcaaaaaacagtgcaagtccccatccagaagagacagttacagtgacagcagtgggagtggagaagatgacttagtgacagctccagcaaacatatcaaattcgacctggagttcagctttgcatcagactctaagcaacatggtatcacaggcacagagtcatcatgaagcacccaagagtcaagaagataccatttgtaccatgttttactatcctcagaaaattcccaataaaccagagtttgaggacagtaatccttcccctctaccaccggatatggctcctgggcagagttatcaaccccaatcagaatctgcttcctctagttcgatggataagtatcatatacatcacatttctgaaccaactagacaagaaaactggacacctttgaaaaatgacttggaaaatcaccttgaagactttgaactggaagtagaactcctcattaccctaattaaatcagaaaaaggaagcctgggttttacagtaaccaaaggcaatcagagaattggttgttatgttcatgatgtcatacaggatccagccaaaagtgatggaaggctaaaacctggggaccggctcataaaggttaatgatacagatgttactaatatgactcatacagatgcagttaatctgctccgggctgcatccaaaacagtcagattagttattggacgagttctagaattacccagaataccaatgttgcctcatttgctaccggacataacactaacgtgcaacaaagaggagttgggtttttccttatgtggaggtcatgacagcctttatcaagtggtatatattagtgatattaatccaaggtccgtcgcagccattgagggtaatctccagctattagatgtcatccattatgtgaacggagtcagcacacaaggaatgaccttggaggaagttaacagagcattagacatgtcacttccttcattggtattgaaagcaacaagaaatgatcttccagtggtccccagctcaaagaggtctgctgtttcagctccaaagtcaaccaaaggcaatggttcctacagtgtggggtcttgcagccagcctgccctcactcctaatgattcattctccacggttgctggggaagaaataaatgaaatatcgtaccccaaaggaaaatgttctacttatcagataaagggatcaccaaacttgactctgcccaaagaatcttatatacaagaagatgacatttatgatgattcccaagaagctgaagttatccagtctctgctggatgttgtggatgaggaagcccagaatcttttaaacgaaaataatgcagcaggatactcctgtggtccaggtacattaaagatgaatgggaagttatcagaagagagaacagaagatacagactgcgatggttcacctttacctgagtattttactgaggccaccaaaatgaatggctgtgaagaatattgtgaagaaaaagtaaaaagtgaaagcttaattcagaagccacaagaaaagaagactgatgatgatgaaataacatggggaaatgatgagttgccaatagagagaacaaaccatgaagattctgataaagatcattcctttctgacaaacgatgagctcgctgtactccctgtcgtcaaagtgcttccctctggtaaatacacgggtgccaacttaaaatcagtcattcgagtcctgcggggtttgctagatcaaggaattccttctaaggagctggagaatcttcaagaattaaaacctttggatcagtgtctaattgggcaaactaaggaaaacagaaggaagaacagatataaaaatatacttccctatgatgctacaagagtgcctcttggagatgaaggtggctatatcaatgccagcttcattaagataccagttgggaaagaagagttcgtttacattgcctgccaaggaccactgcctacaactgttggagacttctggcagatgatttgggagcaaaaatccacagtgatagccatgatgactcaagaagtagaaggagaaaaaatcaaatgccagcgctattggcccaacatcctaggcaaaacaacaatggtcagcaacagacttcgactggctcttgtgagaatgcagcagctgaagggctttgtggtgagggcaatgacccttgaagatattcagaccagagaggtgcgccatatttctcatctgaatttcactgcctggccagaccatgatacaccttctcaaccagatgatctgcttacttttatctcctacatgagacacatccacagatcaggcccaatcattacgcactgcagtgctggcattggacgttcagggaccctgatttgcatagatgtggttctgggattaatcagtcaggatcttgattttgacatctctgatttggtgcgctgcatgagactacaaagacacggaatggttcagacagaggatcaatatattttctgctatcaagtcatcctttatgtcctgacacgtcttcaagcagaagaagagcaaaaacagcagcctcagcttctgaagtgacatgaaaagagcctctggatgcatttccatttctctccttaacctccagcagactcctgctctctatccaaaataaagatcacagagcagcaagttcatacaacatgcatgttctcctctatcttagaggggtattcttcttgaaaataaaaaatattgaaatgctgtatttttacagctactttaacctatgataattatttacaaaattttaacactaaccaaacaatgcagatcttagggatgattaaaggcagcatttgatgatagcagacattgttacaaggacatggtgagtctatttttaatgcaccaatcttgtttatagcaaaaatgttttccaatattttaataaagtagttattttataggggatacttgaaaccagtatttaagctttaaatgacagtaatattggcatagaaaaaagtagcaaatgtttactgtatcaatttctaatgtttactatatagaatttcctgtaatatatttatatactttttcatgaaaatggagttatcagttatctgtttgttactgcatcatctgtttgtaatcattatctcactttgtaaataaaaacacaccttaaaacatgaa

SEQ ID NO: 441142 - DNA, 430 bp, Homo sapiens
taaaatgttgccttttaatttaaaaatgcaatatctgcactgaagagattacagagaatgggatagcatgctggggacagagtttgagaatggtacaaaatactatgtaattaatggcattccttccctatttccaacctgaaaaagagatagaaggtaacattcttgctacagaaattccctgagaagtaatggattcatcagcattgactggaacacagcaaggcaggctggagttgcttagcttcaagaagacattctgtaaggagtgtgaatacatgggtccatttatcctcttttgatgattttcgtttctcttacctgaaaggaaaccatcacccactgacacaatggcgtccttcacagggagtgccgtatttagagtgtctgtcttcactgaagagttccacaatcctctttgtttataatg

SEQ ID NO: 441143 - DNA, 8432 bp, Homo sapiens
aaggcgcacgatggcgcgtccctgcagccctcgcccggcgctccagtagcaggacccggtctcgggaccagccggtaatatgcacgtgtcactagctgaggccctggaggttcggggtggaccacttcaggaggaagaaatatgggctgtattaaatcaaagtgctgaaagtctccaagaattattcagaaaagtaagcctagctgatcctgctgcccttggcttcatcatttctccatggtctctgctgttgctgccatctggtagtgtgtcatttacagatgaaaatatttccaatcaggatcttcgagcattcactgcaccagaggttcttcaaaatcagtcactaacttctctctcagatgttgaaaagatccacatttattctcttggaatgacactgtattggggggctgattatgaagtgcctcagagccaacctattaagcttggagatcatctcaacagcatactgcttggaatgtgtgaggatgttatttacgctcgagtttctgttcggactgtgctggatgcttgcagtgcccacattaggaatagcaattgtgcaccctcattttcctacgtgaaacacttggtaaaactggttctgggaaatctttctgggacagatcagctttcctgtaacagtgaacaaaagcctgatcgaagccaggctattcgagatcgattgcgaggaaaaggattaccaacaggaagaagctctacttctgatgtactagacatacaaaagcctccactctctcatcagacctttcttaacaaagggcttagtaaatctatgggatttctgtccatcaaagatacacaagatgagaattatttcaaggacattttatcagataattctggacgtgaagattctgaaaatacattctccccttaccagttcaaaactagtggcccagaaaaaaaacccatccctggcattgatgtgctttctaagaagaagatctgggcttcatccatggacttgctttgtacagctgacagagacttctcttcaggagagactgccacatatcgtcgttgtcaccctgaggcagtaacagtgcggacttcaactactcctagaaaaaaggaggcaagatactcagatggaagtatagccttggatatctttggccctcagaaaatggatccaatatatcacactcgagaattgcccacctcctcagcaatatcaagtgctttggaccgaatccgagagagacaaaagaaacttcaggttctgagggaagccatgaatgtagaagaaccagttcgaagatacaaaacttatcatggtgatgtctttagtacctccagtgaaagtccatctattatttcctctgaatcagatttcagacaagtgagaagaagtgaagcctcaaagaggtttgaatccagcagtggtctcccaggggtagatgaaaccttaagtcaaggccagtcacagagaccgagcagacaatatgaaacaccctttgaaggcaacttaattaatcaagagatcatgctaaaacggcaagaggaagaactgatgcagctacaagccaaaatggcccttagacagtctcggttgagcctatatccaggagacacaatcaaagcgtccatgcttgacatcaccagggatccgttaagagaaattgccctagaaacagccatgactcaaagaaaactgaggaatttctttggccctgagtttgtgaaaatgacaattgaaccatttatatctttggatttgccacggtctattcttactaagaaagggaagaatgaggataaccgaaggaaagtaaacataatgcttctgaacgggcaaagactggaactgacctgtgataccaaaactatatgtaaagatgtgtttgatatggttgtggcacatattggcttagtagagcatcatttgtttgctttagctaccctcaaagataatgaatatttctttgttgatcctgacttaaaattaaccaaagtggccccagagggatggaaagaagaaccaaagaaaaagaccaaagccactgttaattttactttgtttttcagaattaaattttttatggatgatgttagtctaatacaacatactctgacgtgtcatcagtattaccttcagcttcgaaaagatattttggaggaaaggatgcactgtgatgatgagacttccttattgctggcatccttggctctccaggctgagtatggagattatcaaccagaggttcatggtgtgtcttactttagaatggagcactatttgcccgccagagtgatggagaaacttgatttatcctatatcaaagaagagttacccaaattgcataatacctatgtgggagcttctgaaaaagagacagagttagaatttttaaaggtctgccaaagactgacagaatatggagttcattttcaccgagtgcaccctgagaagaagtcacaaacaggaatattgcttggagtctgttctaaaggtgtccttgtgtttgaagttcacaatggagtgcgcacattggtccttcgctttccatggagggaaaccaagaaaatatctttttctaaaaagaaaatcacattgcaaaatacatcagatggaataaaacatggcttccagacagacaacagtaagatatgccagtacctgctgcacctctgctcttaccagcataagttccagctacagatgagagcaagacagagcaaccaagatgcccaagatattgagagagcttcgtttaggagcctgaatctccaagcagagtctgttagaggatttaatatgggacgagcaatcagcactggcagtctggccagcagcaccctcaacaaacttgctgttcgacctttatcagttcaagctgagattctgaagaggctatcctgctcagagctgtcgctttaccagccattgcaaaacagttcaaaagagaagaatgacaaagcttcatgggaggaaaagcctagagagatgagtaaatcataccatgatctcagtcaggcctctctctatccacatcggaaaaatgtcattgttaacatggaacccccaccacaaaccgttgcagagttggtgggaaaaccttctcaccagatgtcaagatctgatgcagaatctttggcaggagtgacaaaacttaataattcaaagtctgttgcgagtttaaatagaagtcctgaaaggaggaaacatgaatcagactcctcatccattgaagaccctgggcaagcatatgttctagatgtgctacacaaaagatggagcatagtatcttcaccagaaagggagatcaccttagtgaacctgaaaaaagatgcaaagtatggcttgggatttcaaattattggtggggagaagatgggaagactggacctaggcatatttatcagttcagttgcccctggaggaccagctgacttggatggatgcttgaagccaggagaccgtttgatatctgtgaatagtgtgagtctggagggagtcagccaccatgctgcaattgaaattttgcaaaatgcacctgaagatgtgacacttgttatctctcagccaaaagaaaagatatccaaagtgccttctactcctgtgcatctcaccaatgagatgaaaaactacatgaagaaatcttcctacatgcaagacagtgctatagattcttcttccaaggatcaccactggtcacgtggtaccctgaggcacatctcggagaactcctttgggccatctgggggcctgcgggaaggaagcctgagttctcaagattccaggactgagagtgccagcttgtctcaaagccaggtcaatggtttctttgccagccatttaggtgaccaaacctggcaggaatcacagcatggcagcccttccccatctgtaatatccaaagccaccgagaaagagactttcactgatagtaaccaaagcaaaactaaaaagccaggcatttctgatgtaactgattactcagaccgtggagattcagacatggatgaagccacttactccagcagtcaggatcatcaaacaccaaaacaggaatcttcctcttcagtgaatacatccaacaagatgaattttaaaactttttcttcatcacctcctaagcctggagatatctttgaggttgaactggctaaaaatgataacagcttggggataagtgtcacgggaggtgtgaatacgagtgtcagacatggtggcatttatgtgaaagctgttattccccagggagcagcagagtctgatggtagaattcacaaaggtgatcgcgtcctagctgtcaatggagttagtctagaaggagccacccataagcaagctgtggaaacactgagaaatacaggacaggtggttcatctgttattagaaaagggacaatctccaacatctaaagaacatgtcccggtaaccccacagtgtaccctttcagatcagaatgcccaaggtcaaggcccagaaaaagtgaagaaaacaactcaggtcaaagactacagctttgtcactgaagaaaatacatttgaggtaaaattatttaaaaatagctcaggtctaggattcagtttttctcgagaagataatcttataccggagcaaattaatgccagcatagtaagggttaaaaagctctttcctggacagccagcagcagaaagtggaaaaattgatgtaggagatgttatcttgaaagtgaatggagcctctttgaaaggactatctcagcaggaagtcatatctgctctcaggggaactgctccagaagtattcttgcttctctgcagacctccacctggtgtgctaccggaaattgatactgcgcttttgaccccacttcagtctccagcacaagtacttccaaacagcagtaaagactcttctcagccatcatgtgtggagcaaagcaccagctcagatgaaaatgaaatgtcagacaaaagcaaaaaacagtgcaagtccccatccagaagagacagttacagtgacagcagtgggagtggagaagatgacttagtgacagctccagcaaacatatcaaattcgacctggagttcagctttgcatcagactctaagcaacatggtatcacaggcacagagtcatcatgaagcacccaagagtcaagaagataccatttgtaccatgttttactatcctcagaaaattcccaataaaccagagtttgaggacagtaatccttcccctctaccaccggatatggctcctgggcagagttatcaaccccaatcagaatctgcttcctctagttcgatggataagtatcatatacatcacatttctgaaccaactagacaagaaaactggacacctttgaaaaatgacttggaaaatcaccttgaagactttgaactggaagtagaactcctcattaccctaattaaatcagaaaaaggaagcctgggttttacagtaaccaaaggcaatcagagaattggttgttatgttcatgatgtcatacaggatccagccaaaagtgatggaaggctaaaacctggggaccggctcataaaggttaatgatacagatgttactaatatgactcatacagatgcagttaatctgctccgggctgcatccaaaacagtcagattagttattggacgagttctagaattacccagaataccaatgttgcctcatttgctaccggacataacactaacgtgcaacaaagaggagttgggtttttccttatgtggaggtcatgacagcctttatcaagtggtatatattagtgatattaatccaaggtccgtcgcagccattgagggtaatctccagctattagatgtcatccattatgtgaacggagtcagcacacaaggaatgaccttggaggaagttaacagagcattagacatgtcacttccttcattggtattgaaagcaacaagaaatgatcttccagtggtccccagctcaaagaggtctgctgtttcagctccaaagtcaaccaaaggcaatggttcctacagtgtggggtcttgcagccagcctgccctcactcctaatgattcattctccacggttgctggggaagaaataaatgaaatatcgtaccccaaaggaaaatgttctacttatcagataaagggatcaccaaacttgactctgcccaaagaatcttatatacaagaagatgacatttatgatgattcccaagaagctgaagttatccagtctctgctggatgttgtggatgaggaagcccagaatcttttaaacgaaaataatgcagcaggatactcctgtggtccaggtacattaaagatgaatgggaagttatcagaagagagaacagaagatacagactgcgatggttcacctttacctgagtattttactgaggccaccaaaatgaatggctgtgaagaatattgtgaagaaaaagtaaaaagtgaaagcttaattcagaagccacaagaaaagaagactgatgatgatgaaataacatggggaaatgatgagttgccaatagagagaacaaaccatgaagattctgataaagatcattcctttctgacaaacgatgagctcgctgtactccctgtcgtcaaagtgcttccctctggtaaatacacgggtgccaacttaaaatcagtcattcgagtcctgcggggtttgctagatcaaggaattccttctaaggagctggagaatcttcaagaattaaaacctttggatcagtgtctaattgggcaaactaaggaaaacagaaggaagaacagatataaaaatatacttccctatgatgctacaagagtgcctcttggagatgaaggtggctatatcaatgccagcttcattaagataccagttgggaaagaagagttcgtttacattgcctgccaaggaccactgcctacaactgttggagacttctggcagatgatttgggagcaaaaatccacagtgatagccatgatgactcaagaagtagaaggagaaaaaatcaaatgccagcgctattggcccaacatcctaggcaaaacaacaatggtcagcaacagacttcgactggctcttgtgagaatgcagcagctgaagggctttgtggtgagggcaatgacccttgaagatattcagaccagagaggtgcgccatatttctcatctgaatttcactgcctggccagaccatgatacaccttctcaaccagatgatctgcttacttttatctcctacatgagacacatccacagatcaggcccaatcattacgcactgcagtgctggcattggacgttcagggaccctgatttgcatagatgtggttctgggattaatcagtcaggatcttgattttgacatctctgatttggtgcgctgcatgagactacaaagacacggaatggttcagacagaggatcaatatattttctgctatcaagtcatcctttatgtcctgacacgtcttcaagcagaagaagagcaaaaacagcagcctcagcttctgaagtgacatgaaaagagcctctggatgcatttccatttctctccttaacctccagcagactcctgctctctatccaaaataaagatcacagagcagcaagttcatacaacatgcatgttctcctctatcttagaggggtattcttcttgaaaataaaaaatattgaaatgctgtatttttacagctactttaacctatgataattatttacaaaattttaacactaaccaaacaatgcagatcttagggatgattaaaggcagcatttgatgatagcagacattgttacaaggacatggtgagtctatttttaatgcaccaatcttgtttatagcaaaaatgttttccaatattttaataaagtagttattttataggggatacttgaaaccagtatttaagctttaaatgacagtaatattggcatagaaaaaagtagcaaatgtttactgtatcaatttctaatgtttactatatagaatttcctgtaatatatttatatactttttcatgaaaatggagttatcagttatctgtttgttactgcatcatctgtttgtaatcattatctcactttgtaaataaaaacacaccttaaaacatgaaaaaaaaaaaaaaaaaaaaaaaaaaaaaaaaaaagaaaaaaaaaaaaaaaaaaaagaaaagaagaaaaagaagcacaacaaaaacaaaacaaggggagggggggcgaacaaaaaaattaccccacagaagggaggcacatcataagacaaccacctattgtctgaaaggaaggacgccaccagaggcggattaaaaaacagcaggcgggcgggcgataacaacggacggggcggaacacaccgtcggcatactaggagagaccctcgggtgggggcagtagggaccacaacaagagaagcagcgaaaaaaaccaggtgtgggcacccccactagcgaggacggcggatgaatc

SEQ ID NO: 441144 - DNA, 7606 bp, Homo sapiens
aatgtccgttcatgtatacttgcttttattagataagagacgatgaactatgaaaagttatgcaaacatagtatctctttcctcttccactatgaccatcatcaccatcccatttcacctctgatcttccatttggagcatttaggaaattgccaccactttcattgtcaatagtggattacatttccatttattttctaaaaattgtgtgcatacatgatagattcttatcattccaggaagaagctctacttctgatgtactagacatacaaaagcctccactctctcatcagacctttcttaacaaagggcttagtaaatctatgggatttctgtccatcaaagatacacaagatgagaattatttcaaggacattttatcagataattctggacgtgaagattctgaaaatacattctccccttaccagttcaaaactagtggcccagaaaaaaaacccatccctggcattgatgtgctttctaagaagaagatctgggcttcatccatggacttgctttgtacagctgacagagacttctcttcaggagagactgccacatatcgtcgttgtcaccctgaggcagtaacagtgcggacttcaactactcctagaaaaaaggaggcaagatactcagatggaagtatagccttggatatctttggccctcagaaaatggatccaatatatcacactcgagaattgcccacctcctcagcaatatcaagtgctttggaccgaatccgagagagacaaaagaaacttcaggttctgagggaagccatgaatgtagaagaaccagttcgaagatacaaaacttatcatggtgatgtctttagtacctccagtgaaagtccatctattatttcctctgaatcagatttcagacaagtgagaagaagtgaagcctcaaagaggtttgaatccagcagtggtctcccaggggtagatgaaaccttaagtcaaggccagtcacagagaccgagcagacaatatgaaacaccctttgaaggcaacttaattaatcaagagatcatgctaaaacggcaagaggaagaactgatgcagctacaagccaaaatggcccttagacagtctcggttgagcctatatccaggagacacaatcaaagcgtccatgcttgacatcaccagggatccgttaagagaaattgccctagaaacagccatgactcaaagaaaactgaggaatttctttggccctgagtttgtgaaaatgacaattgaaccatttatatctttggatttgccacggtctattcttactaagaaagggaagaatgaggataaccgaaggaaagtaaacataatgcttctgaacgggcaaagactggaactgacctgtgataccaaaactatatgtaaagatgtgtttgatatggttgtggcacatattggcttagtagagcatcatttgtttgctttagctaccctcaaagataatgaatatttctttgttgatcctgacttaaaattaaccaaagtggccccagagggatggaaagaagaaccaaagaaaaagaccaaagccactgttaattttactttgtttttcagaattaaattttttatggatgatgttagtctaatacaacatactctgacgtgtcatcagtattaccttcagcttcgaaaagatattttggaggaaaggatgcactgtgatgatgagacttccttattgctggcatccttggctctccaggctgagtatggagattatcaaccagaggttcatggtgtgtcttactttagaatggagcactatttgcccgccagagtgatggagaaacttgatttatcctatatcaaagaagagttacccaaattgcataatacctatgtgggagcttctgaaaaagagacagagttagaatttttaaaggtctgccaaagactgacagaatatggagttcattttcaccgagtgcaccctgagaagaagtcacaaacaggaatattgcttggagtctgttctaaaggtgtccttgtgtttgaagttcacaatggagtgcgcacattggtccttcgctttccatggagggaaaccaagaaaatatctttttctaaaaagaaaatcacattgcaaaatacatcagatggaataaaacatggcttccagacagacaacagtaagatatgccagtacctgctgcacctctgctcttaccagcataagttccagctacagatgagagcaagacagagcaaccaagatgcccaagatattgagagagcttcgtttaggagcctgaatctccaagcagagtctgttagaggatttaatatgggacgagcaatcagcactggcagtctggccagcagcaccctcaacaaacttgctgttcgacctttatcagttcaagctgagattctgaagaggctatcctgctcagagctgtcgctttaccagccattgcaaaacagttcaaaagagaagaatgacaaagcttcatgggaggaaaagcctagagagatgagtaaatcataccatgatctcagtcaggcctctctctatccacatcggaaaaatgtcattgttaacatggaacccccaccacaaaccgttgcagagttggtgggaaaaccttctcaccagatgtcaagatctgatgcagaatctttggcaggagtgacaaaacttaataattcaaagtctgttgcgagtttaaatagaagtcctgaaaggaggaaacatgaatcagactcctcatccattgaagaccctgggcaagcatatgttctagatgtgctacacaaaagatggagcatagtatcttcaccagaaagggagatcaccttagtgaacctgaaaaaagatgcaaagtatggcttgggatttcaaattattggtggggagaagatgggaagactggacctaggcatatttatcagttcagttgcccctggaggaccagctgacttggatggatgcttgaagccaggagaccgtttgatatctgtgaatagtgtgagtctggagggagtcagccaccatgctgcaattgaaattttgcaaaatgcacctgaagatgtgacacttgttatctctcagccaaaagaaaagatatccaaagtgccttctactcctgtgcatctcaccaatgagatgaaaaactacatgaagaaatcttcctacatgcaagacagtgctatagattcttcttccaaggatcaccactggtcacgtggtaccctgaggcacatctcggagaactcctttgggccatctgggggcctgcgggaaggaagcctgagttctcaagattccaggactgagagtgccagcttgtctcaaagccaggtcaatggtttctttgccagccatttaggtgaccaaacctggcaggaatcacagcatggcagcccttccccatctgtaatatccaaagccaccgagaaagagactttcactgatagtaaccaaagcaaaactaaaaagccaggcatttctgatgtaactgattactcagaccgtggagattcagacatggatgaagccacttactccagcagtcaggatcatcaaacaccaaaacaggaatcttcctcttcagtgaatacatccaacaagatgaattttaaaactttttcttcatcacctcctaagcctggagatatctttgaggttgaactggctaaaaatgataacagcttggggataagtgtcacgggaggtgtgaatacgagtgtcagacatggtggcatttatgtgaaagctgttattccccagggagcagcagagtctgatggtagaattcacaaaggtgatcgcgtcctagctgtcaatggagttagtctagaaggagccacccataagcaagctgtggaaacactgagaaatacaggacaggtggttcatctgttattagaaaagggacaatctccaacatctaaagaacatgtcccggtaaccccacagtgtaccctttcagatcagaatgcccaaggtcaaggcccagaaaaagtgaagaaaacaactcaggtcaaagactacagctttgtcactgaagaaaatacatttgaggtaaaattatttaaaaatagctcaggtctaggattcagtttttctcgagaagataatcttataccggagcaaattaatgccagcatagtaagggttaaaaagctctttcctggacagccagcagcagaaagtggaaaaattgatgtaggagatgttatcttgaaagtgaatggagcctctttgaaaggactatctcagcaggaagtcatatctgctctcaggggaactgctccagaagtattcttgcttctctgcagacctccacctggtgtgctaccggaaattgatactgcgcttttgaccccacttcagtctccagcacaagtacttccaaacagcagtaaagactcttctcagccatcatgtgtggagcaaagcaccagctcagatgaaaatgaaatgtcagacaaaagcaaaaaacagtgcaagtccccatccagaagagacagttacagtgacagcagtgggagtggagaagatgacttagtgacagctccagcaaacatatcaaattcgacctggagttcagctttgcatcagactctaagcaacatggtatcacaggcacagagtcatcatgaagcacccaagagtcaagaagataccatttgtaccatgttttactatcctcagaaaattcccaataaaccagagtttgaggacagtaatccttcccctctaccaccggatatggctcctgggcagagttatcaaccccaatcagaatctgcttcctctagttcgatggataagtatcatatacatcacatttctgaaccaactagacaagaaaactggacacctttgaaaaatgacttggaaaatcaccttgaagactttgaactggaagtagaactcctcattaccctaattaaatcagaaaaaggaagcctgggttttacagtaaccaaaggcaatcagagaattggttgttatgttcatgatgtcatacaggatccagccaaaagtgatggaaggctaaaacctggggaccggctcataaaggttaatgatacagatgttactaatatgactcatacagatgcagttaatctgctccgggctgcatccaaaacagtcagattagttattggacgagttctagaattacccagaataccaatgttgcctcatttgctaccggacataacactaacgtgcaacaaagaggagttgggtttttccttatgtggaggtcatgacagcctttatcaagtggtatatattagtgatattaatccaaggtccgtcgcagccattgagggtaatctccagctattagatgtcatccattatgtgaacggagtcagcacacaaggaatgaccttggaggaagttaacagagcattagacatgtcacttccttcattggtattgaaagcaacaagaaatgatcttccagtggtccccagctcaaagaggtctgctgtttcagctccaaagtcaaccaaaggcaatggttcctacagtgtggggtcttgcagccagcctgccctcactcctaatgattcattctccacggttgctggggaagaaataaatgaaatatcgtaccccaaaggaaaatgttctacttatcagataaagggatcaccaaacttgactctgcccaaagaatcttatatacaagaagatgacatttatgatgattcccaagaagctgaagttatccagtctctgctggatgttgtggatgaggaagcccagaatcttttaaacgaaaataatgcagcaggatactcctgtggtccaggtacattaaagatgaatgggaagttatcagaagagagaacagaagatacagactgcgatggttcacctttacctgagtattttactgaggccaccaaaatgaatggctgtgaagaatattgtgaagaaaaagtaaaaagtgaaagcttaattcagaagccacaagaaaagaagactgatgatgatgaaataacatggggaaatgatgagttgccaatagagagaacaaaccatgaagattctgataaagatcattcctttctgacaaacgatgagctcgctgtactccctgtcgtcaaagtgcttccctctggtaaatacacgggtgccaacttaaaatcagtcattcgagtcctgcggggtttgctagatcaaggaattccttctaaggagctggagaatcttcaagaattaaaacctttggatcagtgtctaattgggcaaactaaggaaaacagaaggaagaacagatataaaaatatacttccctatgatgctacaagagtgcctcttggagatgaaggtggctatatcaatgccagcttcattaagataccagttgggaaagaagagttcgtttacattgcctgccaaggaccactgcctacaactgttggagacttctggcagatgatttgggagcaaaaatccacagtgatagccatgatgactcaagaagtagaaggagaaaaaatcaaatgccagcgctattggcccaacatcctaggcaaaacaacaatggtcagcaacagacttcgactggctcttgtgagaatgcagcagctgaagggctttgtggtgagggcaatgacccttgaagatattcagaccagagaggtgcgccatatttctcatctgaatttcactgcctggccagaccatgatacaccttctcaaccagatgatctgcttacttttatctcctacatgagacacatccacagatcaggcccaatcattacgcactgcagtgctggcattggacgttcagggaccctgatttgcatagatgtggttctgggattaatcagtcaggatcttgattttgacatctctgatttggtgcgctgcatgagactacaaagacacggaatggttcagacagaggatcaatatattttctgctatcaagtcatcctttatgtcctgacacgtcttcaagcagaagaagagcaaaaacagcagcctcagcttctgaagtgacatgaaaagagcctctggatgcatttccatttctctccttaacctccagcagactcctgctctctatccaaaataaagatcacagagcagcaagttcatacaacatgcatgttctcctctatcttagaggggtattcttcttgaaaataaaaaatattgaaatgctgtatttttacagctactttaacctatgataattatttacaaaattttaacactaaccaaacaatgcagatcttagggatgattaaaggcagcatttgatgatagcagacattgttacaaggacatggtgagtctatttttaatgcaccaatcttgtttatagcaaaaatgttttccaatattttaataaagtagttattttataggggatacttgaaaccagtatttaagctttaaatgacagtaatattggcatagaaaaaagtagcaaatgtttactgtatcaatttctaatgtttactatatagaatttcctgtaatatatttatatactttttcatgaaaatggagttatcagttatctgtttgttactgcatcatctgtttgtaatcattatctcactttgtaaataaaaacacaccttaaaacatgaa

SEQ ID NO: 441145 - DNA, 7723 bp, Homo sapiens
aatgtccgttcatgtatacttgcttttattagataagagacgatgaactatgaaaagttatgcaaacatagtatctctttcctcttccactatgaccatcatcaccatcccatttcacctctgatcttccatttggagcatttaggaaattgccaccactttcattgtcaatagtggattacatttccatttattttctaaaaattgtgtgcatacatgatagattcttatcattccaggaagaagctctacttctgatgtactagacatacaaaagcctccactctctcatcagacctttcttaacaaagggcttagtaaatctatgggatttctgtccatcaaagatacacaagatgagaattatttcaaggacattttatcagataattctggacgtgaagattctgaaaatacattctccccttaccagttcaaaactagtggcccagaaaaaaaacccatccctggcattgatgtgctttctaagaagaagatctgggcttcatccatggacttgctttgtacagctgacagagacttctcttcaggagagactgccacatatcgtcgttgtcaccctgaggcagtaacagtgcggacttcaactactcctagaaaaaaggaggcaagatactcagatggaagtatagccttggatatctttggccctcagaaaatggatccaatatatcacactcgagaattgcccacctcctcagcaatatcaagtgctttggaccgaatccgagagagacaaaagaaacttcaggttctgagggaagccatgaatgtagaagaaccagttcgaagatacaaaacttatcatggtgatgtctttagtacctccagtgaaagtccatctattatttcctctgaatcagatttcagacaagtgagaagaagtgaagcctcaaagaggtttgaatccagcagtggtctcccaggggtagatgaaaccttaagtcaaggccagtcacagagaccgagcagacaatatgaaacaccctttgaaggcaacttaattaatcaagagatcatgctaaaacggcaagaggaagaactgatgcagctacaagccaaaatggcccttagacagtctcggttgagcctatatccaggagacacaatcaaagcgtccatgcttgacatcaccagggatccgttaagagaaattgccctagaaacagccatgactcaaagaaaactgaggaatttctttggccctgagtttgtgaaaatgacaattgaaccatttatatctttggatttgccacggtctattcttactaagaaagggaagaatgaggataaccgaaggaaagtaaacataatgcttctgaacgggcaaagactggaactgacctgtgataccaaaactatatgtaaagatgtgtttgatatggttgtggcacatattggcttagtagagcatcatttgtttgctttagctaccctcaaagataatgaatatttctttgttgatcctgacttaaaattaaccaaagtggccccagagggatggaaagaagaaccaaagaaaaagaccaaagccactgttaattttactttgtttttcagaattaaattttttatggatgatgttagtctaatacaacatactctgacgtgtcatcagtattaccttcagcttcgaaaagatattttggaggaaaggatgcactgtgatgatgagacttccttattgctggcatccttggctctccaggctgagtatggagattatcaaccagaggttcatggtgtgtcttactttagaatggagcactatttgcccgccagagtgatggagaaacttgatttatcctatatcaaagaagagttacccaaattgcataatacctatgtgggagcttctgaaaaagagacagagttagaatttttaaaggtctgccaaagactgacagaatatggagttcattttcaccgagtgcaccctgagaagaagtcacaaacaggaatattgcttggagtctgttctaaaggtgtccttgtgtttgaagttcacaatggagtgcgcacattggtccttcgctttccatggagggaaaccaagaaaatatctttttctaaaaagaaaatcacattgcaaaatacatcagatggaataaaacatggcttccagacagacaacagtaagatatgccagtacctgctgcacctctgctcttaccagcataagttccagctacagatgagagcaagacagagcaaccaagatgcccaagatattgagagagcttcgtttaggagcctgaatctccaagcagagtctgttagaggatttaatatgggacgagcaatcagcactggcagtctggccagcagcaccctcaacaaacttgctgttcgacctttatcagttcaagctgagattctgaagaggctatcctgctcagagctgtcgctttaccagccattgcaaaacagttcaaaagagaagaatgacaaagcttcatgggaggaaaagcctagagagatgagtaaatcataccatgatctcagtcaggcctctctctatccacatcggaaaaatgtcattgttaacatggaacccccaccacaaaccgttgcagagttggtgggaaaaccttctcaccagatgtcaagatctgatgcagaatctttggcaggagtgacaaaacttaataattcaaagtctgttgcgagtttaaatagaagtcctgaaaggaggaaacatgaatcagactcctcatccattgaagaccctgggcaagcatatgttctagatgtgctacacaaaagatggagcatagtatcttcaccagaaagggagatcaccttagtgaacctgaaaaaagatgcaaagtatggcttgggatttcaaattattggtggggagaagatgggaagactggacctaggcatatttatcagttcagttgcccctggaggaccagctgacttggatggatgcttgaagccaggagaccgtttgatatctgtgaatagtgtgagtctggagggagtcagccaccatgctgcaattgaaattttgcaaaatgcacctgaagatgtgacacttgttatctctcagccaaaagaaaagatatccaaagtgccttctactcctgtgcatctcaccaatgagatgaaaaactacatgaagaaatcttcctacatgcaagacagtgctatagattcttcttccaaggatcaccactggtcacgtggtaccctgaggcacatctcggagaactcctttgggccatctgggggcctgcgggaaggaagcctgagttctcaagattccaggactgagagtgccagcttgtctcaaagccaggtcaatggtttctttgccagccatttaggtgaccaaacctggcaggaatcacagcatggcagcccttccccatctgtaatatccaaagccaccgagaaagagactttcactgatagtaaccaaagcaaaactaaaaagccaggcatttctgatgtaactgattactcagaccgtggagattcagacatggatgaagccacttactccagcagtcaggatcatcaaacaccaaaacaggaatcttcctcttcagtgaatacatccaacaagatgaattttaaaactttttcttcatcacctcctaagcctggagatatctttgaggttgaactggctaaaaatgataacagcttggggataagtgtcacgggaggtgtgaatacgagtgtcagacatggtggcatttatgtgaaagctgttattccccagggagcagcagagtctgatggtagaattcacaaaggtgatcgcgtcctagctgtcaatggagttagtctagaaggagccacccataagcaagctgtggaaacactgagaaatacaggacaggtggttcatctgttattagaaaagggacaatctccaacatctaaagaacatgtcccggtaaccccacagtgtaccctttcagatcagaatgcccaaggtcaaggcccagaaaaagtgaagaaaacaactcaggtcaaagactacagctttgtcactgaagaaaatacatttgaggtaaaattatttaaaaatagctcaggtctaggattcagtttttctcgagaagataatcttataccggagcaaattaatgccagcatagtaagggttaaaaagctctttcctggacagccagcagcagaaagtggaaaaattgatgtaggagatgttatcttgaaagtgaatggagcctctttgaaaggactatctcagcaggtgagcccctagcatgtggagtatagcatttttaatgatgagatggattggcctttcagaatggtttcataatgctggtttaactgtaccttcatttgtcattcatggtacccccaggaagtcatatctgctctcaggggaactgctccagaagtattcttgcttctctgcagacctccacctggtgtgctaccggaaattgatactgcgcttttgaccccacttcagtctccagcacaagtacttccaaacagcagtaaagactcttctcagccatcatgtgtggagcaaagcaccagctcagatgaaaatgaaatgtcagacaaaagcaaaaaacagtgcaagtccccatccagaagagacagttacagtgacagcagtgggagtggagaagatgacttagtgacagctccagcaaacatatcaaattcgacctggagttcagctttgcatcagactctaagcaacatggtatcacaggcacagagtcatcatgaagcacccaagagtcaagaagataccatttgtaccatgttttactatcctcagaaaattcccaataaaccagagtttgaggacagtaatccttcccctctaccaccggatatggctcctgggcagagttatcaaccccaatcagaatctgcttcctctagttcgatggataagtatcatatacatcacatttctgaaccaactagacaagaaaactggacacctttgaaaaatgacttggaaaatcaccttgaagactttgaactggaagtagaactcctcattaccctaattaaatcagaaaaaggaagcctgggttttacagtaaccaaaggcaatcagagaattggttgttatgttcatgatgtcatacaggatccagccaaaagtgatggaaggctaaaacctggggaccggctcataaaggttaatgatacagatgttactaatatgactcatacagatgcagttaatctgctccgggctgcatccaaaacagtcagattagttattggacgagttctagaattacccagaataccaatgttgcctcatttgctaccggacataacactaacgtgcaacaaagaggagttgggtttttccttatgtggaggtcatgacagcctttatcaagtggtatatattagtgatattaatccaaggtccgtcgcagccattgagggtaatctccagctattagatgtcatccattatgtgaacggagtcagcacacaaggaatgaccttggaggaagttaacagagcattagacatgtcacttccttcattggtattgaaagcaacaagaaatgatcttccagtggtccccagctcaaagaggtctgctgtttcagctccaaagtcaaccaaaggcaatggttcctacagtgtggggtcttgcagccagcctgccctcactcctaatgattcattctccacggttgctggggaagaaataaatgaaatatcgtaccccaaaggaaaatgttctacttatcagataaagggatcaccaaacttgactctgcccaaagaatcttatatacaagaagatgacatttatgatgattcccaagaagctgaagttatccagtctctgctggatgttgtggatgaggaagcccagaatcttttaaacgaaaataatgcagcaggatactcctgtggtccaggtacattaaagatgaatgggaagttatcagaagagagaacagaagatacagactgcgatggttcacctttacctgagtattttactgaggccaccaaaatgaatggctgtgaagaatattgtgaagaaaaagtaaaaagtgaaagcttaattcagaagccacaagaaaagaagactgatgatgatgaaataacatggggaaatgatgagttgccaatagagagaacaaaccatgaagattctgataaagatcattcctttctgacaaacgatgagctcgctgtactccctgtcgtcaaagtgcttccctctggtaaatacacgggtgccaacttaaaatcagtcattcgagtcctgcggggtttgctagatcaaggaattccttctaaggagctggagaatcttcaagaattaaaacctttggatcagtgtctaattgggcaaactaaggaaaacagaaggaagaacagatataaaaatatacttccctatgatgctacaagagtgcctcttggagatgaaggtggctatatcaatgccagcttcattaagataccagttgggaaagaagagttcgtttacattgcctgccaaggaccactgcctacaactgttggagacttctggcagatgatttgggagcaaaaatccacagtgatagccatgatgactcaagaagtagaaggagaaaaaatcaaatgccagcgctattggcccaacatcctaggcaaaacaacaatggtcagcaacagacttcgactggctcttgtgagaatgcagcagctgaagggctttgtggtgagggcaatgacccttgaagatattcagaccagagaggtgcgccatatttctcatctgaatttcactgcctggccagaccatgatacaccttctcaaccagatgatctgcttacttttatctcctacatgagacacatccacagatcaggcccaatcattacgcactgcagtgctggcattggacgttcagggaccctgatttgcatagatgtggttctgggattaatcagtcaggatcttgattttgacatctctgatttggtgcgctgcatgagactacaaagacacggaatggttcagacagaggatcaatatattttctgctatcaagtcatcctttatgtcctgacacgtcttcaagcagaagaagagcaaaaacagcagcctcagcttctgaagtgacatgaaaagagcctctggatgcatttccatttctctccttaacctccagcagactcctgctctctatccaaaataaagatcacagagcagcaagttcatacaacatgcatgttctcctctatcttagaggggtattcttcttgaaaataaaaaatattgaaatgctgtatttttacagctactttaacctatgataattatttacaaaattttaacactaaccaaacaatgcagatcttagggatgattaaaggcagcatttgatgatagcagacattgttacaaggacatggtgagtctatttttaatgcaccaatcttgtttatagcaaaaatgttttccaatattttaataaagtagttattttataggggatacttgaaaccagtatttaagctttaaatgacagtaatattggcatagaaaaaagtagcaaatgtttactgtatcaatttctaatgtttactatatagaatttcctgtaatatatttatatactttttcatgaaaatggagttatcagttatctgtttgttactgcatcatctgtttgtaatcattatctcactttgtaaataaaaacacaccttaaaacatgaa

SEQ ID NO: 441146 - DNA, 794 bp, Homo sapiens
aactcatccaacatcacttccaatagtggtatagctatatatatataatatttacattatacatctaaagtattctatctcactttttttggccataggatcaatatattttctgctatcaagtcatcctttatgtcctgacacgtcttcaagcagaagaagagcaaaaacagcagcctcagcttctgaagtgacatgaaaagagcctctggatgcatttccatttctctccttaacctccagcagactcctgctctctatccaaaataaagatcacagagcagcaagttcatacaacatgcatgttctcctctatcttagaggggtattcttcttgaaaataaaaaatattgaaatgctgtatttttacagctactttaacctatgataattatttacaaaattttaacactaaccaaacaatgcagatcttagggatgattaaaggcagcatttgatgatagcagacattgttacaaggacatggtgagtctatttttaatgcaccaatcttgtttatagcaaaaatgttttccaatattttaataaagtagttattttataggggatacttgaaaccagtatttaagctttaaatgacagtaatattggcatagaaaaaagtagcaaatgtttactgtatcaatttctaatgtttactatatagaatttcctgtaatatatttatatactttttcatgaaaatggagttatcagttatctgtttgttactgcatcatctgtttgtaatcattatctcactttgtaaataaaaacacaccttaaaacatgaa

SEQ ID NO: 441147 - DNA, 3231 bp, Homo sapiens
aatgtccgttcatgtatacttgcttttattagataagagacgatgaactatgaaaagttatgcaaacatagtatctctttcctcttccactatgaccatcatcaccatcccatttcacctctgatcttccatttggagcatttaggaaattgccaccactttcattgtcaatagtggattacatttccatttattttctaaaaattgtgtgcatacatgatagattcttatcattccaggaagaagctctacttctgatgtactagacatacaaaagcctccactctctcatcagacctttcttaacaaagggcttagtaaatctatgggatttctgtccatcaaagatacacaagatgagaattatttcaaggacattttatcagataattctggacgtgaagattctgaaaatacattctccccttaccagttcaaaactagtggcccagaaaaaaaacccatccctggcattgatgtgctttctaagaagaagatctgggcttcatccatggacttgctttgtacagctgacagagacttctcttcaggagagactgccacatatcgtcgttgtcaccctgaggcagtaacagtgcggacttcaactactcctagaaaaaaggaggcaagatactcagatggaagtatagccttggatatctttggccctcagaaaatggatccaatatatcacactcgagaattgcccacctcctcagcaatatcaagtgctttggaccgaatccgagagagacaaaagaaacttcaggttctgagggaagccatgaatgtagaagaaccagttcgaagatacaaaacttatcatggtgatgtctttagtacctccagtgaaagtccatctattatttcctctgaatcagatttcagacaagtgagaagaagtgaagcctcaaagaggtttgaatccagcagtggtctcccaggggtagatgaaaccttaagtcaaggccagtcacagagaccgagcagacaatatgaaacaccctttgaaggcaacttaattaatcaagagatcatgctaaaacggcaagaggaagaactgatgcagctacaagccaaaatggcccttagacagtctcggttgagcctatatccaggagacacaatcaaagcgtccatgcttgacatcaccagggatccgttaagagaaattgccctagaaacagccatgactcaaagaaaactgaggaatttctttggccctgagtttgtgaaaatgacaattgaaccatttatatctttggatttgccacggtctattcttactaagaaagggaagaatgaggataaccgaaggaaagtaaacataatgcttctgaacgggcaaagactggaactgacctgtgataccaaaactatatgtaaagatgtgtttgatatggttgtggcacatattggcttagtagagcatcatttgtttgctttagctaccctcaaagataatgaatatttctttgttgatcctgacttaaaattaaccaaagtggccccagagggatggaaagaagaaccaaagaaaaagaccaaagccactgttaattttactttgtttttcagaattaaattttttatggatgatgttagtctaatacaacatactctgacgtgtcatcagtattaccttcagcttcgaaaagatattttggaggaaaggatgcactgtgatgatgagacttccttattgctggcatccttggctctccaggctgagtatggagattatcaaccagaggttcatggtgtgtcttactttagaatggagcactatttgcccgccagagtgatggagaaacttgatttatcctatatcaaagaagagttacccaaattgcataatacctatgtgggagcttctgaaaaagagacagagttagaatttttaaaggtctgccaaagactgacagaatatggagttcattttcaccgagtgcaccctgagaagaagtcacaaacaggaatattgcttggagtctgttctaaaggtgtccttgtgtttgaagttcacaatggagtgcgcacattggtccttcgctttccatggagggaaaccaagaaaatatctttttctaaaaagaaaatcacattgcaaaatacatcagatggaataaaacatggcttccagacagacaacagtaagatatgccagtacctgctgcacctctgctcttaccagcataagttccagctacagatgagagcaagacagagcaaccaagatgcccaagatattgagagagcttcgtttaggagcctgaatctccaagcagagtctgttagaggatttaatatgggacgagcaatcagcactggcagtctggccagcagcaccctcaacaaacttgctgttcgacctttatcagttcaagctgagattctgaagaggctatcctgctcagagctgtcgctttaccagccattgcaaaacagttcaaaagagaagaatgacaaagcttcatgggaggaaaagcctagagagatgagtaaatcataccatgatctcagtcaggcctctctctatccacatcggaaaaatgtcattgttaacatggaacccccaccacaaaccgttgcagagttggtgggaaaaccttctcaccagatgtcaagatctgatgcagaatctttggcaggagtgacaaaacttaataattcaaagtctgttgcgagtttaaatagaagtcctgaaaggaggaaacatgaatcagactcctcatccattgaagaccctgggcaagcatatgttctagatgtgctacacaaaagatggagcatagtatcttcaccagaaagggagatcaccttagtgaacctgaaaaaagatgcaaagtatggcttgggatttcaaattattggtggggagaagatgggaagactggacctaggcatatttatcagttcagttgcccctggaggaccagctgacttggatggatgcttgaagccaggagaccgtttgatatctgtgaatagtgtgagtctggagggagtcagccaccatgctgcaattgaaattttgcaaaatgcacctgaagatgtgacacttgttatctctcagccaaaagaaaagatatccaaaggtaatgtgaatgtctcttacttatgtattctgtttcacttttctgtctcattcctttttagtgatattcgcacaaaaatggattcattgtgtacaaaattgatgcaacttaagtaaactgtgattactta

SEQ ID NO: 441148 - DNA, 413 bp, Homo sapiens
attacaggcgtgagcctctgagcccagcctgatatctacacttttagtaaggactaactaggaactttcctccaatctctatatatttatagttcaacttatcttctctcttgatttaaatttatttttataaagatactgttctaaaatatacttaacattagacataagattggggaataaattaaataacatattaaagaaactctgtaacacaatttcttccagaatttgcctgagtccctcctcaaacaaatgaatacgaaataagaccataagatttaaaagaacatgtaggatttttatttatgatttgaactgcctaatttttaggtgatcgcgtcctagctgtcaatggagttagtctagaaggagccacccataagcaagctgtggaaacactgagaaataca

SEQ ID NO: 441149 - DNA, 303 bp, Homo sapiens
gccccagagggatggaaagaagaaccaaagaaaaagaccaaagccactgttaattttactttgtttttcagaattaaattttttatggatgatgttagtctaatacagtgagtacacaagagtttctcttttgctctttttggacactggtcttttgaccctttagcttactgatactgaattacttgattccaatcaatgataatgtctgctttatcataaaagtaatatttctttcaacacagtttatctaatccttatgccttaaaagcttaataataagcttagtaataaactcatgga

SEQ ID NO: 441150 - DNA, 364 bp, Homo sapiens
tttaatgttacatcctccaaaaactgtgtaactagtgtcattctgtaaacagttaccatgaaaacaaaagggagatccttttgtcaaacttgattttttattacctgtgtacagacagatcagctttcctgtaacagtgaacaaaagcctgatcgaagccaggctattcgagatcgattgcgaggaaaaggattaccaacaggtaagagtatattaataggaaatgtctaggctttaaccttatcccattgttttctttacaaaattatacttacctggctttgaaatctggtaattgagactatgattagaacgtaaacgtacaaactggaggtagggaatgggcaggaacactagctacatt

SEQ ID NO: 441151 - DNA, 425 bp, Homo sapiens
atcattcctttctgacaaacgatgagctcgctgtactccctgtcgtcaaagtgcttccctctggtaaatacacgggtgccaacttaaaatcagtcattcgagtcctgcggggtttgctagatcaaggaattccttctaaggagctggaggtaagtggcttctgccaatgattctctcccaaagtgtatgcatttagtttgtaaggaaaatgtatctttactggcccaagattagaagaatttttgaaaattttccaactctaaaagcaccaccttatcatatctagcagaaaattaatttttctgattaggatcccaataatagtgatttaaaggaatcactttaactacttggaacttgatacatttccctgaagattatccttcctgcctcatagttaaggtaaaaatgtttaaaaaaaaaaa

SEQ ID NO: 441152 - DNA, 8275 bp, Homo sapiens
ctgattatgaagtgcctcagagccaacctattaagcttggagatcatctcaacagcatactgcttggaatgtgtgaggatgttatttacgctcgagtttctgttcggactgtgctggatgcttgcagtgcccacattaggaatagcaattgtgcaccctcattttcctacgtgaaacacttggtaaaactggttctgggaaatctttctggggtaatatgcacgtgtcactagctgaggccctggaggttcggggtggaccacttcaggaggaagaaatatgggctgtattaaatcaaagtgctgaaagtctccaagaattattcagaaaagtaagcctagctgatcctgctgcccttggcttcatcatttctccatggtctctgctgttgctgccatctggtagtgtgtcatttacagatgaaaatatttccaatcaggatcttcgagcattcactgcaccagaggttcttcaaaatcagtcactaacttctctctcagatgttgaaaagatccacatttattctcttggaatgacactgtattggggggctgattatgaagtgcctcagagccaacctattaagcttggagatcatctcaacagcatactgcttggaatgtgtgaggatgttatttacgctcgagtttctgttcggactgtgctggatgcttgcagtgcccacattaggaatagcaattgtgcaccctcattttcctacgtgaaacacttggtaaaactggttctgggaaatctttctgggacagatcagctttcctgtaacagtgaacaaaagcctgatcgaagccaggctattcgagatcgattgcgaggaaaaggattaccaacaggaagaagctctacttctgatgtactagacatacaaaagcctccactctctcatcagacctttcttaacaaagggcttagtaaatctatgggatttctgtccatcaaagatacacaagatgagaattatttcaaggacattttatcagataattctggacgtgaagattctgaaaatacattctccccttaccagttcaaaactagtggcccagaaaaaaaacccatccctggcattgatgtgctttctaagaagaagatctgggcttcatccatggacttgctttgtacagctgacagagacttctcttcaggagagactgccacatatcgtcgttgtcaccctgaggcagtaacagtgcggacttcaactactcctagaaaaaaggaggcaagatactcagatggaagtatagccttggatatctttggccctcagaaaatggatccaatatatcacactcgagaattgcccacctcctcagcaatatcaagtgctttggaccgaatccgagagagacaaaagaaacttcaggttctgagggaagccatgaatgtagaagaaccagttcgaagatacaaaacttatcatggtgatgtctttagtacctccagtgaaagtccatctattatttcctctgaatcagatttcagacaagtgagaagaagtgaagcctcaaagaggtttgaatccagcagtggtctcccaggggtagatgaaaccttaagtcaaggccagtcacagagaccgagcagacaatatgaaacaccctttgaaggcaacttaattaatcaagagatcatgctaaaacggcaagaggaagaactgatgcagctacaagccaaaatggcccttagacagtctcggttgagcctatatccaggagacacaatcaaagcgtccatgcttgacatcaccagggatccgttaagagaaattgccctagaaacagccatgactcaaagaaaactgaggaatttctttggccctgagtttgtgaaaatgacaattgaaccatttatatctttggatttgccacggtctattcttactaagaaagggaagaatgaggataaccgaaggaaagtaaacataatgcttctgaacgggcaaagactggaactgacctgtgataccaaaactatatgtaaagatgtgtttgatatggttgtggcacatattggcttagtagagcatcatttgtttgctttagctaccctcaaagataatgaatatttctttgttgatcctgacttaaaattaaccaaagtggccccagagggatggaaagaagaaccaaagaaaaagaccaaagccactgttaattttactttgtttttcagaattaaattttttatggatgatgttagtctaatacaacatactctgacgtgtcatcagtattaccttcagcttcgaaaagatattttggaggaaaggatgcactgtgatgatgagacttccttattgctggcatccttggctctccaggctgagtatggagattatcaaccagaggttcatggtgtgtcttactttagaatggagcactatttgcccgccagagtgatggagaaacttgatttatcctatatcaaagaagagttacccaaattgcataatacctatgtgggagcttctgaaaaagagacagagttagaatttttaaaggtctgccaaagactgacagaatatggagttcattttcaccgagtgcaccctgagaagaagtcacaaacaggaatattgcttggagtctgttctaaaggtgtccttgtgtttgaagttcacaatggagtgcgcacattggtccttcgctttccatggagggaaaccaagaaaatatctttttctaaaaagaaaatcacattgcaaaatacatcagatggaataaaacatggcttccagacagacaacagtaagatatgccagtacctgctgcacctctgctcttaccagcataagttccagctacagatgagagcaagacagagcaaccaagatgcccaagatattgagagagcttcgtttaggagcctgaatctccaagcagagtctgttagaggatttaatatgggacgagcaatcagcactggcagtctggccagcagcaccctcaacaaacttgctgttcgacctttatcagttcaagctgagattctgaagaggctatcctgctcagagctgtcgctttaccagccattgcaaaacagttcaaaagagaagaatgacaaagcttcatgggaggaaaagcctagagagatgagtaaatcataccatgatctcagtcaggcctctctctatccacatcggaaaaatgtcattgttaacatggaacccccaccacaaaccgttgcagagttggtgggaaaaccttctcaccagatgtcaagatctgatgcagaatctttggcaggagtgacaaaacttaataattcaaagtctgttgcgagtttaaatagaagtcctgaaaggaggaaacatgaatcagactcctcatccattgaagaccctgggcaagcatatgttctaggaatgactatgcatagttctggaaactcttcatcccaagtacccttaaaagaaaatgatgtgctacacaaaagatggagcatagtatcttcaccagaaagggagatcaccttagtgaacctgaaaaaagatgcaaagtatggcttgggatttcaaattattggtggggagaagatgggaagactggacctaggcatatttatcagttcagttgcccctggaggaccagctgacttggatggatgcttgaagccaggagaccgtttgatatctgtgaatagtgtgagtctggagggagtcagccaccatgctgcaattgaaattttgcaaaatgcacctgaagatgtgacacttgttatctctcagccaaaagaaaagatatccaaagtgccttctactcctgtgcatctcaccaatgagatgaaaaactacatgaagaaatcttcctacatgcaagacagtgctatagattcttcttccaaggatcaccactggtcacgtggtaccctgaggcacatctcggagaactcctttgggccatctgggggcctgcgggaaggaagcctgagttctcaagattccaggactgagagtgccagcttgtctcaaagccaggtcaatggtttctttgccagccatttaggtgaccaaacctggcaggaatcacagcatggcagcccttccccatctgtaatatccaaagccaccgagaaagagactttcactgatagtaaccaaagcaaaactaaaaagccaggcatttctgatgtaactgattactcagaccgtggagattcagacatggatgaagccacttactccagcagtcaggatcatcaaacaccaaaacaggaatcttcctcttcagtgaatacatccaacaagatgaattttaaaactttttcttcatcacctcctaagcctggagatatctttgaggttgaactggctaaaaatgataacagcttggggataagtgtcacgggaggtgtgaatacgagtgtcagacatggtggcatttatgtgaaagctgttattccccagggagcagcagagtctgatggtagaattcacaaaggtgatcgcgtcctagctgtcaatggagttagtctagaaggagccacccataagcaagctgtggaaacactgagaaatacaggacaggtggttcatctgttattagaaaagggacaatctccaacatctaaagaacatgtcccggtaaccccacagtgtaccctttcagatcagaatgcccaaggtcaaggcccagaaaaagtgaagaaaacaactcaggtcaaagactacagctttgtcactgaagaaaatacatttgaggtaaaattatttaaaaatagctcaggtctaggattcagtttttctcgagaagataatcttataccggagcaaattaatgccagcatagtaagggttaaaaagctctttcctggacagccagcagcagaaagtggaaaaattgatgtaggagatgttatcttgaaagtgaatggagcctctttgaaaggactatctcagcaggaagtcatatctgctctcaggggaactgctccagaagtattcttgcttctctgcagacctccacctggtgtgctaccggaaattgatactgcgcttttgaccccacttcagtctccagcacaagtacttccaaacagcagtaaagactcttctcagccatcatgtgtggagcaaagcaccagctcagatgaaaatgaaatgtcagacaaaagcaaaaaacagtgcaagtccccatccagaagagacagttacagtgacagcagtgggagtggagaagatgacttagtgacagctccagcaaacatatcaaattcgacctggagttcagctttgcatcagactctaagcaacatggtatcacaggcacagagtcatcatgaagcacccaagagtcaagaagataccatttgtaccatgttttactatcctcagaaaattcccaataaaccagagtttgaggacagtaatccttcccctctaccaccggatatggctcctgggcagagttatcaaccccaatcagaatctgcttcctctagttcgatggataagtatcatatacatcacatttctgaaccaactagacaagaaaactggacacctttgaaaaatgacttggaaaatcaccttgaagactttgaactggaagtagaactcctcattaccctaattaaatcagaaaaaggaagcctgggttttacagtaaccaaaggcaatcagagaattggttgttatgttcatgatgtcatacaggatccagccaaaagtgatggaaggctaaaacctggggaccggctcataaaggttaatgatacagatgttactaatatgactcatacagatgcagttaatctgctccgggctgcatccaaaacagtcagattagttattggacgagttctagaattacccagaataccaatgttgcctcatttgctaccggacataacactaacgtgcaacaaagaggagttgggtttttccttatgtggaggtcatgacagcctttatcaagtggtatatattagtgatattaatccaaggtccgtcgcagccattgagggtaatctccagctattagatgtcatccattatgtgaacggagtcagcacacaaggaatgaccttggaggaagttaacagagcattagacatgtcacttccttcattggtattgaaagcaacaagaaatgatcttccagtggtccccagctcaaagaggtctgctgtttcagctccaaagtcaaccaaaggcaatggttcctacagtgtggggtcttgcagccagcctgccctcactcctaatgattcattctccacggttgctggggaagaaataaatgaaatatcgtaccccaaaggaaaatgttctacttatcagataaagggatcaccaaacttgactctgcccaaagaatcttatatacaagaagatgacatttatgatgattcccaagaagctgaagttatccagtctctgctggatgttgtggatgaggaagcccagaatcttttaaacgaaaataatgcagcaggatactcctgtggtccaggtacattaaagatgaatgggaagttatcagaagagagaacagaagatacagactgcgatggttcacctttacctgagtattttactgaggccaccaaaatgaatggctgtgaagaatattgtgaagaaaaagtaaaaagtgaaagcttaattcagaagccacaagaaaagaagactgatgatgatgaaataacatggggaaatgatgagttgccaatagagagaacaaaccatgaagattctgataaagatcattcctttctgacaaacgatgagctcgctgtactccctgtcgtcaaagtgcttccctctggtaaatacacgggtgccaacttaaaatcagtcattcgagtcctgcggggtttgctagatcaaggaattccttctaaggagctggagaatcttcaagaattaaaacctttggatcagtgtctaattgggcaaactaaggaaaacagaaggaagaacagatataaaaatatacttccctatgatgctacaagagtgcctcttggagatgaaggtggctatatcaatgccagcttcattaagataccagttgggaaagaagagttcgtttacattgcctgccaaggaccactgcctacaactgttggagacttctggcagatgatttgggagcaaaaatccacagtgatagccatgatgactcaagaagtagaaggagaaaaaatcaaatgccagcgctattggcccaacatcctaggcaaaacaacaatggtcagcaacagacttcgactggctcttgtgagaatgcagcagctgaagggctttgtggtgagggcaatgacccttgaagatattcagaccagagaggtgcgccatatttctcatctgaatttcactgcctggccagaccatgatacaccttctcaaccagatgatctgcttacttttatctcctacatgagacacatccacagatcaggcccaatcattacgcactgcagtgctggcattggacgttcagggaccctgatttgcatagatgtggttctgggattaatcagtcaggatcttgattttgacatctctgatttggtgcgctgcatgagactacaaagacacggaatggttcagacagaggatcaatatattttctgctatcaagtcatcctttatgtcctgacacgtcttcaagcagaagaagagcaaaaacagcagcctcagcttctgaagtgacatgaaaagagcctctggatgcatttccatttctctccttaacctccagcagactcctgctctctatccaaaataaagatcacagagcagcaagttcatacaacatgcatgttctcctctatcttagaggggtattcttcttgaaaataaaaaatattgaaatgctgtatttttacagctactttaacctatgataattatttacaaaattttaacactaaccaaacaatgcagatcttagggatgattaaaggcagcatttgatgatagcagacattgttacaaggacatggtgagtctatttttaatgcaccaatcttgtttatagcaaaaatgttttccaatattttaataaagtagttattttataggggatacttgaaaccagtatttaagctttaaatgacagtaatattggcatagaaaaaagtagcaaatgtttactgtatcaatttctaatgtttactatatagaatttcctgtaatatatttatatactttttcatgaaaatggagttatcagttatctgtttgttactgcatcatctgtttgtaatcattatctcactttgtaaataaaaacacaccttaaaacatgaa

SEQ ID NO: 441153 - DNA, 677 bp, Homo sapiens
  misc_feature (616)..(616): n is a, c, g, or t
  misc_feature (620)..(620): n is a, c, g, or t
  misc_feature (643)..(643): n is a, c, g, or t
aatgtccgttcatgtatacttgcttttattagataagagacgatgaactatgaaaagttatgcaaacatagtatctctttcctcttccactatgaccatcatcaccatcccatttcacctctgatcttccatttggagcatttaggaaattgccaccactttcattgtcaatagtggattacatttccatttattttctaaaaattgtgtgcatacatgatagattcttatcattccaggaagaagctctacttctgatgtactagacatacaaaagcctccactctctcatcagacctttcttaacaaagggcttagtaaatctatgggatttctgtccatcaaagatacacaagatgagaattatttcaaggacattttatcagataattctggacgtgaagattctgaaaatacattctccccttaccagttcaaaactagtggcccagaaaaaaaacccatccctggcattgatgtgctttctaagaagaagatctgggcttcatccatggacttgctttgtacagctgacagagacttctcttcaggagagactgccacatatcgtcgttgtcaccctgaggcagtaacagtgcggacagatctggaatcnatcnctcggaaaccccccttccaaaanacagattccgggcggggccagggcggccccgccg

SEQ ID NO: 441154 - DNA, 8102 bp, Homo sapiens
aaggcgcacgatggcgcgtccctgcagccctcgcccggcgctccagtagcaggacccggtctcgggaccagccggtaatatgcacgtgtcactagctgaggccctggaggttcggggtggaccacttcaggaggaagaaatatgggctgtattaaatcaaagtgctgaaagtctccaagaattattcagaaaagtaagcctagctgatcctgctgcccttggcttcatcatttctccatggtctctgctgttgctgccatctggtagtgtgtcatttacagatgaaaatatttccaatcaggatcttcgagcattcactgcaccagaggttcttcaaaatcagtcactaacttctctctcagatgttgaaaagatccacatttattctcttggaatgacactgtattggggggctgattatgaagtgcctcagagccaacctattaagcttggagatcatctcaacagcatactgcttggaatgtgtgaggatgttatttacgctcgagtttctgttcggactgtgctggatgcttgcagtgcccacattaggaatagcaattgtgcaccctcattttcctacgtgaaacacttggtaaaactggttctgggaaatctttctgggacagatcagctttcctgtaacagtgaacaaaagcctgatcgaagccaggctattcgagatcgattgcgaggaaaaggattaccaacaggaagaagctctacttctgatgtactagacatacaaaagcctccactctctcatcagacctttcttaacaaagggcttagtaaatctatgggatttctgtccatcaaagatacacaagatgagaattatttcaaggacattttatcagataattctggacgtgaagattctgaaaatacattctccccttaccagttcaaaactagtggcccagaaaaaaaacccatccctggcattgatgtgctttctaagaagaagatctgggcttcatccatggacttgctttgtacagctgacagagacttctcttcaggagagactgccacatatcgtcgttgtcaccctgaggcagtaacagtgcggacttcaactactcctagaaaaaaggaggcaagatactcagatggaagtatagccttggatatctttggccctcagaaaatggatccaatatatcacactcgagaattgcccacctcctcagcaatatcaagtgctttggaccgaatccgagagagacaaaagaaacttcaggttctgagggaagccatgaatgtagaagaaccagttcgaagatacaaaacttatcatggtgatgtctttagtacctccagtgaaagtccatctattatttcctctgaatcagatttcagacaagtgagaagaagtgaagcctcaaagaggtttgaatccagcagtggtctcccaggggtagatgaaaccttaagtcaaggccagtcacagagaccgagcagacaatatgaaacaccctttgaaggcaacttaattaatcaagagatcatgctaaaacggcaagaggaagaactgatgcagctacaagccaaaatggcccttagacagtctcggttgagcctatatccaggagacacaatcaaagcgtccatgcttgacatcaccagggatccgttaagagaaattgccctagaaacagccatgactcaaagaaaactgaggaatttctttggccctgagtttgtgaaaatgacaattgaaccatttatatctttggatttgccacggtctattcttactaagaaagggaagaatgaggataaccgaaggaaagtaaacataatgcttctgaacgggcaaagactggaactgacctgtgataccaaaactatatgtaaagatgtgtttgatatggttgtggcacatattggcttagtagagcatcatttgtttgctttagctaccctcaaagataatgaatatttctttgttgatcctgacttaaaattaaccaaagtggccccagagggatggaaagaagaaccaaagaaaaagaccaaagccactgttaattttactttgtttttcagaattaaattttttatggatgatgttagtctaatacaacatactctgacgtgtcatcagtattaccttcagcttcgaaaagatattttggaggaaaggatgcactgtgatgatgagacttccttattgctggcatccttggctctccaggctgagtatggagattatcaaccagaggttcatggtgtgtcttactttagaatggagcactatttgcccgccagagtgatggagaaacttgatttatcctatatcaaagaagagttacccaaattgcataatacctatgtgggagcttctgaaaaagagacagagttagaatttttaaaggtctgccaaagactgacagaatatggagttcattttcaccgagtgcaccctgagaagaagtcacaaacaggaatattgcttggagtctgttctaaaggtgtccttgtgtttgaagttcacaatggagtgcgcacattggtccttcgctttccatggagggaaaccaagaaaatatctttttctaaaaagaaaatcacattgcaaaatacatcagatggaataaaacatggcttccagacagacaacagtaagatatgccagtacctgctgcacctctgctcttaccagcataagttccagctacagatgagagcaagacagagcaaccaagatgcccaagatattgagagagcttcgtttaggagcctgaatctccaagcagagtctgttagaggatttaatatgggacgagcaatcagcactggcagtctggccagcagcaccctcaacaaacttgctgttcgacctttatcagttcaagctgagattctgaagaggctatcctgctcagagctgtcgctttaccagccattgcaaaacagttcaaaagagaagaatgacaaagcttcatgggaggaaaagcctagagagatgagtaaatcataccatgatctcagtcaggcctctctctatccacatcggaaaaatgtcattgttaacatggaacccccaccacaaaccgttgcagagttggtgggaaaaccttctcaccagatgtcaagatctgatgcagaatctttggcaggagtgacaaaacttaataattcaaagtctgttgcgagtttaaatagaagtcctgaaaggaggaaacatgaatcagactcctcatccattgaagaccctgggcaagcatatgttctagatgtgctacacaaaagatggagcatagtatcttcaccagaaagggagatcaccttagtgaacctgaaaaaagatgcaaagtatggcttgggatttcaaattattggtggggagaagatgggaagactggacctaggcatatttatcagttcagttgcccctggaggaccagctgacttggatggatgcttgaagccaggagaccgtttgatatctgtgaatagtgtgagtctggagggagtcagccaccatgctgcaattgaaattttgcaaaatgcacctgaagatgtgacacttgttatctctcagccaaaagaaaagatatccaaagtgccttctactcctgtgcatctcaccaatgagatgaaaaactacatgaagaaatcttcctacatgcaagacagtgctatagattcttcttccaaggatcaccactggtcacgtggtaccctgaggcacatctcggagaactcctttgggccatctgggggcctgcgggaaggaagcctgagttctcaagattccaggactgagagtgccagcttgtctcaaagccaggtcaatggtttctttgccagccatttaggtgaccaaacctggcaggaatcacagcatggcagcccttccccatctgtaatatccaaagccaccgagaaagagactttcactgatagtaaccaaagcaaaactaaaaagccaggcatttctgatgtaactgattactcagaccgtggagattcagacatggatgaagccacttactccagcagtcaggatcatcaaacaccaaaacaggaatcttcctcttcagtgaatacatccaacaagatgaattttaaaactttttcttcatcacctcctaagcctggagatatctttgaggttgaactggctaaaaatgataacagcttggggataagtgtcacgggaggtgtgaatacgagtgtcagacatggtggcatttatgtgaaagctgttattccccagggagcagcagagtctgatggtagaattcacaaaggtgatcgcgtcctagctgtcaatggagttagtctagaaggagccacccataagcaagctgtggaaacactgagaaatacaggacaggtggttcatctgttattagaaaagggacaatctccaacatctaaagaacatgtcccggtaaccccacagtgtaccctttcagatcagaatgcccaaggtcaaggcccagaaaaagtgaagaaaacaactcaggtcaaagactacagctttgtcactgaagaaaatacatttgaggtaaaattatttaaaaatagctcaggtctaggattcagtttttctcgagaagataatcttataccggagcaaattaatgccagcatagtaagggttaaaaagctctttcctggacagccagcagcagaaagtggaaaaattgatgtaggagatgttatcttgaaagtgaatggagcctctttgaaaggactatctcagcaggaagtcatatctgctctcaggggaactgctccagaagtattcttgcttctctgcagacctccacctggtgtgctaccggaaattgatactgcgcttttgaccccacttcagtctccagcacaagtacttccaaacagcagtaaagactcttctcagccatcatgtgtggagcaaagcaccagctcagatgaaaatgaaatgtcagacaaaagcaaaaaacagtgcaagtccccatccagaagagacagttacagtgacagcagtgggagtggagaagatgacttagtgacagctccagcaaacatatcaaattcgacctggagttcagctttgcatcagactctaagcaacatggtatcacaggcacagagtcatcatgaagcacccaagagtcaagaagataccatttgtaccatgttttactatcctcagaaaattcccaataaaccagagtttgaggacagtaatccttcccctctaccaccggatatggctcctgggcagagttatcaaccccaatcagaatctgcttcctctagttcgatggataagtatcatatacatcacatttctgaaccaactagacaagaaaactggacacctttgaaaaatgacttggaaaatcaccttgaagactttgaactggaagtagaactcctcattaccctaattaaatcagaaaaaggaagcctgggttttacagtaaccaaaggcaatcagagaattggttgttatgttcatgatgtcatacaggatccagccaaaagtgatggaaggctaaaacctggggaccggctcataaaggttaatgatacagatgttactaatatgactcatacagatgcagttaatctgctccgggctgcatccaaaacagtcagattagttattggacgagttctagaattacccagaataccaatgttgcctcatttgctaccggacataacactaacgtgcaacaaagaggagttgggtttttccttatgtggaggtcatgacagcctttatcaagtggtatatattagtgatattaatccaaggtccgtcgcagccattgagggtaatctccagctattagatgtcatccattatgtgaacggagtcagcacacaaggaatgaccttggaggaagttaacagagcattagacatgtcacttccttcattggtattgaaagcaacaagaaatgatcttccagtggtccccagctcaaagaggtctgctgtttcagctccaaagtcaaccaaaggcaatggttcctacagtgtggggtcttgcagccagcctgccctcactcctaatgattcattctccacggttgctggggaagaaataaatgaaatatcgtaccccaaaggaaaatgttctacttatcagataaagggatcaccaaacttgactctgcccaaagaatcttatatacaagaagatgacatttatgatgattcccaagaagctgaagttatccagtctctgctggatgttgtggatgaggaagcccagaatcttttaaacgaaaataatgcagcaggatactcctgtggtccaggtacattaaagatgaatgggaagttatcagaagagagaacagaagatacagactgcgatggttcacctttacctgagtattttactgaggccaccaaaatgaatggctgtgaagaatattgtgaagaaaaagtaaaaagtgaaagcttaattcagaagccacaagaaaagaagactgatgatgatgaaataacatggggaaatgatgagttgccaatagagagaacaaaccatgaagattctgataaagatcattcctttctgacaaacgatgagctcgctgtactccctgtcgtcaaagtgcttccctctggtaaatacacgggtgccaacttaaaatcagtcattcgagtcctgcggggtttgctagatcaaggaattccttctaaggagctggagaatcttcaagaattaaaacctttggatcagtgtctaattgggcaaactaaggaaaacagaaggaagaacagatataaaaatatacttccctatgatgctacaagagtgcctcttggagatgaaggtggctatatcaatgccagcttcattaagataccagttgggaaagaagagttcgtttacattgcctgccaaggaccactgcctacaactgttggagacttctggcagatgatttgggagcaaaaatccacagtgatagccatgatgactcaagaagtagaaggagaaaaaatcaaatgccagcgctattggcccaacatcctaggcaaaacaacaatggtcagcaacagacttcgactggctcttgtgagaatgcagcagctgaagggctttgtggtgagggcaatgacccttgaagatattcagaccagagaggtgcgccatatttctcatctgaatttcactgcctggccagaccatgatacaccttctcaaccagatgatctgcttacttttatctcctacatgagacacatccacagatcaggcccaatcattacgcactgcagtgctggcattggacgttcagggaccctgatttgcatagatgtggttctgggattaatcagtcaggatcttgattttgacatctctgatttggtgcgctgcatgagactacaaagacacggaatggttcagacagaggatcaatatattttctgctatcaagtcatcctttatgtcctgacacgtcttcaagcagaagaagagcaaaaacagcagcctcagcttctgaagtgacatgaaaagagcctctggatgcatttccatttctctccttaacctccagcagactcctgctctctatccaaaataaagatcacagagcagcaagttcatacaacatgcatgttctcctctatcttagaggggtattcttcttgaaaataaaaaatattgaaatgctgtatttttacagctactttaacctatgataattatttacaaaattttaacactaaccaaacaatgcagatcttagggatgattaaaggcagcatttgatgatagcagacattgttacaaggacatggtgagtctatttttaatgcaccaatcttgtttatagcaaaaatgttttccaatattttaataaagtagttattttataggggatacttgaaaccagtatttaagctttaaatgacagtaatattggcatagaaaaaagtagcaaatgtttactgtatcaatttctaatgtttactatatagaatttcctgtaatatatttatatactttttcatgaaaatggagttatcagttatctgtttgttactgcatcatctgtttgtaatcattatctcactttgtaaataaaaacacaccttaaaacatgaacaagccaaaactgtgtgcagac

SEQ ID NO: 441155 - DNA, 7391 bp, Homo sapiens
aatgtccgttcatgtatacttgcttttattagataagagacgatgaactatgaaaagttatgcaaacatagtatctctttcctcttccactatgaccatcatcaccatcccatttcacctctgatcttccatttggagcatttaggaaattgccaccactttcattgtcaatagtggattacatttccatttattttctaaaaattgtgtgcatacatgatagattcttatcattccaggaagaagctctacttctgatgtactagacatacaaaagcctccactctctcatcagacctttcttaacaaagggcttagtaaatctatgggatttctgtccatcaaagatacacaagatgagaattatttcaaggacattttatcagataattctggacgtgaagattctgaaaatacattctccccttaccagttcaaaactagtggcccagaaaaaaaacccatccctggcattgatgtgctttctaagaagaagatctgggcttcatccatggacttgctttgtacagctgacagagacttctcttcaggagagactgccacatatcgtcgttgtcaccctgaggcagtaacagtgcggacttcaactactcctagaaaaaaggaggcaagatactcagatggaagtatagccttggatatctttggccctcagaaaatggatccaatatatcacactcgagaattgcccacctcctcagcaatatcaagtgctttggaccgaatccgagagagacaaaagaaacttcaggttctgagggaagccatgaatgtagaagaaccagttcgaagatacaaaacttatcatggtgatgtctttagtacctccagtgaaagtccatctattatttcctctgaatcagatttcagacaagtgagaagaagtgaagcctcaaagaggtttgaatccagcagtggtctcccaggggtagatgaaaccttaagtcaaggccagtcacagagaccgagcagacaatatgaaacaccctttgaaggcaacttaattaatcaagagatcatgctaaaacggcaagaggaagaactgatgcagctacaagccaaaatggcccttagacagtctcggttgagcctatatccaggagacacaatcaaagcgtccatgcttgacatcaccagggatccgttaagagaaattgccctagaaacagccatgactcaaagaaaactgaggaatttctttggccctgagtttgtgaaaatgacaattgaaccatttatatctttggatttgccacggtctattcttactaagaaagggaagaatgaggataaccgaaggaaagtaaacataatgcttctgaacgggcaaagactggaactgacctgtgataccaaaactatatgtaaagatgtgtttgatatggttgtggcacatattggcttagtagagcatcatttgtttgctttagctaccctcaaagataatgaatatttctttgttgatcctgacttaaaattaaccaaagtggccccagagggatggaaagaagaaccaaagaaaaagaccaaagccactgttaattttactttgtttttcagaattaaattttttatggatgatgttagtctaatacaacatactctgacgtgtcatcagtattaccttcagcttcgaaaagatattttggaggaaaggatgcactgtgatgatgagacttccttattgctggcatccttggctctccaggctgagtatggagattatcaaccagaggttcatggtgtgtcttactttagaatggagcactatttgcccgccagagtgatggagaaacttgatttatcctatatcaaagaagagttacccaaattgcataatacctatgtgggagcttctgaaaaagagacagagttagaatttttaaaggtctgccaaagactgacagaatatggagttcattttcaccgagtgcaccctgagaagaagtcacaaacaggaatattgcttggagtctgttctaaaggtgtccttgtgtttgaagttcacaatggagtgcgcacattggtccttcgctttccatggagggaaaccaagaaaatatctttttctaaaaagaaaatcacattgcaaaatacatcagatggaataaaacatggcttccagacagacaacagtaagatatgccagtacctgctgcacctctgctcttaccagcataagttccagctacagatgagagcaagacagagcaaccaagatgcccaagatattgagagagcttcgtttaggagcctgaatctccaagcagagtctgttagaggatttaatatgggacgagcaatcagcactggcagtctggccagcagcaccctcaacaaacttgctgttcgacctttatcagttcaagctgagattctgaagaggctatcctgctcagagctgtcgctttaccagccattgcaaaacagttcaaaagagaagaatgacaaagcttcatgggaggaaaagcctagagagatgagtaaatcataccatgatctcagtcaggcctctctctatccacatcggaaaaatgtcattgttaacatggaacccccaccacaaaccgttgcagagttggtgggaaaaccttctcaccagatgtcaagatctgatgcagaatctttggcaggagtgacaaaacttaataattcaaagtctgttgcgagtttaaatagaagtcctgaaaggaggaaacatgaatcagactcctcatccattgaagaccctgggcaagcatatgttctagatgtgctacacaaaagatggagcatagtatcttcaccagaaagggagatcaccttagtgaacctgaaaaaagatgcaaagtatggcttgggatttcaaattattggtggggagaagatgggaagactggacctaggcatatttatcagttcagttgcccctggaggaccagctgacttggatggatgcttgaagccaggagaccgtttgatatctgtgaatagtgtgagtctggagggagtcagccaccatgctgcaattgaaattttgcaaaatgcacctgaagatgtgacacttgttatctctcagccaaaagaaaagatatccaaagtgccttctactcctgtgcatctcaccaatgagatgaaaaactacatgaagaaatcttcctacatgcaagacagtgctatagattcttcttccaaggatcaccactggtcacgtggtaccctgaggcacatctcggagaactcctttgggccatctgggggcctgcgggaaggaagcctgagttctcaagattccaggactgagagtgccagcttgtctcaaagccaggtcaatggtttctttgccagccatttaggtgaccaaacctggcaggaatcacagcatggcagcccttccccatctgtaatatccaaagccaccgagaaagagactttcactgatagtaaccaaagcaaaactaaaaagccaggcatttctgatgtaactgattactcagaccgtggagattcagacatggatgaagccacttactccagcagtcaggatcatcaaacaccaaaacaggaatcttcctcttcagtgaatacatccaacaagatgaattttaaaactttttcttcatcacctcctaagcctggagatatctttgaggttgaactggctaaaaatgataacagcttggggataagtgtcacgggaggtgtgaatacgagtgtcagacatggtggcatttatgtgaaagctgttattccccagggagcagcagagtctgatggtagaattcacaaaggtgatcgcgtcctagctgtcaatggagttagtctagaaggagccacccataagcaagctgtggaaacactgagaaatacaggacaggtggttcatctgttattagaaaagggacaatctccaacatctaaagaacatgtcccggtaaccccacagtgtaccctttcagatcagaatgcccaaggtcaaggcccagaaaaagtgaagaaaacaactcaggtcaaagactacagctttgtcactgaaggaagtcatatctgctctcaggggaactgctccagaagtattcttgcttctctgcagacctccacctggtgtgctaccggaaattgatactgcgcttttgaccccacttcagtctccagcacaagtacttccaaacagcagtaaagactcttctcagccatcatgtgtggagcaaagcaccagctcagatgaaaatgaaatgtcagacaaaagcaaaaaacagtgcaagtccccatccagaagagacagttacagtgacagcagtgggagtggagaagatgacttagtgacagctccagcaaacatatcaaattcgacctggagttcagctttgcatcagactctaagcaacatggtatcacaggcacagagtcatcatgaagcacccaagagtcaagaagataccatttgtaccatgttttactatcctcagaaaattcccaataaaccagagtttgaggacagtaatccttcccctctaccaccggatatggctcctgggcagagttatcaaccccaatcagaatctgcttcctctagttcgatggataagtatcatatacatcacatttctgaaccaactagacaagaaaactggacacctttgaaaaatgacttggaaaatcaccttgaagactttgaactggaagtagaactcctcattaccctaattaaatcagaaaaaggaagcctgggttttacagtaaccaaaggcaatcagagaattggttgttatgttcatgatgtcatacaggatccagccaaaagtgatggaaggctaaaacctggggaccggctcataaaggttaatgatacagatgttactaatatgactcatacagatgcagttaatctgctccgggctgcatccaaaacagtcagattagttattggacgagttctagaattacccagaataccaatgttgcctcatttgctaccggacataacactaacgtgcaacaaagaggagttgggtttttccttatgtggaggtcatgacagcctttatcaagtggtatatattagtgatattaatccaaggtccgtcgcagccattgagggtaatctccagctattagatgtcatccattatgtgaacggagtcagcacacaaggaatgaccttggaggaagttaacagagcattagacatgtcacttccttcattggtattgaaagcaacaagaaatgatcttccagtggtccccagctcaaagaggtctgctgtttcagctccaaagtcaaccaaaggcaatggttcctacagtgtggggtcttgcagccagcctgccctcactcctaatgattcattctccacggttgctggggaagaaataaatgaaatatcgtaccccaaaggaaaatgttctacttatcagataaagggatcaccaaacttgactctgcccaaagaatcttatatacaagaagatgacatttatgatgattcccaagaagctgaagttatccagtctctgctggatgttgtggatgaggaagcccagaatcttttaaacgaaaataatgcagcaggatactcctgtggtccaggtacattaaagatgaatgggaagttatcagaagagagaacagaagatacagactgcgatggttcacctttacctgagtattttactgaggccaccaaaatgaatggctgtgaagaatattgtgaagaaaaagtaaaaagtgaaagcttaattcagaagccacaagaaaagaagactgatgatgatgaaataacatggggaaatgatgagttgccaatagagagaacaaaccatgaagattctgataaagatcattcctttctgacaaacgatgagctcgctgtactccctgtcgtcaaagtgcttccctctggtaaatacacgggtgccaacttaaaatcagtcattcgagtcctgcggggtttgctagatcaaggaattccttctaaggagctggagaatcttcaagaattaaaacctttggatcagtgtctaattgggcaaactaaggaaaacagaaggaagaacagatataaaaatatacttccctatgatgctacaagagtgcctcttggagatgaaggtggctatatcaatgccagcttcattaagataccagttgggaaagaagagttcgtttacattgcctgccaaggaccactgcctacaactgttggagacttctggcagatgatttgggagcaaaaatccacagtgatagccatgatgactcaagaagtagaaggagaaaaaatcaaatgccagcgctattggcccaacatcctaggcaaaacaacaatggtcagcaacagacttcgactggctcttgtgagaatgcagcagctgaagggctttgtggtgagggcaatgacccttgaagatattcagaccagagaggtgcgccatatttctcatctgaatttcactgcctggccagaccatgatacaccttctcaaccagatgatctgcttacttttatctcctacatgagacacatccacagatcaggcccaatcattacgcactgcagtgctggcattggacgttcagggaccctgatttgcatagatgtggttctgggattaatcagtcaggatcttgattttgacatctctgatttggtgcgctgcatgagactacaaagacacggaatggttcagacagaggatcaatatattttctgctatcaagtcatcctttatgtcctgacacgtcttcaagcagaagaagagcaaaaacagcagcctcagcttctgaagtgacatgaaaagagcctctggatgcatttccatttctctccttaacctccagcagactcctgctctctatccaaaataaagatcacagagcagcaagttcatacaacatgcatgttctcctctatcttagaggggtattcttcttgaaaataaaaaatattgaaatgctgtatttttacagctactttaacctatgataattatttacaaaattttaacactaaccaaacaatgcagatcttagggatgattaaaggcagcatttgatgatagcagacattgttacaaggacatggtgagtctatttttaatgcaccaatcttgtttatagcaaaaatgttttccaatattttaataaagtagttattttataggggatacttgaaaccagtatttaagctttaaatgacagtaatattggcatagaaaaaagtagcaaatgtttactgtatcaatttctaatgtttactatatagaatttcctgtaatatatttatatactttttcatgaaaatggagttatcagttatctgtttgttactgcatcatctgtttgtaatcattatctcactttgtaaataaaaacacaccttaaaacatgaa

SEQ ID NO: 441156 - DNA, 665 bp, Homo sapiens
aatgtccgttcatgtatacttgcttttattagataagagacgatgaactatgaaaagttatgcaaacatagtatctctttcctcttccactatgaccatcatcaccatcccatttcacctctgatcttccatttggagcatttaggaaattgccaccactttcattgtcaatagtggattacatttccatttattttctaaaaattgtgtgcatacatgatagattcttatcattccaggaagaagctctacttctgatgtactagacatacaaaagcctccactctctcatcagacctttcttaacaaagggcttagtaaatctatgggatttctgtccatcaaagatacacaagatgagaattatttcaaggacattttatcagataattctggacgtgaagattctgaaaatacattctccccttaccagttcaaaactagtggcccagaaaaaaaacccatccctggcattgatgtgctttctaagaagaagatctgggcttcatccatggacttgctttgtacagctgacagagacttctcttcaggagagactgccacatatcgtcgttgtcaccctgaggcagtaacagtgcggacgtgttaccctcaaggtctgtcgtgtgtgggtaagatgaaagaagaaaaatatgagatgtata

SEQ ID NO: 441157 - DNA, 374 bp, Homo sapiens
cttgctttgtacagctgacagagacttctcttcaggagagactgccacatatcgtcgttgtcaccctgaggcagtaacagtgcggacttcaactactcctagaaaaaaggaggcaagatactcagatggaagtatagccttggatatctttggccctcagaaaatggatccaatatatcacactcgagaattgcccacctcctcagcaatatcaagtgctttggaccgaatccgagagagacaaaagaaacttcaggttctgagggaagccatgaatgtagaaggttagtaattctgtgcatgtttgagaaagaattgaagtattttaaatatttttttgaaataaagaagggttattaaattattccacaagt

SEQ ID NO: 441158 - DNA, 3146 bp, Homo sapiens
  misc_feature (2)..(3): n is a, c, g, or t
cnnacgcgtggggtgggagaccggagcgggagacagcggtgacaggagcagcggccgggagcccttagggaggcagacagagcctgcagccaatgccccaggagccctcggttccaaccaactgatgcccctgtgcccactggcccacgccatgcagccccagtccgttctgcacagcggctacttccacccactacttcgggcctggcagacagccaccaccaccctcaatgcctccaacctcatctaccccatctttgtcacggatgttcctgatgacatacagcctatcaccagcctcccaggagtggccaggtatggtgtgaagcggctggaagagatgctgaggcccttggtggaagagggcctacgctgtgtcttgatctttggcgtccccagcagagttcccaaggacgagcggggttccgcagctgactccgaggagtccccagctattgaggcaatccatctgttgaggaagaccttccccaacctcctggtggcctgtgatgtctgcctgtgtccctacacctcccatggtcactgcgggctcctgagtgaaaacggagcattccgggctgaggagagccgccagcggctggctgaggtggcattggcgtatgccaaggcaggatgtcaggtggtagccccgtcggacatgatggatggacgcgtggaagccatcaaagaggccctgatggcacatggacttggcaacagggtatcggtgatgagctacagtgccaaatttgcttcctgtttctatggccctttccgggatgcagctaagtcaagcccagcttttggggaccgccgctgctaccagctgccccctggagcacgaggcctggctctccgagctgtggaccgggatgtacgggaaggagctgacatgctcatggtgaagccgggaatgccctacctggacatcgtgcgggaggtaaaggacaagcaccctgacctccctctcgccgtgtaccacgtctctggagagtttgccatgctgtggcatggagcccaggccggggcatttgatctcaaggctgccgtactggaggccatgactgccttccgcagagcaggtgctgacatcatcatcacctactacacaccgcagctgctgcagtggctgaaggaggaatgatggagacagtgccaggcccaagaactagaactttaaaacgttcccggggcctcagacaagtgaaaaccaaagtaaatgctgcttttagaactgtgccctcatgccctcttcctgctcacatgctagcggggcccagcagccctgggtggttttgccagcatgctaactcttgtaactcgcagctgcatcctatgagctctcccaagcttccccgcccctcccctgggtcagccgtgaggcccacctttgccaccctcagctctttcctctggtgtggcttcagcttgaaagcaacctggagtcgggggcacagcctttggggcctggctgggagagggtcttggagcattaggggaagaagagagcagtgggatcttggggcctgagaagccttggaacgcttctggcagcagagctgggtgtgggaatgaggcctagatcgatatccctgggttagagttgaaatttgccgcaattccactggaaggcatttcccacgaggccagaggttgccaggctgcctgaggtctcctattctactctgaaccataaacccagagaagaattactcattaaccagcataaatactgcctgaggatcaaaactcagaggcaaagagggagttcctgactgctagaggtgccaccaccacaaacactttttattcaggagatactttttgagaatctctgctctgttcctaggttcagtgctgggtcctgggaatacagcaggacagacctcagcttatctcttcatagaaattatacaaagagaattggggagacagctaagaagaaaacaaagaaataaagcagttacaaattgtgataagtgctttgaaggaaagaaggggtctgagacaacaacagggaaggggcctctcttgaaacagtagttgggaaggaggcagacatgcaccagtgatgtggtgacaggtgctctgaaggaggtcaccaggacctgacctctttgaaggatcagaaaatacttccctgaaggactgacatttgagcctagacctgaagggtgagccatcaagctaagacaattggggaagagcattccagggagagggaggagttgtgcaaaggccctggggctccttctagctggaggaatgcaaggctagcttgtctggagcactgagaggatggcctgaactgagtggagagagacagaccaggaccaaaccatgcagaggtcaagggccacattcaccttttcagagtgactcaatcaaatttgtagtttgtaaaagtattttaacagctctgcggcaaagtgcaaatgaaaagtcttgatggcatggactggagcggggacagtggggatggagaaaggggaatggattgtggatgtgtttagaaggtagattcgatgtgaaggatgaatctggcttgaccttctgggtggctgatgggccatttactgagatggggcagcctggaagaggaacagaagcagggtcggggtggagggagaatactaaacttagcttgagacattttgcaataaggaagctatatctagagtgcttatgtgactcacctaaggccactcaacaagtttgtggcagaactggattagaactgcacagaaaacagccaagctgggatttgaacccatgtagtccaactccaaggcctctgcccctaaccactgtgccataccacctcccaataatcaacagcaaaattataggtctaacaatgttttatagacacccctccatttatgtgatgggtttgcatcctgataaacccatcataagttgaaaatatgatcataagttgaaaatatgatcataagtcaaaaatgtatttaatatacctaacctaccaaacatcatagcttagcctagcctgccttaaacatgctcagaacacttacattagcctacagtgggcaaaactatccaacacaaaatctatattgtaataaagttataaagaattttgaataaaaattcaatatttgaaaaaaaatttctactgaatg

SEQ ID NO: 441159 - DNA, 3092 bp, Homo sapiens
  misc_feature (2)..(3): n is a, c, g, or t
cnnacgcgtggggtgggagaccggagcgggagacagcggtgacaggagcagcggccgggagcccttagggaggcagacagagcctgcagccaatgccccaggagccctcggttccaaccaactgatgcccctgtgcccactggcccacgccatgcagccccagtccgttctgcacagcggctacttccacccactacttcgggcctggcagacagccaccaccaccctcaatgcctccaacctcatctaccccatctttgtcacggatgttcctgatgacatacagcctatcaccagcctcccaggagtggccaggtatggtgtgaagcggctggaagagatgctgaggcccttggtggaagagggcctacgctgtgtcttgatctttggcgtccccagcagagttcccaaggacgagcggggttccgcagctgactccgaggagtccccagctattgaggcaatccatctgttgaggaagaccttccccaacctcctggtggcctgtgatgtctgcctgtgtccctacacctcccatggtcactgcgggctcctgagtgaaaacggagcattccgggctgaggagagccgccagcggctggctgaggtggcattggcgtatgccaaggcaggatgtcaggtggtagccccgtcggacatgatggatggacgcgtggaagccatcaaagaggccctgatggcacatggacttggcaacagggtatcggtgatgagctacagtgccaaatttgcttcctgtttctatggccctttccgggatgcagctaagtcaagcccagcttttggggaccgccgctgctaccagctgccccctggagcacgaggcctggctctccgagctgtggaccgggatgtacgggaaggagctgacatgctcatggtgaagccgggaatgccctacctggacatcgtgcgggaggtaaaggacaagcaccctgacctccctctcgccgtgtaccacgtctctggagagtttgccatgctgtggcatggagcccaggccggggcatttgatctcaaggctgccgtactggaggccatgactgccttccgcagagcaggtgctgacatcatcatcacctactacacaccgcagctgctgcagtggctgaaggaggaatgatggagacagtgccaggcccaagaactagaactttaaaacgttcccggggcctcagacaagtgcacatgctagcggggcccagcagccctgggtggttttgccagcatgctaactcttgtaactcgcagctgcatcctatgagctctcccaagcttccccgcccctcccctgggtcagccgtgaggcccacctttgccaccctcagctctttcctctggtgtggcttcagcttgaaagcaacctggagtcgggggcacagcctttggggcctggctgggagagggtcttggagcattaggggaagaagagagcagtgggatcttggggcctgagaagccttggaacgcttctggcagcagagctgggtgtgggaatgaggcctagatcgatatccctgggttagagttgaaatttgccgcaattccactggaaggcatttcccacgaggccagaggttgccaggctgcctgaggtctcctattctactctgaaccataaacccagagaagaattactcattaaccagcataaatactgcctgaggatcaaaactcagaggcaaagagggagttcctgactgctagaggtgccaccaccacaaacactttttattcaggagatactttttgagaatctctgctctgttcctaggttcagtgctgggtcctgggaatacagcaggacagacctcagcttatctcttcatagaaattatacaaagagaattggggagacagctaagaagaaaacaaagaaataaagcagttacaaattgtgataagtgctttgaaggaaagaaggggtctgagacaacaacagggaaggggcctctcttgaaacagtagttgggaaggaggcagacatgcaccagtgatgtggtgacaggtgctctgaaggaggtcaccaggacctgacctctttgaaggatcagaaaatacttccctgaaggactgacatttgagcctagacctgaagggtgagccatcaagctaagacaattggggaagagcattccagggagagggaggagttgtgcaaaggccctggggctccttctagctggaggaatgcaaggctagcttgtctggagcactgagaggatggcctgaactgagtggagagagacagaccaggaccaaaccatgcagaggtcaagggccacattcaccttttcagagtgactcaatcaaatttgtagtttgtaaaagtattttaacagctctgcggcaaagtgcaaatgaaaagtcttgatggcatggactggagcggggacagtggggatggagaaaggggaatggattgtggatgtgtttagaaggtagattcgatgtgaaggatgaatctggcttgaccttctgggtggctgatgggccatttactgagatggggcagcctggaagaggaacagaagcagggtcggggtggagggagaatactaaacttagcttgagacattttgcaataaggaagctatatctagagtgcttatgtgactcacctaaggccactcaacaagtttgtggcagaactggattagaactgcacagaaaacagccaagctgggatttgaacccatgtagtccaactccaaggcctctgcccctaaccactgtgccataccacctcccaataatcaacagcaaaattataggtctaacaatgttttatagacacccctccatttatgtgatgggtttgcatcctgataaacccatcataagttgaaaatatgatcataagttgaaaatatgatcataagtcaaaaatgtatttaatatacctaacctaccaaacatcatagcttagcctagcctgccttaaacatgctcagaacacttacattagcctacagtgggcaaaactatccaacacaaaatctatattgtaataaagttataaagaattttgaataaaaattcaatatttgaaaaaaaatttctactgaatg

SEQ ID NO: 441160 - DNA, 3091 bp, Homo sapiens
  misc_feature (2)..(3): n is a, c, g, or t
cnnacgcgtggggtgggagaccggagcgggagacagcggtgacaggagcagcggccgggagcccttagggaggcagacagagcctgcagccaatgccccaggagccctcggttccaaccaactgatgcccctgtgcccactggcccacgccatgcagccccagtccgttctgcacagcggctacttccacccactacttcgggcctggcagacagccaccaccaccctcaatgcctccaacctcatctaccccatctttgtcacggatgttcctgatgacatacagcctatcaccagcctcccaggagtggccaggtatggtgtgaagcggctggaagagatgctgaggcccttggtggaagagggcctacgctgtgtcttgatctttggcgtccccagcagagttcccaaggacgagcggggttccgcagctgactccgaggagtccccagctattgaggcaatccatctgttgaggaagaccttccccaacctcctggtggcctgtgatgtctgcctgtgtccctacacctcccatggtcactgcgggctctgagtgccaccctctgccccccaggatgtcaggtggtagccccgtcggacatgatggatggacgcgtggaagccatcaaagaggccctgatggcacatggacttggcaacagggtatcggtgatgagctacagtgccaaatttgcttcctgtttctatggccctttccgggatgcagctaagtcaagcccagcttttggggaccgccgctgctaccagctgccccctggagcacgaggcctggctctccgagctgtggaccgggatgtacgggaaggagctgacatgctcatggtgaagccgggaatgccctacctggacatcgtgcgggaggtaaaggacaagcaccctgacctccctctcgccgtgtaccacgtctctggagagtttgccatgctgtggcatggagcccaggccggggcatttgatctcaaggctgccgtactggaggccatgactgccttccgcagagcaggtgctgacatcatcatcacctactacacaccgcagctgctgcagtggctgaaggaggaatgatggagacagtgccaggcccaagaactagaactttaaaacgttcccggggcctcagacaagtgaaaaccaaagtaaatgctgcttttagaactgtgccctcatgccctcttcctgctcacatgctagcggggcccagcagccctgggtggttttgccagcatgctaactcttgtaactcgcagctgcatcctatgagctctcccaagcttccccgcccctcccctgggtcagccgtgaggcccacctttgccaccctcagctctttcctctggtgtggcttcagcttgaaagcaacctggagtcgggggcacagcctttggggcctggctgggagagggtcttggagcattaggggaagaagagagcagtgggatcttggggcctgagaagccttggaacgcttctggcagcagagctgggtgtgggaatgaggcctagatcgatatccctgggttagagttgaaatttgccgcaattccactggaaggcatttcccacgaggccagaggttgccaggctgcctgaggtctcctattctactctgaaccataaacccagagaagaattactcattaaccagcataaatactgcctgaggatcaaaactcagaggcaaagagggagttcctgactgctagaggtgccaccaccacaaacactttttattcaggagatactttttgagaatctctgctctgttcctaggttcagtgctgggtcctgggaatacagcaggacagacctcagcttatctcttcatagaaattatacaaagagaattggggagacagctaagaagaaaacaaagaaataaagcagttacaaattgtgataagtgctttgaaggaaagaaggggtctgagacaacaacagggaaggggcctctcttgaaacagtagttgggaaggaggcagacatgcaccagtgatgtggtgacaggtgctctgaaggaggtcaccaggacctgacctctttgaaggatcagaaaatacttccctgaaggactgacatttgagcctagacctgaagggtgagccatcaagctaagacaattggggaagagcattccagggagagggaggagttgtgcaaaggccctggggctccttctagctggaggaatgcaaggctagcttgtctggagcactgagaggatggcctgaactgagtggagagagacagaccaggaccaaaccatgcagaggtcaagggccacattcaccttttcagagtgactcaatcaaatttgtagtttgtaaaagtattttaacagctctgcggcaaagtgcaaatgaaaagtcttgatggcatggactggagcggggacagtggggatggagaaaggggaatggattgtggatgtgtttagaaggtagattcgatgtgaaggatgaatctggcttgaccttctgggtggctgatgggccatttactgagatggggcagcctggaagaggaacagaagcagggtcggggtggagggagaatactaaacttagcttgagacattttgcaataaggaagctatatctagagtgcttatgtgactcacctaaggccactcaacaagtttgtggcagaactggattagaactgcacagaaaacagccaagctgggatttgaacccatgtagtccaactccaaggcctctgcccctaaccactgtgccataccacctcccaataatcaacagcaaaattataggtctaacaatgttttatagacacccctccatttatgtgatgggtttgcatcctgataaacccatcataagttgaaaatatgatcataagttgaaaatatgatcataagtcaaaaatgtatttaatatacctaacctaccaaacatcatagcttagcctagcctgccttaaacatgctcagaacacttacattagcctacagtgggcaaaactatccaacacaaaatctatattgtaataaagttataaagaattttgaataaaaattcaatatttgaaaaaaaatttctactgaatg

SEQ ID NO: 441161 - DNA, 3312 bp, Homo sapiens
  misc_feature (2)..(3): n is a, c, g, or t
cnnacgcgtggggtgggagaccggagcgggagacagcggtgacaggagcagcggccgggagcccttagggaggcagacagagcctgcagccaatgccccaggagccctcggttccaaccaactgatgcccctgtgcccactggcccacgccatgcagccccagtccgttctgcacagcggctacttccacccactacttcgggcctggcagacagccaccaccaccctcaatgcctccaacctcatctaccccatctttgtcacgccctgggcttggccaggcagggaagccagacactggatcccatcctcctcccaccatctccacttccatatttctttcctgcttcccaaccatccctctcagtcgcccccgcaccactggcccttcccacagctaccaatccatatcccacccccgctcttgcagggatgttcctgatgacatacagcctatcaccagcctcccaggagtggccaggtatggtgtgaagcggctggaagagatgctgaggcccttggtggaagagggcctacgctgtgtcttgatctttggcgtccccagcagagttcccaaggacgagcggggttccgcagctgactccgaggagtccccagctattgaggcaatccatctgttgaggaagaccttccccaacctcctggtggcctgtgatgtctgcctgtgtccctacacctcccatggtcactgcgggctcctgagtgaaaacggagcattccgggctgaggagagccgccagcggctggctgaggtggcattggcgtatgccaaggcaggatgtcaggtggtagccccgtcggacatgatggatggacgcgtggaagccatcaaagaggccctgatggcacatggacttggcaacagggtatcggtgatgagctacagtgccaaatttgcttcctgtttctatggccctttccgggatgcagctaagtcaagcccagcttttggggaccgccgctgctaccagctgccccctggagcacgaggcctggctctccgagctgtggaccgggatgtacgggaaggagctgacatgctcatggtgaagccgggaatgccctacctggacatcgtgcgggaggtaaaggacaagcaccctgacctccctctcgccgtgtaccacgtctctggagagtttgccatgctgtggcatggagcccaggccggggcatttgatctcaaggctgccgtactggaggccatgactgccttccgcagagcaggtgctgacatcatcatcacctactacacaccgcagctgctgcagtggctgaaggaggaatgatggagacagtgccaggcccaagaactagaactttaaaacgttcccggggcctcagacaagtgaaaaccaaagtaaatgctgcttttagaactgtgccctcatgccctcttcctgctcacatgctagcggggcccagcagccctgggtggttttgccagcatgctaactcttgtaactcgcagctgcatcctatgagctctcccaagcttccccgcccctcccctgggtcagccgtgaggcccacctttgccaccctcagctctttcctctggtgtggcttcagcttgaaagcaacctggagtcgggggcacagcctttggggcctggctgggagagggtcttggagcattaggggaagaagagagcagtgggatcttggggcctgagaagccttggaacgcttctggcagcagagctgggtgtgggaatgaggcctagatcgatatccctgggttagagttgaaatttgccgcaattccactggaaggcatttcccacgaggccagaggttgccaggctgcctgaggtctcctattctactctgaaccataaacccagagaagaattactcattaaccagcataaatactgcctgaggatcaaaactcagaggcaaagagggagttcctgactgctagaggtgccaccaccacaaacactttttattcaggagatactttttgagaatctctgctctgttcctaggttcagtgctgggtcctgggaatacagcaggacagacctcagcttatctcttcatagaaattatacaaagagaattggggagacagctaagaagaaaacaaagaaataaagcagttacaaattgtgataagtgctttgaaggaaagaaggggtctgagacaacaacagggaaggggcctctcttgaaacagtagttgggaaggaggcagacatgcaccagtgatgtggtgacaggtgctctgaaggaggtcaccaggacctgacctctttgaaggatcagaaaatacttccctgaaggactgacatttgagcctagacctgaagggtgagccatcaagctaagacaattggggaagagcattccagggagagggaggagttgtgcaaaggccctggggctccttctagctggaggaatgcaaggctagcttgtctggagcactgagaggatggcctgaactgagtggagagagacagaccaggaccaaaccatgcagaggtcaagggccacattcaccttttcagagtgactcaatcaaatttgtagtttgtaaaagtattttaacagctctgcggcaaagtgcaaatgaaaagtcttgatggcatggactggagcggggacagtggggatggagaaaggggaatggattgtggatgtgtttagaaggtagattcgatgtgaaggatgaatctggcttgaccttctgggtggctgatgggccatttactgagatggggcagcctggaagaggaacagaagcagggtcggggtggagggagaatactaaacttagcttgagacattttgcaataaggaagctatatctagagtgcttatgtgactcacctaaggccactcaacaagtttgtggcagaactggattagaactgcacagaaaacagccaagctgggatttgaacccatgtagtccaactccaaggcctctgcccctaaccactgtgccataccacctcccaataatcaacagcaaaattataggtctaacaatgttttatagacacccctccatttatgtgatgggtttgcatcctgataaacccatcataagttgaaaatatgatcataagttgaaaatatgatcataagtcaaaaatgtatttaatatacctaacctaccaaacatcatagcttagcctagcctgccttaaacatgctcagaacacttacattagcctacagtgggcaaaactatccaacacaaaatctatattgtaataaagttataaagaattttgaataaaaattcaatatttgaaaaaaaatttctactgaatg

SEQ ID NO: 441162 - DNA, 3392 bp, Homo sapiens
aaaaaaaaagaagagaattttttttaaacagtcattgcttgctcagatgtttactttaaaagataataatgaacaagaagcagtcacataaaatacaagcccaaattttatatcattagattctgattgtcatgaaagtttctaaagacttactttcatttctcaacttaccttgttgaccagcagggattggtgaaccatgctgtgagtagcattgggctagagagaggggaggcaggaatctagaagagctgttttccagatgtgaccatctcctgaggacagggaccatgtctcatgtgccacccatcaccccccacagacagagcctgcagccaatgccccaggagccctcggttccaaccaactgatgcccctgtgcccactggcccacgccatgcagccccagtccgttctgcacagcggctacttccacccactacttcgggcctggcagacagccaccaccaccctcaatgcctccaacctcatctaccccatctttgtcacggatgttcctgatgacatacagcctatcaccagcctcccaggagtggccaggtatggtgtgaagcggctggaagagatgctgaggcccttggtggaagagggcctacgctgtgtcttgatctttggcgtccccagcagagttcccaaggacgagcggggttccgcagctgactccgaggagtccccagctattgaggcaatccatctgttgaggaagaccttccccaacctcctggtggcctgtgatgtctgcctgtgtccctacacctcccatggtcactgcgggctcctgagtgaaaacggagcattccgggctgaggagagccgccagcggctggctgaggtggcattggcgtatgccaaggcaggatgtcaggtggtagccccgtcggacatgatggatggacgcgtggaagccatcaaagaggccctgatggcacatggacttggcaacagggtatcggtgatgagctacagtgccaaatttgcttcctgtttctatggccctttccgggatgcagctaagtcaagcccagcttttggggaccgccgctgctaccagctgccccctggagcacgaggcctggctctccgagctgtggaccgggatgtacgggaaggagctgacatgctcatggtgaagccgggaatgccctacctggacatcgtgcgggaggtaaaggacaagcaccctgacctccctctcgccgtgtaccacgtctctggagagtttgccatgctgtggcatggagcccaggccggggcatttgatctcaaggctgccgtactggaggccatgactgccttccgcagagcaggtgctgacatcatcatcacctactacacaccgcagctgctgcagtggctgaaggaggaatgatggagacagtgccaggcccaagaactagaactttaaaacgttcccggggcctcagacaagtgaaaaccaaagtaaatgctgcttttagaactgtgccctcatgccctcttcctgctcacatgctagcggggcccagcagccctgggtggttttgccagcatgctaactcttgtaactcgcagctgcatcctatgagctctcccaagcttccccgcccctcccctgggtcagccgtgaggcccacctttgccaccctcagctctttcctctggtgtggcttcagcttgaaagcaacctggagtcgggggcacagcctttggggcctggctgggagagggtcttggagcattaggggaagaagagagcagtgggatcttggggcctgagaagccttggaacgcttctggcagcagagctgggtgtgggaatgaggcctagatcgatatccctgggttagagttgaaatttgccgcaattccactggaaggcatttcccacgaggccagaggttgccaggctgcctgaggtctcctattctactctgaaccataaacccagagaagaattactcattaaccagcataaatactgcctgaggatcaaaactcagaggcaaagagggagttcctgactgctagaggtgccaccaccacaaacactttttattcaggagatactttttgagaatctctgctctgttcctaggttcagtgctgggtcctgggaatacagcaggacagacctcagcttatctcttcatagaaattatacaaagagaattggggagacagctaagaagaaaacaaagaaataaagcagttacaaattgtgataagtgctttgaaggaaagaaggggtctgagacaacaacagggaaggggcctctcttgaaacagtagttgggaaggaggcagacatgcaccagtgatgtggtgacaggtgctctgaaggaggtcaccaggacctgacctctttgaaggatcagaaaatacttccctgaaggactgacatttgagcctagacctgaagggtgagccatcaagctaagacaattggggaagagcattccagggagagggaggagttgtgcaaaggccctggggctccttctagctggaggaatgcaaggctagcttgtctggagcactgagaggatggcctgaactgagtggagagagacagaccaggaccaaaccatgcagaggtcaagggccacattcaccttttcagagtgactcaatcaaatttgtagtttgtaaaagtattttaacagctctgcggcaaagtgcaaatgaaaagtcttgatggcatggactggagcggggacagtggggatggagaaaggggaatggattgtggatgtgtttagaaggtagattcgatgtgaaggatgaatctggcttgaccttctgggtggctgatgggccatttactgagatggggcagcctggaagaggaacagaagcagggtcggggtggagggagaatactaaacttagcttgagacattttgcaataaggaagctatatctagagtgcttatgtgactcacctaaggccactcaacaagtttgtggcagaactggattagaactgcacagaaaacagccaagctgggatttgaacccatgtagtccaactccaaggcctctgcccctaaccactgtgccataccacctcccaataatcaacagcaaaattataggtctaacaatgttttatagacacccctccatttatgtgatgggtttgcatcctgataaacccatcataagttgaaaatatgatcataagttgaaaatatgatcataagtcaaaaatgtatttaatatacctaacctaccaaacatcatagcttagcctagcctgccttaaacatgctcagaacacttacattagcctacagtgggcaaaactatccaacacaaaatctatattgtaataaagttataaagaattttgaataaaaattcaatatttgaaaaaaaatttctactgaatg

SEQ ID NO: 441163 - DNA, 3257 bp, Homo sapiens
  misc_feature (2)..(3): n is a, c, g, or t
cnnacgcgtggggtgggagaccggagcgggagacagcggtgacaggagcagcggccgggagcccttagggaggcagacagagcctgcagccaatgccccaggagccctcggttccaaccaactgatgcccctgtgcccactggcccacgccatgcagccccagtccgttctgcacagcggctacttccacccactacttcgggcctggcagacagccaccaccaccctcaatgcctccaacctcatctaccccatctttgtcacgccctgggcttggccaggcagggaagccagacactggatcccatcctcctcccaccatctccacttccatatttctttcctgcttcccaaccatccctctcagtcgcccccgcaccactggcccttcccacagctaccaatccatatcccacccccgctcttgcagggatgttcctgatgacatacagcctatcaccagcctcccaggagtggccaggtatggtgtgaagcggctggaagagatgctgaggcccttggtggaagagggcctacgctgtgtcttgatctttggcgtccccagcagagttcccaaggacgagcggggttccgcagctgactccgaggagtccccagctattgaggcaatccatctgttgaggaagaccttccccaacctcctggtggcctgtgatgtctgcctgtgtccctacacctcccatggtcactgcgggctctgagtgccaccctctgccccccaggatgtcaggtggtagccccgtcggacatgatggatggacgcgtggaagccatcaaagaggccctgatggcacatggacttggcaacagggtatcggtgatgagctacagtgccaaatttgcttcctgtttctatggccctttccgggatgcagctaagtcaagcccagcttttggggaccgccgctgctaccagctgccccctggagcacgaggcctggctctccgagctgtggaccgggatgtacgggaaggagctgacatgctcatggtgaagccgggaatgccctacctggacatcgtgcgggaggtaaaggacaagcaccctgacctccctctcgccgtgtaccacgtctctggagagtttgccatgctgtggcatggagcccaggccggggcatttgatctcaaggctgccgtactggaggccatgactgccttccgcagagcaggtgctgacatcatcatcacctactacacaccgcagctgctgcagtggctgaaggaggaatgatggagacagtgccaggcccaagaactagaactttaaaacgttcccggggcctcagacaagtgaaaaccaaagtaaatgctgcttttagaactgtgccctcatgccctcttcctgctcacatgctagcggggcccagcagccctgggtggttttgccagcatgctaactcttgtaactcgcagctgcatcctatgagctctcccaagcttccccgcccctcccctgggtcagccgtgaggcccacctttgccaccctcagctctttcctctggtgtggcttcagcttgaaagcaacctggagtcgggggcacagcctttggggcctggctgggagagggtcttggagcattaggggaagaagagagcagtgggatcttggggcctgagaagccttggaacgcttctggcagcagagctgggtgtgggaatgaggcctagatcgatatccctgggttagagttgaaatttgccgcaattccactggaaggcatttcccacgaggccagaggttgccaggctgcctgaggtctcctattctactctgaaccataaacccagagaagaattactcattaaccagcataaatactgcctgaggatcaaaactcagaggcaaagagggagttcctgactgctagaggtgccaccaccacaaacactttttattcaggagatactttttgagaatctctgctctgttcctaggttcagtgctgggtcctgggaatacagcaggacagacctcagcttatctcttcatagaaattatacaaagagaattggggagacagctaagaagaaaacaaagaaataaagcagttacaaattgtgataagtgctttgaaggaaagaaggggtctgagacaacaacagggaaggggcctctcttgaaacagtagttgggaaggaggcagacatgcaccagtgatgtggtgacaggtgctctgaaggaggtcaccaggacctgacctctttgaaggatcagaaaatacttccctgaaggactgacatttgagcctagacctgaagggtgagccatcaagctaagacaattggggaagagcattccagggagagggaggagttgtgcaaaggccctggggctccttctagctggaggaatgcaaggctagcttgtctggagcactgagaggatggcctgaactgagtggagagagacagaccaggaccaaaccatgcagaggtcaagggccacattcaccttttcagagtgactcaatcaaatttgtagtttgtaaaagtattttaacagctctgcggcaaagtgcaaatgaaaagtcttgatggcatggactggagcggggacagtggggatggagaaaggggaatggattgtggatgtgtttagaaggtagattcgatgtgaaggatgaatctggcttgaccttctgggtggctgatgggccatttactgagatggggcagcctggaagaggaacagaagcagggtcggggtggagggagaatactaaacttagcttgagacattttgcaataaggaagctatatctagagtgcttatgtgactcacctaaggccactcaacaagtttgtggcagaactggattagaactgcacagaaaacagccaagctgggatttgaacccatgtagtccaactccaaggcctctgcccctaaccactgtgccataccacctcccaataatcaacagcaaaattataggtctaacaatgttttatagacacccctccatttatgtgatgggtttgcatcctgataaacccatcataagttgaaaatatgatcataagttgaaaatatgatcataagtcaaaaatgtatttaatatacctaacctaccaaacatcatagcttagcctagcctgccttaaacatgctcagaacacttacattagcctacagtgggcaaaactatccaacacaaaatctatattgtaataaagttataaagaattttgaataaaaattcaatatttgaaaaaaaatttctactgaatg

SEQ ID NO: 441164 - DNA, 1260 bp, Homo sapiens
  misc_feature (2)..(3): n is a, c, g, or t
cnnacgcgtggggtgggagaccggagcgggagacagcggtgacaggagcagcggccgggagcccttagggaggcagacagagcctgcagccaatgccccaggagccctcggttccaaccaactgatgcccctgtgcccactggcccacgccatgcagccccagtccgttctgcacagcggctacttccacccactacttcgggcctggcagacagccaccaccaccctcaatgcctccaacctcatctaccccatctttgtcacggatgttcctgatgacatacagcctatcaccagcctcccaggagtggccaggtatggtgtgaagcggctggaagagatgctgaggcccttggtggaagagggcctacgctgtgtcttgatctttggcgtccccagcagagttcccaaggacgagcggggttccgcagctgactccgaggagtccccagctattgaggcaatccatctgttgaggaagaccttccccaacctcctggtggcctgtgatgtctgcctgtgtccctacacctcccatggtcactgcgggctcctgagtgaaaacggagcattccgggctgaggagagccgccagcggctggctgaggtggcattggcgtatgccaaggcaggatgtcaggtggtagccccgtcggacatgatggatggacgcgtggaagccatcaaagaggccctgatggcacatggacttggcaacagggtatcggtgatgagctacagtgccaaatttgcttcctgtttctatggccctttccgggatgcagctaagtcaagcccagcttttggggaccgccgctgctaccagctgccccctggagcacgaggcctggctctccgagctgtggaccgggatgtacgggaaggagctgacatgctcatggtgaagccgggaatgccctacctggacatcgtgcgggaggtaaaggacaagcaccctgacctccctctcgccgtgtaccacgtctctggagagtttgccatgctgtggcatggagcccaggccggggcatttgatctcaaggctgccgtactggaggccatgactgccttccgcagagcaggtgctgacatcatcatcacctactacacaccgcagctgctgcagtggctgaaggaggaatgatggagacagtgccaggcccaagaactagaactttaaaacgttcccggggcctcagacaagtgaaaaccaaagtaaatgctgcttttagaactgtgccctcatgccctcttcctgct

SEQ ID NO: 441165 - DNA, 2557 bp, Homo sapiens
ggcacgagggccccgggagcgcgggcggcgggccccttggtcctcaggcggccgtggcggcggtggcggcggttgggccgaggcaggcggcctcagtggccgaggtggctggacgcgtagcaggtggaaggagggagggagccgcaggcgcagacccacccgccatgaagccccccgcagcctgtgcaggagacatggcggacgcagcatctccgtgctctgtggtaaacgacctgcggtgggacctgagtgcccagcagatagaggagcgcaccagggagctcatcgagcagaccaagcgcgtgtatgaccaggttggcacccaggagtttgaggacgtgtcctacgagagcacgctcaaggcgctggccgatgtggaggtcacctacacagttcagaggaatatccttgacttcccccagcatgtttccccctccaaggacatccggacagccagcacagaggccgacaagaagctctctgagttcgacgtggagatgagcatgagggaggacgtgtaccagaggatcgtgtggctccaggagaaagttcagaaggactcactgaggcccgaggctgcgcggtacctggagcggctaatcaagctgggccggagaaatgggcttcacctccccagagagactcaggaaaacatcaaacgcatcaagaagaagctgagccttctgtgcatcgacttcaacaagaacctgaacgaggacacgaccttcctgcccttcacgctccaggagctaggagggctccccgaggactttctgaactccctggagaagatggaggacggcaagttgaaggtcaccctcaagtacccccattacttccccctcctgaagaaatgccacgtgcctgagaccaggaggaaagtggaggaggccttcaactgccggtgcaaggaggagaactgcgctatcctcaaggagctggtgacgctgcgggcccagaagtcccgcctgctggggttccacacgcacgccgactatgtcctggagatgaacatggccaagaccagccagaccgtggccaccttcctagatgagctggcgcagaagctgaagcccctgggggagcaggagcgtgcggtgattctggagctgaagcgtgcggagtgcgagcgccggggcctgcccttcgacggccgcatccgtgcctgggacatgcgctactacatgaaccaggtggaggagacgcgctactgcgtggaccagaacctgctcaaggagtacttccccgtgcaggtggtcacgcacgggctgctgggcatctaccaggagctcctggggctggccttccaccacgaggagggcgccagtgcctggcatgaggacgtgcggctctacaccgcgagggacgcggcctcgggggaggtggtcggcaagttctacctggacctgtacccgcgggaaggaaagtacgggcacgcggcctgctttggcctgcagcccggctgcctgcggcaggatgggagccgccagatcgccatcgcggccatggtggccaacttcaccaagcccacagccgacgcgccctcgctgctgcagcatgacgaggtggagacctacttccatgagtttggccacgtgatgcaccagctctgctcccaggcggagttcgccatgttcagcgggacccacgtggagcgggactttgtggaggcgccgtcgcagatgctggagaactgggtgtgggagcaggagccgctgctgcggatgtcgcggcactaccgcacaggcagcgccgtgccccgggagctcctggagaagctcattgagtcccggcaggccaacacaggcctcttcaacctgcgccagatcgtcctcgccaaggtggaccaggccctgcacacgcagacggacgcagaccccgccgaggagtatgcgcggctctgccaggagatcctcggggtcccggccacgccaggaaccaacatgcctgcaaccttcggccatctggcaggtggctacgacgcccagtactacgggtacctgtggagcgaggtgtattccatggacatgttccacacgcgcttcaagcaggagggtgtcctgaacagcaaggttggcatggattacagaagctgcatcctgagacccggcggttccgaggatgccagcgccatgctgaggcgcttcctgggccgtgaccccaagcaggacgccttcctcctgagcaaggggctgcaggtcgggggctgcgagcccgagccgcaggtctgctgaggcctggcactgcgactgcccagtctggcctgcgctcccgccgccctggtgccttagcccccggcacaggatggggcaggctctggcacagtgcctgggactggcagggtggctgagcggctgtcttgcctcttgtcattgtctgtccccacccggtcgtggcccacccggctagagacggcgtcctcaaggcatctggagggctttcgtggctgccagggcctggtctttgttgcactaacacgtctcctctctgggaaacgtcccttgtcaggagacggctcttctttgaaatgaggtcattaaaaggaaacagaaaaaga

SEQ ID NO: 441166 - DNA, 2402 bp, Homo sapiens
ggcacgagggccccgggagcgcgggcggcgggccccttggtcctcaggcggccgtggcggcggtggcggcggttgggccgaggcaggcggcctcagtggccgaggtggctggacgcgtagcaggtggaaggagggagggagccgcaggcgcagacccacccgccatgaagccccccgcaggacgtgtcctacgagagcacgctcaaggcgctggccgatgtggaggtcacctacacagttcagaggaatatccttgacttcccccagcatgtttccccctccaaggacatccggacagccagcacagaggccgacaagaagctctctgagttcgacgtggagatgagcatgagggaggacgtgtaccagaggatcgtgtggctccaggagaaagttcagaaggactcactgaggcccgaggctgcgcggtacctggagcggctaatcaagctgggccggagaaatgggcttcacctccccagagagactcaggaaaacatcaaacgcatcaagaagaagctgagccttctgtgcatcgacttcaacaagaacctgaacgaggacacgaccttcctgcccttcacgctccaggagctaggagggctccccgaggactttctgaactccctggagaagatggaggacggcaagttgaaggtcaccctcaagtacccccattacttccccctcctgaagaaatgccacgtgcctgagaccaggaggaaagtggaggaggccttcaactgccggtgcaaggaggagaactgcgctatcctcaaggagctggtgacgctgcgggcccagaagtcccgcctgctggggttccacacgcacgccgactatgtcctggagatgaacatggccaagaccagccagaccgtggccaccttcctagatgagctggcgcagaagctgaagcccctgggggagcaggagcgtgcggtgattctggagctgaagcgtgcggagtgcgagcgccggggcctgcccttcgacggccgcatccgtgcctgggacatgcgctactacatgaaccaggtggaggagacgcgctactgcgtggaccagaacctgctcaaggagtacttccccgtgcaggtggtcacgcacgggctgctgggcatctaccaggagctcctggggctggccttccaccacgaggagggcgccagtgcctggcatgaggacgtgcggctctacaccgcgagggacgcggcctcgggggaggtggtcggcaagttctacctggacctgtacccgcgggaaggaaagtacgggcacgcggcctgctttggcctgcagcccggctgcctgcggcaggatgggagccgccagatcgccatcgcggccatggtggccaacttcaccaagcccacagccgacgcgccctcgctgctgcagcatgacgaggtggagacctacttccatgagtttggccacgtgatgcaccagctctgctcccaggcggagttcgccatgttcagcgggacccacgtggagcgggactttgtggaggcgccgtcgcagatgctggagaactgggtgtgggagcaggagccgctgctgcggatgtcgcggcactaccgcacaggcagcgccgtgccccgggagctcctggagaagctcattgagtcccggcaggccaacacaggcctcttcaacctgcgccagatcgtcctcgccaaggtggaccaggccctgcacacgcagacggacgcagaccccgccgaggagtatgcgcggctctgccaggagatcctcggggtcccggccacgccaggaaccaacatgcctgcaaccttcggccatctggcaggtggctacgacgcccagtactacgggtacctgtggagcgaggtgtattccatggacatgttccacacgcgcttcaagcaggagggtgtcctgaacagcaaggttggcatggattacagaagctgcatcctgagacccggcggttccgaggatgccagcgccatgctgaggcgcttcctgggccgtgaccccaagcaggacgccttcctcctgagcaaggggctgcaggtcgggggctgcgagcccgagccgcaggtctgctgaggcctggcactgcgactgcccagtctggcctgcgctcccgccgccctggtgccttagcccccggcacaggatggggcaggctctggcacagtgcctgggactggcagggtggctgagcggctgtcttgcctcttgtcattgtctgtccccacccggtcgtggcccacccggctagagacggcgtcctcaaggcatctggagggctttcgtggctgccagggcctggtctttgttgcactaacacgtctcctctctgggaaacgtcccttgtcaggagacggctcttctttgaaatgaggtcattaaaaggaaacagaaaaaga

SEQ ID NO: 441167 - DNA, 2528 bp, Homo sapiens
ggcacgagggccccgggagcgcgggcggcgggccccttggtcctcaggcggccgtggcggcggtggcggcggttgggccgaggcaggcggcctcagtggccgaggtggctggacgcgtagcaggtggaaggagggagggagccgcaggcgcagacccacccgccatgaagccccccgcagcctgtgcaggagacatggcggacgcagcatctccgtgctctgtggtaaacgacctgcggtgggacctgagtgcccagcagatagaggagcgcaccagggagctcatcgagcagaccaagcgcgtgtatgaccaggttggcacccaggagtttgaggacgtgtcctacgagagcacgctcaaggcgctggccgatgtggaggtcacctacacagcatgtttccccctccaaggacatccggacagccagcacagaggccgacaagaagctctctgagttcgacgtggagatgagcatgagggaggacgtgtaccagaggatcgtgtggctccaggagaaagttcagaaggactcactgaggcccgaggctgcgcggtacctggagcggctaatcaagctgggccggagaaatgggcttcacctccccagagagactcaggaaaacatcaaacgcatcaagaagaagctgagccttctgtgcatcgacttcaacaagaacctgaacgaggacacgaccttcctgcccttcacgctccaggagctaggagggctccccgaggactttctgaactccctggagaagatggaggacggcaagttgaaggtcaccctcaagtacccccattacttccccctcctgaagaaatgccacgtgcctgagaccaggaggaaagtggaggaggccttcaactgccggtgcaaggaggagaactgcgctatcctcaaggagctggtgacgctgcgggcccagaagtcccgcctgctggggttccacacgcacgccgactatgtcctggagatgaacatggccaagaccagccagaccgtggccaccttcctagatgagctggcgcagaagctgaagcccctgggggagcaggagcgtgcggtgattctggagctgaagcgtgcggagtgcgagcgccggggcctgcccttcgacggccgcatccgtgcctgggacatgcgctactacatgaaccaggtggaggagacgcgctactgcgtggaccagaacctgctcaaggagtacttccccgtgcaggtggtcacgcacgggctgctgggcatctaccaggagctcctggggctggccttccaccacgaggagggcgccagtgcctggcatgaggacgtgcggctctacaccgcgagggacgcggcctcgggggaggtggtcggcaagttctacctggacctgtacccgcgggaaggaaagtacgggcacgcggcctgctttggcctgcagcccggctgcctgcggcaggatgggagccgccagatcgccatcgcggccatggtggccaacttcaccaagcccacagccgacgcgccctcgctgctgcagcatgacgaggtggagacctacttccatgagtttggccacgtgatgcaccagctctgctcccaggcggagttcgccatgttcagcgggacccacgtggagcgggactttgtggaggcgccgtcgcagatgctggagaactgggtgtgggagcaggagccgctgctgcggatgtcgcggcactaccgcacaggcagcgccgtgccccgggagctcctggagaagctcattgagtcccggcaggccaacacaggcctcttcaacctgcgccagatcgtcctcgccaaggtggaccaggccctgcacacgcagacggacgcagaccccgccgaggagtatgcgcggctctgccaggagatcctcggggtcccggccacgccaggaaccaacatgcctgcaaccttcggccatctggcaggtggctacgacgcccagtactacgggtacctgtggagcgaggtgtattccatggacatgttccacacgcgcttcaagcaggagggtgtcctgaacagcaaggttggcatggattacagaagctgcatcctgagacccggcggttccgaggatgccagcgccatgctgaggcgcttcctgggccgtgaccccaagcaggacgccttcctcctgagcaaggggctgcaggtcgggggctgcgagcccgagccgcaggtctgctgaggcctggcactgcgactgcccagtctggcctgcgctcccgccgccctggtgccttagcccccggcacaggatggggcaggctctggcacagtgcctgggactggcagggtggctgagcggctgtcttgcctcttgtcattgtctgtccccacccggtcgtggcccacccggctagagacggcgtcctcaaggcatctggagggctttcgtggctgccagggcctggtctttgttgcactaacacgtctcctctctgggaaacgtcccttgtcaggagacggctcttctttgaaatgaggtcattaaaaggaaacagaaaaaga

SEQ ID NO: 441168 - DNA, 2521 bp, Homo sapiens
ggcacgagggccccgggagcgcgggcggcgggccccttggtcctcaggcggccgtggcggcggtggcggcggttgggccgaggcaggcggcctcagtggccgaggtggctggacgcgtagcaggtggaaggagggagggagccgcaggcgcagacccacccgccatgaagccccccgcagcctgtgcaggagacatggcggacgcagcatctccgtgctctgtggtaaacgacctgcggtgggacctgagtgcccagcagatagaggagcgcaccagggagctcatcgagcagaccaagcgcgtgtatgaccaggttggcacccaggagtttgaggacgtgtcctacgagagcacgctcaaggcgctggccgatgtggaggtcacctacacagttcagaggaatatccttgacttcccccagcatgtttccccctccaaggacatccggacagccagcacagaggccgacaagaagctctctgagttcgacgtggagatgagcatgagggaggacgtgtaccagaggatcgtgtggctccaggagaaagttcagaaggactcactgaggcccgaggctgcgcggtacctggagcggctaatcaagctgggccggagaaatgggcttcacctccccagagagactcaggaaaacatcaaacgcatcaagaagaagctgagccttctgtgcatcgacttcaacaagaacctgaacgaggacacgaccttcctgcccttcacgctccaggagctaggagggctccccgaggactttctgaactccctggagaagatggaggacggcaagttgaaggtcaccctcaagtacccccattacttccccctcctgaagaaatgccacgtgcctgagaccaggaggaaagtggaggaggccttcaactgccggtgcaaggaggagaactgcgctatcctcaaggagctggtgacgctgcgggcccagaagtcccgcctgctggggttccacacgcacgccgactatgtcctggagatgaacatggccaagaccagccagaccgtggccaccttcctagatgagctggcgcagaagctgaagcccctgggggagcaggagcgtgcggtgattctggagctgaagcgtgcggagtgcgagcgccggggcctgcccttcgacggccgcatccgtgcctgggacatgcgctactacatgaaccaggtggaggagacgcgctactgcgtggaccagaacctgctcaaggagtacttccccgtgcaggtggtcacgcacgggctgctgggcatctaccaggagctcctggggctggccttccaccacgaggagggcgccagtgcctggcatgaggacgtgcggctctacaccgcgagggacgcggcctcgggggaggtggtcggcaagttctacctggacctgtacccgcgggaaggaaagtacgggcacgcggcctgctttggcctgcagcccggctgcctgcggcaggatgggagccgccagatcgccatcgcggccatggtggccaacttcaccaagcccacagccgacgcgccctcgctgctgcagcatgacgaggtggagacctacttccatgagtttggccacgtgatgcaccagctctgctcccaggcggagttcgccatgttcagcgggacccacgtggagcgggactttgtggaggcgccgtcgcagatgctggagaactgggtgtgggagcaggagccgctgctgcggatgtcgcggcactaccgcacaggcagcgccgtgccccgggagctcctggagaagctcattgagtcccggcaggccaacacaggcctcttcaacctgcgccagatcgtcctcgccaaggtggaccaggccctgcacacgcagacggacgcagaccccgccgaggagtatgcgcggctctgccaggagatcctcggggtcccggccacgccaggtggctacgacgcccagtactacgggtacctgtggagcgaggtgtattccatggacatgttccacacgcgcttcaagcaggagggtgtcctgaacagcaaggttggcatggattacagaagctgcatcctgagacccggcggttccgaggatgccagcgccatgctgaggcgcttcctgggccgtgaccccaagcaggacgccttcctcctgagcaaggggctgcaggtcgggggctgcgagcccgagccgcaggtctgctgaggcctggcactgcgactgcccagtctggcctgcgctcccgccgccctggtgccttagcccccggcacaggatggggcaggctctggcacagtgcctgggactggcagggtggctgagcggctgtcttgcctcttgtcattgtctgtccccacccggtcgtggcccacccggctagagacggcgtcctcaaggcatctggagggctttcgtggctgccagggcctggtctttgttgcactaacacgtctcctctctgggaaacgtcccttgtcaggagacggctcttctttgaaatgaggtcattaaaaggaaacagaaaaaga

SEQ ID NO: 441169 - DNA, 2907 bp, Homo sapiens
  misc_feature (2560)..(2560): n is a, c, g, or t
ggcacgagggccccgggagcgcgggcggcgggccccttggtcctcaggcggccgtggcggcggtggcggcggttgggccgaggcaggcggcctcagtggccgaggtggctggacgcgtagcaggtggaaggagggagggagccgcaggcgcagacccacccgccatgaagccccccgcagcctgtgcaggagacatggcggacgcagcatctccgtgctctgtggtaaacgacctgcggtgggacctgagtgcccagcagatagaggagcgcaccagggagctcatcgagcagaccaagcgcgtgtatgaccaggttggcacccaggagtttgaggacgtgtcctacgagagcacgctcaaggcgctggccgatgtggaggtcacctacacagttcagaggaatatccttgacttcccccagcatgtttccccctccaaggacatccggacagccagcacagaggccgacaagaagctctctgagttcgacgtggagatgagcatgagggaggacgtgtaccagaggatcgtgtggctccaggagaaagttcagaaggactcactgaggcccgaggctgcgcggtacctggagcggctaatcaagctgggccggagaaatgggcttcacctccccagagagactcaggaaaacatcaaacgcatcaagaagaagctgagccttctgtgcatcgacttcaacaagaacctgaacgaggacacgaccttcctgcccttcacgctccaggagctaggagggctccccgaggactttctgaactccctggagaagatggaggacggcaagttgaaggtcaccctcaagtacccccattacttccccctcctgaagaaatgccacgtgcctgagaccaggaggaaagtggaggaggccttcaactgccggtgcaaggaggagaactgcgctatcctcaaggagctggtgacgctgcgggcccagaagtcccgcctgctggggttccacacgcacgccgactatgtcctggagatgaacatggccaagaccagccagaccgtggccaccttcctagatgagctggcgcagaagctgaagcccctgggggagcaggagcgtgcggtgattctggagctgaagcgtgcggagtgcgagcgccggggcctgcccttcgacggccgcatccgtgcctgggacatgcgctactacatgaaccaggtggaggagacgcgctactgcgtggaccagaacctgctcaaggagtacttccccgtgcaggtggtcacgcacgggctgctgggcatctaccaggagctcctggggctggccttccaccacgaggagggcgccagtgcctggcatgaggacgtgcggctctacaccgcgagggacgcggcctcgggggaggtggtcggcaagttctacctggacctgtacccgcgggaaggaaagtacgggcacgcggcctgctttggcctgcagcccggctgcctgcggcaggatgggagccgccagatcgccatcgcggccatggtggccaacttcaccaagcccacagccgacgcgccctcgctgctgcagcatgacgaggtggagacctacttccatgagtttggccacgtgatgcaccagctctgctcccaggcggagttcgccatgttcagcgggacccacgtggagcgggactttgtggaggcgccgtcgcagatgctggagaactgggtgtgggagcaggagccgctgctgcggatgtcgcggcactaccgcacaggcagcgccgtgccccgggagctcctggagaagctcattgagtcccggcaggccaacacaggcctcttcaacctgcgccagatcgtcctcgccaaggtggaccaggccctgcacacgcagacggacgcagaccccgccgaggagtatgcgcggctctgccaggagatcctcggggtcccggccacgccaggaaccaacatgcctgcaaccttcggccatctggcaggtggctacgacgcccagtactacgggtacctgtggagcgaggtgtattccatggacatgttccacacgcgcttcaagcaggagggtgtcctgaacagcaaggttggcatggattacagaagctgcatcctgagacccggcggttccgaggatgccagcgccatgctgaggcgcttcctgggccgtgaccccaagcaggacgccttcctcctgagcaaggggctgcaggtcgggggctgcgagcccgagccgcaggtctgctgaggcctggcactgcgactgcccagtctggcctgcgctcccgccgccctggtgccttagcccccggcacaggatggggcaggctctggcacagtgcctgggactggcagggtggctgagcggctgtcttgcctcttgtcattgtctgtccccacccggtcgtggcccacccggctagagacggcgtcctcaaggcatctggagggctttcgtggctgccagggcctggtctttgttgcactaacacgtctcctctctgggaaacgtcccttgtcaggagacggctcttctttgaaatgaggtcattaaaaggaaacagaaaaagaaanaaaaaacaaaaaaacaaaaacaaaaacaaaaaaaagggccgccccccctctcataaagatttctcccccaaggggcccccaacttttccgcgcgtctaccccgcgctttctcttgttgtccccaagggtggccccccctttggcggacgccgcgcctttttataagaccgtaaggccctggcgcgcccgcgcgtcgttcttcacgacagcgccctgtcacacactggtgcgcaacaacacgcgtctcttacctgtgtggggacaccttgttgtgtgcagaggggccaccccctttttcttctgtgggcgcgtgtgctcccccctttctgcggccccaaacctcccct

SEQ ID NO: 441170 - DNA, 2486 bp, Homo sapiens
ggcacgagggccccgggagcgcgggcggcgggccccttggtcctcaggcggccgtggcggcggtggcggcggttgggccgaggcaggcggcctcagtggccgaggtggctggacgcgtagcaggtggaaggagggagggagccgcaggcgcagacccacccgccatgaagccccccgcagcctgtgcaggagacatggcggacgcagcatctccgtgctctgtggtaaacgacctgcggtgggacctgagtgcccagcagatagaggagcgcaccagggagctcatcgagcagaccaagcgcgtgtatgaccaggttggcacccaggagtttgaggacgtgtcctacgagagcacgctcaaggcgctggccgatgtggaggtcacctacacagttcagaggaatatccttgacttcccccagcatgtttccccctccaaggacatccggacagccagcacagaggccgacaagaagctctctgagttcgacgtggagatgagcatgagggaggacgtgtaccagaggatcgtgtggctccaggagaaatgggcttcacctccccagagagactcaggaaaacatcaaacgcatcaagaagaagctgagccttctgtgcatcgacttcaacaagaacctgaacgaggacacgaccttcctgcccttcacgctccaggagctaggagggctccccgaggactttctgaactccctggagaagatggaggacggcaagttgaaggtcaccctcaagtacccccattacttccccctcctgaagaaatgccacgtgcctgagaccaggaggaaagtggaggaggccttcaactgccggtgcaaggaggagaactgcgctatcctcaaggagctggtgacgctgcgggcccagaagtcccgcctgctggggttccacacgcacgccgactatgtcctggagatgaacatggccaagaccagccagaccgtggccaccttcctagatgagctggcgcagaagctgaagcccctgggggagcaggagcgtgcggtgattctggagctgaagcgtgcggagtgcgagcgccggggcctgcccttcgacggccgcatccgtgcctgggacatgcgctactacatgaaccaggtggaggagacgcgctactgcgtggaccagaacctgctcaaggagtacttccccgtgcaggtggtcacgcacgggctgctgggcatctaccaggagctcctggggctggccttccaccacgaggagggcgccagtgcctggcatgaggacgtgcggctctacaccgcgagggacgcggcctcgggggaggtggtcggcaagttctacctggacctgtacccgcgggaaggaaagtacgggcacgcggcctgctttggcctgcagcccggctgcctgcggcaggatgggagccgccagatcgccatcgcggccatggtggccaacttcaccaagcccacagccgacgcgccctcgctgctgcagcatgacgaggtggagacctacttccatgagtttggccacgtgatgcaccagctctgctcccaggcggagttcgccatgttcagcgggacccacgtggagcgggactttgtggaggcgccgtcgcagatgctggagaactgggtgtgggagcaggagccgctgctgcggatgtcgcggcactaccgcacaggcagcgccgtgccccgggagctcctggagaagctcattgagtcccggcaggccaacacaggcctcttcaacctgcgccagatcgtcctcgccaaggtggaccaggccctgcacacgcagacggacgcagaccccgccgaggagtatgcgcggctctgccaggagatcctcggggtcccggccacgccaggaaccaacatgcctgcaaccttcggccatctggcaggtggctacgacgcccagtactacgggtacctgtggagcgaggtgtattccatggacatgttccacacgcgcttcaagcaggagggtgtcctgaacagcaaggttggcatggattacagaagctgcatcctgagacccggcggttccgaggatgccagcgccatgctgaggcgcttcctgggccgtgaccccaagcaggacgccttcctcctgagcaaggggctgcaggtcgggggctgcgagcccgagccgcaggtctgctgaggcctggcactgcgactgcccagtctggcctgcgctcccgccgccctggtgccttagcccccggcacaggatggggcaggctctggcacagtgcctgggactggcagggtggctgagcggctgtcttgcctcttgtcattgtctgtccccacccggtcgtggcccacccggctagagacggcgtcctcaaggcatctggagggctttcgtggctgccagggcctggtctttgttgcactaacacgtctcctctctgggaaacgtcccttgtcaggagacggctcttctttgaaatgaggtcattaaaaggaaacagaaaaaga

SEQ ID NO: 441171 - DNA, 1939 bp, Homo sapiens
ggcacgagggccccgggagcgcgggcggcgggccccttggtcctcaggcggccgtggcggcggtggcggcggttgggccgaggcaggcggcctcagtggccgaggtggctggacgcgtagcaggtggaaggagggagggagccgcaggcgcagacccacccgccatgaagccccccgcagcctgtgcaggagacatggcggacgcagcatctccgtgctctgtggtaaacgacctgcggtgggacctgagtgcccagcagatagaggagcgcaccagggagctcatcgagcagaccaagcgcgtgtatgaccaggttggcacccaggagtttgaggacgtgtcctacgagagcacgctcaaggcgctggccgatgtggaggtcacctacacagttcagaggaatatccttgacttcccccagcatgtttccccctccaaggacatccggacagccagcacagaggccgacaagaagctctctgagttcgacgtggagatgagcatgagggaggacgtgtaccagaggatcgtgtggctccaggagaaagttcagaaggactcactgaggcccgaggctgcgcggtacctggagcggctaatcaagctgggccggagaaatgggcttcacctccccagagagactcaggaaaacatcaaacgcatcaagaagaagctgagccttctgtgcatcgacttcaacaagaacctgaacgaggacacgaccttcctgcccttcacgctccaggagctaggagggctccccgaggactttctgaactccctggagaagatggaggacggcaagttgaaggtcaccctcaagtacccccattacttccccctcctgaagaaatgccacgtgcctgagaccaggaggaaagtggaggaggccttcaactgccggtgcaaggaggagaactgcgctatcctcaaggagctggtgacgctgcgggcccagaagtcccgcctgctggggttccacacgcacgccgactatgtcctggagatgaacatggccaagaccagccagaccgtggccaccttcctagatgagctggcgcagaagctgaagcccctgggggagcaggagcgtgcggtgattctggagctgaagcgtgcggagtgcgagcgccggggcctgcccttcgacggccgcatccgtgcctgggacatgcgctactacatgaaccaggtggaggagacgcgctactgcgtggaccagaacctgctcaaggagtacttccccgtgcaggtggtcacgcacgggctgctgggcatctaccaggagctcctggggctggccttccaccacgaggagggcgccagtgcctggcatgaggacgtgcggctctacaccgcgagggacgcggcctcgggggaggtggtcggcaagttctacctggacctgtacccgcgggaaggaaagtacgggcacgcggcctgctttggcctgcagcccggctgcctgcggcaggatgggagccgccagatcgccatcgcggccatggtggccaacttcaccaagcccacagccgacgcgccctcgctgctgcagcatgacgaggtggagacctacttccatgagtttggccacgtgatgcaccagctctgctcccaggcggagttcgccatgttcagcgggacccacgtggagcgggactttgtggaggcgccgtcgcagatgctggagaactgggtgtgggagcaggagccgctgctgcggatgtcgcggcactaccgcacaggcagcgccgtgccccgggagctcctggagaagctcattgagtcccggcaggccaacacaggcctcttcaacctgcgccagatcgtcctcggcctggtctttgttgcactaacacgtctcctctctgggaaacgtcccttgtcaggagacggctcttctttgaaatgaggtcattaaaaggaaacagaaaaaga

SEQ ID NO: 441172 - DNA, 2116 bp, Homo sapiens
ggcacgagggccccgggagcgcgggcggcgggccccttggtcctcaggcggccgtggcggcggtggcggcggttgggccgaggcaggcggcctcagtggccgaggtggctggacgcgtagcaggtggaaggagggagggagccgcaggcgcagacccacccgccatgaagccccccgcagcctgtgcaggagacatggcggacgcagcatctccgtgctctgtggtaaacgacctgcggtgggacctgagtgcccagcagatagaggagcgcaccagggagctcatcgagcagaccaagcgcgtgtatgaccaggttggcacccaggagtttgaggacgtgtcctacgagagcacgctcaaggcgctggccgatgtggaggtcacctacacagttcagaggaatatccttgacttcccccagcatgtttccccctccaaggacatccggacagccagcacagaggccgacaagaagctctctgagttcgacgtggagatgagcatgagggaggacgtgtaccagaggatcgtgtggctccaggagaaagttcagaaggactcactgaggcccgaggctgcgcggtacctggagcggctaatcaagctgggccggagaaatgggcttcacctccccagagagactcaggaacgtgcggtgattctggagctgaagcgtgcggagtgcgagcgccggggcctgcccttcgacggccgcatccgtgcctgggacatgcgctactacatgaaccaggtggaggagacgcgctactgcgtggaccagaacctgctcaaggagtacttccccgtgcaggtggtcacgcacgggctgctgggcatctaccaggagctcctggggctggccttccaccacgaggagggcgccagtgcctggcatgaggacgtgcggctctacaccgcgagggacgcggcctcgggggaggtggtcggcaagttctacctggacctgtacccgcgggaaggaaagtacgggcacgcggcctgctttggcctgcagcccggctgcctgcggcaggatgggagccgccagatcgccatcgcggccatggtggccaacttcaccaagcccacagccgacgcgccctcgctgctgcagcatgacgaggtggagacctacttccatgagtttggccacgtgatgcaccagctctgctcccaggcggagttcgccatgttcagcgggacccacgtggagcgggactttgtggaggcgccgtcgcagatgctggagaactgggtgtgggagcaggagccgctgctgcggatgtcgcggcactaccgcacaggcagcgccgtgccccgggagctcctggagaagctcattgagtcccggcaggccaacacaggcctcttcaacctgcgccagatcgtcctcgccaaggtggaccaggccctgcacacgcagacggacgcagaccccgccgaggagtatgcgcggctctgccaggagatcctcggggtcccggccacgccaggaaccaacatgcctgcaaccttcggccatctggcaggtggctacgacgcccagtactacgggtacctgtggagcgaggtgtattccatggacatgttccacacgcgcttcaagcaggagggtgtcctgaacagcaaggttggcatggattacagaagctgcatcctgagacccggcggttccgaggatgccagcgccatgctgaggcgcttcctgggccgtgaccccaagcaggacgccttcctcctgagcaaggggctgcaggtcgggggctgcgagcccgagccgcaggtctgctgaggcctggcactgcgactgcccagtctggcctgcgctcccgccgccctggtgccttagcccccggcacaggatggggcaggctctggcacagtgcctgggactggcagggtggctgagcggctgtcttgcctcttgtcattgtctgtccccacccggtcgtggcccacccggctagagacggcgtcctcaaggcatctggagggctttcgtggctgccagggcctggtctttgttgcactaacacgtctcctctctgggaaacgtcccttgtcaggagacggctcttctttgaaatgaggtcattaaaaggaaacagaaaaaga

SEQ ID NO: 441173 - DNA, 319 bp, Homo sapiens
caagagccctggacctcactcttctggatgagaagcgggtgatcccttcctttccctctgccctcctgactttgaccctaactgaaccgaaagcagacccgcccggcactgggttttgtttctgcgtagcctgtgcaggagacatggcggacgcagcatctccgtgctctgtggtaaacgacctgcggtgggacctgagtgcccagcagatagaggagcgcaccagggagctcatcgagcagaccaagcgcgtgtatgaccaggttggcacccaggagtttgaggacgtgtcctacgagagcacgctcaaggcgctggc

SEQ ID NO: 441174 - DNA, 897 bp, Homo sapiens
cctcccaaaatttcccccatctgcctctggccccccaaccggatcattctttccacccttgcctccctggggtccccgtgagctcccgatcattctttccacccctactgccctggggtcggggtgagctcccaatcattctttccaccctgaccgccctggggtcggcgtgagctcccgatcgttctttctacccctactgctctggggtccgtgtgagctccggatcattctttccaccctgactcccctggggtcggagtgagctcccgatcattctttccactctgaccgccctggggttgaggtgaaccagtctttgcattgaagctgcaagcctgaggcacggtggccctggcgtctcccgagccatgaggtaggaaccccagagggtttcagtccgggatgctgccgcccccacttctcttgaggctgtcgggcaggggccaggtgggagggtgtggctgccgggcagcggggtgaactgtgtcctgccaggggttttgtgggtggagaagggacagcagggctccagtgagaagctctgggagtaggaattgggtctctctggagggacacacttgaaagtggttgagccgtggggctgcgtgctgagatctcagctctgagcgggaggctctgcctgggggtggttcttcaggaaaagcaaagcaggacctccctctccacgtggggcctccctctccgcccagggcccagcgtgctcagctctcctgctgtttttgtctttgatgggaggcactgcctctaacgctggtttccttgtgcagtggccgggccacccttcccgccacctcctcccttcacacatgaggttggtgccggcgccctggaagcccacgatgtccgggggttgggctggatttagctttaacc

SEQ ID NO: 441175 - DNA, 807 bp, Homo sapiens
ggcacgagggccccgggagcgcgggcggcgggccccttggtcctcaggcggccgtggcggcggtggcggcggttgggccgaggcaggcggcctcagtggccgaggtggctggacgcgtagcaggtggaaggagggagggagccgcaggcgcagacccacccgccatgaagccccccgcagcctgtgcaggagacatggcggacgcagcatctccgtgctctgtggtaaacgacctgcggtgggacctgagtgcccagcagatagaggagcgcaccagggagctcatcgagcagaccaagcgcgtgtatgaccaggttggcacccaggagtttgaggacgtgtcctacgagagcacgctcaaggcgctggccgatgtggaggtcacctacacagttcagaggaatatccttgacttcccccagcatgtttccccctccaaggacatccggacagccagcacagaggccgacaagaagctctctgagttcgacgtggagatgagcatgagggaggacgtgtaccagaggatcgtgtggctccaggagaaagttcagaaggactcactgaggcccgaggctgcgcggtacctggagcggctaatcaagctgggccggagaaatgggcttcacctccccagagagactcaggaaaacatcaaacgcatcaagaagaagctgagccttctgtgcatcgacttcaacaagaacctgaacgaggacacgaccttcctgcccttcacgctccaggagctagtggccgggccacccttcccgccacctcctcccttcacacatgaggttggtgccg

SEQ ID NO: 441176 - DNA, 2991 bp, Homo sapiens
ggcacgagggccccgggagcgcgggcggcgggccccttggtcctcaggcggccgtggcggcggtggcggcggttgggccgaggcaggcggcctcagtggccgaggtggctggacgcgtagcaggtggaaggagggagggagccgcaggcgcagacccacccgccatgaagccccccgcagcctgtgcaggagacatggcggacgcagcatctccgtgctctgtggtaaacgacctgcggtgggacctgagtgcccagcagatagaggagcgcaccagggagctcatcgagcagaccaagcgcgtgtatgaccaggttggcacccaggagtttgaggacgtgtcctacgagagcacgctcaaggcgctggccgatgtggaggtcacctacacagttcagaggaatatccttgacttcccccagcatgtttccccctccaaggacatccggacagccagcacagaggccgacaagaagctctctgagttcgacgtggagatgagcatgagggaggacgtgtaccagaggatcgtgtggctccaggagaaagttcagaaggactcactgaggcccgaggctgcgcggtacctggagcggctaatcaagctgggccggagaaatgggcttcacctccccagagagactcaggaaaacatcaaacgcatcaagaagaagctgagccttctgtgcatcgacttcaacaagaacctgaacgaggacacgaccttcctgcccttcacgctccaggagctaggagggctccccgaggactttctgaactccctggagaagatggaggacggcaagttgaaggtcaccctcaagtacccccattacttccccctcctgaagaaatgccacgtgcctgagaccaggaggaaagtggaggaggccttcaactgccggtgcaaggaggagaactgcgctatcctcaaggagctggtgacgctgcgggcccagaagtcccgcctgctggggttccacacgcacgccgactatgtcctggagatgaacatggccaagaccagccagaccgtggccaccttcctagatgagctggcgcagaagctgaagcccctgggggagcaggagcgtgcggtgattctggagctgaagcgtgcggagtgcgagcgccggggcctgcccttcgacggccgcatccgtgcctgggacatgcgctactacatgaaccaggtggaggagacgcgctactgcgtggaccagaacctgctcaaggagtacttccccgtgcaggtggtcacgcacgggctgctgggcatctaccaggagctcctggggctggccttccaccacgaggagggcgccagtgcctggcatgaggacgtgcggctctacaccgcgagggacgcggcctcgggggaggtggtcggcaagttctacctggacctgtacccgcggtgggtgagggcagcgggggcggggggcgcaccccggccctgggtctcctcggagcccggtgtgcccgtctgagatgggaaggaagtcgttgcctgctccatggggcctcggggatgaaccccgagacgtagcacccgtgggcacaccacaggggccgaaaatgcagctgtccccgtttccagtctcactcagccaccccgacagggcgcagctctgcccaggccggagtcctttaggggagggatggcagccggggcctggccgtggttttcatgctgccctgcgccaagccacctctgctgagagggaggtttagaacctcagaggtgcccggcggtctgggttagcagtcaggtgggctgagggatgcggagtcagggactcttgcggtgtctctagtccctgcggggcctgacgctgcctccctccccagggaaggaaagtacgggcacgcggcctgctttggcctgcagcccggctgcctgcggcaggatgggagccgccagatcgccatcgcggccatggtggccaacttcaccaagcccacagccgacgcgccctcgctgctgcagcatgacgaggtggagacctacttccatgagtttggccacgtgatgcaccagctctgctcccaggcggagttcgccatgttcagcgggacccacgtggagcgggactttgtggaggcgccgtcgcagatgctggagaactgggtgtgggagcaggagccgctgctgcggatgtcgcggcactaccgcacaggcagcgccgtgccccgggagctcctggagaagctcattgagtcccggcaggccaacacaggcctcttcaacctgcgccagatcgtcctcgccaaggtggaccaggccctgcacacgcagacggacgcagaccccgccgaggagtatgcgcggctctgccaggagatcctcggggtcccggccacgccaggaaccaacatgcctgcaaccttcggccatctggcaggtggctacgacgcccagtactacgggtacctgtggagcgaggtgtattccatggacatgttccacacgcgcttcaagcaggagggtgtcctgaacagcaaggttggcatggattacagaagctgcatcctgagacccggcggttccgaggatgccagcgccatgctgaggcgcttcctgggccgtgaccccaagcaggacgccttcctcctgagcaaggggctgcaggtcgggggctgcgagcccgagccgcaggtctgctgaggcctggcactgcgactgcccagtctggcctgcgctcccgccgccctggtgccttagcccccggcacaggatggggcaggctctggcacagtgcctgggactggcagggtggctgagcggctgtcttgcctcttgtcattgtctgtccccacccggtcgtggcccacccggctagagacggcgtcctcaaggcatctggagggctttcgtggctgccagggcctggtctttgttgcactaacacgtctcctctctgggaaacgtcccttgtcaggagacggctcttctttgaaatgaggtcattaaaaggaaacagaaaaaga

SEQ ID NO: 441177 - DNA, 2611 bp, Homo sapiens
ggcacgagggccccgggagcgcgggcggcgggccccttggtcctcaggcggccgtggcggcggtggcggcggttgggccgaggcaggcggcctcagtggccgaggtggctggacgcgtagcaggtggaaggagggagggagccgcaggcgcagacccacccgccatgaagccccccgcagcctgtgcaggagacatggcggacgcagcatctccgtgctctgtggtaaacgacctgcggtgggacctgagtgcccagcagatagaggagcgcaccagggagctcatcgagcagaccaagcgcgtgtatgaccaggttggcacccaggagtttgaggacgtgtcctacgagagcacgctcaaggcgctggccgatgtggaggtcacctacacagttcagaggaatatccttgacttcccccagcatgtttccccctccaaggacatccggacagccagcacagaggccgacaagaagctctctgagttcgacgtggagatgagcatgagggaggacgtgtaccagaggatcgtgtggctccaggagaaagttcagaaggactcactgaggcccgaggctgcgcggtacctggagcggctaatcaagctgggccggagaaatgggcttcacctccccagagagactcaggaaaacatcaaacgcatcaagaagaagctgagccttctgtgcatcgacttcaacaagaacctgaacgaggacacgaccttcctgcccttcacgctccaggagctaggagggctccccgaggactttctgaactccctggagaagatggaggacggcaagttgaaggtcaccctcaagtacccccattacttccccctcctgaagaaatgccacgtgcctgagaccaggaggaaagtggaggaggccttcaactgccggtgcaaggaggagaactgcgctatcctcaaggagctggtgacgctgcgggcccagaagtcccgcctgctggggttccacacgcacgccgactatgtcctggagatgaacatggccaagaccagccagaccgtggccaccttcctagatgagctggcgcagaagctgaagcccctgggggagcaggagcgtgcggtgattctggagctgaagcgtgcggagtgcgagcgccggggcctgcccttcgacggccgcatccgtgcctgggacatgcgctactacatgaaccaggtggaggagacgcgctactgcgtggaccagaacctgctcaaggagtacttccccgtgcaggtggtcacgcacgggctgctgggcatctaccaggagctcctggggctggccttccaccacgaggagggcgccagtgcctggcatgaggacgtgcggctctacaccgcgagggacgcggcctcgggggaggtggtcggcaagttctacctggacctgtacccgcgggaaggaaagtacgggcacgcggcctgctttggcctgcagcccggctgcctgcggcaggatgggagccgccagatcgccatcgcggccatggtggccaacttcaccaagcccacagccgacgcgccctcgctgctgcagcatgacgaggtggagacctacttccatgagtttggccacgtgatgcaccagctctgctcccaggcggagttcgccatgttcagcgggacccacgtggagcgggactttgtggaggcgccgtcgcagatgctggagaactgggtgtgggagcaggagccgctgctgcggatgtcgcggcactaccgcacaggcagcgccgtgccccgggagctcctggagaagctcattgagtcccggcaggccaacacaggcctcttcaacctgcgccagatcgtcctcgccaaggtggaccaggccctgcacacgcagacggacgcagaccccgccgaggagtatgcgcggctctgccaggagatcctcggggtcccggccacgccaggaaccaacatgcctgcaaccttcggccatctggcaggtggctacgacgcccagtactacgggtacctgtggagcgaggtgtattccatggacatgttccacacgcgcttcaagcaggagggtgtcctgaacagcaaggttggcatggattacagaagctgcatcctgagacccggcggttccgaggatgccagcgccatgctgaggcgcttcctgggccgtgaccccaagcaggacgccttcctcctgagcaaggggctgcaggtcgggggctgcgagcccgagccgcaggtctgctgaggcctggcactgcgactgcccagtctggcctgcgctcccgccgccctggtgccttagcccccggcacaggatggggcaggctctggcacagtgcctgggactggcagggtggctgagcggctgtcttgcctcttgtcattgtctgtccccacccggtcgtggcccacccggctagagacggcgtcctcaaggcatctggagggctttcgtggctgccagggcctggtctttgttgcactaacacgtctcctctctgggaaacgtcccttgtcaggagacggctcttctttgaaatgaggtcattaaaaggaaacagaaaaagacgcaccaccacacctgatccacaccgcgaaacacacatggcctagcacaccaga

SEQ ID NO: 441178 - DNA, 2276 bp, Homo sapiens
ggcacgagggccccgggagcgcgggcggcgggccccttggtcctcaggcggccgtggcggcggtggcggcggttgggccgaggcaggcggcctcagtggccgaggtggctggacgcgtagcaggtggaaggagggagggagccgcaggcgcagacccacccgccatgaagccccccgcagcctgtgcaggagacatggcggacgcagcatctccgtgctctgtggtaaacgacctgcggtgggacctgagtgcccagcagatagaggagcgcaccagggagctcatcgagcagaccaagcgcgtgtatgaccaggttggcacccaggagtttgaggacgtgtcctacgagagcacgctcaaggcgctggccgatgtggaggtcacctacacagttcagaggaatatccttgacttcccccagcatgtttccccctccaaggacatccggacagccagcacagaggccgacaagaagctctctgagttcgacgtggagatgagcatgagggaggacgtgtaccagaggatcgtgtggctccaggagaaagttcagaaggactcactgaggcccgaggctgcgcggtacctggagcggctaatcaagctgggccggagaaatgggcttcacctccccagagagactcaggaaaacatcaaacgcatcaagaagaagctgagccttctgtgcatcgacttcaacaagaacctgaacgaggacacgaccttcctgcccttcacgctccaggagctaggagggctccccgaggactttctgaactccctggagaagatggaggacggcaagttgaaggtcaccctcaagtacccccattacttccccctcctgaagaaatgccacgtgcctgagaccaggaggaaagtggaggaggccttcaactgccggtgcaaggaggagaactgcgctatcctcaaggagctggtgacgctgcgggcccagaagtcccgcctgctggggttccacacgcacgccgactatgtcctggagatgaacatggccaagaccagccagaccgtggccaccttcctagatgagctggcgcagaagctgaagcccctgggggagcaggagcgtgcggtgattctggagctgaagcgtgcggagtgcgagcgccggggcctgcccttcgacggccgcatccgtgcctgggacatgcgctactacatgaaccaggtggaggagacgcgctactgcgtggaccagaacctgctcaaggagtacttccccgtgcaggtggtcacgcacgggctgctgggcatctaccaggagctcctggggctggccttccaccacgaggagggcgccagtgcctggcatgaggacgtgcggctctacaccgcgagggacgcggcctcgggggaggtggtcggcaagttctacctggacctgtacccgcgggaaggaaagtacgggcacgcggcctgctttggcctgcagcccggctgcctgcggcaggatgggagccgccagatcgccatcgcggccatggtggccaacttcaccaagcccacagccgacgcgccctcgctgctgcagcatgacgaggtggagacctacttccatgagtttggccacgtgatgcaccagctctgctcccaggcggagttcgccatgttcagcgggacccacgtggagcgggactttgtggaggcgccgtcgcagatgctggagaactgggtgtgggagcaggagccgctgctgcggatgtcgcggcactaccgcacaggcagcgccgtgccccgggagctcctggagaagctcattgagtcccggcaggccaacacaggcctcttcaacctgcgccagatcgtcctcgccaaggtggaccaggccctgcacacgcagacggacgcagaccccgccgaggagtatgcgcggctctgccaggagatcctcggggtcccggccacgccaggaaccaacatgcctgcaaccttcggccatctggcaggtggctacgacgcccagtactacgggtacctgtggagcgaggtgtattccatggacatgttccacacgcgcttcaagcaggagggtgtcctgaacagcaaggaagctccacactggcccctcaggcctcgggctgtgagtgctgggagctccgtgtcttcccatacgagtccttccgggatctgcgtgatcggctcagagccatgggctgagacagacccttctctggagaaggcttgggtttgccattcatttgctcctcaacctccagtttcctcactatgaagtgcggccgttacgccatgt

SEQ ID NO: 441179 - DNA, 1876 bp, Homo sapiens
  misc_feature (9)..(10): n is a, c, g, or t
  misc_feature (44)..(44): n is a, c, g, or t
  misc_feature (46)..(46): n is a, c, g, or t
  misc_feature (54)..(54): n is a, c, g, or t
  misc_feature (56)..(57): n is a, c, g, or t
ccgagtaanngggatatcgtcggaccgcccgctcggacacgacntncctgcccntnncgctccaggagctaggagggctccccgaggactttctgaactccctggagaagatggaggacggcaagttgaaggtcaccctcaagtacccccattacttccccctcctgaagaaatgccacgtgcctgagaccaggaggaaagtggaggaggccttcaactgccggtgcaaggaggagaactgcgctatcctcaaggagctggtgacgctgcgggcccagaagtcccgcctgctggggttccacacgcacgccgactatgtcctggagatgaacatggccaagaccagccagaccgtggccaccttcctagatgagctggcgcagaagctgaagcccctgggggagcaggagcgtgcggtgattctggagctgaagcgtgcggagtgcgagcgccggggcctgcccttcgacggccgcatccgtgcctgggacatgcgctactacatgaaccaggtggaggagacgcgctactgcgtggaccagaacctgctcaaggagtacttccccgtgcaggtggtcacgcacgggctgctgggcatctaccaggagctcctggggctggccttccaccacgaggagggcgccagtgcctggcatgaggacgtgcggctctacaccgcgagggacgcggcctcgggggaggtggtcggcaagttctacctggacctgtacccgcgggaaggaaagtacgggcacgcggcctgctttggcctgcagcccggctgcctgcggcaggatgggagccgccagatcgccatcgcggccatggtggccaacttcaccaagcccacagccgacgcgccctcgctgctgcagcatgacgaggtggagacctacttccatgagtttggccacgtgatgcaccagctctgctcccaggcggagttcgccatgttcagcgggacccacgtggagcgggactttgtggaggcgccgtcgcagatgctggagaactgggtgtgggagcaggagccgctgctgcggatgtcgcggcactaccgcacaggcagcgccgtgccccgggagctcctggagaagctcattgagtcccggcaggccaacacaggcctcttcaacctgcgccagatcgtcctcgccaaggtggaccaggccctgcacacgcagacggacgcagaccccgccgaggagtatgcgcggctctgccaggagatcctcggggtcccggccacgccaggaaccaacatgcctgcaaccttcggccatctggcaggtggctacgacgcccagtactacgggtacctgtggagcgaggtgtattccatggacatgttccacacgcgcttcaagcaggagggtgtcctgaacagcaaggttggcatggattacagaagctgcatcctgagacccggcggttccgaggatgccagcgccatgctgaggcgcttcctgggccgtgaccccaagcaggacgccttcctcctgagcaaggggctgcaggtcgggggctgcgagcccgagccgcaggtctgctgaggcctggcactgcgactgcccagtctggcctgcgctcccgccgccctggtgccttagcccccggcacaggatggggcaggctctggcacagtgcctgggactggcagggtggctgagcggctgtcttgcctcttgtcattgtctgtccccacccggtcgtggcccacccggctagagacggcgtcctcaaggcatctggagggctttcgtggctgccagggcctggtctttgttgcactaacacgtctcctctctgggaaacgtcccttgtcaggagacggctcttctttgaaatgaggtcattaaaaggaaacagaaaaaga

SEQ ID NO: 441180 - DNA, 685 bp, Homo sapiens
tgcacacccccgctctgagattctgatgaaaggcacctgcgctctcccacctgtgctgatgcaggcggcccccgggcctccctgggaacctggaaggggttgctccgaggcccccctgggcgagggtgtgcagactcctggggtcctctgccttcctccctgggtccccacccggccacagtgccctgtctcctcggcaggttggcatggattacagaagctgcatcctgagacccggcggttccgaggatgccagcgccatgctgaggcgcttcctgggccgtgaccccaagcaggacgccttcctcctgagcaaggggctgcaggtcgggggctgcgagcccgagccgcaggtctgctgaggcctggcactgcgactgcccagtctggcctgcgctcccgccgccctggtgccttagcccccggcacaggatggggcaggctctggcacagtgcctgggactggcagggtggctgagcggctgtcttgcctcttgtcattgtctgtccccacccggtcgtggcccacccggctagagacggcgtcctcaaggcatctggagggctttcgtggctgccagggcctggtctttgttgcactaacacgtctcctctctgggaaacgtcccttgtcaggagacggctcttctttgaaatgaggtcattaaaaggaaacagaaaaaga

SEQ ID NO: 441181 - DNA, 1416 bp, Homo sapiens
agcggaggggaggggcgcggccgccggacgcgccctcgcagcttccgccgggcccctccggaaatcccgtatcgtagggcgacggcggcttagaaagtgcttcctggagcgcagacgaggtcatgaatcatgtgacggtggcttgaggaggaacctgtctttaaagctgtccctgaagtgacagcggagagaaccaggcagcccagaaaccccaggcgtggagattgatcctgcgagagaagggggttcatcatggcggatgacctaaagcgattcttgtataaaaagttaccaagtgttgaagggctccatgccattgttgtgtcagatagagatggagtacctgttattaaagtggcaaatgacaatgctccagagcatgctttgcgacctggtttcttatccacttttgcccttgcaacagaccaaggaagcaaacttggactttccaaaaataaaagtatcatctgttactataacacctaccaggtggttcaatttaatcgtttacctttggtggtgagtttcatagccagcagcagtgccaatacaggactaattgtcagcctagaaaaggaacttgctccattgtttgaagaactgagacaagttgtggaagtttcttaatctgacagtggtttcagtgtgtaccttatcttcattataacaacacaatatcaatccagcaatctttagactacaataatacttttatccatgtgctcaagaaagggcccctttttccaacttatactaaagagctagcatatagatgtaatttatagatagatcagttgctatattttctggtgtagggtctttcttatttagtgagatctagggataccacagaaatggttcagtctatcacagctcccatggagttagtctggtcaccagatatggatgagagattctattcagtggatcagaatcaaactggtacattgatccacttgagccgttaagtgctgccaattgtacaatatgcccaggcttgcagaataaagccaactttttattgtgaataataataaggacatatttttcttcagattatgttttatttctttgcattgagtgaggaacataaaatggcttggtaaaagtaataaaatcagtacaatcactaactttcctttgtacatattattttgcagtatagatgaatattactaatcagtttgattattctcagagggtgctgctctttaatgaaaatgaaaattatagctaatgttttttcctcaaactctgctttctgtaaccaatcagtgttttaatgtttgtgtgttcttcataaaatttaaatacaattcgttattctgtttccaatgttagtatgtatgtaaacatgatagtacagccatttttttcatatgtgagtaaaaataaaatagtatttttaaaaatata

SEQ ID NO: 441182 - DNA, 4288 bp, Homo sapiens
agcggaggggaggggcgcggccgccggacgcgccctcgcagcttccgccgggcccctccggaaatcccgtatcgtagggcgacggcggcttagaaagtgcttcctggagcgcagacgaggtcatgaatcatgtgacggtggcttgaggaggaacctgtctttaaagctgtccctgaagtgacagcggagagaaccaggcagcccagaaaccccaggcgtggagattgatcctgcgagagaagggggttcatcatggcggatgacctaaagcgattcttgtataaaaagttaccaagtgttgaagggctccatgccattgttgtgtcagatagagatggagtacctgttattaaagtggcaaatgacaatgctccagagcatgctttgcgacctggtttcttatccacttttgcccttgcaacagaccaaggaagcaaacttggactttccaaaaataaaagtatcatctgttactataacacctaccaggtggttcaatttaatcgtttacctttggtggtgagtttcatagccagcagcagtgccaatacaggactaattgtcagcctagaaaaggaacttgctccattgtttgaagaactgagacaagttgtggaagtttcttaatctgacagtggtttcagtgtgtaccttatcttcattataacaacacaatatcaatccagcaatctttagactacaataatacttttatccatgtgctcaagaaagggcccctttttccaacttatactaaagagctagcatatagatgtaatttatagatagatcagttgctatattttctggtgtagggtctttcttatttagtgagatctagggataccacagaaatggttcagtctatcacagctcccatggagttagtctggtcaccagatatggatgagagattctattcagtggatcagaatcaaactggtacattgatccacttgagccgttaagtgctgccaattgtacaatatgcccaggcttgcagaataaagccaactttttattgtgaataataataaggacatatttttcttcagattatgttttatttctttgcattgagtgaggaacataaaatggcttggtaaaagtaataaaatcagtacaatcactaactttcctttgtacatattattttgcagtatagatgaatattactaatcagtttgattattctcagagggtgctgctctttaatgaaaatgaaaattatagctaatgttttttcctcaaactctgctttctgtaaccaatcagtgttttaatgtttgtgtgttcttcataaaatttaaatacaattcgttattctgtttccaatgttagtatgtatgtaaacatgatagtacagccatttttttcatatgtgagtaaaaataaaatagtatttttaaaaatatagtttgagcactgtataggtcctttttttgttcagactttttccaaaaatctaaacataattaatatactctttcagccacatgaataaataatgagtgtttcttgtaggtattggtttggagattgttttacggtaatatgtactgttaactggaaaagaaacctgagattgcagtcagccaagattgtgccactgcaccccagcctgggcaacagagactccgtctcaaaaacaaaaaagaaaagaaaccaagaaacctcaggcatgaacctaatttaatctccatgaaagaggtactacagttctagaatataccctttatgttcaggaatgcagtctatcattcagagttaatttctttctaggctctttgacaatcagtttttccctggatcagttcagtacatatgcattgagcacctgtgtgccagtcagccgagctatcacattgcacaattctaagaagcaccattcatgtctcatcatatttctatgctctgggagttgcctttcacatagaatatgtgtgattgttatccctagaattgtgcagtgaggcaattggctaggtgctgtgctgctttttctttctttcttttttttttaagagacggagtcttgctgtgttgcccagtctggagtgcagtggtggcatgatcttgcctcactgtaacctctgcctcctgggttcaagctgttctcatgccccattctcccttgtagctgggattacaggcttacaccatcgcacttggcaaatttgtgtatttttagtagagacaggaattcaccatgttggccaggctggtcttgaactcctgacttaaagtgatccacctgctttggcctcccaaaatgctaggattataggtgtgagccactgcaccgggccatgtgctactttttcttccttccatccttcctcccttcttcagtgtaaatatgagattaatttgtgataccttactttaaagaacttagagttcagtaaaggaagcaggtatagaaagtgctatgataaagctatacataggatggtatagaaccacagactaggggcacttaaaatgggcaagaaaatagcctttgtaaataaaatagaggcaagagatataatgctttacctgcaaagagctataaatacagccatgtaccatataatgatgtttcagttagtgaaggaccacatacgagggtggtcagaacagcaggctataccatatagcctaggtgtgtagtaggctataccatatagcctaggtgtgtagtagtaggctataccatatagcctaggtgtgtagtagtaggcgataccatatagcctaggtgtgtagtagtaggctataccatatagcctaggtgtatagtagtaggctataccatatagcctaggtgtgtagtaggctataccatatagcctaggtatgtagtagtaggctataccatatagcctaggtgtgtagtagtaggctataccatctggggttcctgtcagtacagtatgatgttcacataatgatgaaatcacctaacaaagcatgtctcgaaatgtatccacattgttacgtaacacatgactgtagttaattgttacaattgaaatactagatgtactcattgaaatccagaattcccattatctggattatttaatatcgttcaggaaatttttgccagtgcaatggtgcatgaaacaatgtcttttagaaatgaggtggccagatttctatttgcagataataattgtatatctaaaaatcctagaaaaagaaatgataacaaatggagctacttaacctttacatgttgaatgctgccactgttaaaatttctgagggggtataatagataaactatcccatagttcatctggaaaaataaggtggtgaaaattgctaagaaatttttgaaagggtaatgtaaacctagattaactgtttttgaaaggtagtacagaactgaatgcacaactagatatcaatggtatgtactcacccagaaaaaagacttcagtacatacatgtgagggcttaaaacattgttataaagacgggatcacaatgggaaaaggattattcaataagtagggcaggcattctctatgcctgctagggaagtgtgacttgttatactctttatgtacagcaattggcagtctgtgaaacttttaaattcatatacataaccttttgccctgcaattccacttctagaaatttatcctaccaaacaaagcacatagatgtgcaaaagtatgtatttacaagtatattctttgcaacttggtaatgtcaaagaattggaagcaacctaaatatctgccataggtaggataaccatatgctttggctttttgaacactaccagtttatacctgctgttcttggataattattaatagtgctttcattctcaatgtctcactttagataataaattacagaggattggtgaaactaatttgcccaatggaaaaaggaatgaagaagtgctttaggtactgagatgaaaagatctctaaggcataataatgtttattgagaaaagcatggtgtcaaactgtatggcatgctacaattgatgtataagaagaaaaaatgtgtatgtattcctatttgtttgtatatggtagactgtctctgaagacatatatggaagaacctgatcacattggtagtctccaaggagcagaactagatacctgggggataaggatcccaggagtgagccttttcattgtaaacttcattgtactttgagtttttaactgttcaaaaataataaaattagaaataaaatatttcaacaaacaataaaatgggatatttggggaagaaagttgtctcagggctctccaaagaagcagaaccgg

SEQ ID NO: 441183 - DNA, 2078 bp, Homo sapiens
  misc_feature (2078)..(2078): n is a, c, g, or t
agcggaggggaggggcgcggccgccggacgcgccctcgcagcttccgccgggcccctccggaaatcccgtatcgtagggcgacggcggcttagaaagtgcttcctggagcgcagacgaggtcatgaatcatgtgacggtggcttgaggaggaacctgtctttaaagctgtccctgaagtgacagcggagagaaccaggcagcccagaaaccccaggcgtggagattgatcctgcgagagaagggggttcatcatggcggatgacctaaagcgattcttgtataaaaagttaccaagtgttgaagggctccatgccattgttgtgtcagatagagatggagtacctgttattaaagtggcaaatgacaatgctccagagcatgctttgcgacctggtttcttatccacttttgcccttgcaacagaccaaggaagcaaacttggactttccaaaaataaaagtatcatctgttactataacacctaccaggtggttcaatttaatcgtttacctttggtggtgagtttcatagccagcagcagtgccaatacaggactaattgtcagcctagaaaaggaacttgctccattgtttgaagaactgagacaagttgtggaagtttcttaatctgacagtggtttcagtgtgtaccttatcttcattataacaacacaatatcaatccagcaatctttagactacaataatacttttatccatgtgctcaagaaagggcccctttttccaacttatactaaagagctagcatatagatgtaatttatagatagatcagttgctatattttctggtgtagggtctttcttatttagtgagatctagggataccacagaaatggttcagtctatcacagctcccatggagttagtctggtcaccagatatggatgagagattctattcagtggatcagaatcaaactggtacattgatccacttgagccgttaagtgctgccaattgtacaatatgcccaggcttgcagaataaagccaactttttattgtgaataataataaggacatatttttcttcagattatgttttatttctttgcattgagtgaggaacataaaatggcttggtaaaagtaataaaatcagtacaatcactaactttcctttgtacatattattttgcagtatagatgaatattactaatcagtttgattattctcagagggtgctgctctttaatgaaaatgaaaattatagctaatgttttttcctcaaactctgctttctgtaaccaatcagtgttttaatgtttgtgtgttcttcataaaatttaaatacaattcgttattctgtttccaatgttagtatgtatgtaaacatgatagtacagccatttttttcatatgtgagtaaaaataaaatagtatttttaaaaatataaaaaaaaaaaaaaaaaaaaaaaacaaaaaaaaaaaaaaaaaaaaaaaaaaaaaaaaaaaaaaaaaaagaggggcgcgcgcgcgcccccacaaaagactaccccagcggggcgcgccacagcccgccgccgccccccacctgtgagaaaaaagcggccgcccccatagaggggcgcataataaacacacacgagccggaccggagggggcgcggcggcgagctataacaaacacacacaccaaagggagcacgaaggggaaacaaacaaaaagaaggcaccgaagggcgaggggagaacaactcacttggaaagagagagagacacccaccaacaaaacatgagtgggggggggagagaagcaacaaacaaaaaatcttggggacacaacacaacaactaacctcagcaccaagaaataatatataaaggagccactcacaagcgagggagaaagataaatataaaacaaaagatcagctagcaggcggtgaaaattagcggggcggtgggccaaaaacaaaaaaggggcgcataatcacgaagcacggcggcggcagaaacaaaaaaacaaacagctggcgccacgacaagcagagaaagacgtatcacatagaacaaaacaccatattatacaaccaagggcgcctaccaatcaaacaggn

SEQ ID NO: 441184 - DNA, 1370 bp, Homo sapiens
agcggaggggaggggcgcggccgccggacgcgccctcgcagcttccgccgggcccctccggaaatcccgtatcgtagggcgacggcggcttagaaagtgcttcctggagcgcagacgaggtcatgaatcatgtgacggtggcttgaggaggaacctgtctttaaagctgtccctgaagtgacagcggagagaaccaggcagcccagaaaccccaggacctaaagcgattcttgtataaaaagttaccaagtgttgaagggctccatgccattgttgtgtcagatagagatggagtacctgttattaaagtggcaaatgacaatgctccagagcatgctttgcgacctggtttcttatccacttttgcccttgcaacagaccaaggaagcaaacttggactttccaaaaataaaagtatcatctgttactataacacctaccaggtggttcaatttaatcgtttacctttggtggtgagtttcatagccagcagcagtgccaatacaggactaattgtcagcctagaaaaggaacttgctccattgtttgaagaactgagacaagttgtggaagtttcttaatctgacagtggtttcagtgtgtaccttatcttcattataacaacacaatatcaatccagcaatctttagactacaataatacttttatccatgtgctcaagaaagggcccctttttccaacttatactaaagagctagcatatagatgtaatttatagatagatcagttgctatattttctggtgtagggtctttcttatttagtgagatctagggataccacagaaatggttcagtctatcacagctcccatggagttagtctggtcaccagatatggatgagagattctattcagtggatcagaatcaaactggtacattgatccacttgagccgttaagtgctgccaattgtacaatatgcccaggcttgcagaataaagccaactttttattgtgaataataataaggacatatttttcttcagattatgttttatttctttgcattgagtgaggaacataaaatggcttggtaaaagtaataaaatcagtacaatcactaactttcctttgtacatattattttgcagtatagatgaatattactaatcagtttgattattctcagagggtgctgctctttaatgaaaatgaaaattatagctaatgttttttcctcaaactctgctttctgtaaccaatcagtgttttaatgtttgtgtgttcttcataaaatttaaatacaattcgttattctgtttccaatgttagtatgtatgtaaacatgatagtacagccatttttttcatatgtgagtaaaaataaaatagtatttttaaaaatata

SEQ ID NO: 441185 - DNA, 1188 bp, Homo sapiens
ggcttcttttccgacaaaacaccaaatggcggatgacctaaagcgattctgtataaaaagttaccaagtgttgaagggctccatgccattgttgtgtcagatagagatggagtacctgttattaaagtggcaaatgacaatgctccagagcatgctttgcgacctggtttcttatccacttttgcccttgcaacagaccaaggaagcaaacttggactttccaaaaataaaagtatcatctgttactataacacctaccaggtggttcaatttaatcgtttacctttggtggtgagtttcatagccagcagcagtgccaatacaggactaattgtcagcctagaaaaggaacttgctccattgtttgaagaactgagacaagttgtggaagtttcttaatctgacagtggtttcagtgtgtaccttatcttcattataacaacacaatatcaatccagcaatctttagactacaataatacttttatccatgtgctcaagaaagggcccctttttccaacttatactaaagagctagcatatagatgtaatttatagatagatcagttgctatattttctggtgtagggtctttcttatttagtgagatctagggataccacagaaatggttcagtctatcacagctcccatggagttagtctggtcaccagatatggatgagagattctattcagtggatcagaatcaaactggtacattgatccacttgagccgttaagtgctgccaattgtacaatatgcccaggcttgcagaataaagccaactttttattgtgaataataataaggacatatttttcttcagattatgttttatttctttgcattgagtgaggaacataaaatggcttggtaaaagtaataaaatcagtacaatcactaactttcctttgtacatattattttgcagtatagatgaatattactaatcagtttgattattctcagagggtgctgctctttaatgaaaatgaaaattatagctaatgttttttcctcaaactctgctttctgtaaccaatcagtgttttaatgtttgtgtgttcttcataaaatttaaatacaattcgttattctgtttccaatgttagtatgtatgtaaacatgatagtacagccatttttttcatatgtgagtaaaaataaaatagtatttttaaaaatata

SEQ ID NO: 441186 - DNA, 4267 bp, Homo sapiens
agcggaggggaggggcgcggccgccggacgcgccctcgcagcttccgccgggcccctccggaaatcccgtatcgtagggcgacggcggcttagaaagtgcttcctggagcgcagacgaggtcatgaatcatgtgacggtggcttgaggaggaacctgtctttaaagctgtccctgaagtgacagcggagagaaccaggcagcccagaaaccccaggcgtggagattgatcctgcgagagaagggggttcatcatggcggatgacctaaagcgattcttgtataaaaagttaccaagtgttgaagggctccatgccattgttgtgtcagatagagatggagtacctgttattaaagagcatgctttgcgacctggtttcttatccacttttgcccttgcaacagaccaaggaagcaaacttggactttccaaaaataaaagtatcatctgttactataacacctaccaggtggttcaatttaatcgtttacctttggtggtgagtttcatagccagcagcagtgccaatacaggactaattgtcagcctagaaaaggaacttgctccattgtttgaagaactgagacaagttgtggaagtttcttaatctgacagtggtttcagtgtgtaccttatcttcattataacaacacaatatcaatccagcaatctttagactacaataatacttttatccatgtgctcaagaaagggcccctttttccaacttatactaaagagctagcatatagatgtaatttatagatagatcagttgctatattttctggtgtagggtctttcttatttagtgagatctagggataccacagaaatggttcagtctatcacagctcccatggagttagtctggtcaccagatatggatgagagattctattcagtggatcagaatcaaactggtacattgatccacttgagccgttaagtgctgccaattgtacaatatgcccaggcttgcagaataaagccaactttttattgtgaataataataaggacatatttttcttcagattatgttttatttctttgcattgagtgaggaacataaaatggcttggtaaaagtaataaaatcagtacaatcactaactttcctttgtacatattattttgcagtatagatgaatattactaatcagtttgattattctcagagggtgctgctctttaatgaaaatgaaaattatagctaatgttttttcctcaaactctgctttctgtaaccaatcagtgttttaatgtttgtgtgttcttcataaaatttaaatacaattcgttattctgtttccaatgttagtatgtatgtaaacatgatagtacagccatttttttcatatgtgagtaaaaataaaatagtatttttaaaaatatagtttgagcactgtataggtcctttttttgttcagactttttccaaaaatctaaacataattaatatactctttcagccacatgaataaataatgagtgtttcttgtaggtattggtttggagattgttttacggtaatatgtactgttaactggaaaagaaacctgagattgcagtcagccaagattgtgccactgcaccccagcctgggcaacagagactccgtctcaaaaacaaaaaagaaaagaaaccaagaaacctcaggcatgaacctaatttaatctccatgaaagaggtactacagttctagaatataccctttatgttcaggaatgcagtctatcattcagagttaatttctttctaggctctttgacaatcagtttttccctggatcagttcagtacatatgcattgagcacctgtgtgccagtcagccgagctatcacattgcacaattctaagaagcaccattcatgtctcatcatatttctatgctctgggagttgcctttcacatagaatatgtgtgattgttatccctagaattgtgcagtgaggcaattggctaggtgctgtgctgctttttctttctttcttttttttttaagagacggagtcttgctgtgttgcccagtctggagtgcagtggtggcatgatcttgcctcactgtaacctctgcctcctgggttcaagctgttctcatgccccattctcccttgtagctgggattacaggcttacaccatcgcacttggcaaatttgtgtatttttagtagagacaggaattcaccatgttggccaggctggtcttgaactcctgacttaaagtgatccacctgctttggcctcccaaaatgctaggattataggtgtgagccactgcaccgggccatgtgctactttttcttccttccatccttcctcccttcttcagtgtaaatatgagattaatttgtgataccttactttaaagaacttagagttcagtaaaggaagcaggtatagaaagtgctatgataaagctatacataggatggtatagaaccacagactaggggcacttaaaatgggcaagaaaatagcctttgtaaataaaatagaggcaagagatataatgctttacctgcaaagagctataaatacagccatgtaccatataatgatgtttcagttagtgaaggaccacatacgagggtggtcagaacagcaggctataccatatagcctaggtgtgtagtaggctataccatatagcctaggtgtgtagtagtaggctataccatatagcctaggtgtgtagtagtaggcgataccatatagcctaggtgtgtagtagtaggctataccatatagcctaggtgtatagtagtaggctataccatatagcctaggtgtgtagtaggctataccatatagcctaggtatgtagtagtaggctataccatatagcctaggtgtgtagtagtaggctataccatctggggttcctgtcagtacagtatgatgttcacataatgatgaaatcacctaacaaagcatgtctcgaaatgtatccacattgttacgtaacacatgactgtagttaattgttacaattgaaatactagatgtactcattgaaatccagaattcccattatctggattatttaatatcgttcaggaaatttttgccagtgcaatggtgcatgaaacaatgtcttttagaaatgaggtggccagatttctatttgcagataataattgtatatctaaaaatcctagaaaaagaaatgataacaaatggagctacttaacctttacatgttgaatgctgccactgttaaaatttctgagggggtataatagataaactatcccatagttcatctggaaaaataaggtggtgaaaattgctaagaaatttttgaaagggtaatgtaaacctagattaactgtttttgaaaggtagtacagaactgaatgcacaactagatatcaatggtatgtactcacccagaaaaaagacttcagtacatacatgtgagggcttaaaacattgttataaagacgggatcacaatgggaaaaggattattcaataagtagggcaggcattctctatgcctgctagggaagtgtgacttgttatactctttatgtacagcaattggcagtctgtgaaacttttaaattcatatacataaccttttgccctgcaattccacttctagaaatttatcctaccaaacaaagcacatagatgtgcaaaagtatgtatttacaagtatattctttgcaacttggtaatgtcaaagaattggaagcaacctaaatatctgccataggtaggataaccatatgctttggctttttgaacactaccagtttatacctgctgttcttggataattattaatagtgctttcattctcaatgtctcactttagataataaattacagaggattggtgaaactaatttgcccaatggaaaaaggaatgaagaagtgctttaggtactgagatgaaaagatctctaaggcataataatgtttattgagaaaagcatggtgtcaaactgtatggcatgctacaattgatgtataagaagaaaaaatgtgtatgtattcctatttgtttgtatatggtagactgtctctgaagacatatatggaagaacctgatcacattggtagtctccaaggagcagaactagatacctgggggataaggatcccaggagtgagccttttcattgtaaacttcattgtactttgagtttttaactgttcaaaaataataaaattagaaataaaatatttcaacaaacaataaaatgggatatttggggaagaaagttgtctcagggctctccaaagaagcagaaccgg

SEQ ID NO: 441187 - DNA, 748 bp, Homo sapiens
agcggaggggaggggcgcggccgccggacgcgccctcgcagcttccgccgggcccctccggaaatcccgtatcgtagggcgacggcggcttagaaagtgcttcctggagcgcagacgaggtcatgaatcatgtgacggtggcttgaggaggaacctgtctttaaagctgtccctgaagtgacagcggagagaaccaggcagcccagaaaccccaggcgtggagattgatcctgcgagagaagggggttcatcatggcggatgacctaaagcgattcttgtataaaaagttaccaagtgttgaagggctccatgccattgttgtgtcagatagagatggagtacctgttattaaagtggcaaatgacaatgctccagagcatgctttgcgacctggtttcttatccacttttgcccttgcaacagaccaaggaagcaaacttggactttccaaaaataaaagtatcatctgttactataacacctaccaggtggttcaatttaatcgtttacctttggtggtgagtttcatagccagcagcagtgccaatacaggactaattgtcagcctagaaaaggaacttgctccattgtttgaagaactgagacaagttgtggaagtttcttaatctgacagtggtttcagtgtgtaccttatcttcattataacaacacaatatcaatccagcaatctttagactacaataatacttttatccatgtgctcaagggctccggaggttaaggctc

SEQ ID NO: 441188 - DNA, 964 bp, Homo sapiens
  misc_feature (799)..(799): n is a, c, g, or t
  misc_feature (824)..(824): n is a, c, g, or t
  misc_feature (962)..(962): n is a, c, g, or t
agcggaggggaggggcgcggccgccggacgcgccctcgcagcttccgccgggcccctccggaaatcccgtatcgtagggcgacggcggcttagaaagtgcttcctggagcgcagacgaggtcatgaatcatgtgacggtggcttgaggaggaacctgtctttaaagctgtccctgaagtgacagcggagagaaccaggcagcccagaaaccccaggacctaaagcgattcttgtataaaaagttaccaagtgttgaagggctccatgccattgttgtgtcagatagagatggagtacctgttattaaagtggcaaatgacaatgctccagagcatgctttgcgacctggtttcttatccacttttgcccttgcaacagaccaaggaagcaaacttggactttccaaaaataaaagtatcatctgttactataacacctaccaggtggttcaatttaatcgtttacctttggtggtgagtttcatagccagcagcagtgccaatacaggactaattgtcagcctagaaaaggaacttgctccattgtttgaagaactgagacaagttgtggaagtttcttaatctgacagtggtttcagtgtgtaccttatcttcattataacaacacaatatcaatccagcaatctttagactacaataatacttttatccatgtgctcaaggaggcctttcactatataggcagcttgtgtatatgtgatcgtgcatattatgtgtggtctctattagtagacaggatcacgatgtcgtttcgcccatggtagttgtacgtatgatanggttatcgtgatcgatcaactgtcntgtcactgagcgtagtgctgcatgtcattgccgctgcgatagcacttatgtatatataggctttctcgttttatctgctagtagatatgctgtagtatatcgtctactactcctgtctatattgcgttgagattctancg

SEQ ID NO: 441189 - DNA, 2102 bp, Homo sapiens
agcggaggggaggggcgcggccgccggacgcgccctcgcagcttccgccgggcccctccggaaatcccgtatcgtagggcgacggcggcttagaaagtgcttcctggagcgcagacgaggtcatgaatcatgtgacggtggcttgaggaggaacctgtctttaaagctgtccctgaagtgacagcggagagaaccaggcagcccagaaaccccaggcgtggagattgatcctgcgagagaagggggttcatcatggcggatgacctaaagcgattcttgtataaaaagttaccaagtgttgaagggctccatgccattgttgtgtcagatagagatggagtacctgttattaaagtggcaaatgacaatgctccagagcatgctttgcgacctggtttcttatccacttttgcccttgcaacagaccaaggaagcaaacttggactttccaaaaataaaagtatcatctgttactataacacctaccaggtggttcaatttaatcgtttacctttggtggtgagtttcatagccagcagcagtgccaatacaggactaattgtcagcctagaaaaggaacttgctccattgtttgaagaactgagacaagttgtggaagtttcttaatctgacagtggtttcagtgtgtaccttatcttcattataacaacacaatatcaatccagcaatctttagactacaataatacttttatccatgtgctcaagaaagggcccctttttccaacttatactaaagagctagcatatagatgtaatttatagatagatcagttgctatattttctggtgtagggtctttcttatttagtgagatctagggataccacagaaatggttcagtctatcacagctcccatggagttagtctggtcaccagatatggatgagagattctattcagtggatcagaatcaaactggtacattgatccacttgagccgttaagtgctgccaattgtacaatatgcccaggcttgcagaataaagccaactttttattgtgaataataataaggacatatttttcttcagattatgttttatttctttgcattgagtgaggaacataaaatggcttggtaaaagtaataaaatcagtacaatcactaactttcctttgtacatattattttgcagtatagatgaatattactaatcagtttgattattctcagagggtgctgctctttaatgaaaatgaaaattatagctaatgttttttcctcaaactctgctttctgtaaccaatcagtgttttaatgtttgtgtgttcttcataaaatttaaatacaattcgttattctgtttccaatgttagtatgtatgtaaacatgatagtacagccatttttttcatatgtgagtaaaaataaaatagtatttttaaaaatatagtttgagcactgtataggtcctttttttgttcagactttttccaaaaatctaaacataattaatatactctttcagccacatgaataaataatgagtgtttcttgtaggtattggtttggagattgttttacggtaatatgtactgttaactggaaaagaaacctgagattgcagtcagccaagattgtgccactgcaccccagcctgggcaacagagactccgtctcaaaaacaaaaaagaaaagaaaccaagaaacctcaggcatgaacctaatttaatctccatgaaagaggtactacagttctagaatataccctttatgttcaggaatgcagtctatcattcagagttaatttctttctaggctctttgacaatcagtttttccctggatcagttcagtacatatgcattgagcacctgtgtgccagtcagccgagctatcacattgcacaattctaagaagcaccattcatgtctcatcatatttctatgctctgggagttgcctttcacatagaatatgtgtgattgttatccctagaattgtgcagtgaggcaattggctaggtgctgtgctgcttttcacatagaatatgtgtgattgttatccctagaattgtgcagtgaggcaacttggctaggtgcacaattctagggataacaatcacatagaatatgtgtgc

SEQ ID NO: 441190 - DNA, 1432 bp, Homo sapiens
  misc_feature (1374)..(1374): n is a, c, g, or t
  misc_feature (1376)..(1376): n is a, c, g, or t
  misc_feature (1380)..(1380): n is a, c, g, or t
agcggaggggaggggcgcggccgccggacgcgccctcgcagcttccgccgggcccctccggaaatcccgtatcgtagggcgacggcggcttagaaagtgcttcctggagcgcagacgaggtcatgaatcatgtgacggtggcttgaggaggaacctgtctttaaagctgtccctgaagtgacagcggagagaaccaggcagcccagaaaccccaggcgtggagattgatcctgcgagagaagggggttcatcatggcggatgacctaaagcgattcttgtataaaaagttaccaagtgttgaagggctccatgccattgttgtgtcagatagagatggagtacctgttattaaagtggcaaatgacaatgctccagagcatgctttgcgacctggtttcttatccacttttgcccttgcaacagaccaaggaagcaaacttggactttccaaaaataaaagtatcatctgttactataacacctaccaggtggttcaatttaatcgtttacctttggtggtgagtttcatagccagcagcagtgccaatacaggactaattgtcagcctagaaaaggaacttgctccattgtttgaagaactgagacaagttgtggaagtttcttaatctgacagtggtttcagtgtgtaccttatcttcattataacaacacaatatcaatccagcaatctttagactacaataatacttttatccatgtgctcaagaaagggcccctttttccaacttatactaaagagctagcatatagatgtaatttatagatagatcagttgctatattttctggtgtagggtctttcttatttagtgagatctagggataccacagaaatggttcagtctatcacagctcccatggagttagtctggtcaccagatatggatgagagattctattcagtggatcagaatcaaactggtacattgatccacttgagccgttaagtgctgccaattgtacaatatgcccaggcttgcagaataaagccaactttttattgtgaataataataaggacatatttttcttcagattatgttttatttctttgcattgagtgaggaacataaaatggcttggtaaaagtaataaaatcagtacaatcactaactttcctttgtacatattattttgcagtatagatgaatattactaatcagtttgattattctcagagggtgctgctctttaatgaaaatgaaaattatagctaatgttttttcctcaaactctgctttctgtaaccaatcagtgttttaatgtttgtgtgttcttcataaaatttaaatacaattcgttattctgtttccaatgttagtatgtatgtaaacatgatagtaccatgcgccantntgtntgttataccagtcagtgggtcgacgctcaacaatataaattactaccgcctc

SEQ ID NO: 441191 - DNA, 4236 bp, Homo sapiens
agcggaggggaggggcgcggccgccggacgcgccctcgcagcttccgccgggcccctccggaaatcccgtatcgtagggcgacggcggcttagaaagtgcttcctggagcgcagacgaggtcatgaatcatgtgacggtggcttgaggaggaacctgtctttaaagctgtccctgaagtgacagcggagagaaccaggcagcccagaaaccccaggcgtggagattgatcctgcgagagaagggggttcatcatggcggatgacctaaagcgattcttgtataaaaagttaccaagtgttgaagggctccatgccattgttgtgtcagatagagatggagtacctgttattaaagtggcaaatgacaatgctccagagcatgctttgcgacctggtttcttatccacttttgcccttgcaacagaccaaggaagcaaacttggactttccaaaaataaaagtatcatctgttactataacacctaccaggtggttcaatttaatcgtttacctttggtggtgagtttcatagccagcagcagtgccaatacagacaagttgtggaagtttcttaatctgacagtggtttcagtgtgtaccttatcttcattataacaacacaatatcaatccagcaatctttagactacaataatacttttatccatgtgctcaagaaagggcccctttttccaacttatactaaagagctagcatatagatgtaatttatagatagatcagttgctatattttctggtgtagggtctttcttatttagtgagatctagggataccacagaaatggttcagtctatcacagctcccatggagttagtctggtcaccagatatggatgagagattctattcagtggatcagaatcaaactggtacattgatccacttgagccgttaagtgctgccaattgtacaatatgcccaggcttgcagaataaagccaactttttattgtgaataataataaggacatatttttcttcagattatgttttatttctttgcattgagtgaggaacataaaatggcttggtaaaagtaataaaatcagtacaatcactaactttcctttgtacatattattttgcagtatagatgaatattactaatcagtttgattattctcagagggtgctgctctttaatgaaaatgaaaattatagctaatgttttttcctcaaactctgctttctgtaaccaatcagtgttttaatgtttgtgtgttcttcataaaatttaaatacaattcgttattctgtttccaatgttagtatgtatgtaaacatgatagtacagccatttttttcatatgtgagtaaaaataaaatagtatttttaaaaatatagtttgagcactgtataggtcctttttttgttcagactttttccaaaaatctaaacataattaatatactctttcagccacatgaataaataatgagtgtttcttgtaggtattggtttggagattgttttacggtaatatgtactgttaactggaaaagaaacctgagattgcagtcagccaagattgtgccactgcaccccagcctgggcaacagagactccgtctcaaaaacaaaaaagaaaagaaaccaagaaacctcaggcatgaacctaatttaatctccatgaaagaggtactacagttctagaatataccctttatgttcaggaatgcagtctatcattcagagttaatttctttctaggctctttgacaatcagtttttccctggatcagttcagtacatatgcattgagcacctgtgtgccagtcagccgagctatcacattgcacaattctaagaagcaccattcatgtctcatcatatttctatgctctgggagttgcctttcacatagaatatgtgtgattgttatccctagaattgtgcagtgaggcaattggctaggtgctgtgctgctttttctttctttcttttttttttaagagacggagtcttgctgtgttgcccagtctggagtgcagtggtggcatgatcttgcctcactgtaacctctgcctcctgggttcaagctgttctcatgccccattctcccttgtagctgggattacaggcttacaccatcgcacttggcaaatttgtgtatttttagtagagacaggaattcaccatgttggccaggctggtcttgaactcctgacttaaagtgatccacctgctttggcctcccaaaatgctaggattataggtgtgagccactgcaccgggccatgtgctactttttcttccttccatccttcctcccttcttcagtgtaaatatgagattaatttgtgataccttactttaaagaacttagagttcagtaaaggaagcaggtatagaaagtgctatgataaagctatacataggatggtatagaaccacagactaggggcacttaaaatgggcaagaaaatagcctttgtaaataaaatagaggcaagagatataatgctttacctgcaaagagctataaatacagccatgtaccatataatgatgtttcagttagtgaaggaccacatacgagggtggtcagaacagcaggctataccatatagcctaggtgtgtagtaggctataccatatagcctaggtgtgtagtagtaggctataccatatagcctaggtgtgtagtagtaggcgataccatatagcctaggtgtgtagtagtaggctataccatatagcctaggtgtatagtagtaggctataccatatagcctaggtgtgtagtaggctataccatatagcctaggtatgtagtagtaggctataccatatagcctaggtgtgtagtagtaggctataccatctggggttcctgtcagtacagtatgatgttcacataatgatgaaatcacctaacaaagcatgtctcgaaatgtatccacattgttacgtaacacatgactgtagttaattgttacaattgaaatactagatgtactcattgaaatccagaattcccattatctggattatttaatatcgttcaggaaatttttgccagtgcaatggtgcatgaaacaatgtcttttagaaatgaggtggccagatttctatttgcagataataattgtatatctaaaaatcctagaaaaagaaatgataacaaatggagctacttaacctttacatgttgaatgctgccactgttaaaatttctgagggggtataatagataaactatcccatagttcatctggaaaaataaggtggtgaaaattgctaagaaatttttgaaagggtaatgtaaacctagattaactgtttttgaaaggtagtacagaactgaatgcacaactagatatcaatggtatgtactcacccagaaaaaagacttcagtacatacatgtgagggcttaaaacattgttataaagacgggatcacaatgggaaaaggattattcaataagtagggcaggcattctctatgcctgctagggaagtgtgacttgttatactctttatgtacagcaattggcagtctgtgaaacttttaaattcatatacataaccttttgccctgcaattccacttctagaaatttatcctaccaaacaaagcacatagatgtgcaaaagtatgtatttacaagtatattctttgcaacttggtaatgtcaaagaattggaagcaacctaaatatctgccataggtaggataaccatatgctttggctttttgaacactaccagtttatacctgctgttcttggataattattaatagtgctttcattctcaatgtctcactttagataataaattacagaggattggtgaaactaatttgcccaatggaaaaaggaatgaagaagtgctttaggtactgagatgaaaagatctctaaggcataataatgtttattgagaaaagcatggtgtcaaactgtatggcatgctacaattgatgtataagaagaaaaaatgtgtatgtattcctatttgtttgtatatggtagactgtctctgaagacatatatggaagaacctgatcacattggtagtctccaaggagcagaactagatacctgggggataaggatcccaggagtgagccttttcattgtaaacttcattgtactttgagtttttaactgttcaaaaataataaaattagaaataaaatatttcaacaaacaataaaatgggatatttggggaagaaagttgtctcagggctctccaaagaagcagaaccgg

SEQ ID NO: 441192 - DNA, 579 bp, Homo sapiens
cgcgcctgacaaccccgtcgtccccgtgccgtcccccgaactccacataccatgcgacgcgcggccagccccccgcccctgcccggctgctgggaggaagtgacagcgccccgcatcccccgctgggcaggccgggcgcgcccagcccctgggacgcagggacacagccgggccgcgctgggccttggcctccgcccgcgggttttccgcggttgcggcggggcggggaaggaggggcgggcggggcggggctgactctgcgactatttcaggccttgcggaacccgggccaggacagtggcggccaggccgggacacggtaagtgacctccgcttccacacgtccattccccgccgctccgcgcggcttctcgcccgcccctaccccgaggccaggccggattccccgaggaaagagcctgtcgccgcggcggggacaggagggggctggacgcttccagggaaactgaggccctggcgcgcccagcgtccgcgcgtccgggcgcagaggggccaaggctggctgagggcccgggcctgccagaggcagggagggcggggctggggcaggcgcagggg

SEQ ID NO: 441193 - DNA, 4727 bp, Homo sapiens
  misc_feature (4408)..(4408): n is a, c, g, or t
  misc_feature (4417)..(4418): n is a, c, g, or t
  misc_feature (4420)..(4420): n is a, c, g, or t
  misc_feature (4569)..(4569): n is a, c, g, or t
  misc_feature (4583)..(4583): n is a, c, g, or t
ttacagcagaaaggccccaggtccggcgtgactccccggccgggcgacacaggccgagtcacttcctcgcccgtgcccgggtgtcctcatcgggggatgggtgcgccttccacatcctgcccaggactgaaggagccgggcccagcgagctcccgggaggtgtgtggacatcagccctgacggggaaggcgagccaggagcctgcaggcctgaaccagggtgatgctgaagatgatgaccttcttccaaggcctctagagccatcagcctgtgccaggcaccctcgacttgcctagaggcccccaaaagttgcagtccacatcagaggcagagtcagaggcctccatgtcggaggcctcctctgaggacctggtgccacccctggaggctggggcagccccatatagggaggaggaagaggcggcgaagaagaagaaggagaagaagaagaagtccaaaggcctggccaatgtgttctgcgtcttcaccaaagggaagaagaagaagggtcagcccagctcagcggagcccgaggacgcagccgggtccaggcaggggctggatggcccgccccccacagtggaggagctgaaggcggcgctggagcgcgggcagctggaggcggcgcggccgctgctggcgctggagcgggagctggcggcggcggcggcggcgggcggtgtgagcgaggaggagctggtgcggcgccagagcaaggtggaggcgctgtacgagctgctgcgcgaccaggtgctgggcgtgctgcggcggccgctggaggcgccgcccgagcggctgcgccaggcgctggccgtggtggcggagcaggagcgcgaggaccgccaggcggcggcggcggggccggggacctcggggctggcggccacgcgcccgcggcgctggctgcagctgtggcggcgcggcgtggcggaggcggccgaggagcgcatgggccagcggccggccgcgggcgccgaggtccccgagagcgtctttctgcacttgggccgcaccatgaaggaggacctggaggccgtggtggagcggctgaagccgctgttccccgccgagttcggcgtcgtggcggcctacgccgagagctaccaccagcacttcgcggcccacctggccgccgtggcgcagttcgagctgtgcgagcgcgacacctacatgctgctgctctgggtggagaacctctaccccaatgacatcatcaacagccccaagctggtgggtgagctgcagggtatggggctcgggagcctcctgccccccaggcagatccgactgctggaggccacattcctgtccagtgaggcggccaatgtgagggagttgatggaccgagctctggagctagaggcacggcgctgggctgaggatgtgcctccccagaggctggacggccactgccacagcgagctggccatcgacatcatccagatcacctcccaggcccaggccaaggccgagagcatcacgctggacttgggctcacagataaagcgggtgctgctggtggagctgcctgcgttcctgaggagctaccagcgcgcctttaatgaatttctggagagaggcaagcagctgacgaattacagggccaatgttattgccaacatcaacaactgcctgtccttccggatgtccatggagcagaattggcaggtaccccaggacaccctgagcctcctgctgggccccctgggtgagctcaagagccacggctttgacaccctgctccagaacctgcatgaggacctgaagccactgttcaagaggttcacgcacacccgctgggcggcccctgtggagaccctggaaaacatcatcgccactgtagacacgaggctgcctgagttctcagagctgcagggctgtttccgggaggagctcatggaggccttgcacctgcacctggtgaaggagtacatcatccaactcagcaaggggcgcctggtcctcaagacggccgagcagcagcagcagctggctgggtacatcctggccaatgctgacaccatccagcacttctgcacccagcacggctccccggcgacctggctgcagcctgctctccctacgctggccgagatcattcgcctgcaggaccccagtgccatcaagattgaggtggccacttatgccacctgctaccctgacttcagcaaaggccacctgagcgctatcctggccatcaaggggaacctatccaacagtgaggtcaagcgcatccggagcatcttggacgtcagcatgggggcgcaggagccctcccggcccctattttcccttataaaggttggttagcttttcctgtggcctgacctgcctgtgagtgcccagcaagccttgggcacaccccgctgggagctgttaagagcagcgctggttctcggttcctcccgggtctcctgtgctctgatgctacttctgcctagccctggcggaggtgcaggccctgtcagctggaactggacagaccttggtttgtttacatgtccgatgggggcaggagctcccatcctgggcagccaaccaggcaacaccaaggactctttgtaaacgatagctgatcgtgtgcacgcaaggaaagaaccaggagggagagtgcagccaggctcagggatccccggacacctctgtccagagcccctccacagtcggcctcatgactgtcctcctcgtgggtggggccgagggccctcttcagctctctggagacaggggccgagcctcacccatctgccctctgcagcccagggccgccgtgagcgggattcagcaatggtggaatggaagacagaactggaagagaaagaaggaaaagatgagctctcgtctggcaggggcttttagggtcctgtggcgagctgtgagcaccgccagcgttagacgtcacatccaggtggccccacggcccctacaggctggccctgcaatggggccctgagccctccctcttcatcccccaaggcctcaactagagggtggtcccccgagggcttggtgtctactaccgaagggcccaagacctcctgggtcctctcaggctcccccttccccaaggcagggacaggccctgggggtgccaccgtgggccctgccacccagaagtctggctgaggtctgggcaggggcagggcaagcttgacctctcactgttgaccctttggcctctgtatttgtttcctattgccgtgacaggtttccacaaacttcgtggatcaaaacgaggtcttccagttctgcgggtcagaaggctgacccggggctcaaatctgggtgtcggcagtcctgcactccttctggaggctctaggggagaattcatttctggccttttcatttttagaggctgaccgtaattcttgacttcaggctcctccatcttcagagccagctgtgggtagttgaatctttttcccgtcacctcattgaggcctcccctctcctgcctccctccaccacttttttttttttttttttgagacagggtcttgctgtgttgcccaggctggagtgcagtggcctggtcatggcatcaaggctcactgcagcctggacctcctggttcaagtgatcctcttgtctcagtcccctgagacaatcccccacgcccagctacatattttttgtggatacagggtctcattctgttgcctaggcttgtctggaactcctgggctcaagggatcttgtagccttagcctcctaaagtgctgggattataggcatgagtcactgtacccggcctgctctaccgcttttaaggacgcttatgatcacattgcgcctacccagagaacccaggtcgtctttctattttcaggtcagctgattagccaccttagttccatctgcaactttagttcccactggctgtgtaacctaacatagtcacaggctctggggactgtcacgtggacatctttgggaggccgttattctgcccaccgcaccctccgttcatcccctgccctgccgggcacctcgctctaccccaggaaaatgtgagctcgttttcctgctcggcatgtgctccccctaaggctctgctcctccctgggcctgaaagttccttctcagcctgagagggggcccttcggatctcaggcatgactcagcccggctgatgcctctgcagtgctgagtcaggatttggggccggctctcttgggtctgtccccttttcccaggtactgccttacaaagctgtggccaggaagtggccggtataaaggatgcccaaggtctttgtacgtgtgtaggagttagcgtgtttgatattgttaatataataataattattttttagagtactgcttttgtatgtatgttgaacaggatccaggtttttatagcttgatataaaacagaattcaaaagtgaaaaaaaaaaaaaaaaanaaaaaaaannanaaaaaaaaaacttattaataattaccaaacccttaaaacccctcaaataccttttatattttaaactaaatataaaccttaatacccattccccttgtatcaccttaccacaattacccccatttaaacttcctttaattttttggccncgcgcctagccganattttctttataatggaagagtccttaaagcgggcccctatatttcaaagcccatgcgcctatttccacttatgggaggggggatacactccccatggggcgggtttttaaaattggggcgggtggaagaacactggggaaccc

SEQ ID NO: 441194 - DNA, 4849 bp, Homo sapiens
  misc_feature (4530)..(4530): n is a, c, g, or t
  misc_feature (4539)..(4540): n is a, c, g, or t
  misc_feature (4542)..(4542): n is a, c, g, or t
  misc_feature (4691)..(4691): n is a, c, g, or t
  misc_feature (4705)..(4705): n is a, c, g, or t
cgcgcctgacaaccccgtcgtccccgtgccgtcccccgaactccacataccatgcgacgcgcggccagccccccgcccctgcccggctgctgggaggaagtgacagcgccccgcatcccccgctgggcaggccgggcgcgcccagcccctgggacgcagggacacagccgggccgcgctgggccttggcctccgcccgcgggttttccgcggttgcggcggggcggggaaggaggggcgggcggggcggggctgactctgcgactatttcaggccttgcggaacccgggccaggacagtggcggccaggccgggacacggagcctgcaggcctgaaccagggtgatgctgaagatgatgaccttcttccaaggcctctagagccatcagcctgtgccaggcaccctcgacttgcctagaggcccccaaaagttgcagtccacatcagaggcagagtcagaggcctccatgtcggaggcctcctctgaggacctggtgccacccctggaggctggggcagccccatatagggaggaggaagaggcggcgaagaagaagaaggagaagaagaagaagtccaaaggcctggccaatgtgttctgcgtcttcaccaaagggaagaagaagaagggtcagcccagctcagcggagcccgaggacgcagccgggtccaggcaggggctggatggcccgccccccacagtggaggagctgaaggcggcgctggagcgcgggcagctggaggcggcgcggccgctgctggcgctggagcgggagctggcggcggcggcggcggcgggcggtgtgagcgaggaggagctggtgcggcgccagagcaaggtggaggcgctgtacgagctgctgcgcgaccaggtgctgggcgtgctgcggcggccgctggaggcgccgcccgagcggctgcgccaggcgctggccgtggtggcggagcaggagcgcgaggaccgccaggcggcggcggcggggccggggacctcggggctggcggccacgcgcccgcggcgctggctgcagctgtggcggcgcggcgtggcggaggcggccgaggagcgcatgggccagcggccggccgcgggcgccgaggtccccgagagcgtctttctgcacttgggccgcaccatgaaggaggacctggaggccgtggtggagcggctgaagccgctgttccccgccgagttcggcgtcgtggcggcctacgccgagagctaccaccagcacttcgcggcccacctggccgccgtggcgcagttcgagctgtgcgagcgcgacacctacatgctgctgctctgggtggagaacctctaccccaatgacatcatcaacagccccaagctggtgggtgagctgcagggtatggggctcgggagcctcctgccccccaggcagatccgactgctggaggccacattcctgtccagtgaggcggccaatgtgagggagttgatggaccgagctctggagctagaggcacggcgctgggctgaggatgtgcctccccagaggctggacggccactgccacagcgagctggccatcgacatcatccagatcacctcccaggcccaggccaaggccgagagcatcacgctggacttgggctcacagataaagcgggtgctgctggtggagctgcctgcgttcctgaggagctaccagcgcgcctttaatgaatttctggagagaggcaagcagctgacgaattacagggccaatgttattgccaacatcaacaactgcctgtccttccggatgtccatggagcagaattggcaggtaccccaggacaccctgagcctcctgctgggccccctgggtgagctcaagagccacggctttgacaccctgctccagaacctgcatgaggacctgaagccactgttcaagaggttcacgcacacccgctgggcggcccctgtggagaccctggaaaacatcatcgccactgtagacacgaggctgcctgagttctcagagctgcagggctgtttccgggaggagctcatggaggccttgcacctgcacctggtgaaggagtacatcatccaactcagcaaggggcgcctggtcctcaagacggccgagcagcagcagcagctggctgggtacatcctggccaatgctgacaccatccagcacttctgcacccagcacggctccccggcgacctggctgcagcctgctctccctacgctggccgagatcattcgcctgcaggaccccagtgccatcaagattgaggtggccacttatgccacctgctaccctgacttcagcaaaggccacctgagcgctatcctggccatcaaggggaacctatccaacagtgaggtcaagcgcatccggagcatcttggacgtcagcatgggggcgcaggagccctcccggcccctattttcccttataaaggttggttagcttttcctgtggcctgacctgcctgtgagtgcccagcaagccttgggcacaccccgctgggagctgttaagagcagcgctggttctcggttcctcccgggtctcctgtgctctgatgctacttctgcctagccctggcggaggtgcaggccctgtcagctggaactggacagaccttggtttgtttacatgtccgatgggggcaggagctcccatcctgggcagccaaccaggcaacaccaaggactctttgtaaacgatagctgatcgtgtgcacgcaaggaaagaaccaggagggagagtgcagccaggctcagggatccccggacacctctgtccagagcccctccacagtcggcctcatgactgtcctcctcgtgggtggggccgagggccctcttcagctctctggagacaggggccgagcctcacccatctgccctctgcagcccagggccgccgtgagcgggattcagcaatggtggaatggaagacagaactggaagagaaagaaggaaaagatgagctctcgtctggcaggggcttttagggtcctgtggcgagctgtgagcaccgccagcgttagacgtcacatccaggtggccccacggcccctacaggctggccctgcaatggggccctgagccctccctcttcatcccccaaggcctcaactagagggtggtcccccgagggcttggtgtctactaccgaagggcccaagacctcctgggtcctctcaggctcccccttccccaaggcagggacaggccctgggggtgccaccgtgggccctgccacccagaagtctggctgaggtctgggcaggggcagggcaagcttgacctctcactgttgaccctttggcctctgtatttgtttcctattgccgtgacaggtttccacaaacttcgtggatcaaaacgaggtcttccagttctgcgggtcagaaggctgacccggggctcaaatctgggtgtcggcagtcctgcactccttctggaggctctaggggagaattcatttctggccttttcatttttagaggctgaccgtaattcttgacttcaggctcctccatcttcagagccagctgtgggtagttgaatctttttcccgtcacctcattgaggcctcccctctcctgcctccctccaccacttttttttttttttttttgagacagggtcttgctgtgttgcccaggctggagtgcagtggcctggtcatggcatcaaggctcactgcagcctggacctcctggttcaagtgatcctcttgtctcagtcccctgagacaatcccccacgcccagctacatattttttgtggatacagggtctcattctgttgcctaggcttgtctggaactcctgggctcaagggatcttgtagccttagcctcctaaagtgctgggattataggcatgagtcactgtacccggcctgctctaccgcttttaaggacgcttatgatcacattgcgcctacccagagaacccaggtcgtctttctattttcaggtcagctgattagccaccttagttccatctgcaactttagttcccactggctgtgtaacctaacatagtcacaggctctggggactgtcacgtggacatctttgggaggccgttattctgcccaccgcaccctccgttcatcccctgccctgccgggcacctcgctctaccccaggaaaatgtgagctcgttttcctgctcggcatgtgctccccctaaggctctgctcctccctgggcctgaaagttccttctcagcctgagagggggcccttcggatctcaggcatgactcagcccggctgatgcctctgcagtgctgagtcaggatttggggccggctctcttgggtctgtccccttttcccaggtactgccttacaaagctgtggccaggaagtggccggtataaaggatgcccaaggtctttgtacgtgtgtaggagttagcgtgtttgatattgttaatataataataattattttttagagtactgcttttgtatgtatgttgaacaggatccaggtttttatagcttgatataaaacagaattcaaaagtgaaaaaaaaaaaaaaaaanaaaaaaaannanaaaaaaaaaacttattaataattaccaaacccttaaaacccctcaaataccttttatattttaaactaaatataaaccttaatacccattccccttgtatcaccttaccacaattacccccatttaaacttcctttaattttttggccncgcgcctagccganattttctttataatggaagagtccttaaagcgggcccctatatttcaaagcccatgcgcctatttccacttatgggaggggggatacactccccatggggcgggtttttaaaattggggcgggtggaagaacactggggaaccc

SEQ ID NO: 441195 - DNA, 3822 bp, Homo sapiens
ttacagcagaaaggccccaggtccggcgtgactccccggccgggcgacacaggccgagtcacttcctcgcccgtgcccgggtgtcctcatcgggggatgggtgcgccttccacatcctgcccaggactgaaggagccgggcccagcgagctcccgggaggtgtgtggacatcagccctgacggggaaggcgagccaggagcctgcaggcctgaaccagggtgatgctgaagatgatgaccttcttccaaggcctctagagccatcagcctgtgccaggcaccctcgacttgcctagaggcccccaaaagttgcagtccacatcagaggcagagtcagaggcctccatgtcggaggcctcctctgaggacctggtgccacccctggaggctggggcagccccatatagggaggaggaagaggcggcgaagaagaagaaggagaagaagaagaagtccaaaggcctggccaatgtgttctgcgtcttcaccaaagggaagaagaagaagggtcagcccagctcagcggagcccgaggacgcagccgggtccaggcaggggctggatggcccgccccccacagtggaggagctgaaggcggcgctggagcgcgggcagctggaggcggcgcggccgctgctggcgctggagcgggagctggcggcggcggcggcggcgggcggtgtgagcgaggaggagctggtgcggcgccagagcaaggtggaggcgctgtacgagctgctgcgcgaccaggtgctgggcgtgctgcggcggccgctggaggcgccgcccgagcggctgcgccaggcgctggccgtggtggcggagcaggagcgcgaggaccgccaggcggcggcggcggggccgaggtccccgagagcgtctttctgcacttgggccgcaccatgaaggaggacctggaggccgtggtggagcggctgaagccgctgttccccgccgagttcggcgtcgtggcggcctacgccgagagctaccaccagcacttcgcggcccacctggccgccgtggcgcagttcgagctgtgcgagcgcgacacctacatgctgctgctctgggtggagaacctctaccccaatgacatcatcaacagccccaagctggtgggtgagctgcagggtatggggctcgggagcctcctgccccccaggcagatccgactgctggaggccacattcctgtccagtgaggcggccaatgtgagggagttgatggaccgagctctggagctagaggcacggcgctgggctgaggatgtgcctccccagaggctggacggccactgccacagcgagctggccatcgacatcatccagatcacctcccaggcccaggccaaggccgagagcatcacgctggacttgggctcacagataaagcgggtgctgctggtggagctgcctgcgttcctgaggagctaccagcgcgcctttaatgaatttctggagagaggcaagcagctgacgaattacagggccaatgttattgccaacatcaacaactgcctgtccttccggatgtccatggagcagaattggcaggtaccccaggacaccctgagcctcctgctgggccccctgggtgagctcaagagccacggctttgacaccctgctccagaacctgcatgaggacctgaagccactgttcaagaggttcacgcacacccgctgggcggcccctgtggagaccctggaaaacatcatcgccactgtagacacgaggctgcctgagttctcagagctgcagggctgtttccgggaggagctcatggaggccttgcacctgcacctggtgaaggagtacatcatccaactcagcaaggggcgcctggtcctcaagacggccgagcagcagcagcagctggctgggtacatcctggccaatgctgacaccatccagcacttctgcacccagcacggctccccggcgacctggctgcagcctgctctccctacgctggccgagatcattcgcctgcaggaccccagtgccatcaagattgaggtggccacttatgccacctgctaccctgacttcagcaaaggccacctgagcgctatcctggccatcaaggggaacctatccaacagtgaggtcaagcgcatccggagcatcttggacgtcagcatgggggcgcaggagccctcccggcccctattttcccttataaagcccagggccgccgtgagcgggattcagcaatggtggaatggaagacagaactggaagagaaagaaggaaaagatgagctctcgtctggcaggggcttttagggtcctgtggcgagctgtgagcaccgccagcgttagacgtcacatccaggtggccccacggcccctacaggctggccctgcaatggggccctgagccctccctcttcatcccccaaggcctcaactagagggtggtcccccgagggcttggtgtctactaccgaagggcccaagacctcctgggtcctctcaggctcccccttccccaaggcagggacaggccctgggggtgccaccgtgggccctgccacccagaagtctggctgaggtctgggcaggggcagggcaagcttgacctctcactgttgaccctttggcctctgtatttgtttcctattgccgtgacaggtttccacaaacttcgtggatcaaaacgaggtcttccagttctgcgggtcagaaggctgacccggggctcaaatctgggtgtcggcagtcctgcactccttctggaggctctaggggagaattcatttctggccttttcatttttagaggctgaccgtaattcttgacttcaggctcctccatcttcagagccagctgtgggtagttgaatctttttcccgtcacctcattgaggcctcccctctcctgcctccctccaccacttttttttttttttttttgagacagggtcttgctgtgttgcccaggctggagtgcagtggcctggtcatggcatcaaggctcactgcagcctggacctcctggttcaagtgatcctcttgtctcagtcccctgagacaatcccccacgcccagctacatattttttgtggatacagggtctcattctgttgcctaggcttgtctggaactcctgggctcaagggatcttgtagccttagcctcctaaagtgctgggattataggcatgagtcactgtacccggcctgctctaccgcttttaaggacgcttatgatcacattgcgcctacccagagaacccaggtcgtctttctattttcaggtcagctgattagccaccttagttccatctgcaactttagttcccactggctgtgtaacctaacatagtcacaggctctggggactgtcacgtggacatctttgggaggccgttattctgcccaccgcaccctccgttcatcccctgccctgccgggcacctcgctctaccccaggaaaatgtgagctcgttttcctgctcggcatgtgctccccctaaggctctgctcctccctgggcctgaaagttccttctcagcctgagagggggcccttcggatctcaggcatgactcagcccggctgatgcctctgcagtgctgagtcaggatttggggccggctctcttgggtctgtccccttttcccaggtactgccttacaaagctgtggccaggaagtggccggtataaaggatgcccaaggtctttgtacgtgtgtaggagttagcgtgtttgatattgttaatataataataattattttttagagtactgcttttgtatgtatgttgaacaggatccaggtttttatagcttgatataaaacagaattcaaaagtga

SEQ ID NO: 441196 - DNA, 2253 bp, Homo sapiens
gctgggctgacaggatgctctctttgccagcaaaggccacctgagcgctatcctggccatcaaggggaacctatccaacagtgaggtcaagcgcatccggagcatcttggacgtcagcatgggggcgcaggagccctcccggcccctattttcccttataaaggttggttagcttttcctgtggcctgacctgcctgtgagtgcccagcaagccttgggcacaccccgctgggagctgttaagagcagcgctggttctcggttcctcccgggtctcctgtgctctgatgctacttctgcctagccctggcggaggtgcaggccctgtcagctggaactggacagaccttggtttgtttacatgtccgatgggggcaggagctcccatcctgggcagccaaccaggcaacaccaaggactctttgtaaacgatagctgatcgtgtgcacgcaaggaaagaaccaggagggagagtgcagccaggctcagggatccccggacacctctgtccagagcccctccacagtcggcctcatgactgtcctcctcgtgggtggggccgagggccctcttcagctctctggagacaggggccgagcctcacccatctgccctctgcagcccagggccgccgtgagcgggattcagcaatggtggaatggaagacagaactggaagagaaagaaggaaaagatgagctctcgtctggcaggggcttttagggtcctgtggcgagctgtgagcaccgccagcgttagacgtcacatccaggtggccccacggcccctacaggctggccctgcaatggggccctgagccctccctcttcatcccccaaggcctcaactagagggtggtcccccgagggcttggtgtctactaccgaagggcccaagacctcctgggtcctctcaggctcccccttccccaaggcagggacaggccctgggggtgccaccgtgggccctgccacccagaagtctggctgaggtctgggcaggggcagggcaagcttgacctctcactgttgaccctttggcctctgtatttgtttcctattgccgtgacaggtttccacaaacttcgtggatcaaaacgaggtcttccagttctgcgggtcagaaggctgacccggggctcaaatctgggtgtcggcagtcctgcactccttctggaggctctaggggagaattcatttctggccttttcatttttagaggctgaccgtaattcttgacttcaggctcctccatcttcagagccagctgtgggtagttgaatctttttcccgtcacctcattgaggcctcccctctcctgcctccctccaccacttttttttttttttttttgagacagggtcttgctgtgttgcccaggctggagtgcagtggcctggtcatggcatcaaggctcactgcagcctggacctcctggttcaagtgatcctcttgtctcagtcccctgagacaatcccccacgcccagctacatattttttgtggatacagggtctcattctgttgcctaggcttgtctggaactcctgggctcaagggatcttgtagccttagcctcctaaagtgctgggattataggcatgagtcactgtacccggcctgctctaccgcttttaaggacgcttatgatcacattgcgcctacccagagaacccaggtcgtctttctattttcaggtcagctgattagccaccttagttccatctgcaactttagttcccactggctgtgtaacctaacatagtcacaggctctggggactgtcacgtggacatctttgggaggccgttattctgcccaccgcaccctccgttcatcccctgccctgccgggcacctcgctctaccccaggaaaatgtgagctcgttttcctgctcggcatgtgctccccctaaggctctgctcctccctgggcctgaaagttccttctcagcctgagagggggcccttcggatctcaggcatgactcagcccggctgatgcctctgcagtgctgagtcaggatttggggccggctctcttgggtctgtccccttttcccaggtactgccttacaaagctgtggccaggaagtggccggtataaaggatgcccaaggtctttgtacgtgtgtaggagttagcgtgtttgatattgttaatataataataattattttttagagtactgcttttgtatgtatgttgaacaggatccaggtttttatagcttgatataaaacagaattcaaaagtga

SEQ ID NO: 441197 - DNA, 1597 bp, Homo sapiens
ttacagcagaaaggccccaggtccggcgtgactccccggccgggcgacacaggccgagtcacttcctcgcccgtgcccgggtgtcctcatcgggggatgggtgcgccttccacatcctgcccaggactgaaggagccgggcccagcgagctcccgggaggtgtgtggacatcagccctgacggggaaggcgagccaggagcctgcaggcctgaaccagggtgatgctgaagatgatgaccttcttccaaggcctctagagccatcagcctgtgccaggcaccctcgacttgcctagaggcccccaaaagttgcagtccacatcagaggcagagtcagaggcctccatgtcggaggcctcctctgaggacctggtgccacccctggaggctggggcagccccatatagggaggaggaagaggcggcgaagaagaagaaggagaagaagaagaagtccaaaggcctggccaatgtgttctgcgtcttcaccaaagggaagaagaagaagggtcagcccagctcagcggagcccgaggacgcagccgggtccaggcaggggctggatggcccgccccccacagtggaggagctgaaggcggcgctggagcgcgggcagctggaggcggcgcggccgctgctggcgctggagcgggagctggcggcggcggcggcggcgggcggtgtgagcgaggaggagctggtgcggcgccagagcaaggtggaggcgctgtacgagctgctgcgcgaccaggtgctgggcgtgctgcggcggccgctggaggcgccgcccgagcggctgcgccaggcgctggccgtggtggcggagcaggagcgcgaggaccgccaggcggcggcggcggggccgaggtccccgagagcgtctttctgcacttgggccgcaccatgaaggaggacctggaggccgtggtggagcggctgaagccgctgttccccgccgagttcggcgtcgtggcggcctacgccgagagctaccaccagcacttcgcggcccacctggccgccgtggcgcagttcgagctgtgcgagcgcgacacctacatgctgctgctctgggtggagaacctctaccccaatgacatcatcaacagccccaagctggtgggtgagctgcagggtatggggctcgggagcctcctgccccccaggcagatccgactgctggaggccacattcctgtccagtgaggcggccaatgtgagggagttgatggaccgagctctggagctagaggcacggcgctgggctgaggatgtgcctccccagaggctggacggccactgccacagcgagctggccatcgacatcatccagatcacctcccaggcccaggccaaggccgagagcatcacgctggacttgggctcacagataaagcgggtgctgctggtggagctgcctgcgttcctgaggagctaccagcgcgcctttaatgaatttctggagagaggcaagcagctgacgaattacagggccaatgttattgccaacatcaacaactgcctgtccttccggatgtccatggagcagaattggcagtaccccgaggatcactgagcccaggcatcctctagacgact

SEQ ID NO: 441198 - DNA, 776 bp, Homo sapiens
  misc_feature (457)..(457): n is a, c, g, or t
  misc_feature (466)..(467): n is a, c, g, or t
  misc_feature (469)..(469): n is a, c, g, or t
  misc_feature (618)..(618): n is a, c, g, or t
  misc_feature (632)..(632): n is a, c, g, or t
tgccagtgtcctccaggcactcaaacctagcccttctgaagccgacctcacgtgacctcacagcccctcctgaaggcgcctcactgatgacggtgggtggaataacagcccccagagatgtccaggtttggaaccccaggacgtgggaaagtgttaccttgcgtggcaaaagggacccggctgatgcctctgcagtgctgagtcaggatttggggccggctctcttgggtctgtccccttttcccaggtactgccttacaaagctgtggccaggaagtggccggtataaaggatgcccaaggtctttgtacgtgtgtaggagttagcgtgtttgatattgttaatataataataattattttttagagtactgcttttgtatgtatgttgaacaggatccaggtttttatagcttgatataaaacagaattcaaaagtgaaaaaaaaaaaaaaaaanaaaaaaaannanaaaaaaaaaacttattaataattaccaaacccttaaaacccctcaaataccttttatattttaaactaaatataaaccttaatacccattccccttgtatcaccttaccacaattacccccatttaaacttcctttaattttttggccncgcgcctagccganattttctttataatggaagagtccttaaagcgggcccctatatttcaaagcccatgcgcctatttccacttatgggaggggggatacactccccatggggcgggtttttaaaattggggcgggtggaagaacactggggaaccc

SEQ ID NO: 441199 - DNA, 4686 bp, Homo sapiens
  misc_feature (4408)..(4408): n is a, c, g, or t
  misc_feature (4417)..(4418): n is a, c, g, or t
  misc_feature (4420)..(4420): n is a, c, g, or t
  misc_feature (4559)..(4559): n is a, c, g, or t
ttacagcagaaaggccccaggtccggcgtgactccccggccgggcgacacaggccgagtcacttcctcgcccgtgcccgggtgtcctcatcgggggatgggtgcgccttccacatcctgcccaggactgaaggagccgggcccagcgagctcccgggaggtgtgtggacatcagccctgacggggaaggcgagccaggagcctgcaggcctgaaccagggtgatgctgaagatgatgaccttcttccaaggcctctagagccatcagcctgtgccaggcaccctcgacttgcctagaggcccccaaaagttgcagtccacatcagaggcagagtcagaggcctccatgtcggaggcctcctctgaggacctggtgccacccctggaggctggggcagccccatatagggaggaggaagaggcggcgaagaagaagaaggagaagaagaagaagtccaaaggcctggccaatgtgttctgcgtcttcaccaaagggaagaagaagaagggtcagcccagctcagcggagcccgaggacgcagccgggtccaggcaggggctggatggcccgccccccacagtggaggagctgaaggcggcgctggagcgcgggcagctggaggcggcgcggccgctgctggcgctggagcgggagctggcggcggcggcggcggcgggcggtgtgagcgaggaggagctggtgcggcgccagagcaaggtggaggcgctgtacgagctgctgcgcgaccaggtgctgggcgtgctgcggcggccgctggaggcgccgcccgagcggctgcgccaggcgctggccgtggtggcggagcaggagcgcgaggaccgccaggcggcggcggcggggccggggacctcggggctggcggccacgcgcccgcggcgctggctgcagctgtggcggcgcggcgtggcggaggcggccgaggagcgcatgggccagcggccggccgcgggcgccgaggtccccgagagcgtctttctgcacttgggccgcaccatgaaggaggacctggaggccgtggtggagcggctgaagccgctgttccccgccgagttcggcgtcgtggcggcctacgccgagagctaccaccagcacttcgcggcccacctggccgccgtggcgcagttcgagctgtgcgagcgcgacacctacatgctgctgctctgggtggagaacctctaccccaatgacatcatcaacagccccaagctggtgggtgagctgcagggtatggggctcgggagcctcctgccccccaggcagatccgactgctggaggccacattcctgtccagtgaggcggccaatgtgagggagttgatggaccgagctctggagctagaggcacggcgctgggctgaggatgtgcctccccagaggctggacggccactgccacagcgagctggccatcgacatcatccagatcacctcccaggcccaggccaaggccgagagcatcacgctggacttgggctcacagataaagcgggtgctgctggtggagctgcctgcgttcctgaggagctaccagcgcgcctttaatgaatttctggagagaggcaagcagctgacgaattacagggccaatgttattgccaacatcaacaactgcctgtccttccggatgtccatggagcagaattggcaggtaccccaggacaccctgagcctcctgctgggccccctgggtgagctcaagagccacggctttgacaccctgctccagaacctgcatgaggacctgaagccactgttcaagaggttcacgcacacccgctgggcggcccctgtggagaccctggaaaacatcatcgccactgtagacacgaggctgcctgagttctcagagctgcagggctgtttccgggaggagctcatggaggccttgcacctgcacctggtgaaggagtacatcatccaactcagcaaggggcgcctggtcctcaagacggccgagcagcagcagcagctggctgggtacatcctggccaatgctgacaccatccagcacttctgcacccagcacggctccccggcgacctggctgcagcctgctctccctacgctggccgagatcattcgcctgcaggaccccagtgccatcaagattgaggtggccacttatgccacctgctaccctgacttcagcaaaggccacctgagcgctatcctggccatcaaggggaacctatccaacagtgaggtcaagcgcatccggagcatcttggacgtcagcatgggggcgcaggagccctcccggcccctattttcccttataaaggttggttagcttttcctgtggcctgacctgcctgtgagtgcccagcaagccttgggcacaccccgctgggagctgttaagagcagcgctggttctcggttcctcccgggtctcctgtgctctgatgctacttctgcctagccctggcggaggtgcaggccctgtcagctggaactggacagaccttggtttgtttacatgtccgatgggggcaggagctcccatcctgggcagccaaccaggcaacaccaaggactctttgtaaacgatagctgatcgtgtgcacgcaaggaaagaaccaggagggagagtgcagccaggctcagggatccccggacacctctgtccagagcccctccacagtcggcctcatgactgtcctcctcgtgggtggggccgagggccctcttcagctctctggagacaggggccgagcctcacccatctgccctctgcagcccagggccgccgtgagcgggattcagcaatggtggaatggaagacagaactggaagagaaagaaggaaaagatgagctctcgtctggcaggggcttttagggtcctgtggcgagctgtgagcaccgccagcgttagacgtcacatccaggtggccccacggcccctacaggctggccctgcaatggggccctgagccctccctcttcatcccccaaggcctcaactagagggtggtcccccgagggcttggtgtctactaccgaagggcccaagacctcctgggtcctctcaggctcccccttccccaaggcagggacaggccctgggggtgccaccgtgggccctgccacccagaagtctggctgaggtctgggcaggggcagggcaagcttgacctctcactgttgaccctttggcctctgtatttgtttcctattgccgtgacaggtttccacaaacttcgtggatcaaaacgaggtcttccagttctgcgggtcagaaggctgacccggggctcaaatctgggtgtcggcagtcctgcactccttctggaggctctaggggagaattcatttctggccttttcatttttagaggctgaccgtaattcttgacttcaggctcctccatcttcagagccagctgtgggtagttgaatctttttcccgtcacctcattgaggcctcccctctcctgcctccctccaccacttttttttttttttttttgagacagggtcttgctgtgttgcccaggctggagtgcagtggcctggtcatggcatcaaggctcactgcagcctggacctcctggttcaagtgatcctcttgtctcagtcccctgagacaatcccccacgcccagctacatattttttgtggatacagggtctcattctgttgcctaggcttgtctggaactcctgggctcaagggatcttgtagccttagcctcctaaagtgctgggattataggcatgagtcactgtacccggcctgctctaccgcttttaaggacgcttatgatcacattgcgcctacccagagaacccaggtcgtctttctattttcaggtcagctgattagccaccttagttccatctgcaactttagttcccactggctgtgtaacctaacatagtcacaggctctggggactgtcacgtggacatctttgggaggccgttattctgcccaccgcaccctccgttcatcccctgccctgccgggcacctcgctctaccccaggaaaatgtgagctcgttttcctgctcggcatgtgctccccctaaggctctgctcctccctgggcctgaaagttccttctcagcctgagagggggcccttcggatctcaggcatgactcagcccggctgatgcctctgcagtgctgagtcaggatttggggccggctctcttgggtctgtccccttttcccaggtactgccttacaaagctgtggccaggaagtggccggtataaaggatgcccaaggtctttgtacgtgtgtaggagttagcgtgtttgatattgttaatataataataattattttttagagtactgcttttgtatgtatgttgaacaggatccaggtttttatagcttgatataaaacagaattcaaaagtgaaaaaaaaaaaaaaaaanaaaaaaaannanaaaaaaaaaaaaaaaaaaaaaaaaaaaaaaaaaaaaaaaaaaaaaaaaaaaaaaaaaaaaaaaaaataaaaaaaaataataatttttaaaaaaataaaaattatttaatttttattaattttactatttaaattatttnttattattaatattttacaatatttaattccttttctttaaaattcttaatttttctaatttcatttaattctataacatatctatttaatctctatttccctattattaaatttcttttactaact

SEQ ID NO: 441200 - DNA, 4279 bp, Homo sapiens
ttacagcagaaaggccccaggtccggcgtgactccccggccgggcgacacaggccgagtcacttcctcgcccgtgcccgggtgtcctcatcgggggatgggtgcgccttccacatcctgcccaggactgaaggagccgggcccagcgagctcccgggaggtgtgtggacatcagccctgacggggaaggcgagccaggagcctgcaggcctgaaccagggtgatgctgaagatgatgaccttcttccaaggcctctagagccatcagcctgtgccaggcaccctcgacttgcctagaggcccccaaaagttgcagtccacatcagaggcagagtcagaggcctccatgtcggaggcctcctctgaggacctggtgccacccctggaggctggggcagccccatatagggaggaggaagaggcggcgaagaagaagaaggagaagaagaagaagtccaaaggcctggccaatgtgttctgcgtcttcaccaaagggaagaagaagaagggtcagcccagctcagcggagcccgaggacgcagccgggtccaggcaggggctggatggcccgccccccacagtggaggagctgaaggcggcgctggagcgcgggcagctggaggcggcgcggccgctgctggcgctggagcgggagctggcggcggcggcggcggcgggcggtgtgagcgaggaggagctggtgcggcgccagagcaaggtggaggcgctgtacgagctgctgcgcgaccaggtgctgggcgtgctgcggcggccgctggaggcgccgcccgagcggctgcgccaggcgctggccgtggtggcggagcaggagcgcgaggaccgccaggcggcggcggcggggccgaggtccccgagagcgtctttctgcacttgggccgcaccatgaaggaggacctggaggccgtggtggagcggctgaagccgctgttccccgccgagttcggcgtcgtggcggcctacgccgagagctaccaccagcacttcgcggcccacctggccgccgtggcgcagttcgagctgtgcgagcgcgacacctacatgctgctgctctgggtggagaacctctaccccaatgacatcatcaacagccccaagctggtgggtgagctgcagggtatggggctcgggagcctcctgccccccaggcagatccgactgctggaggccacattcctgtccagtgaggcggccaatgtgagggagttgatggaccgagctctggagctagaggcacggcgctgggctgaggatgtgcctccccagaggctggacggccactgccacagcgagctggccatcgacatcatccagatcacctcccaggcccaggccaaggccgagagcatcacgctggacttgggctcacagataaagcgggtgctgctggtggagctgcctgcgttcctgaggagctaccagcgcgcctttaatgaatttctggagagaggcaagcagctgacgaattacagggccaatgttattgccaacatcaacaactgcctgtccttccggatgtccatggagcagaattggcaggtaccccaggacaccctgagcctcctgctgggccccctgggtgagctcaagagccacggctttgacaccctgctccagaacctgcatgaggacctgaagccactgttcaagaggttcacgcacacccgctgggcggcccctgtggagaccctggaaaacatcatcgccactgtagacacgaggctgcctgagttctcagagctgcagggctgtttccgggaggagctcatggaggccttgcacctgcacctggtgaaggagtacatcatccaactcagcaaggggcgcctggtcctcaagacggccgagcagcagcagcagctggctgggtacatcctggccaatgctgacaccatccagcacttctgcacccagcacggctccccggcgacctggctgcagcctgctctccctacgctggccgagatcattcgcctgcaggaccccagtgccatcaagattgaggtggccacttatgccacctgctaccctgacttcagcaaaggccacctgagcgctatcctggccatcaaggggaacctatccaacagtgaggtcaagcgcatccggagcatcttggacgtcagcatgggggcgcaggagccctcccggcccctattttcccttataaaggttggttagcttttcctgtggcctgacctgcctgtgagtgcccagcaagccttgggcacaccccgctgggagctgttaagagcagcgctggttctcggttcctcccgggtctcctgtgctctgatgctacttctgcctagccctggcggaggtgcaggccctgtcagctggaactggacagaccttggtttgtttacatgtccgatgggggcaggagctcccatcctgggcagccaaccaggcaacaccaaggactctttgtaaacgatagctgatcgtgtgcacgcaaggaaagaaccaggagggagagtgcagccaggctcagggatccccggacacctctgtccagagcccctccacagtcggcctcatgactgtcctcctcgtgggtggggccgagggccctcttcagctctctggagacaggggccgagcctcacccatctgccctctgcagcccagggccgccgtgagcgggattcagcaatggtggaatggaagacagaactggaagagaaagaaggaaaagatgagctctcgtctggcaggggcttttagggtcctgtggcgagctgtgagcaccgccagcgttagacgtcacatccaggtggccccacggcccctacaggctggccctgcaatggggccctgagccctccctcttcatcccccaaggcctcaactagagggtggtcccccgagggcttggtgtctactaccgaagggcccaagacctcctgggtcctctcaggctcccccttccccaaggcagggacaggccctgggggtgccaccgtgggccctgccacccagaagtctggctgaggtctgggcaggggcagggcaagcttgacctctcactgttgaccctttggcctctgtatttgtttcctattgccgtgacaggtttccacaaacttcgtggatcaaaacgaggtcttccagttctgcgggtcagaaggctgacccggggctcaaatctgggtgtcggcagtcctgcactccttctggaggctctaggggagaattcatttctggccttttcatttttagaggctgaccgtaattcttgacttcaggctcctccatcttcagagccagctgtgggtagttgaatctttttcccgtcacctcattgaggcctcccctctcctgcctccctccaccacttttttttttttttttttgagacagggtcttgctgtgttgcccaggctggagtgcagtggcctggtcatggcatcaaggctcactgcagcctggacctcctggttcaagtgatcctcttgtctcagtcccctgagacaatcccccacgcccagctacatattttttgtggatacagggtctcattctgttgcctaggcttgtctggaactcctgggctcaagggatcttgtagccttagcctcctaaagtgctgggattataggcatgagtcactgtacccggcctgctctaccgcttttaaggacgcttatgatcacattgcgcctacccagagaacccaggtcgtctttctattttcaggtcagctgattagccaccttagttccatctgcaactttagttcccactggctgtgtaacctaacatagtcacaggctctggggactgtcacgtggacatctttgggaggccgttattctgcccaccgcaccctccgttcatcccctgccctgccgggcacctcgctctaccccaggaaaatgtgagctcgttttcctgctcggcatgtgctccccctaaggctctgctcctccctgggcctgaaagttccttctcagcctgagagggggcccttcggatctcaggcatgactcagcccggctgatgcctctgcagtgctgagtcaggatttggggccggctctcttgggtctgtccccttttcccaggtactgccttacaaagctgtggccaggaagtggccggtataaaggatgcccaaggtctttgtacgtgtgtaggagttagcgtgtttgatattgttaatataataataattattttttagagtactgcttttgtatgtatgttgaacaggatccaggtttttatagcttgatataaaacagaattcaaaagtga

SEQ ID NO: 441201 - DNA, 2681 bp, Homo sapiens
ttacagcagaaaggccccaggtccggcgtgactccccggccgggcgacacaggccgagtcacttcctcgcccgtgcccgggtgtcctcatcgggggatgggtgcgccttccacatcctgcccaggactgaaggagccgggcccagcgagctcccgggaggtgtgtggacatcagccctgacggggaaggcgagccaggagcctgcaggcctgaaccagggtgatgctgaagatgatgaccttcttccaaggcctctagagccatcagcctgtgccaggcaccctcgacttgcctagaggcccccaaaagttgcagtccacatcagaggcagagtcagaggcctccatgtcggaggcctcctctgaggacctggtgccacccctggaggctggggcagccccatatagggaggaggaagaggcggcgaagaagaagaaggagaagaagaagaagtccaaaggcctggccaatgtgttctgcgtcttcaccaaagggaagaagaagaagggtcagcccagctcagcggagcccgaggacgcagccgggtccaggcaggggctggatggcccgccccccacagtggaggagctgaaggcggcgctggagcgcgggcagctggaggcggcgcggccgctgctggcgctggagcgggagctggcggcggcggcggcggcgggcggtgtgagcgaggaggagctggtgcggcgccagagcaaggtggaggcgctgtacgagctgctgcgcgaccaggtgctgggcgtgctgcggcggccgctggaggcgccgcccgagcggctgcgccaggcgctggccgtggtggcggagcaggagcgcgaggaccgccaggcggcggcggcggggccgaggtccccgagagcgtctttctgcacttgggccgcaccatgaaggaggacctggaggccgtggtggagcggctgaagccgctgttccccgccgagttcggcgtcgtggcggcctacgccgagagctaccaccagcacttcgcggcccacctggccgccgtggcgcagttcgagctgtgcgagcgcgacacctacatgctgctgctctgggtggagaacctctaccccaatgacatcatcaacagccccaagctggtgggtgagctgcagggtatggggctcgggagcctcctgccccccaggcagatccgactgctggaggccacattcctgtccagtgaggcggccaatgtgagggagttgatggaccgagctctggagctagaggcacggcgctgggctgaggatgtgcctccccagaggctggacggccactgccacagcgagctggccatcgacatcatccagatcacctcccaggcccaggccaaggccgagagcatcacgctggacttgggctcacagataaagcgggtgctgctggtggagctgcctgcgttcctgaggagctaccagcgcgcctttaatgaatttctggagagaggcaagcagctgacgaattacagggccaatgttattgccaacatcaacaactgcctgtccttccggatgtccatggagcagaattggcaggtaccccaggacaccctgagcctcctgctgggccccctgggtgagctcaagagccacggctttgacaccctgctccagaacctgcatgaggacctgaagccactgttcaagaggttcacgcacacccgctgggcggcccctgtggagaccctggaaaacatcatcgccactgtagacacgaggctgcctgagttctcagagctgcagggctgtttccgggaggagctcatggaggccttgcacctgcacctggtgaaggagtacatcatccaactcagcaaggggcgcctggtcctcaagacggccgagcagcagcagcagctggctgggtacatcctggccaatgctgacaccatccagcacttctgcacccagcacggctccccggcgacctggctgcagcctgctctccctacgctggccgagatcattcgcctgcaggaccccagtgccatcaagattgaggtggccacttatgccacctgctaccctgacttcaggtgagaacctggggcacctcaggaccactgtcacatcactgtggccaaggcctcacagggctggcattgggaacccagatcctggcagctgcccacgtgccagtcactgtgtgaacctcaccaggggctcattcttgtggccttcaccacagcactacgaggacaatacttcccattcccgtttcacagaggaggcctggagagctcacaggatgtgtccaaggtgacacggctagttagtgtctggctgcatggcccacactcttagctttacctgacactgcctctcacaggggagactgagaccagagaggccagcttcacccagcctggggggcctctgcggcctaggcctatgctctgggaccagggctcatattcgggagtggaggcttagcccttggctgcctgaagttctggtgggccagggacattgtttcttcctgggctgggtcctctgacatgttagggtaagtttgaatgggtcttgacagggttgaccccagcttcgccaagtccagtccctgtctgatccattccacccattcattcattcacccaccatacaagcacccatctgctcatccacccattccttcacccatctgctatccgtctatcttct

SEQ ID NO: 441202 - DNA, 2966 bp, Homo sapiens
tgtattgtgactatcagcattctggtgcaaatgaacttttctccatcatcgactgtggaaaattgatacttttaaagcatattcttctatgagcacaggtcctcctagtgaagcttagtttgacaaagggtgtcatatgctttcctaacctgatttgtagttaacattcacagagcctacattttctcattagggttatgatgctcagtatctttccaagtgccaggcacgggcttccttttctgatcaaacataccattttttgtatttcacaactatagacagtcacttctgcagtcccaatttaaaaatgcagaactgctttatccaagaatgctgaaaaatactgttctatccaggtttcctaaactataaaagcagattttgcttttgtttgttaatcataggcatggccgagcattgtggattagcctgaggcttaaaatcagatgcatgtctggtaagatgaccactgtctcactatcaagagcctgcagagccattttccagacctgtgattgcccagaacacatagtccccacgtttctaatttggagcaaatctaaaaggtgctgagggattggacagctctgactttcctcgagactatggatatagtccttctcagattagctggaaatggggacagagttctcatttatcccagatatatacattggcttttttggaatctatagattgagattttgatgaatttatattggttttaatgagacccaaatgactctctcttaacaattcaagcagtagacaaagttgctcacaaatacagaaaacatctttttgtctacttcgcaagtctcaaaacgtgataatatttaagcccatttgtagaagaaatcttgtatatactattattacaccttgatatctatacaaaacatcacttgtattaaaatatatagataactttctggcatttagaattttgttccattcatttgatttgttcatctgagaattttttttttttgcctgaaaacccattaaaagaaaacgtgccttctgtataagtttatgtttattcctacattttattcatttttaatgtatgggtaattggtggcacgtgactttacataatgactttctagactctgaaaaaaatgcttttatcatttttgcaattcagacaagggtaaacattttactttatgtaattgccacatcccaagatgtaaaacggcagtaatttatgaccacatatggaagaaattcttcaaatagctaccttacatttctgcgtatatatgaaaactgagtgatatttctcagtgtatttgcttgcatttgaatggttcaattctgttgtgtttatgtagaaaattcacaaatctgttcatttaattttttaatttgagaatttttatttcttttgactgaaaacacattagaacctatgagtaaattctgaaggttttaagatttacttcagcttgtcaccagtttcaaataaatccctaataggtaacaagtaaaatacaaattcttgtctactttcatgtggttttaaatggcagggacttcgctgagtcagtaagtataatcactctagtttattcaaggatgtgtggcaactttcaacttccatacgtatatatgtatgtatggaaggccatgtcaatactagtatcattggatataactttgattcttaatcagagggcaaattcattagagaagaatctttagtagatacacagactaatatttgtgtggaggttcttttgaccaattttattcctaagaataaacaaacccctacagttaaaatgcaaagatgcctgtcatctaagtattgaaagaatttttgcctttcaagagttgttttttaaaaatttaataaattcataaaaaagactcatatctttgcaaacaaaagaagggcagatactgggcttctacatgctatccttaagagcttctccccctcacccattcctagtgctcttggtatacacttgggaaaataatgtcctccaggagaaagtgttagagggaactaacattttaggaatgcttattcagaaaaaaatcctagagttgattcattgttttcctccatcctgcaaaagaagatccctttgttaagcagctcacttggaaatatgattcttggagtcaatgatctctaaacaaactggattatcaactatttacaacgtctatacagtataaactacctcacttgcctttcttgggaaaaaaaaaatgaatggactttaacaattgttgttacaaactgtgcctgaatcttattatttaaatcacttcagttagctttcagtgtatgtttaataatatacatttaatgatgaaaaatattttcagcaaagctttaaaaccagaaatactgtgtaactgtgatctatgtggtatactctgagagaattctgtgtcctgctcattgtcttgagtttctaaccatgtgcagatgcaagcgttcgggagtaggaattaatgtccatcttttctttcaggcattttcatctgctgtccacgtatttcacttgactgaaagctcatatgagttaaaatgtcccttcttcctagcgagcatatttcaactgttcttcataaatgtttatgtgccttaaaagactttatgttaaaggattaaatagtttctctgacaggcagtttttaactgttttccacaaataaaaataatatgtcatgggattaaaatgtttgttttcaagcatttttaacagttttacacacttacatacaccttaattaaaaattttttttctgtcagacatttaccattttctaaaactaatttgacaaatcatgacactagaaaacgccaatgttttatgtctttgcccatctcaaaagctaatattgattcttctgtcccatcagctttcattgttaagtagaatatgtatgttgcattttatccataagaaataaagagaaaaaaactaaaaaaaaaa

SEQ ID NO: 441203 - DNA, 161 bp, Homo sapiens
  misc_feature (10)..(11): n is a, c, g, or t
actatacggnngcgagaagaccacagaatggggactatggaagacagcaggagctcatttcctctgcacattttggctgttagacctgtgtgtgtgtttaaaaaaagagaagtcagtgctcactttttgtatttaaatattaaaaatgattccaactcaaa

SEQ ID NO: 441204 - DNA, 1110 bp, Homo sapiens
ggacgcgtgggtcgacccacgcgtcggacccacgcgatggctgccgccgtcgctgctgccggtgcaggggaaccccagtccccggacgaattgctcccgaaaggcgacgcggagaagcctgaggaggagctggaggaggacgacgatgaggagctagatgagaccctgtcggagagactatggggcctgacggagatgtttccggagagggtccggtccgcggccggagccacttttgatctttccctctttgtggctcagaaaatgtacaggttttccagggcagccttgtggattgggaccacttcctttatgatcctggttcttcccgttgtctttgagacggagaagttgcaaatggagcaacagcagcaactgcagcagcggcagatacttctaggacctaacacagggctctcaggaggaatgccaggggctctaccctcacttcctggaaagatctagattgttattgctgtttgagctgtctcagtgggataagtttgaaattcaagtgtttgaactgctgataatttggattttttttttttttaactttggcacattgatctatctaaacctggtggggagaattatccccacattgtctcatggaaagactcaacttgcaactgtgccctccacactatccttacttctgtctccactctgataccagagtgcagccatgcagatggttattccagctctggtcacccgactcctttcaccaaattgctcctaactggaagatctcactttccccttgtggggtaggaaccgatgccagtgggagggatgtgcccctgaccattaacgactgttttttttttttttttttaaagaatggagttgttggggcaggacatgcacacaatgtgaaacagacaaaatgcattacacctgtagtgtaaagtggccactatgaatccctatgtatgagaggagggaggcaggctgcagcttcagccacagaatggggactatggaagacagcaggagctcatttcctctgcacattttggctgttagacctgtgtgtgtgtttaaaaaaagagaagtcagtgctcactttttgtatttaaatattaaaaatgattccaactcaaa

SEQ ID NO: 441205 - DNA, 1513 bp, Homo sapiens
  misc_feature (1378)..(1378): n is a, c, g, or t
acctccgagcgcgcttccggtgtcccctacagtcatggctgccgccgtcgctgctgccggtgcaggggaaccccagtccccggacgaattgctcccgaaaggcgacgcggagaagcctgaggaggagctggaggaggacgacgatgaggagctagatgagaccctgtcggagagactatggggcctgacggagatgtttccggagagggtccggtccgcggccggagccacttttgatctttccctctttgtggctcagaaaatgtacaggttttccagggcagccttgtggattgggaccacttcctttatgatcctggttcttcccgttgtctttgagacggagaagttgcaaatggagcaacagcagcaactgcagcagcggcagatacttctaggacctaacacagggctctcaggaggaatgccaggggctctaccctcacttcctggaaagatctagattgttattgctgtttgagctgtctcagtgggataagtttgaaattcaagtgtttgaactgctgataatttggattttttttttttttaactttggcacattgatctatctaaacctggtggggagaattatccccacattgtctcatggaaagactcaacttgcaactgtgccctccacactatccttacttctgtctccactctgataccagagtgcagccatgcagatggttattccagctctggtcacccgactcctttcaccaaattgctcctaactggaagatctcactttccccttgtggggtaggaaccgatgccagtgggagggatgtgcccctgaccattaacgactgttttttttttttttttttaaagaatggagttgttggggcaggacatgcacacaatgtgaaacagacaaaatgcattacacctgtagtgtaaagtggccactatgaatccctatgtatgagaggagggaggcaggctgcagcttcagccacagaatggggactatggaagacagcaggagctcatttcctctgcacattttggctgttagacctgtgtgtgtgtttaaaaaaagagaagtcagtgctcactttttgtatttaaatattaaaaatgattccaactcaaaaaaaaaaaaaaaaaaaaaaaaaaaaaatttttggggggcctgggcccggagaaagagttttttctaaaaccctttgcgttgtgggggcgcgggggccccacgttaggtgttcagagtgtgaacccgtggggtcctataacggtgttttcctcgtagagggagaatccgcggggtccataggaaacatgaggcgcgctggggatattctctcccacctatataaaaaaaagagcgccgcgcgggggacaaccgcgcgaggcgtttttttgngaaaacatatatcccgagagaggggaggtttgcgaggagggtacaataacggggggggcttctttaccaccgagggagagtccacaaaggagaaattctccgatattttcaatttaaggcccccatccctggtgg

SEQ ID NO: 441206 - DNA, 1191 bp, Homo sapiens
acctccgagcgcgcttccggtgtcccctacagtcatggctgccgccgtcgctgctgccggtgcaggggaaccccagtccccggacgaattgctcccgaaaggcgacgcggagaagcctgaggaggagctggaggaggacgacgatgaggagctagatgagaccctgtcggagagactatggggcctgacggagatgtttccggagagggtccggtccgcggccggagccacttttgatctttccctctttgtggctcagaaaatgtacaggttttccagggcagccttgtggattgggaccacttcctttatgatcctggttcttcccgttgtctttgagacggagaagttgcaaatggagcaacagcagcaactgcagcagcggcagatacttctaggacctaacacagggctctcaggaggaatgccaggggctctaccctcacttcctggaaagatctagattgttattgctgtttgagctgtctcagtgggataagtttgaaattcaagtgtttgaactgctgataatttggattttttttttttttaactttggcacattgatctatctaaacctggtggggagaattatccccacattgtctcatggaaagactcaacttgcaactgtgccctccacactatccttacttctgtctccactctgataccagagtgcagccatgcagatggttattccagctctggtcacccgactcctttcaccaaattgctcctaactggaagatctcactttccccttgtggggtaggaaccgatgccagtgggagggatgtgcccctgaccattaacgacttttaaaaaaagggatttgtgggggcagagaattgcccccatggtggaaacagccaacaaagtgggcgttttaccacgcgtgggtagttgtataaagaggtggccacttattaaaatctccctttgtgttattgaagaagggcggggaacggcagggcgtgcagcttttcgagcccccagagatgaggggggccactagtggacagaacgagcggggagccctacatttcctctctgcaccatttgggggcgtgtaacacccgtggtgtgtgttggtgtcttcacaaaaaagagaagaacgctgggtggcccccccttttgtgggatttacaacttttttaaacactgtgatctcccccctgtgataaaaac

SEQ ID NO: 441207 - DNA, 1108 bp, Homo sapiens
agcgaagcggctgctttgggaggcggggttaggggccctgctgggccctgggtgccctagctccagtggggctcggcggctcccagtgccgcagcggggccaggaatggatgtcgctttttcggctaagacccgcgtctactccaccacagctagatgagaccctgtcggagagactatggggcctgacggagatgtttccggagagggtccggtccgcggccggagccacttttgatctttccctctttgtggctcagaaaatgtacaggttttccagggcagccttgtggattgggaccacttcctttatgatcctggttcttcccgttgtctttgagacggagaagttgcaaatggagcaacagcagcaactgcagcagcggcagatacttctaggacctaacacagggctctcaggaggaatgccaggggctctaccctcacttcctggaaagatctagattgttattgctgtttgagctgtctcagtgggataagtttgaaattcaagtgtttgaactgctgataatttggattttttttttttttaactttggcacattgatctatctaaacctggtggggagaattatccccacattgtctcatggaaagactcaacttgcaactgtgccctccacactatccttacttctgtctccactctgataccagagtgcagccatgcagatggttattccagctctggtcacccgactcctttcaccaaattgctcctaactggaagatctcactttccccttgtggggtaggaaccgatgccagtgggagggatgtgcccctgaccattaacgactgttttttttttttttttttaaagaatggagttgttggggcaggacatgcacacaatgtgaaacagacaaaatgcattacacctgtagtgtaaagtggccactatgaatccctatgtatgagaggagggaggcaggctgcagcttcagccacagaatggggactatggaagacagcaggagctcatttcctctgcacattttggctgttagacctgtgtgtgtgtttaaaaaaagagaagtcagtgctcactttttgtatttaaatattaaaaatgattccaactcaaa

SEQ ID NO: 441208 - DNA, 528 bp, Homo sapiens
  misc_feature (448)..(449): n is a, c, g, or t
acctccgagcgcgcttccggtgtcccctacagtcatggctgccgccgtcgctgctgccggtgcaggggaaccccagtccccggacgaattgctcccgaaaggcgacgcggagaagcctgaggaggagctggaggaggacgacgatgaggagctagatgagaccctgtcggagagactatggggcctgacggagatgtttccggagagggtccggtccgcggccggagccacttttgatctttccctctttgtggctcagaaaatgtacaggttttccagggcagccttgtggattgggaccacttcctttatgatcctggttcttcccgttgtctttgagacggagaagttgcaaatggagcaacagcagcaactgcagcagcggcagatacttctaggacctaacacagggcttctcagtgaggatatggccaggtgctttcttacnncctcatcttctcttgggaaaaaaggattccgtaggatatgccctactttggaatagtctttgaagaagttctttgtata

SEQ ID NO: 441209 - DNA, 509 bp, Homo sapiens
agctctctaggcctgtatgatgccttacacccctccttttcttttccagatacttctaggacctaacacagggctctcaggaggaatgccaggggctctaccctcacttcctggaaagatctagattgttattgctgtttgagctgtctcagtgggataagtttgaaattcaagtgtttgaactgctgataatttggattttttttttttttaactttggcacattgatctatctaaacctggtggggagaattatccccacattgtctcatggaaagactcaacttgcaactgtgccctccacactatccttacttctgtctccactctgataccagagtgcagccatgcagatggttattccagctctggtcacccgactcctttcaccaaattgctcctaactggaagatctcactttccccttgtggggtaggaaccgatgccagtgggagggatgtgcccctgaccattaacgactgttttttttttttttttttaaagaatgg

SEQ ID NO: 441210 - DNA, 575 bp, Homo sapiens
aatttggattttttttttttttaactttggcacattgatctatctaaacctggtggggagaattatccccacattgtctcatggaaagactcaacttgcaactgtgccctccacactatccttacttctgtctccactctgataccagagtgcagccatgcagatggttattccagctctggtcacccgactcctttcaccaaattgctcctaactggaagatctcactttccccttgtggggtaggaaccgatgccagtgggagggatgtgcccctgaccattaacgactgttttttttttttttttttaaagaatggagttgttggggcaggacatgcacacaatgtgaaacagacaaaatgcattacacctgtagtgtaaagtggccactatgaatccctatgtatgagaggagggaggcaggctgcagcttcagccacagaatggggactatggaagacagcaggagctcatttcctctgcacattttggctgttagacctgtgtgtgtgtttaaaaaaagagaagtcagtgctcactttttgtatttaaatattaaaaatgattccaact

SEQ ID NO: 441211 - DNA, 1108 bp, Homo sapiens
acctccgagcgcgcttccggtgtcccctacagtcatggctgccgccgtcgctgctgccggtgcaggggaaccccagtccccggacgaattgctcccgaaaggcgacgcggagaagcctgaggaggagctggaggaggacgacgatgaggagctagatgagaccctgtcggagagactatggggcctgacggagatgtttccggagagggtccggtccgcggccggagccacttttgatctttccctctttgtggctcagaaaatgtacaggttttccagggcagccttgtggattgggaccacttcctttatgatcctggttcttcccgttgtctttgagacggagaagttgcaaatggagcaacagcagcaactgcagcagcggcagatacttctaggacctaacacagggctctcaggaggaatgccaggggctctaccctcacttcctggaaagatctagattgttattgctgtttgagctgtctcagtgggataagtttgaaattcaagtgtttgaactgctgataatttggattttttttttttttaactttggcacattgatctatctaaacctggtggggagaattatccccacattgtctcatggaaagactcaacttgcaactgtgccctccacactatccttacttctgtctccactctgataccagagtgcagccatgcagatggttattccagctctggtcacccgactcctttcaccaaattgctcctaactggaagatctcactttccccttgtggggtaggaaccgatgccagtgggagggatgtgcccctgaccattaacgactgttttttttttttttttttaaagaatggagttgttggggcaggacatgcacacaatgtgaaacagacaaaatgcattacacctgtagtgtaaagtggccactatgaatccctatgtatgagaggagggaggcaggctgcagcttcagccacagaatggggactatggaagacagcaggagctcatttcctctgcacattttggctgttagacctgtgtgtgtgtttaaaaaaagagaagtcagtgctcactttttgtatttaaatattaaaaatgattccaactcaaa

SEQ ID NO: 441212 - DNA, 1379 bp, Homo sapiens
acctccgagcgcgcttccggtgtcccctacagtcatggctgccgccgtcgctgctgccggtgcaggggaaccccagtccccggacgaattgctcccgaaaggcgacgcggagaagcctgaggaggagctggaggaggacgacgatgaggagctagatgagaccctgtcggagagactatggggcctgacggagatgtttccggagagggtccggtccgcggccggagccacttttgatctttccctctttgtggctcagaaaatgtacaggttttccagggcagccttgtggattgggaccacttcctttatgatcctggttcttcccgttgtctttgagacggagaagttgcaaatggagcaacagcagcaactgcagcagcggcagatacttctaggacctaacacagggctctcaggaggaatgccaggggctctaccctcacttcctggaaagatctagattgttattgctgtttgagctgtctcagtgggataagtttgaaattcaagtgtttgaactgctgataatttggattttttttttttttaactttggcacattgatctatctaaacctggtggggagaattatccccacattgtctcatggaaagactcaacttgcaactgtgccctccacactatccttacttctgtctccactctgataccagagtgcagccatgcagatggttattccagctctggtcacccgactcctttcaccaaattgctcctaactggaagatctcactttccccttgtggggtaggaaccgatgccagtgggagggatgtgcccctgaccattaacgactgttttttttttttttttttaaagaatggagttgttggggcaggacatgcacacaatgtgaaacagacaaaatgcattacacctgtagtgtaaagtggccactatgaatccctatgtatgagaggagggaggcaggctgcagcttcagccacagaatggggactatggaagacagcaggagctcatttcctctgcacattttggctgttagacctgtgtgtgtgtttaaaaaaagagaagtcagtgctcactttttgtatttaaatattaaaaatgattccaactcaaagtgtcatcctaagtaccttgaaatgagaccacgtcagagacatgtactgcccctcacattttctcacctaaaccagcagcacctccatcttaacagccataggcccaaattgtttccaagtgaaaattcatttttagccaagtacttcatagcaatctttgccctgaatttaggcagtcactttgagatccatcagcctaaaacaaaggattgggtctatgtacttctttagtctataatgacactgtgtaattataaagtatttgtaggg

SEQ ID NO: 441213 - DNA, 950 bp, Homo sapiens
acctccgagcgcgcttccggtgtcccctacagtcatggctgccgccgtcgctgctgccggtgcaggggaaccccagtccccggacgaattgctcccgaaaggcgacgcggagaagcctgaggaggagctggaggaggacgacgatgaggagctagatgagaccctgtcggagagactatggggcctgacggagatgtttccggagagggtccggtccgcggccggagccacttttgatctttccctctttgtggctcagaaaatgtacaggttttccagggcagccttgtggattgggaccacttcctttatgatcctggttcttcccgttgtctttgagacggagaagttgcaaatggagcaacagcagcaactgcagcagcggcagatacttctaggacctaacacagggctctcaggaggaatgccaggggctctaccctcacttcctggaaagatctagattgttattgctgtttgagctgtctcagtgggataagtttgaaattcaagtgtttgaactgctgataatttggattttttttttttttaactttggcacattgatctatctaaacctggtggggagaattatccccacattgtctcatggaaagactcaacttgcaactgtgccctccacactatccttacttctgtctccactctgataccagagtgcagccatgcagatggttattccagctctggtcacccgactcctttcaccaaattgctcctaactggaagatctcactttccccttgtggggtaggaaccgatgccagtgggagggatgtgcccctgaccattaacgactgttttttttttttttttttaaagaatggagttgttggggcaggacatgcacacaatgtgaaacagacaaaatgcattacactacaggtgtaatgcatttggtagacgcggccgggaaatttagtaagtag

SEQ ID NO: 441214 - DNA, 879 bp, Homo sapiens
ccctggaacacctgtcttttctgagccacaaagagggaaagatcaaaagtggctccggccgcggaccggaccacttcctttatgatcctggttcttcccgttgtctttgagacggagaagttgcaaatggagcaacagcagcaactgcagcagcggcagatacttctaggacctaacacagggctctcaggaggaatgccaggggctctaccctcacttcctggaaagatctagattgttattgctgtttgagctgtctcagtgggataagtttgaaattcaagtgtttgaactgctgataatttggattttttttttttttaactttggcacattgatctatctaaacctggtggggagaattatccccacattgtctcatggaaagactcaacttgcaactgtgccctccacactatccttacttctgtctccactctgataccagagtgcagccatgcagatggttattccagctctggtcacccgactcctttcaccaaattgctcctaactggaagatctcactttccccttgtggggtaggaaccgatgccagtgggagggatgtgcccctgaccattaacgactgttttttttttttttttttaaagaatggagttgttggggcaggacatgcacacaatgtgaaacagacaaaatgcattacacctgtagtgtaaagtggccactatgaatccctatgtatgagaggagggaggcaggctgcagcttcagccacagaatggggactatggaagacagcaggagctcatttcctctgcacattttggctgttagacctgtgtgtgtgtttaaaaaaagagaagtcagtgctcactttttgtatttaaatattaaaaatgattccaactcaaa

SEQ ID NO: 441215 - DNA, 2289 bp, Homo sapiens
cagtcaggggagaggtttaagaaatctatttctaatgcagctccctcaaaggaagcttttaagatgcgcagcctcaggaaaggtaaggaccgaacagtggctgaaggtgaggaatgtgccagggagatgggtgtggacatcattgccaggagcgagtctctgggccccatcagtgagctctactctgatgagctcagtgaaccagaacacgaggcagccaggccggtgtatcctccccatgaaggaagggaaatccccacccccgagcctttaaaagttacttttaaatctcaggtgaaagtagaggatgatgaatctcttttgttagatttaaagcactcatcgtaaagaggaattaagtatatcctaaatatgaatctcctaatcatgcagttttagtttgaatagtgtagtcgtctacatttctgtgccatgtaggaaaacataaatgtattttttttcttatatttaaaatcttgaagataatataaatattattatcactctttctcatggcagctgtggattttttagttcctttctcttgtccaccagaaaaatagtttcctaggttgggccagttacgtgtttggtaagggcaactttgcggccgtcatttgcaggagaactctaaatattggttaggattaatattgtggccagcctcaaaggggaataactcatgtgtgggttatatcgtccagatgttcagatcaacagatttgttagtaaattagcagtcacaccccttttttgatgctttcacattaaaaaattgaagttttggacttgagcatttggctctagtatcatagctttacttataagaaaaccctgggcaagtcatctgcttattctcatcagtaaaaatggagagggttggcctctgctgcctgcctcagaggactgttgtgatgatcaaaggaaatggtacacattctgggggaacaagaagcacacccagagaaaacaagcctcatcagttcctccaaaacagaatggaaagagttacaccttctgaaaaagccctcagcaccaatcaataaggtcctaggttggagagaaactaaagctggtcttcagaagccttttcacagaatcaagagtgaaaaataagtaaatgtttgggtgaccactttttcatcagactaactatatcttgggttttagttgggtctcaaaatgttccccagccagaccctttctaatttccttttgattaagatctttggtggactatagcactaaatttgtttaagcagtatgaggcataaaattgtgactatgtttctaaagtcggccctgatgcattgggtttggaaatgaccacaaatattcctgttttcctgagtgtacccttcagggtccagctgtccaaaacagtgttgataggagttcatcatagctgctttgggaggaagccagattctccttatcttttagctttagatcgtggaatccaggaagtagaacaatgtctattgttgctaaagaaagaaagaaatgggccgggtgtggtggctcacggggagtaatcccagcactttgcgaggccgaggtgggtgaatcacctgaggtcagaagttcacgaccagcctgaccaacatggcgaaaccctgactctactgaaaatacaaaaattagctgggcatggtgcatgcgcctgtcccagctactcaggaggctgagacaggagaattgcctgaacccaggaggcggaggttgcagtgagccgagattgtgccactgcactcaagcctgggcaaaagagccagactctgtttcaaaaaaaaagaaaaaaagaaaagaaagaaatggtagtactgattctgtacttgaaggatgtttaatgtagcatggtgttgtaatagagaagaaatgatgaaattgttgaatttgaagagttgggacaacgatcagctatcccactttttttctcactttcagatcagtttttggataatcatatggtagttaaaataataagtgtacacatatacacacaggcatacataaatcggctttaaaatatttgactcagttactcagatgtttgggtttgggagtctgattcagcatcatttcctcttcaccttgcatgaatacatgaaatcataatatcgttcatgttgttacctttttatattgaaaactaaagtgtatacaacattggataacactttcaaatgaataattttaaaatgtttttatgacattttggaaagatcttgggtgcctaatcacatattttcttaagaaccataataaatttgaatttaagaaaatgtt

SEQ ID NO: 441216 - DNA, 496 bp, Homo sapiens
gtaccccaccgcggggtggtgctctgactgcgggaaccgttgaagagctgcccccggggagtcagcgaggcgccactggtctcttagacatcttctcaagattatgctaagagaaatgactgcacccttttcctgagctatggcagtcagacctggcagtggtaactactctacagaactcccaaacctggcaaggatggtgcagattttggcagattatggctttgtccccacccagcactgatgatattatgaaatatgacaccttcaagtataagcaaccaaagaaaactagataaattggacctcataaagtaaaacaaacaaaaaccttttgcttcaaaggataccactaagcaagcgaaaagacaacacatagaatgtgagaaaaaggttgtaaatcctatatatgacaaggcacctgtatccagaataaagaacctcttaaaactcaacaataaaaacacaaataatctaattgtaaaatagcttacaa

SEQ ID NO: 441217 - DNA, 523 bp, Homo sapiens
tccccgcttgcttccctgcccgccctgtgtgatctaactgcaagccctttcccttaagagttggagcctgtttgtccaaccttgtgatcatttccttgtggtctcttagacatcttctcaagattatgctaagagaaatgactgcacccttttcctgagctatggcagtcagacctggcagtggtaactactctacagaactcccaaacctggcaaggatggtgcagattttggcagattatggctttgtccccacccagcactgatgatattatgaaacctatactacaagaaatgataatggaagttcttcaactgagcaagaaatgatattaacagaaaacttggatcttcagaagcaaatgaagaacatcagaaatgtagcaacagctgctgagaagagatgactaaaagctgaaaagtgaagaattaacactgatttcttggcagaagcagaagcttcaggactcctgaattgagggaatgatctaaattccaaggattatctctcagtgagaacaag

SEQ ID NO: 441218 - DNA, 5714 bp, Homo sapiens
  misc_feature (336)..(336): n is a, c, g, or t
  misc_feature (962)..(962): n is a, c, g, or t
atcagaacatggagactttcaccaaaggaattgctatataaaggaatcagtatgcagacagtttggggaaagataccttctccattgttgaatgggtttttccagtgtttaccttaattatgattgggtttcattaatcagtttatattcaagaggttagtcttcatccaggagacaacgggaagtcactgaaggagtttaggcaggggtggggtataatcagatctctgtttttgaaagatgtggtggtatgaaaactgtattagagggaacataagcaggaagccaaggcaacatttatgaatcagttctagtagtccacataatgactaatgnttgataaatagggataaagtttaaagaacaaaatctaatagggattgattcgatctatgttaccgctactcagattcccaccatatagctcatgtcgtttttctacatcaagtatcttattttctttataaagaagtgttccttaaaacggagtttagatttttccagaatggacaggacaaagaactttgtctttgcctaaacattgtcccgttagttctgtgactttcattttattgcagaaatacttgtatgaataagttcatatcaatttaaacagaaaagggcttggccaggaattggacaagcagtgtcagtgcagttgtttaaaatatagagcaaagaaaaagagcaaaggaacccatgtttgctgtaggttctctcttcttcagagaccagtttttactgaatgattccagagaggtgaaaatctccatattagagttctgaagtggggagacaattgcttttgccttagaagaagcaggttcacagttttatataaaataagataattatttcatctttacttgtgtgggttatgttttagtttgctttagaaacctgatagaattctcatttgagaagttaaaagatactcttggactatcccaagcactattctngtataagtatctttaaaagttgaacgaatgccaagctatttacacaaatacaagtctgctctttaggtgcaattggcacttgatattggtaaggtgtaatttttaacagcctttgaaacctgttatagtggcttcccctttcaaggaagatttcatttggatacatacaaaacagatatgacaacacagatttgtttttggaaggtagatccagctttcttaattgtctgagtttccttaaattcaacctttttacatttctgttctttaggtctgccaaaatgtctgaaagatcagatctccttcacttcaagtttgaaaattatggagattcaatgttacaaaaaatgaacaaattaagagaagagaataaattttgtgatgttacagttctcatagatgatattgaggtacagggacataaaattgtgtttgctgcaggttcccccttcttaagagaccaatttttactgaatgattccagagaggtgaaaatctccatattacagagttccgaagtggggagacaattgctcttatcctgttatagtggtgtgctggaattccctgagatggaactggtaaattacttgactgctgcaagttttcttcagatgagccacattgtagaacggtgcacacaggccctgtggaagtttataaagccaaaacaaccaatggatagtaaagagggatgtgaaccacagagtgcttctccccagtcaaaagaacagcagggagatgccagaggctccccaaagcaggactcaccttgtattcatccatctgaagacagtatggatatggaggacagtgatattcagattgttaaggtagaatctattggggatgtatcagaggttagaagtaaaaaagatcagaaccagtttatttcttctgaacccactgctttacattcatcagagccccagcactccctgataaattcaactgtggaaaacagagtaagtgaaatagaacaaaaccatctccacaattatgccctttcttatacaggcagtgataacatcatcatggcctcaaaagatgtctttggccctaatattcgaggtgtagacaaaggcctacagtggcatcaccagtgcccaaagtgtaccagggtgtttcgtcacctggagaactacgccaaccatttaaaaatgcacaaactctttatgtgtctactctgcggcaagactttcactcagaaaggcaaccttcatcgacacatgcgtgtgcatgccggaattaaacctttccagtgtaaaatctgtgggaaaaccttttctcagaagtgttccttacaggatcatcttaaccttcacagtggagataagccccataaatgtaactattgtgatatggtttttgcacataaaccagttttgaggaaacaccttaaacagctgcatggcaaaaacagctttgataatgccaatgagagaaatgtacaagacctcacagtggattttgattcttttgcatgtacaacagtcacagactctaaagggtgtcagccacaacccgatgcaacacaggtcctggatgcaggtaaactggcccaagctgtcctgaacttaagaaatgatagtacttgtgtgaattgagtaggggcttcatgctcacaactcgaactgactgacaatgtggcaatagtcttagtctttttaggagtgattttgctagtttgacttctccaaagcctctgtgtaggtggtagggagtgagtcaaagcactaatagaccaggcaacttaccacttggagtggatttgccttacttttgccctctcccattttctgttttgagttatttatcttgtaaagtctgttttcctttcccaaggaataattccttttgtctacctaacattgacttatgtcttagactgacactgttttaggcttttcactaggcacattccgaaggtaccaacaagttaataacatcacctactctccactaatagatgctatgctaagagaagtgaataatctttctttggtagaaaataggctgagatataaggtgatattgctattgacctgaaaatgtgatagaacttctggttgcctattgattattcctccatgtctgataaatgaatctgcttcctaccatttgtacttgtcttggagctggctataaagaagtatgctggtttgttatgtactcttttcaacagtatcatagcccaacttcatctcattgaattgttcacatataccagagtactctctcttgaggaacacctgcaggcagatagttagggatgaccatgaggagcataatcaacagggatagaagtacacttatacaacagcacttacatgggcggtttctctggtagcatgtcccataagaggccatatgcttataattaatgtgtaacttgttgatgcttttgagatcaggactgctccaggcacgctaaaaatgtgctaaagtatagtgggctctctaaaaagaggctatttgggagtctctgaattttgtttcagagtttagccatcagaaaggtgagtttggccatcagagttttgtcctgtgcaccataaaagtctctgaattttcgtttcctcatgtaccttaatttctaaaacggatgataaaagttaggttggacacagaaggggcaatcaaatttctgtattcagatacctcttaaaggtacactgtgccaccttgctgcctttgattgcaaatacaaagttaattttcaaaaaggaaaaacaaaacagctctttttcctaaaacacatgttgtacttcagacctaaaattctaagtcttatttgtttctcacccatgagttagatttaggtaatagtattagtagagtccttagagaatcttaagaggtcatttactccacctctttcattttaaattggggtatccaaagcctgaagaggtggcctggccaatattgaccaaggtataactaaatatgagctagcatcttcttccttcttctcgctatcccttggctttaaaagatttagtacatgaagaataatgcattagcaaaaagctcctagtttgtgtttcccctttgtgtctccctgttggctttctgagacaacctgaattttgccaacaaaatatcgcagagggatttatattaattattttttagttagatgaatattatattcttcccatccaagtgagtgatttgctaggtttgtttagggagggaaaaagcaagaataatgtgagaagaatctaaatgcgaagttgattttgtgtggaaaactgtttattagtttccatcaggattttctgtttttatttttgagctatgagagtgcatgcagatttgaaaaattaggcttgcatagtcagaggggatcttcaattgttatatttgatacgtttacatgtatcattgttatcatatgtaaattatcatcatgtgagtcagatgtgaagtatgatttttgtcttttgttcaaatatttaaaatgataatacagttgagtggtaagactaataggtaccttatgcctaacatcactcattatatggtctaatgatgcttcctagcattgtgatttttacatgatccagccaaagagtaccaattctatgcaatagtgagactctaccctgtcaaccaaacagcattttttggtattttctgtcaacatcatttcttcacagggaaatttcaagttggagtgcttcgtttgctcacattcatgtcttgtttttgttactggtttgaagactaaaaggcacgggttcaaataagattggtctctttggttggagactatttctgggttcattcagttgttcaagaaacattagttaagcacctactgttgctagacactatgctagatactgaggataatgaaggtaagattgatatagtccctgccctcatggagcttatagtctcatgtggtcttagtgaaacaaagtctcaatttgcttttatactagaaataataaagaaagctgccttgctgtattcgatcagttaaaatcagcaactttgtgcttttgtatcagtaaaacatttagttctcaccttttgaaaatgcaaaccactgaagtgatttacagtctcctccatttttggctggagaggtgttctgtttctgtgagacatttttctaatttttgtggaacttcactttcctccttctttgcttatacgtgtttgttagattatattgcaaagaagtcaagttactgatatccagtattttacagaggaagatgactttcaaaactagtcatatttctgtagaggaggaagatttttaaaacctttatcattcagcatttgtattttatggatccccaggagaactaaaaaggagatgactctctaccatagtttggtttaaaaaaaaattactctgtcagttatttatttattatttaatactaaactccaaactgaagtggctctgaggtaaatcagatatgattttaatttaagtttctttattagcagatctataaatggaaggtgaccaatgtcactgcttctaaaatactgtcctaaacaacccagaagattttatttcagctcatgaatagctgttctaaatctgttgtatgttagacatactatgaactacctcttcacttattatggggaagtttccttaataaaagtgtgacgattaagctctggtgtcattggttattttctcactctcccctccttctattcttttttaattgctttactttgaatacaggaaggtcttctttatgtatagtcttaaaa

SEQ ID NO: 441219 - DNA, 919 bp, Homo sapiens
acatgagactataagctccatgagggcaggactatatcaatcttaccttcattatcctcatggagcttatagtctcatgtggtcttagtgaaacaaagtctcaatttgcttttatactagaaataataaagaaagctgccttgctgtattcgatcagttaaaatcagcaactttgtgcttttgtatcagtaaaacatttagttctcaccttttgaaaatgcaaaccactgaagtgatttacagtctcctccatttttggctggagaggtgttctgtttctgtgagacatttttctaatttttgtggaacttcactttcctccttctttgcttatacgtgtttgttagattatattgcaaagaagtcaagttactgatatccagtattttacagaggaagatgactttcaaaactagtcatatttctgtagaggaggaagatttttaaaacctttatcattcagcatttgtattttatggatccccaggagaactaaaaaggagatgactctctaccatagtttggtttaaaaaaaaattactctgtcagttatttatttattatttaatactaaactccaaactgaagtggctctgaggtaaatcagatatgattttaatttaagtttctttattagcagatctataaatggaaggtgaccaatgtcactgcttctaaaatactgtcctaaacaacccagaagattttatttcagctcatgaatagctgttctaaatctgttgtatgttagacatactatgaactacctcttcacttattatggggaagtttccttaataaaagtgtgacgattaagctctggtgtcattggttattttctcactctcccctccttctattcttttttaattgctttactttgaatacaggaaggtcttctttatgtatagtcttaaaa

SEQ ID NO: 441220 - DNA, 4545 bp, Homo sapiens
cggagccccgaggggccggagctcctggcggtgccggatcctgacggcggcttcccccgggtctgtctgccaaaatgtctgaaagatcagatctccttcacttcaagtttgaaaattatggagattcaatgttacaaaaaatgaacaaattaagagaagagaataaattttgtgatgttacagttctcatagatgatattgaggtacagggacataaaattgtgtttgctgcaggttcccccttcttaagagaccaatttttactgaatgattccagagaggtgaaaatctccatattacagagttccgaagtggggagacaattgctcttatcctgttatagtggtgtgctggaattccctgagatggaactggtaaattacttgactgctgcaagttttcttcagatgagccacattgtagaacggtgcacacaggccctgtggaagtttataaagccaaaacaaccaatggatagtaaagagggatgtgaaccacagagtgcttctccccagtcaaaagaacagcagggagatgccagaggctccccaaagcaggactcaccttgtattcatccatctgaagacagtatggatatggaggacagtgatattcagattgttaaggtagaatctattggggatgtatcagaggttagaagtaaaaaagatcagaaccagtttatttcttctgaacccactgctttacattcatcagagccccagcactccctgataaattcaactgtggaaaacagagtaagtgaaatagaacaaaaccatctccacaattatgccctttcttatacaggcagtgataacatcatcatggcctcaaaagatgtctttggccctaatattcgaggtgtagacaaaggcctacagtggcatcaccagtgcccaaagtgtaccagggtgtttcgtcacctggagaactacgccaaccatttaaaaatgcacaaactctttatgtgtctactctgcggcaagactttcactcagaaaggcaaccttcatcgacacatgcgtgtgcatgccggaattaaacctttccagtgtaaaatctgtgggaaaaccttttctcagaagtgttccttacaggatcatcttaaccttcacagtggagataagccccataaatgtaactattgtgatatggtttttgcacataaaccagttttgaggaaacaccttaaacagctgcatggcaaaaacagctttgataatgccaatgagagaaatgtacaagacctcacagtggattttgattcttttgcatgtacaacagtcacagactctaaagggtgtcagccacaacccgatgcaacacaggtcctggatgcaggtaaactggcccaagctgtcctgaacttaagaaatgatagtacttgtgtgaattgagtaggggcttcatgctcacaactcgaactgactgacaatgtggcaatagtcttagtctttttaggagtgattttgctagtttgacttctccaaagcctctgtgtaggtggtagggagtgagtcaaagcactaatagaccaggcaacttaccacttggagtggatttgccttacttttgccctctcccattttctgttttgagttatttatcttgtaaagtctgttttcctttcccaaggaataattccttttgtctacctaacattgacttatgtcttagactgacactgttttaggcttttcactaggcacattccgaaggtaccaacaagttaataacatcacctactctccactaatagatgctatgctaagagaagtgaataatctttctttggtagaaaataggctgagatataaggtgatattgctattgacctgaaaatgtgatagaacttctggttgcctattgattattcctccatgtctgataaatgaatctgcttcctaccatttgtacttgtcttggagctggctataaagaagtatgctggtttgttatgtactcttttcaacagtatcatagcccaacttcatctcattgaattgttcacatataccagagtactctctcttgaggaacacctgcaggcagatagttagggatgaccatgaggagcataatcaacagggatagaagtacacttatacaacagcacttacatgggcggtttctctggtagcatgtcccataagaggccatatgcttataattaatgtgtaacttgttgatgcttttgagatcaggactgctccaggcacgctaaaaatgtgctaaagtatagtgggctctctaaaaagaggctatttgggagtctctgaattttgtttcagagtttagccatcagaaaggtgagtttggccatcagagttttgtcctgtgcaccataaaagtctctgaattttcgtttcctcatgtaccttaatttctaaaacggatgataaaagttaggttggacacagaaggggcaatcaaatttctgtattcagatacctcttaaaggtacactgtgccaccttgctgcctttgattgcaaatacaaagttaattttcaaaaaggaaaaacaaaacagctctttttcctaaaacacatgttgtacttcagacctaaaattctaagtcttatttgtttctcacccatgagttagatttaggtaatagtattagtagagtccttagagaatcttaagaggtcatttactccacctctttcattttaaattggggtatccaaagcctgaagaggtggcctggccaatattgaccaaggtataactaaatatgagctagcatcttcttccttcttctcgctatcccttggctttaaaagatttagtacatgaagaataatgcattagcaaaaagctcctagtttgtgtttcccctttgtgtctccctgttggctttctgagacaacctgaattttgccaacaaaatatcgcagagggatttatattaattattttttagttagatgaatattatattcttcccatccaagtgagtgatttgctaggtttgtttagggagggaaaaagcaagaataatgtgagaagaatctaaatgcgaagttgattttgtgtggaaaactgtttattagtttccatcaggattttctgtttttatttttgagctatgagagtgcatgcagatttgaaaaattaggcttgcatagtcagaggggatcttcaattgttatatttgatacgtttacatgtatcattgttatcatatgtaaattatcatcatgtgagtcagatgtgaagtatgatttttgtcttttgttcaaatatttaaaatgataatacagttgagtggtaagactaataggtaccttatgcctaacatcactcattatatggtctaatgatgcttcctagcattgtgatttttacatgatccagccaaagagtaccaattctatgcaatagtgagactctaccctgtcaaccaaacagcattttttggtattttctgtcaacatcatttcttcacagggaaatttcaagttggagtgcttcgtttgctcacattcatgtcttgtttttgttactggtttgaagactaaaaggcacgggttcaaataagattggtctctttggttggagactatttctgggttcattcagttgttcaagaaacattagttaagcacctactgttgctagacactatgctagatactgaggataatgaaggtaagattgatatagtccctgccctcatggagcttatagtctcatgtggtcttagtgaaacaaagtctcaatttgcttttatactagaaataataaagaaagctgccttgctgtattcgatcagttaaaatcagcaactttgtgcttttgtatcagtaaaacatttagttctcaccttttgaaaatgcaaaccactgaagtgatttacagtctcctccatttttggctggagaggtgttctgtttctgtgagacatttttctaatttttgtggaacttcactttcctccttctttgcttatacgtgtttgttagattatattgcaaagaagtcaagttactgatatccagtattttacagaggaagatgactttcaaaactagtcatatttctgtagaggaggaagatttttaaaacctttatcattcagcatttgtattttatggatccccaggagaactaaaaaggagatgactctctaccatagtttggtttaaaaaaaaattactctgtcagttatttatttattatttaatactaaactccaaactgaagtggctctgaggtaaatcagatatgattttaatttaagtttctttattagcagatctataaatggaaggtgaccaatgtcactgcttctaaaatactgtcctaaacaacccagaagattttatttcagctcatgaatagctgttctaaatctgttgtatgttagacatactatgaactacctcttcacttattatggggaagtttccttaataaaagtgtgacgattaagctctggtgtcattggttattttctcactctcccctccttctattcttttttaattgctttactttgaatacaggaaggtcttctttatgtatagtcttaaaa

SEQ ID NO: 441221 - DNA, 1103 bp, Homo sapiens
agcattgcacctttaataggcttttctctctctctttttcctgagccctggaggcttcctggattgagacctagcctaggtctgcataagcacctttccatcttgttaatgtttaacactgcctctgctggaaaacagctctcacctcctctctttctgtctcttattttttgcctttgcagatgagttttgatcatcctgagaaaaatgggccttggcctgcagacccaataaaccttccctcccatggataatagtgctaattcctgaggacctgaagggcctgccgcccctgggggattagccagaagcaggtaaggaacacacagaggcatgggctagcaaaggggtacattcctgagtaaaagctggtgtggcagatgtcctggcagggaatctcaggatctcagtatctggctccagctttgctgttttctttttgtatgtattttttagtcctctttaactgctgattcaatgtgggtttcattggggggtgtagagaaatggcttgtccatttctattaactatataagatttaagttattctgtatttcagtcaaccattctgagtacctactacctgccacgaatgcaactggtactgagtatgtcatgacgggtgggtcgggacaggatttccttgctttgagcattgatttctgccggttcagtgttggccagttctttgaaggtgatgatgcaagtcgctgtgttcttcctctagaagcctcgtgatgattgtaaagattctctgatacaattgcatcagttcaataatctttcattgagtatccgctctggtccaggcactgtgctgggtactagggtttcagaaaggataccaggaggagttttccttgagcagcaaagtcaggcatgaaaagcaagcattacaaagcactggctggcagcaaaggggagcagggatagtgcggaaggggaggtggcctccactgaccttcagaagcagaaaggtgatgctgtcagagctggcaggcacatggacaaggagaaagagtgcagcagtgcagacacctggaggcttaacacagtctggtgtaattggaaaattcaaagcttagtgtgtttttccaaaaca

SEQ ID NO: 441222 - DNA, 865 bp, Homo sapiens
cctcaggttcctaaatggaacgcctgggggttgtcttggatgccatagttaaatcctgtccatttgctgagcactgcatgcttttcaaagtgcaatggggtcctttgcacttgtgggatacactgaacatatggtagtgttttcatttttctgacagagatagaaatataatctactggtgataccaagagaatatctggtttgctgctttgataactggagtagctactccactgtaagtagcacactggctttgttcacttttctgtgtgcccaggcacaagcgaatgtctttgaatgggtttcaggaatgccacagtatggcccccttcagcccttacagtggctggcagacaggtggtcatctctgcctaggagctttacctgagcaccacacaaatactgccatttcgccctgtggatcatgatggggtaaagatggggaagcattattcccttgccccctcccccgcctctcgtctttctctttttctgcatattgccagtgctcatcacctcttttctgtttctttgtggtttatagatgatcatgacgcagtcctgaggtttaatggggcacccacagccaacttccaacaagatgtgggcacaaaaactaccattcgcctgatgaactctcaggtaaaatttcttctgtgcagctatggagtaagagaaggaccacagtgtgggctctaatgtggaatgtatctactgggagcatatctaggctgccaattaagtctcttgatcttcctgagttcctgattcctcactggagaagaagacaatgattccatgacccaactgatgatgtgttttttaaagaaaaaccctttagtattagtgtctgctaatggaggtg

SEQ ID NO: 441223 - DNA, 270 bp, Homo sapiens
gtggtacttaagctccaagaacttacggcacacctgcttgagtggatcatgggtgagctggagaacctgaagtagcaaaggcaagaaggcaacgacgttccatctgtggaaggacctaccaaccaggtatctctggtgacagggctcatctcataggtggcccactgtacatcataccctgatgttttctttgcatgacgtgctatagaattccaggctcatgcacacctttctgctctcctgttttgcaaatgtctgcactctagagtc

SEQ ID NO: 441224 - DNA, 374 bp, Homo sapiens
cattttttcaacaaatatatgccatggaaaagaagaagtaagggagcgaggaactcttctagataagagagaattgaaaatggcacatcatccagtcatccaaacaaaatgtcctgtccttgtttggatccccttttgagcaggttagtgtaaaagacattattgagagaattggtaaacatttaaaggtgggttggatattgggtgatattggcattgtgatcatattgaattattatttatattcatatattctctggcagaacctggtgcgtgtgtgtgtgtgtgtgtgtgtgtgtgtgtgtctgtgtgtgtgtgtctcacagtgtagagaatctgagggtctacgttctcaattctcccaggggtggtac

SEQ ID NO: 441225 - DNA, 4283 bp, Homo sapiens
ggaggaggttcctgtagggcggcacaaccagggagggcgtggaagctctgcatcccttctcccataccttgctctacacatctcttcatctgtatcctctgcagcatccttgatgataaaccagtaaatatgagttttgatcatcctgagaaaaatgggccttggcctgcagacccaataaaccttccctcccatggataatagtgctaattcctgaggacctgaagggcctgccgcccctgggggattagccagaagcaggcttgttttcctgctcagaacaaagtgacttccctgaacacatcttcattatgattcacaccaacctgaagaaaaagttcagctgctgcgtcctggtctttcttctgtttgcagtcatctgtgtgtggaaggaaaagaagaaagggagttactatgattcctttaaattgcaaaccaaggaattccaggtgttaaagagtctggggaaattggccatggggtctgattcccagtctgtatcctcaagcagcacccaggacccccacaggggccgccagaccctcggcagtctcagaggcctagccaaggccaaaccagaggcctccttccaggtgtggaacaaggacagctcttccaaaaaccttatccctaggctgcaaaagatctggaagaattacctaagcatgaacaagtacaaagtgtcctacaaggggccaggaccaggcatcaagttcagtgcagaggccctgcgctgccacctccgggaccatgtgaatgtatccatggtagaggtcacagattttcccttcaatacctctgaatgggagggttatctgcccaaggagagcattaggaccaaggctgggccttggggcaggtgtgctgttgtgtcgtcagcgggatctctgaagtcctcccaactaggcagagaaatcgatgatcatgacgcagtcctgaggtttaatggggcacccacagccaacttccaacaagatgtgggcacaaaaactaccattcgcctgatgaactctcagttggttaccacagagaagcgcttcctcaaagacagtttgtacaatgaaggaatcctaattgtatgggacccatctgtataccactcagatatcccaaagtggtaccagaatccggattataatttctttaacaactacaagacttatcgtaagctgcaccccaatcagcccttttacatcctcaagccccagatgccttgggagctatgggacattcttcaagaaatctccccagaagagattcagccaaaccccccatcctctgggatgcttggtatcatcatcatgatgacgctgtgtgaccaggtggatatttatgagttcctcccatccaagcgcaagactgacgtgtgctactactaccagaagttcttcgatagtgcctgcacgatgggtgcctaccacccgctgctctatgagaagaatttggtgaagcatctcaaccagggcacagatgaggacatctacctgcttggaaaagccacactgcctggcttccggaccattcactgctaagcacaggctcctcactcttctccatcaggcattaaatgaatggtctcttggccaccccagcctgggaagaacattttcctgaacaattccagcctgctccttttactctaggggcctctgtcagcaagaccatggggacttcaagagcctgtggtcaggaaatcaggtccagccttccctgtagccagacagtttatgagcccagagcctcctgccacacacatgcacacatatctagcattctttccagacagcatcctccccgccttccaccttggtagatgcaaggtctatctctcccatcagggctgccaaagctgggctttgtttttcccagcagaatgatgccattctcacaaaccaatgctctatattgcttgaagtctgcatctaaatattgatttcacgttttaaagaaattctcttaaattacaattgtgcccaatgcagggtggctctggggggcaagtaggtggtacaggggattggaaacatgctccgcgcctccagagaaaagttgctcccgaggtccatgcccctggaacgtgttcctatcactctggctggttgggctggtccttagactgggtgcttatgattaaagggtcttggttagcccactttccctctccatgtggagatggaaggtagagaaggatacagtgtctatcctcaagttgctacggttcagtgagagaggcagacatctgaacaggcaggtaggattcagtgtgctcagtgcactggggatttggagagagatgggcttgctctctctgtgcacccaggagggccacgcacttaaaactgtgtttgtggatcagagaaggctttatagcacagggggcattcagatgagtcttagaggaagagaagaaacatggcaagcagattacatctgagccgtttgaattgtgtttttctttcttcccatgtttattttctaagatctacctgaacttagagactcaagatatttttttaggaaacctcctacccatgtctgaggtagcaagtgcagcctcacgacagataccaggcaatccagagccacaaaacgtgattcctccaggctctgcctggcctgaccctgtcctgtcagctgggtttacataccagtcccattcttccttttcaatacctacccccaaatcttctcctaaccaccatctgttttttttttttaaaagcattttttgctttaaaagcatcctgaccccaatttctttgagctcacgggccttttgctgaaggtctctcagggtgtagtggtgtggctctctggacttaacgtcactctcagaggtcagaaccttggagatcagaactgattctcaccaggtgtgagaggtgtggtagcagattgcaatgctctgcacctcttccttgcaagtgagcaacttcaggctctctgggcagaggctggcccactgtagtttgcagacatgctctccagatggttttactaagtcccctctccctgatagggaatcctgctggaccagcgcagccctggtgtggagaggttaaaagacttgcacaggatcaccaagtcatgctgtagagccaggattcctagacccagggctctgcactctcaaggctggccccatgtgctcaaggggatctaatgtttgggctccaaactaaccatctcggagctgggctcctcatttactgccaaaccctcagcttatgtagctagaaagggccctggagtgagaaagcctggattttcaaattgatgctcccctactgactagctgtgccactctgggcaaatgctcttccttgagcctgtttccacacctgtaaagtggggatgatgatcctatctcactgcttttgtgaggattacaggaaagcacctgtcctggctctgtacctggcacgtagtaggtgctcagttcatgctggtttccttcctgcctttagtagggacctgctctgtgctcacacctcggctgcatgcaccctgctgtgacggaggctagtgtggaagaggtcctgtcctcagggaattaactgtcttattgggagacaacaactgtcctccttggaacacccaagaaaccatgcaaagcagtggacaacacagaacacgccctcctcctcgctgcctgcagctccaatctgattctgcttgggaatgggcggagcacgtgggctgcttaactgctgtataggacaagccccttacccctctctgggcccatgaattcctggcttggtttatgttctgatttgacacactgattttaatcttcgaatcatgacactgagtgcagaggaggtggcattccgacagcaggacatacatgttggtgtgaagactgggacgacactgggtagaatctagtttttaattattattaatataaaggatcaaattaatttaaatatgattctgaagtctacagaacttttagttctgtgctgtctatgtggacactttggtaaaatgcaaattatgatatggacgttatcattggtctggtgagatgtttcatatttgtgacagttaatttaaaaattatgagttaatgctgcctgtgtctatggggttctgtcttctttgatagccatctattcatctggatcatgggaccctctctaatccttccaccaatcaaataagctattgctattggtttggagttgagatatcagtctcggaaacttctgaaaaatgctaataattacccaaggattatgtcaaattttaaaataaatgtgtgtgtgtttctttaa

SEQ ID NO: 441226 - DNA, 4458 bp, Homo sapiens
ggaggaggttcctgtagggcggcacaaccagggagggcgtggaagctctgcatcccttctcccataccttgctctacacatctcttcatctgtatcctctgcagcatccttgatgataaaccagtaaatatgagttttgatcatcctgagaaaaatgggccttggcctgcagacccaataaaccttccctcccatggataatagtgctaattcctgaggacctgaagggcctgccgcccctgggggattagccagaagcaggcttgttttcctgctcagaacaaagtgacttccctgaacacatcttcattatgattcacaccaacctgaagaaaaagttcagctgctgcgtcctggtctttcttctgtttgcagtcatctgtgtgtggaaggaaaagaagaaagggagttactatgattcctttaaattgcaaaccaaggaattccaggtgttaaagagtctggggaaattggccatggggtctgattcccagtctgtatcctcaagcagcacccaggacccccacaggggccgccagaccctcggcagtctcagaggcctagccaaggccaaaccagaggcctccttccaggtgtggaacaaggacagctcttccaaaaaccttatccctaggctgcaaaagatctggaagaattacctaagcatgaacaagtacaaagtgtcctacaaggggccaggaccaggcatcaagttcagtgcagaggccctgcgctgccacctccgggaccatgtgaatgtatccatggtagaggtcacagattttcccttcaatacctctgaatgggagggttatctgcccaaggagagcattaggaccaaggctgggccttggggcaggtgtgctgttgtgtcgtcagcgggatctctgaagtcctcccaactaggcagagaaatcgatgatcatgacgcagtcctgaggtttaatggggcacccacagccaacttccaacaagatgtgggcacaaaaactaccattcgcctgatgaactctcagttggttaccacagagaagcgcttcctcaaagacagtttgtacaatgaaggaatcctaattgtatgggacccatctgtataccactcagatatcccaaagtggtaccagaatccggattataatttctttaacaactacaagacttatcgtaagctgcaccccaatcagcccttttacatcctcaagccccagatgccttgggagctatgggacattcttcaagaaatctccccagaagagattcagccaaaccccccatcctctgggatgcttggtatcatcatcatgatgacgctgtgtgaccaggtggatatttatgagttcctcccatccaagcgcaagactgacgtgtgctactactaccagaagttcttcgatagtgcctgcacgatgggtgcctaccacccgctgctctatgagaagaatttggtgaagcatctcaaccagggcacagatgaggacatctacctgcttggaaaagccacactgcctggcttccggaccattcactgctaagcacaggctcctcactcttctccatcaggcattaaatgaatggtctcttggccaccccagcctgggaagaacattttcctgaacaattccagcctgctccttttactctaggggcctctgtcagcaagaccatggggacttcaagagcctgtggtcaggaaatcaggtccagccttccctgtagccagacagtttatgagcccagagcctcctgccacacacatgcacacatatctagcattctttccagacagcatcctccccgccttccaccttggtagatgcaaggtctatctctcccatcagggctgccaaagctgggctttgtttttcccagcagaatgatgccattctcacaaaccaatgctctatattgcttgaagtctgcatctaaatattgatttcacgttttaaagaaattctcttaaattacaattgtgcccaatgcagggtggctctggggggcaagtaggtggtacaggggattggaaacatgctccgcgcctccagagaaaagttgctcccgaggtccatgcccctggaacgtgttcctatcactctggctggttgggctggtccttagactgggtgcttatgattaaagggtcttggttagcccactttccctctccatgtggagatggaaggtagagaaggatacagtgtctatcctcaagttgctacggttcagtgagagaggcagacatctgaacaggcaggtaggattcagtgtgctcagtgcactggggatttggagagagatgggcttgctctctctgtgcacccaggagggccacgcacttaaaactgtgtttgtggatcagagaaggctttatagcacagggggcattcagatgagtcttagaggaagagaagaaacatggcaagcagattacatctgagccgtttgaattgtgtttttctttcttcccatgtttattttctaagatctacctgaacttagagactcaagatatttttttaggaaacctcctacccatgtctgaggtagcaagtgcagcctcacgacagataccaggcaatccagagccacaaaacgtgattcctccaggctctgcctggcctgaccctgtcctgtcagctgggtttacataccagtcccattcttccttttcaatacctacccccaaatcttctcctaaccaccatctgttttttttttttaaaagcattttttgctttaaaagcatcctgaccccaatttctttgagctcacgggccttttgctgaaggtctctcagggtgtagtggtgtggctctctggacttaacgtcactctcagaggtcagaaccttggagatcagaactgattctcaccaggtgtgagaggtgtggtagcagattgcaatgctctgcacctcttccttgcaagtgagcaacttcaggctctctgggcagaggctggcccactgtagtttgcagacatgctctccagatggttttactaagtcccctctccctgatagggaatcctgctggaccagcgcagccctggtgtggagaggttaaaagacttgcacaggatcaccaagtcatgctgtagagccaggattcctagacccagggctctgcactctcaaggctggccccatgtgctcaaggggatctaatgtttgggctccaaactaaccatctcggagctgggctcctcatttactgccaaaccctcagcttatgtagctagaaagggccctggagtgagaaagcctggattttcaaattgatgctcccctactgactagctgtgccactctgggcaaatgctcttccttgagcctgtttccacacctgtaaagtggggatgatgatcctatctcactgcttttgtgaggattacaggaaagcacctgtcctggctctgtacctggcacgtagtaggtgctcagttcatgctggtttccttcctgcctttagtagggacctgctctgtgctcacacctcggctgcatgcaccctgctgtgacggaggctagtgtggaagaggtcctgtcctcagggaattaactgtcttattgggagacaacaactgtcctccttggaacacccaagaaaccatgcaaagcagtggacaacacagaacacgccctcctcctcgctgcctgcagctccaatctgattctgcttgggaatgggcggagcacgtgggctgcttaactgctgtataggacaagccccttacccctctctgggcccatgaattcctggcttggtttatgttctgatttgacacactgattttaatcttcgaatcatgacactgagtgcagaggaggtggcattccgacagcaggacatacatgttggtgtgaagactgggacgacactgggtagaatctagtttttaattattattaatataaaggatcaaattaatttaaatatgattctgaagtctacagaacttttagttctgtgctgtctatgtggacactttggtaaaatgcaaattatgatatggacgttatcattggtctggtgagatgtttcatatttgtgacagttaatttaaaaattatgagttaatgctgcctgtgtctatggggttctgtcttctttgatagccatctattcatctggatcatgggaccctctctaatccttccaccaatcaaataagctattgctattggtttggagttgagatatcagtctcggaaacttctgaaaaatgctaataattacccaaggattatgtcaaattttaaaataaatgtgtgtgtgtttctttaaaaagacacaaagagaaacaacacacaaaaacaaaactagacgcgaccctagggagcggagacaaagcaacaaaaaacacatggaccgcccggtagagaaacaacaaaatgtgggggggcgcggaggatacaaaaatgggggggggggagaaaggggggtcccaaacaggcggagg

SEQ ID NO: 441227 - DNA, 4230 bp, Homo sapiens
ggaggaggttcctgtagggcggcacaaccagggagggcgtggaagctctgcatcccttctcccataccttgctctacacatctcttcatctgtatcctctgcagcatccttgatgataaaccagtaaatatgagttttgatcatcctgagaaaaatgggccttggcctgcagacccaataaaccttccctcccatggataatagtgctaattcctgaggacctgaagggcctgccgcccctgggggattagccagaagcaggcttgttttcctgctcagaacaaagtgacttccctgaacacatcttcattatgattcacaccaacctgaagaaaaagttcagctgctgcgtcctggtctttcttctgtttgcagtcatctgtgtgtggaaggaaaagaagaaagggagttactatgattcctttaaattgcaaaccaaggaattccaggtgttaaagagtctggggaaattggccatggggtctgattcccagtctgtatcctcaagcagcacccaggacccccacaggggccgccagaccctcggcagtctcagaggcctagccaaggccaaaccagaggcctccttccaggtgtggaacaaggacagctcttccaaaaaccttatccctaggctgcaaaagatctggaagaattacctaagcatgaacaagtacaaagtgtcctacaaggggccaggaccaggcatcaagttcagtgcagaggccctgcgctgccacctccgggaccatgtgaatgtatccatggtagaggtcacagattttcccttcaatacctctgaatgggagggttatctgcccaaggagagcattaggaccaaggctgggccttggggcaggtgtgctgttgtgtcgtcagcgggatctctgaagtcctcccaactaggcagagaaatcgatgatcatgacgcagtcctgaggtttaatggggcacccacagccaacttccaacaagatgtgggcacaaaaactaccattcgcctgatgaactctcagttggttaccacagagaagcgcttcctcaaagacagtttgtacaatgaaggaatcctaattgtatgggacccatctgtataccactcagatatcccaaagtggtaccagaatccggattataatttctttaacaactacaagacttatcgtaagctgcaccccaatcagcccttttacatcctcaagccccagatgccttgggagctatgggacattcttcaagaaatctccccagaagagattcagccaaaccccccatcctctgggatgcttggtatcatcatcatgatgacgctgtgtgaccaggtggatatttatgagttcctcccatccaagcgcaagactgacgtgtgctactactaccagaagttcttcgatagtgcctgcacgatgggtgcctaccacccgctgctctatgagaagaatttggtgaagcatctcaaccagggcacagatgaggacatctacctgcttggaaaagccacactgcctggcttccggaccattcactgctaagcacaggctcctcactcttctccatcaggcattaaatgaatggtctcttggccaccccagcctgggaagaacattttcctgaacaattccagcctgctccttttactctaggggcctctgtcagcaagaccatggggacttcaagagcctgtggtcaggaaatcaggtccagccttccctgtagccagacagtttatgagcccagagcctcctgccacacacatgcacacatatctagcattctttccagacagcatcctccccgccttccaccttggtagatgcaaggtctatctctcccatcagggctgccaaagctgggctttgtttttcccagcagaatgatgccattctcacaaaccaatgctctatattgcttgaagtctgcatctaaatattgatttcacgttttaaagaaattctcttaaattacaattgtgcccaatgcagggtggctctggggggcaagtaggtggtacaggggattggaaacatgctccgcgcctccagagaaaagttgctcccgaggtccatgcccctggaacgtgttcctatcactctggctggttgggctggtccttagactgggtgcttatgattaaagggtcttggttagcccactttccctctccatgtggagatggaaggtagagaaggatacagtgtctatcctcaagttgctacggttcagtgagagaggcagacatctgaacaggcaggtaggattcagtgtgctcagtgcactggggatttggagagagatgggcttgctctctctgtgcacccaggagggccacgcacttaaaactgtgtttgtggatcagagaaggctttatagcacagggggcattcagatgagtcttagaggaagagaagaaacatggcaagcagattacatctgagccgtttgaattgtgtttttctttcttcccatgtttattttctaagatctacctgaacttagagactcaagatatttttttaggaaacctcctacccatgtctgaggtagcaagtgcagcctcacgacagataccaggcaatccagagccacaaaacgtgattcctccaggctctgcctggcctgaccctgtcctgtcagctgggtttacataccagtcccattcttccttttcaatacctacccccaaatcttctcctaaccaccatctgttttttttttttaaaagcattttttgctttaaaagcatcctgaccccaatttctttgagctcacgggccttttgctgaaggtctctcagggtgtagtggtgtggctctctggacttaacgtcactctcagaggtcagaaccttggagatcagaactgattctcaccaggtgtgagaggtgtggtagcagattgcaatgctctgcacctcttccttgcaagtgagcaacttcaggctctctgggcagaggctggcccactgtagtttgcagacatgctctccagatggttttactaagtcccctctccctgatagggaatcctgctggaccagcgcagccctggtgtggagaggttccagggctctgcactctcaaggctggccccatgtgctcaaggggatctaatgtttgggctccaaactaaccatctcggagctgggctcctcatttactgccaaaccctcagcttatgtagctagaaagggccctggagtgagaaagcctggattttcaaattgatgctcccctactgactagctgtgccactctgggcaaatgctcttccttgagcctgtttccacacctgtaaagtggggatgatgatcctatctcactgcttttgtgaggattacaggaaagcacctgtcctggctctgtacctggcacgtagtaggtgctcagttcatgctggtttccttcctgcctttagtagggacctgctctgtgctcacacctcggctgcatgcaccctgctgtgacggaggctagtgtggaagaggtcctgtcctcagggaattaactgtcttattgggagacaacaactgtcctccttggaacacccaagaaaccatgcaaagcagtggacaacacagaacacgccctcctcctcgctgcctgcagctccaatctgattctgcttgggaatgggcggagcacgtgggctgcttaactgctgtataggacaagccccttacccctctctgggcccatgaattcctggcttggtttatgttctgatttgacacactgattttaatcttcgaatcatgacactgagtgcagaggaggtggcattccgacagcaggacatacatgttggtgtgaagactgggacgacactgggtagaatctagtttttaattattattaatataaaggatcaaattaatttaaatatgattctgaagtctacagaacttttagttctgtgctgtctatgtggacactttggtaaaatgcaaattatgatatggacgttatcattggtctggtgagatgtttcatatttgtgacagttaatttaaaaattatgagttaatgctgcctgtgtctatggggttctgtcttctttgatagccatctattcatctggatcatgggaccctctctaatccttccaccaatcaaataagctattgctattggtttggagttgagatatcagtctcggaaacttctgaaaaatgctaataattacccaaggattatgtcaaattttaaaataaatgtgtgtgtgtttctttaa

SEQ ID NO: 441228 - DNA, 4228 bp, Homo sapiens
ggaggaggttcctgtagggcggcacaaccagggagggcgtggaagctctgcatcccttctcccataccttgctctacacatctcttcatctgtatcctctgcagcatccttgatgataaaccagtaaatatgagttttgatcatcctgagaaaaatgggccttggcctgcagacccaataaaccttccctcccatggataatagtgctaattcctgaggacctgaagggcctgccgcccctgggggattagccagaagcaggcttgttttcctgctcagaacaaagtgacttccctgaacacatcttcattatgattcacaccaacctgaagaaaaagttcagctgctgcgtcctggtctttcttctgtttgcagtcatctgtgtgtggaaggaaaagaagaaagggagttactatgattcctttaaattgcaaaccaaggaattccaggtgttaaagagtctggggaaattggccatggggtctgattcccagtctgtatcctcaagcagcacccaggacccccacaggggccgccagaccctcggcagtctcagaggcctagccaaggccaaaccagaggcctccttccaggtgtggaacaaggacagctcttccaaaaaccttatccctaggctgcaaaagatctggaagaattacctaagcatgaacaagtacaaagtgtcctacaaggggccaggaccaggcatcaagttcagtgcagaggccctgcgctgccacctccgggaccatgtgaatgtatccatggtagaggtcacagattttcccttcaatacctctgaatgggagggttatctgcccaaggagagcattaggaccaaggctgggccttggggcaggtgtgctgttgtgtcgtcagcgggatctctgaagtcctcccaactaggcagagaaatcgatgatcatgacgcagtcctgaggtttaatggggcacccacagccaacttccaacaagatgtgggcacaaaaactaccattcgcctgatgaactctcagttggttaccacagagaagcgcttcctcaaagacagtttgtacaatgaaggaatcctaattgtatgggacccatctgtataccactcagatatcccaaagtggtaccagaatccggattataatttctttaacaactacaagacttatcgtaagctgcaccccaatcagcccttttacatcctcaagccccagatgccttgggagctatgggacattcttcaagaaatctccccagaagagattcagccaaaccccccatcctctgggatgcttggtatcatcatcatgatgacgctgtgtgaccaggtggatatttatgagttcctcccatccaagcgcaagactgacgtgtgctactactaccagaagttcttcgatagtgcctgcacgatgggtgcctaccacccgctgctctatgagaagaatttggtgaagcatctcaaccagggcacagatgaggacatctacctgcttggaaaagccacactgcctggcttccggaccattcactgctaagcacaggctcctcactcttctccatcaggcattaaatgaatggtctcttggccaccccagcctgggaagaacattttcctgaacaattccagcctgctccttttactctaggggcctctgtcagcaagaccatggggacttcaagagcctgtggtcaggaaatcaggtccagccttccctgtagccagacagtttatgagcccagagcctcctgccacacacatgcacacatatctagcattctttccagacagcatcctccccgccttccaccttggtagatgcaaggtctatctctcccatcagggctgccaaagctgggctttgtttttcccagcagaatgatgccattctcacaaaccaatgctctatattgcttgaagtctgcatctaaatattgatttcacgttttaaagaaattctcttaaattacaattgtgcccaatgcagggtggctctggggggcaagtaggtggtacaggggattggaaacatgctccgcgcctccagagaaaagttgctcccgaggtccatgcccctggaacgtgttcctatcactctggctggttgggctggtccttagactgggtgcttatgattaaagggtcttggttagcccactttccctctccatgtggagatggaaggtagagaaggatacagtgtctatcctcaagttgctacggttcagtgagagaggcagacatctgaacaggcaggtaggattcagtgtgctcagtgcactggggatttggagagagatgggcttgctctctctgtgcacccaggagggccacgcacttaaaactgtgtttgtggatcagagaaggctttatagcacagggggcattcagatgagtcttagaggaagagaagaaacatggcaagcagattacatctgagccgtttgaattgtgtttttctttcttcccatgtttattttctaagatctacctgaacttagagactcaagatatttttttaggaaacctcctacccatgtctgaggtagcaagtgcagcctcacgacagataccaggcaatccagagccacaaaacgtgattcctccaggctctgcctggcctgaccctgtcctgtcagctgggtttacataccagtcccattcttccttttcaatacctacccccaaatcttctcctaaccaccatctgttttttttttttaaaagcattttttgtctctcagggtgtagtggtgtggctctctggacttaacgtcactctcagaggtcagaaccttggagatcagaactgattctcaccaggtgtgagaggtgtggtagcagattgcaatgctctgcacctcttccttgcaagtgagcaacttcaggctctctgggcagaggctggcccactgtagtttgcagacatgctctccagatggttttactaagtcccctctccctgatagggaatcctgctggaccagcgcagccctggtgtggagaggttaaaagacttgcacaggatcaccaagtcatgctgtagagccaggattcctagacccagggctctgcactctcaaggctggccccatgtgctcaaggggatctaatgtttgggctccaaactaaccatctcggagctgggctcctcatttactgccaaaccctcagcttatgtagctagaaagggccctggagtgagaaagcctggattttcaaattgatgctcccctactgactagctgtgccactctgggcaaatgctcttccttgagcctgtttccacacctgtaaagtggggatgatgatcctatctcactgcttttgtgaggattacaggaaagcacctgtcctggctctgtacctggcacgtagtaggtgctcagttcatgctggtttccttcctgcctttagtagggacctgctctgtgctcacacctcggctgcatgcaccctgctgtgacggaggctagtgtggaagaggtcctgtcctcagggaattaactgtcttattgggagacaacaactgtcctccttggaacacccaagaaaccatgcaaagcagtggacaacacagaacacgccctcctcctcgctgcctgcagctccaatctgattctgcttgggaatgggcggagcacgtgggctgcttaactgctgtataggacaagccccttacccctctctgggcccatgaattcctggcttggtttatgttctgatttgacacactgattttaatcttcgaatcatgacactgagtgcagaggaggtggcattccgacagcaggacatacatgttggtgtgaagactgggacgacactgggtagaatctagtttttaattattattaatataaaggatcaaattaatttaaatatgattctgaagtctacagaacttttagttctgtgctgtctatgtggacactttggtaaaatgcaaattatgatatggacgttatcattggtctggtgagatgtttcatatttgtgacagttaatttaaaaattatgagttaatgctgcctgtgtctatggggttctgtcttctttgatagccatctattcatctggatcatgggaccctctctaatccttccaccaatcaaataagctattgctattggtttggagttgagatatcagtctcggaaacttctgaaaaatgctaataattacccaaggattatgtcaaattttaaaataaatgtgtgtgtgtttctttaa

SEQ ID NO: 441229 - DNA, 4551 bp, Homo sapiens
gctcttcttccttccttctccagtcccttccactgtgcgtcttctgtcccccgttcttccccagcggacccctctttcgagactccctagtggggtccccagctcccgggcgatcctgcccttgccgagcgcgttttctggagtcacctgggggaggggagtcctgggcagggccgggctggggaagacgcctggggcactgcccggcgttaacaaagggagccgataccgaccggcgtgggcgcggagcgggcggccgccaccgagcgtgctgagcaaccgcagcctccgcggccgagagtgcagcgagcaaggggagagccagttgcgcagagccctgcaaccagcagtccagggagaagtggtgaatgtcatggagcccagctgaaatggactggcccccttgagcctgtcccaagccctggtgccaggtgtccatccccgtgctgagatgagttttgatcatcctgagaaaaatgggccttggcctgcagacccaataaaccttccctcccatggataatagtgctaattcctgaggacctgaagggcctgccgcccctgggggattagccagaagcaggcttgttttcctgctcagaacaaagtgacttccctgaacacatcttcattatgattcacaccaacctgaagaaaaagttcagctgctgcgtcctggtctttcttctgtttgcagtcatctgtgtgtggaaggaaaagaagaaagggagttactatgattcctttaaattgcaaaccaaggaattccaggtgttaaagagtctggggaaattggccatggggtctgattcccagtctgtatcctcaagcagcacccaggacccccacaggggccgccagaccctcggcagtctcagaggcctagccaaggccaaaccagaggcctccttccaggtgtggaacaaggacagctcttccaaaaaccttatccctaggctgcaaaagatctggaagaattacctaagcatgaacaagtacaaagtgtcctacaaggggccaggaccaggcatcaagttcagtgcagaggccctgcgctgccacctccgggaccatgtgaatgtatccatggtagaggtcacagattttcccttcaatacctctgaatgggagggttatctgcccaaggagagcattaggaccaaggctgggccttggggcaggtgtgctgttgtgtcgtcagcgggatctctgaagtcctcccaactaggcagagaaatcgatgatcatgacgcagtcctgaggtttaatggggcacccacagccaacttccaacaagatgtgggcacaaaaactaccattcgcctgatgaactctcagttggttaccacagagaagcgcttcctcaaagacagtttgtacaatgaaggaatcctaattgtatgggacccatctgtataccactcagatatcccaaagtggtaccagaatccggattataatttctttaacaactacaagacttatcgtaagctgcaccccaatcagcccttttacatcctcaagccccagatgccttgggagctatgggacattcttcaagaaatctccccagaagagattcagccaaaccccccatcctctgggatgcttggtatcatcatcatgatgacgctgtgtgaccaggtggatatttatgagttcctcccatccaagcgcaagactgacgtgtgctactactaccagaagttcttcgatagtgcctgcacgatgggtgcctaccacccgctgctctatgagaagaatttggtgaagcatctcaaccagggcacagatgaggacatctacctgcttggatcttctccatcaggcattaaatgaatggtctcttggccaccccagcctgggaagaacattttcctgaacaattccagcctgctccttttactctaggggcctctgtcagcaagaccatggggacttcaagagcctgtggtcaggaaatcaggtccagccttccctgtagccagacagtttatgagcccagagcctcctgccacacacatgcacacatatctagcattctttccagacagcatcctccccgccttccaccttggtagatgcaaggtctatctctcccatcagggctgccaaagctgggctttgtttttcccagcagaatgatgccattctcacaaaccaatgctctatattgcttgaagtctgcatctaaatattgatttcacgttttaaagaaattctcttaaattacaattgtgcccaatgcagggtggctctggggggcaagtaggtggtacaggggattggaaacatgctccgcgcctccagagaaaagttgctcccgaggtccatgcccctggaacgtgttcctatcactctggctggttgggctggtccttagactgggtgcttatgattaaagggtcttggttagcccactttccctctccatgtggagatggaaggtagagaaggatacagtgtctatcctcaagttgctacggttcagtgagagaggcagacatctgaacaggcaggtaggattcagtgtgctcagtgcactggggatttggagagagatgggcttgctctctctgtgcacccaggagggccacgcacttaaaactgtgtttgtggatcagagaaggctttatagcacagggggcattcagatgagtcttagaggaagagaagaaacatggcaagcagattacatctgagccgtttgaattgtgtttttctttcttcccatgtttattttctaagatctacctgaacttagagactcaagatatttttttaggaaacctcctacccatgtctgaggtagcaagtgcagcctcacgacagataccaggcaatccagagccacaaaacgtgattcctccaggctctgcctggcctgaccctgtcctgtcagctgggtttacataccagtcccattcttccttttcaatacctacccccaaatcttctcctaaccaccatctgttttttttttttaaaagcattttttgctttaaaagcatcctgaccccaatttctttgagctcacgggccttttgctgaaggtctctcagggtgtagtggtgtggctctctggacttaacgtcactctcagaggtcagaaccttggagatcagaactgattctcaccaggtgtgagaggtgtggtagcagattgcaatgctctgcacctcttccttgcaagtgagcaacttcaggctctctgggcagaggctggcccactgtagtttgcagacatgctctccagatggttttactaagtcccctctccctgatagggaatcctgctggaccagcgcagccctggtgtggagaggttaaaagacttgcacaggatcaccaagtcatgctgtagagccaggattcctagacccagggctctgcactctcaaggctggccccatgtgctcaaggggatctaatgtttgggctccaaactaaccatctcggagctgggctcctcatttactgccaaaccctcagcttatgtagctagaaagggccctggagtgagaaagcctggattttcaaattgatgctcccctactgactagctgtgccactctgggcaaatgctcttccttgagcctgtttccacacctgtaaagtggggatgatgatcctatctcactgcttttgtgaggattacaggaaagcacctgtcctggctctgtacctggcacgtagtaggtgctcagttcatgctggtttccttcctgcctttagtagggacctgctctgtgctcacacctcggctgcatgcaccctgctgtgacggaggctagtgtggaagaggtcctgtcctcagggaattaactgtcttattgggagacaacaactgtcctccttggaacacccaagaaaccatgcaaagcagtggacaacacagaacacgccctcctcctcgctgcctgcagctccaatctgattctgcttgggaatgggcggagcacgtgggctgcttaactgctgtataggacaagccccttacccctctctgggcccatgaattcctggcttggtttatgttctgatttgacacactgattttaatcttcgaatcatgacactgagtgcagaggaggtggcattccgacagcaggacatacatgttggtgtgaagactgggacgacactgggtagaatctagtttttaattattattaatataaaggatcaaattaatttaaatatgattctgaagtctacagaacttttagttctgtgctgtctatgtggacactttggtaaaatgcaaattatgatatggacgttatcattggtctggtgagatgtttcatatttgtgacagttaatttaaaaattatgagttaatgctgcctgtgtctatggggttctgtcttctttgatagccatctattcatctggatcatgggaccctctctaatccttccaccaatcaaataagctattgctattggtttggagttgagatatcagtctcggaaacttctgaaaaatgctaataattacccaaggattatgtcaaattttaaaataaatgtgtgtgtgtttctttaa

SEQ ID NO: 441230 - DNA, 4280 bp, Homo sapiens
gtggtacttaagctccaagaacttacggcacacctgcttgagtggatcatgggtgagctggagaacctgaagtagcaaaggcaagaaggcaacgacgttccatctgtggaaggacctaccaaccagatgagttttgatcatcctgagaaaaatgggccttggcctgcagacccaataaaccttccctcccatggataatagtgctaattcctgaggacctgaagggcctgccgcccctgggggattagccagaagcaggcttgttttcctgctcagaacaaagtgacttccctgaacacatcttcattatgattcacaccaacctgaagaaaaagttcagctgctgcgtcctggtctttcttctgtttgcagtcatctgtgtgtggaaggaaaagaagaaagggagttactatgattcctttaaattgcaaaccaaggaattccaggtgttaaagagtctggggaaattggccatggggtctgattcccagtctgtatcctcaagcagcacccaggacccccacaggggccgccagaccctcggcagtctcagaggcctagccaaggccaaaccagaggcctccttccaggtgtggaacaaggacagctcttccaaaaaccttatccctaggctgcaaaagatctggaagaattacctaagcatgaacaagtacaaagtgtcctacaaggggccaggaccaggcatcaagttcagtgcagaggccctgcgctgccacctccgggaccatgtgaatgtatccatggtagaggtcacagattttcccttcaatacctctgaatgggagggttatctgcccaaggagagcattaggaccaaggctgggccttggggcaggtgtgctgttgtgtcgtcagcgggatctctgaagtcctcccaactaggcagagaaatcgatgatcatgacgcagtcctgaggtttaatggggcacccacagccaacttccaacaagatgtgggcacaaaaactaccattcgcctgatgaactctcagttggttaccacagagaagcgcttcctcaaagacagtttgtacaatgaaggaatcctaattgtatgggacccatctgtataccactcagatatcccaaagtggtaccagaatccggattataatttctttaacaactacaagacttatcgtaagctgcaccccaatcagcccttttacatcctcaagccccagatgccttgggagctatgggacattcttcaagaaatctccccagaagagattcagccaaaccccccatcctctgggatgcttggtatcatcatcatgatgacgctgtgtgaccaggtggatatttatgagttcctcccatccaagcgcaagactgacgtgtgctactactaccagaagttcttcgatagtgcctgcacgatgggtgcctaccacccgctgctctatgagaagaatttggtgaagcatctcaaccagggcacagatgaggacatctacctgcttggaaaagccacactgcctggcttccggaccattcactgctaagcacaggctcctcactcttctccatcaggcattaaatgaatggtctcttggccaccccagcctgggaagaacattttcctgaacaattccagcctgctccttttactctaggggcctctgtcagcaagaccatggggacttcaagagcctgtggtcaggaaatcaggtccagccttccctgtagccagacagtttatgagcccagagcctcctgccacacacatgcacacatatctagcattctttccagacagcatcctccccgccttccaccttggtagatgcaaggtctatctctcccatcagggctgccaaagctgggctttgtttttcccagcagaatgatgccattctcacaaaccaatgctctatattgcttgaagtctgcatctaaatattgatttcacgttttaaagaaattctcttaaattacaattgtgcccaatgcagggtggctctggggggcaagtaggtggtacaggggattggaaacatgctccgcgcctccagagaaaagttgctcccgaggtccatgcccctggaacgtgttcctatcactctggctggttgggctggtccttagactgggtgcttatgattaaagggtcttggttagcccactttccctctccatgtggagatggaaggtagagaaggatacagtgtctatcctcaagttgctacggttcagtgagagaggcagacatctgaacaggcaggtaggattcagtgtgctcagtgcactggggatttggagagagatgggcttgctctctctgtgcacccaggagggccacgcacttaaaactgtgtttgtggatcagagaaggctttatagcacagggggcattcagatgagtcttagaggaagagaagaaacatggcaagcagattacatctgagccgtttgaattgtgtttttctttcttcccatgtttattttctaagatctacctgaacttagagactcaagatatttttttaggaaacctcctacccatgtctgaggtagcaagtgcagcctcacgacagataccaggcaatccagagccacaaaacgtgattcctccaggctctgcctggcctgaccctgtcctgtcagctgggtttacataccagtcccattcttccttttcaatacctacccccaaatcttctcctaaccaccatctgttttttttttttaaaagcattttttgctttaaaagcatcctgaccccaatttctttgagctcacgggccttttgctgaaggtctctcagggtgtagtggtgtggctctctggacttaacgtcactctcagaggtcagaaccttggagatcagaactgattctcaccaggtgtgagaggtgtggtagcagattgcaatgctctgcacctcttccttgcaagtgagcaacttcaggctctctgggcagaggctggcccactgtagtttgcagacatgctctccagatggttttactaagtcccctctccctgatagggaatcctgctggaccagcgcagccctggtgtggagaggttaaaagacttgcacaggatcaccaagtcatgctgtagagccaggattcctagacccagggctctgcactctcaaggctggccccatgtgctcaaggggatctaatgtttgggctccaaactaaccatctcggagctgggctcctcatttactgccaaaccctcagcttatgtagctagaaagggccctggagtgagaaagcctggattttcaaattgatgctcccctactgactagctgtgccactctgggcaaatgctcttccttgagcctgtttccacacctgtaaagtggggatgatgatcctatctcactgcttttgtgaggattacaggaaagcacctgtcctggctctgtacctggcacgtagtaggtgctcagttcatgctggtttccttcctgcctttagtagggacctgctctgtgctcacacctcggctgcatgcaccctgctgtgacggaggctagtgtggaagaggtcctgtcctcagggaattaactgtcttattgggagacaacaactgtcctccttggaacacccaagaaaccatgcaaagcagtggacaacacagaacacgccctcctcctcgctgcctgcagctccaatctgattctgcttgggaatgggcggagcacgtgggctgcttaactgctgtataggacaagccccttacccctctctgggcccatgaattcctggcttggtttatgttctgatttgacacactgattttaatcttcgaatcatgacactgagtgcagaggaggtggcattccgacagcaggacatacatgttggtgtgaagactgggacgacactgggtagaatctagtttttaattattattaatataaaggatcaaattaatttaaatatgattctgaagtctacagaacttttagttctgtgctgtctatgtggacactttggtaaaatgcaaattatgatatggacgttatcattggtctggtgagatgtttcatatttgtgacagttaatttaaaaattatgagttaatgctgcctgtgtctatggggttctgtcttctttgatagccatctattcatctggatcatgggaccctctctaatccttccaccaatcaaataagctattgctattggtttggagttgagatatcagtctcggaaacttctgaaaaatgctaataattacccaaggattatgtcaaattttaaaataaatgtgtgtgtgtttctttaa

SEQ ID NO: 441231 - DNA, 4655 bp, Homo sapiens
gctcttcttccttccttctccagtcccttccactgtgcgtcttctgtcccccgttcttccccagcggacccctctttcgagactccctagtggggtccccagctcccgggcgatcctgcccttgccgagcgcgttttctggagtcacctgggggaggggagtcctgggcagggccgggctggggaagacgcctggggcactgcccggcgttaacaaagggagccgataccgaccggcgtgggcgcggagcgggcggccgccaccgagcgtgctgagcaaccgcagcctccgcggccgagagtgcagcgagcaaggggagagccagttgcgcagagccctgcaaccagcagtccagggagaagtggtgaatgtcatggagcccagctgaaatggactggcccccttgagcctgtcccaagccctggtgccaggtgtccatccccgtgctgagatgagttttgatcatcctgagaaaaatgggccttggcctgcagacccaataaaccttccctcccatggataatagtgctaattcctgaggacctgaagggcctgccgcccctgggggattagccagaagcagttggctacatgtctgctatcttacccagaattcctagcctctatcatgaggcttgttttcctgctcagaacaaagtgacttccctgaacacatcttcattatgattcacaccaacctgaagaaaaagttcagctgctgcgtcctggtctttcttctgtttgcagtcatctgtgtgtggaaggaaaagaagaaagggagttactatgattcctttaaattgcaaaccaaggaattccaggtgttaaagagtctggggaaattggccatggggtctgattcccagtctgtatcctcaagcagcacccaggacccccacaggggccgccagaccctcggcagtctcagaggcctagccaaggccaaaccagaggcctccttccaggtgtggaacaaggacagctcttccaaaaaccttatccctaggctgcaaaagatctggaagaattacctaagcatgaacaagtacaaagtgtcctacaaggggccaggaccaggcatcaagttcagtgcagaggccctgcgctgccacctccgggaccatgtgaatgtatccatggtagaggtcacagattttcccttcaatacctctgaatgggagggttatctgcccaaggagagcattaggaccaaggctgggccttggggcaggtgtgctgttgtgtcgtcagcgggatctctgaagtcctcccaactaggcagagaaatcgatgatcatgacgcagtcctgaggtttaatggggcacccacagccaacttccaacaagatgtgggcacaaaaactaccattcgcctgatgaactctcagttggttaccacagagaagcgcttcctcaaagacagtttgtacaatgaaggaatcctaattgtatgggacccatctgtataccactcagatatcccaaagtggtaccagaatccggattataatttctttaacaactacaagacttatcgtaagctgcaccccaatcagcccttttacatcctcaagccccagatgccttgggagctatgggacattcttcaagaaatctccccagaagagattcagccaaaccccccatcctctgggatgcttggtatcatcatcatgatgacgctgtgtgaccaggtggatatttatgagttcctcccatccaagcgcaagactgacgtgtgctactactaccagaagttcttcgatagtgcctgcacgatgggtgcctaccacccgctgctctatgagaagaatttggtgaagcatctcaaccagggcacagatgaggacatctacctgcttggaaaagccacactgcctggcttccggaccattcactgctaagcacaggctcctcactcttctccatcaggcattaaatgaatggtctcttggccaccccagcctgggaagaacattttcctgaacaattccagcctgctccttttactctaggggcctctgtcagcaagaccatggggacttcaagagcctgtggtcaggaaatcaggtccagccttccctgtagccagacagtttatgagcccagagcctcctgccacacacatgcacacatatctagcattctttccagacagcatcctccccgccttccaccttggtagatgcaaggtctatctctcccatcagggctgccaaagctgggctttgtttttcccagcagaatgatgccattctcacaaaccaatgctctatattgcttgaagtctgcatctaaatattgatttcacgttttaaagaaattctcttaaattacaattgtgcccaatgcagggtggctctggggggcaagtaggtggtacaggggattggaaacatgctccgcgcctccagagaaaagttgctcccgaggtccatgcccctggaacgtgttcctatcactctggctggttgggctggtccttagactgggtgcttatgattaaagggtcttggttagcccactttccctctccatgtggagatggaaggtagagaaggatacagtgtctatcctcaagttgctacggttcagtgagagaggcagacatctgaacaggcaggtaggattcagtgtgctcagtgcactggggatttggagagagatgggcttgctctctctgtgcacccaggagggccacgcacttaaaactgtgtttgtggatcagagaaggctttatagcacagggggcattcagatgagtcttagaggaagagaagaaacatggcaagcagattacatctgagccgtttgaattgtgtttttctttcttcccatgtttattttctaagatctacctgaacttagagactcaagatatttttttaggaaacctcctacccatgtctgaggtagcaagtgcagcctcacgacagataccaggcaatccagagccacaaaacgtgattcctccaggctctgcctggcctgaccctgtcctgtcagctgggtttacataccagtcccattcttccttttcaatacctacccccaaatcttctcctaaccaccatctgttttttttttttaaaagcattttttgctttaaaagcatcctgaccccaatttctttgagctcacgggccttttgctgaaggtctctcagggtgtagtggtgtggctctctggacttaacgtcactctcagaggtcagaaccttggagatcagaactgattctcaccaggtgtgagaggtgtggtagcagattgcaatgctctgcacctcttccttgcaagtgagcaacttcaggctctctgggcagaggctggcccactgtagtttgcagacatgctctccagatggttttactaagtcccctctccctgatagggaatcctgctggaccagcgcagccctggtgtggagaggttaaaagacttgcacaggatcaccaagtcatgctgtagagccaggattcctagacccagggctctgcactctcaaggctggccccatgtgctcaaggggatctaatgtttgggctccaaactaaccatctcggagctgggctcctcatttactgccaaaccctcagcttatgtagctagaaagggccctggagtgagaaagcctggattttcaaattgatgctcccctactgactagctgtgccactctgggcaaatgctcttccttgagcctgtttccacacctgtaaagtggggatgatgatcctatctcactgcttttgtgaggattacaggaaagcacctgtcctggctctgtacctggcacgtagtaggtgctcagttcatgctggtttccttcctgcctttagtagggacctgctctgtgctcacacctcggctgcatgcaccctgctgtgacggaggctagtgtggaagaggtcctgtcctcagggaattaactgtcttattgggagacaacaactgtcctccttggaacacccaagaaaccatgcaaagcagtggacaacacagaacacgccctcctcctcgctgcctgcagctccaatctgattctgcttgggaatgggcggagcacgtgggctgcttaactgctgtataggacaagccccttacccctctctgggcccatgaattcctggcttggtttatgttctgatttgacacactgattttaatcttcgaatcatgacactgagtgcagaggaggtggcattccgacagcaggacatacatgttggtgtgaagactgggacgacactgggtagaatctagtttttaattattattaatataaaggatcaaattaatttaaatatgattctgaagtctacagaacttttagttctgtgctgtctatgtggacactttggtaaaatgcaaattatgatatggacgttatcattggtctggtgagatgtttcatatttgtgacagttaatttaaaaattatgagttaatgctgcctgtgtctatggggttctgtcttctttgatagccatctattcatctggatcatgggaccctctctaatccttccaccaatcaaataagctattgctattggtttggagttgagatatcagtctcggaaacttctgaaaaatgctaataattacccaaggattatgtcaaattttaaaataaatgtgtgtgtgtttctttaa

SEQ ID NO: 441232 - DNA, 3909 bp, Homo sapiens
cctcaggttcctaaatggaacgcctgggggttgtcttggatgccatagttaaatcctgtccatttgctgagcactgcatgcttttcaaagtgcaatggggtcctttgcacttgtgggatacactgaacatatggtagtgttttcatttttctgacagagatagaaatataatctactggtgataccaagagaatatctggtttgctgctttgataactggagtagctactccactgtaagtagcacactggctttgttcacttttctgtgtgcccaggcacaagcgaatgtctttgaatgggtttcaggaatgccacagtatggcccccttcagcccttacagtggctggcagacaggtggtcatctctgcctaggagctttacctgagcaccacacaaatactgccatttcgccctgtggatcatgatggggtaaagatggggaagcattattcccttgccccctcccccgcctctcgtctttctctttttctgcatattgccagtgctcatcacctcttttctgtttctttgtggtttatagatgatcatgacgcagtcctgaggtttaatggggcacccacagccaacttccaacaagatgtgggcacaaaaactaccattcgcctgatgaactctcagttggttaccacagagaagcgcttcctcaaagacagtttgtacaatgaaggaatcctaattgtatgggacccatctgtataccactcagatatcccaaagtggtaccagaatccggattataatttctttaacaactacaagacttatcgtaagctgcaccccaatcagcccttttacatcctcaagccccagatgccttgggagctatgggacattcttcaagaaatctccccagaagagattcagccaaaccccccatcctctgggatgcttggtatcatcatcatgatgacgctgtgtgaccaggtggatatttatgagttcctcccatccaagcgcaagactgacgtgtgctactactaccagaagttcttcgatagtgcctgcacgatgggtgcctaccacccgctgctctatgagaagaatttggtgaagcatctcaaccagggcacagatgaggacatctacctgcttggaaaagccacactgcctggcttccggaccattcactgctaagcacaggctcctcactcttctccatcaggcattaaatgaatggtctcttggccaccccagcctgggaagaacattttcctgaacaattccagcctgctccttttactctaggggcctctgtcagcaagaccatggggacttcaagagcctgtggtcaggaaatcaggtccagccttccctgtagccagacagtttatgagcccagagcctcctgccacacacatgcacacatatctagcattctttccagacagcatcctccccgccttccaccttggtagatgcaaggtctatctctcccatcagggctgccaaagctgggctttgtttttcccagcagaatgatgccattctcacaaaccaatgctctatattgcttgaagtctgcatctaaatattgatttcacgttttaaagaaattctcttaaattacaattgtgcccaatgcagggtggctctggggggcaagtaggtggtacaggggattggaaacatgctccgcgcctccagagaaaagttgctcccgaggtccatgcccctggaacgtgttcctatcactctggctggttgggctggtccttagactgggtgcttatgattaaagggtcttggttagcccactttccctctccatgtggagatggaaggtagagaaggatacagtgtctatcctcaagttgctacggttcagtgagagaggcagacatctgaacaggcaggtaggattcagtgtgctcagtgcactggggatttggagagagatgggcttgctctctctgtgcacccaggagggccacgcacttaaaactgtgtttgtggatcagagaaggctttatagcacagggggcattcagatgagtcttagaggaagagaagaaacatggcaagcagattacatctgagccgtttgaattgtgtttttctttcttcccatgtttattttctaagatctacctgaacttagagactcaagatatttttttaggaaacctcctacccatgtctgaggtagcaagtgcagcctcacgacagataccaggcaatccagagccacaaaacgtgattcctccaggctctgcctggcctgaccctgtcctgtcagctgggtttacataccagtcccattcttccttttcaatacctacccccaaatcttctcctaaccaccatctgttttttttttttaaaagcattttttgctttaaaagcatcctgaccccaatttctttgagctcacgggccttttgctgaaggtctctcagggtgtagtggtgtggctctctggacttaacgtcactctcagaggtcagaaccttggagatcagaactgattctcaccaggtgtgagaggtgtggtagcagattgcaatgctctgcacctcttccttgcaagtgagcaacttcaggctctctgggcagaggctggcccactgtagtttgcagacatgctctccagatggttttactaagtcccctctccctgatagggaatcctgctggaccagcgcagccctggtgtggagaggttaaaagacttgcacaggatcaccaagtcatgctgtagagccaggattcctagacccagggctctgcactctcaaggctggccccatgtgctcaaggggatctaatgtttgggctccaaactaaccatctcggagctgggctcctcatttactgccaaaccctcagcttatgtagctagaaagggccctggagtgagaaagcctggattttcaaattgatgctcccctactgactagctgtgccactctgggcaaatgctcttccttgagcctgtttccacacctgtaaagtggggatgatgatcctatctcactgcttttgtgaggattacaggaaagcacctgtcctggctctgtacctggcacgtagtaggtgctcagttcatgctggtttccttcctgcctttagtagggacctgctctgtgctcacacctcggctgcatgcaccctgctgtgacggaggctagtgtggaagaggtcctgtcctcagggaattaactgtcttattgggagacaacaactgtcctccttggaacacccaagaaaccatgcaaagcagtggacaacacagaacacgccctcctcctcgctgcctgcagctccaatctgattctgcttgggaatgggcggagcacgtgggctgcttaactgctgtataggacaagccccttacccctctctgggcccatgaattcctggcttggtttatgttctgatttgacacactgattttaatcttcgaatcatgacactgagtgcagaggaggtggcattccgacagcaggacatacatgttggtgtgaagactgggacgacactgggtagaatctagtttttaattattattaatataaaggatcaaattaatttaaatatgattctgaagtctacagaacttttagttctgtgctgtctatgtggacactttggtaaaatgcaaattatgatatggacgttatcattggtctggtgagatgtttcatatttgtgacagttaatttaaaaattatgagttaatgctgcctgtgtctatggggttctgtcttctttgatagccatctattcatctggatcatgggaccctctctaatccttccaccaatcaaataagctattgctattggtttggagttgagatatcagtctcggaaacttctgaaaaatgctaataattacccaaggattatgtcaaattttaaaataaatgtgtgtgtgtttctttaa

SEQ ID NO: 441233 - DNA, 4404 bp, Homo sapiens
ggaggaggttcctgtagggcggcacaaccagggagggcgtggaagctctgcatcccttctcccataccttgctctacacatctcttcatctgtatcctctgcagcatccttgatgataaaccagtaaatatgagttttgatcatcctgagaaaaatgggccttggcctgcagacccaataaaccttccctcccatggataatagtgctaattcctgaggacctgaagggcctgccgcccctgggggattagccagaagcaggcttgttttcctgctcagaacaaagtgacttccctgaacacatcttcattatgattcacaccaacctgaagaaaaagttcagctgctgcgtcctggtctttcttctgtttgcagtcatctgtgtgtggaaggaaaagaagaaagggagttactatgattcctttaaattgcaaaccaaggaattccaggtgttaaagagtctggggaaattggccatggggtctgattcccagtctgtatcctcaagcagcacccaggacccccacaggggccgccagaccctcggcagtctcagaggcctagccaaggccaaaccagaggcctccttccaggtgtggaacaaggacagctcttccaaaaaccttatccctaggctgcaaaagatctggaagaattacctaagcatgaacaagtacaaagtgtcctacaaggggccaggaccaggcatcaagttcagtgcagaggccctgcgctgccacctccgggaccatgtgaatgtatccatggtagaggtcacagattttcccttcaatacctctgaatgggagggttatctgcccaaggagagcattaggaccaaggctgggccttggggcaggtgtgctgttgtgtcgtcagcgggatctctgaagtcctcccaactaggcagagaaatcgatgatcatgacgcagtcctgaggtttaatggggcacccacagccaacttccaacaagatgtgggcacaaaaactaccattcgcctgatgaactctcagttggttaccacagagaagcgcttcctcaaagacagtttgtacaatgaaggaatcctaattgtatgggacccatctgtataccactcagatatcccaaagtggtaccagaatccggattataatttctttaacaactacaagacttatcgtaagctgcaccccaatcagcccttttacatcctcaagccccagatgccttgggagctatgggacattcttcaagaaatctccccagaagagattcagccaaaccccccatcctctgggatgcttggtatcatcatcatgatgacgctgtgtgaccaggtggatatttatgagttcctcccatccaagcgcaagactgacgtgtgctactactaccagaagttcttcgatagtgcctgcacgatgggtgcctaccacccgctgctctatgagaagaatttggtgaagcatctcaaccagggcacagatgaggacatctacctgcttggaaaagccacactgcctggcttccggaccattcactgctaagcacaggctcctcactcttctccatcaggcattaaatgaatggtctcttggccaccccagcctgggaagaacattttcctgaacaattccagcctgctccttttactctaggggcctctgtcagcaagaccatggggacttcaagagcctgtggtcaggaaatcaggtccagccttccctgtagccagacagtttatgagcccagagcctcctgccacacacatgcacacatatctagcattctttccagacagcatcctccccgccttccaccttggtagatgcaaggtctatctctcccatcagggctgccaaagctgggctttgtttttcccagcagaatgatgccattctcacaaaccaatgctctatattgcttgaagtctgcatctaaatattgatttcacgttttaaagaaattctcttaaattacaattgtgcccaatgcagggtggctctggggggcaagtaggtggtacaggggattggaaacatgctccgcgcctccagagaaaagttgctcccgaggtccatgcccctggaacgtgttcctatcactctggctggttgggctggtccttagactgggtgcttatgattaaagggtcttggttagcccactttccctctccatgtggagatggaaggtagagaaggatacagtgtctatcctcaagttgctacggttcagtgagagaggcagacatctgaacaggcaggtaggattcagtgtgctcagtgcactggggatttggagagagatgggcttgctctctctgtgcacccaggagggccacgcacttaaaactgtgtttgtggatcagagaaggctttatagcacagggggcattcagatgagtcttagaggaagagaagaaacatggcaagcagattacatctgagccgtttgaattgtgtttttctttcttcccatgtttattttctaagatctacctgaacttagagactcaagatatttttttaggaaacctcctacccatgtctgaggtagcaagtgcagcctcacgacagataccaggcaatccagagccacaaaacgtgattcctccaggctctgcctggcctgaccctgtcctgtcagctgggtttacataccagtcccattcttccttttcaatacctacccccaaatcttctcctaaccaccatctgttttttttttttaaaagcattttttgctttaaaagcatcctgaccccaatttctttgagctcacgggccttttgctgaaggtctctcagggtgtagtggtgtggctctctggacttaacgtcactctcagaggtcagaaccttggagatcagaactgattctcaccaggtgtgagaggtgtggtagcagattgcaatgctctgcacctcttccttgcaagtgagcaacttcaggctctctgggcagaggctggcccactgtagtttgcagacatgctctccagatggttttactaagtcccctctccctgatagggaatcctgctggaccagcgcagccctggtgtggagaggttaaaagacttgcacaggatcaccaagtcatgctgtagagccaggattcctagacccagggctctgcactctcaaggctggccccatgtgctcaaggggatctaatgtttgggctccaaactaaccatctcggagctgggctcctcatttactgccaaaccctcagcttatgtagctagaaagggccctggagtgagaaagcctggattttcaaattgatgctcccctactgactagctgtgccactctgggcaaatgctcttccttgagcctgtttccacacctgtaaagtggggatgatgatcctatctcactgcttttgtgaggattacaggaaagcacctgtcctggctctgtacctggcacgtagtaggtgctcagttcatgctggtttccttcctgcctttagtagggacctgctctgtgctcacacctcggctgcatgcaccctgctgtgacggaggctagtgtggaagaggtcctgtcctcagggaattaactgtcttattgggagacaacaactgtcctccttggaacacccaagaaaccatgcaaagcagtggacaacacagaacacgccctcctcctcgctgcctgcagctccaatctgattctgcttgggaatgggcggagcacgtgggctgcttaactgctgtataggacaagccccttacccctctctgggcccatgaattcctggcttggtttatgttctgatttgacacactgattttaatcttcgaatcatgacactgagtgcagaggaggtggcattccgacagcaggacatacatgttggtgtgaagactgggacgacactgggtagaatctagtttttaattattattaatataaaggatcaaattaatttaaatatgattctgaagtctacagaacttttagttctgtgctgtctatgtggacactttggtaaaatgcaaattatgatatggacgttatcattggtctggtgagatgtttcatatttgtgacagttaatttacatctattcatctggatcatgggaccctctctaatccttccaccaatcaaataagctattgctattggtttggagttgagatatcagtctcggaaacttctgaaaaatgctaataattacccaaggattatgtcaaattttaaaataaatgtgtgtgtgtttctttaaaaagacacaaagagaaacaacacacaaaaacaaaactagacgcgaccctagggagcggagacaaagcaacaaaaaacacatggaccgcccggtagagaaacaacaaaatgtgggggggcgcggaggatacaaaaatgggggggggggagaaaggggggtcccaaacaggcggagg

SEQ ID NO: 441234 - DNA, 2439 bp, Homo sapiens
ggctgcaggattcggcacgagagatgcaaggtctatctctcccatcagggctgccaaagctgggctttgtttttcccagcagaatgatgccattctcacaaaccaatgctctatattgcttgaagtctgcatctaaatattgatttcacgttttaaagaaattctcttaaattacaattgtgcccaatgcagggtggctctggggggcaagtaggtggtacaggggattggaaacatgctccgcgcctccagaggttgggctggtccttagactgggtgcttatgattaaagggtcttggttagcccactttccctctccatgtggagatggaaggtagagaaggatacagtgtctatcctcaagttgctacggttcagtgagagaggcagacatctgaacaggcaggtaggattcagtgtgctcagtgcactggggatttggagagagatgggcttgctctctctgtgcacccaggagggccacgcacttaaaactgtgtttgtggatcagagaaggctttatagcacagggggcattcagatgagtcttagaggaagagaagaaacatggcaagcagattacatctgagccgtttgaattgtgtttttctttcttcccatgtttattttctaagatctacctgaacttagagactcaagatatttttttaggaaacctcctacccatgtctgaggtagcaagtgcagcctcacgacagataccaggcaatccagagccacaaaacgtgattcctccaggctctgcctggcctgaccctgtcctgtcagctgggtttacataccagtcccattcttccttttcaatacctacccccaaatcttctcctaaccaccatctgttttttttttttaaaagcattttttgctttaaaagcatcctgaccccaatttctttgagctcacgggccttttgctgaaggtctctcagggtgtagtggtgtggctctctggacttaacgtcactctcagaggtcagaaccttggagatcagaactgattctcaccaggtgtgagaggtgtggtagcagattgcaatgctctgcacctcttccttgcaagtgagcaacttcaggctctctgggcagaggctggcccactgtagtttgcagacatgctctccagatggttttactaagtcccctctccctgatagggaatcctgctggaccagcgcagccctggtgtggagaggttaaaagacttgcacaggatcaccaagtcatgctgtagagccaggattcctagacccagggctctgcactctcaaggctggccccatgtgctcaaggggatctaatgtttgggctccaaactaaccatctcggagctgggctcctcatttactgccaaaccctcagcttatgtagctagaaagggccctggagtgagaaagcctggattttcaaattgatgctcccctactgactagctgtgccactctgggcaaatgctcttccttgagcctgtttccacacctgtaaagtggggatgatgatcctatctcactgcttttgtgaggattacaggaaagcacctgtcctggctctgtacctggcacgtagtaggtgctcagttcatgctggtttccttcctgcctttagtagggacctgctctgtgctcacacctcggctgcatgcaccctgctgtgacggaggctagtgtggaagaggtcctgtcctcagggaattaactgtcttattgggagacaacaactgtcctccttggaacacccaagaaaccatgcaaagcagtggacaacacagaacacgccctcctcctcgctgcctgcagctccaatctgattctgcttgggaatgggcggagcacgtgggctgcttaactgctgtataggacaagccccttacccctctctgggcccatgaattcctggcttggtttatgttctgatttgacacactgattttaatcttcgaatcatgacactgagtgcagaggaggtggcattccgacagcaggacatacatgttggtgtgaagactgggacgacactgggtagaatctagtttttaattattattaatataaaggatcaaattaatttaaatatgattctgaagtctacagaacttttagttctgtgctgtctatgtggacactttggtaaaatgcaaattatgatatggacgttatcattggtctggtgagatgtttcatatttgtgacagttaatttaaaaattatgagttaatgctgcctgtgtctatggggttctgtcttctttgatagccatctattcatctggatcatgggaccctctctaatccttccaccaatcaaataagctattgctattggtttggagttgagatatcagtctcggaaacttctgaaaaatgctaataattacccaaggattatgtcaaattttaaaataaatgtgtgtgtgtttctttaa

SEQ ID NO: 441235 - DNA, 2496 bp, Homo sapiens
ggaggaggttcctgtagggcggcacaaccagggagggcgtggaagctctgcatcccttctcccataccttgctctacacatctcttcatctgtatcctctgcagcatccttgatgataaaccagtaaatatgagttttgatcatcctgagaaaaatgggccttggcctgcagacccaataaaccttccctcccatggataatagtgctaattcctgaggacctgaagggcctgccgcccctgggggattagccagaagcaggcttgttttcctgctcagaacaaagtgacttccctgaacacatcttcattatgattcacaccaacctgaagaaaaagttcagctgctgcgtcctggtctttcttctgtttgcagtcatctgtgtgtggaaggaaaagaagaaagggagttactatgattcctttaaattgcaaaccaaggaattccaggtgttaaagagtctggggaaattggccatggggtctgattcccagtctgtatcctcaagcagcacccaggacccccacaggggccgccagaccctcggcagtctcagaggcctagccaaggccaaaccagaggcctccttccaggtgtggaacaaggacagctcttccaaaaaccttatccctaggctgcaaaagatctggaagaattacctaagcatgaacaagtacaaagtgtcctacaaggggccaggaccaggcatcaagttcagtgcagaggccctgcgctgccacctccgggaccatgtgaatgtatccatggtagaggtcacagattttcccttcaatacctctgaatgggagggttatctgcccaaggagagcattaggaccaaggctgggccttggggcaggtgtgctgttgtgtcgtcagcgggatctctgaagtcctcccaactaggcagagaaatcgatgatcatgacgcagtcctgaggtttaatggggcacccacagccaacttccaacaagatgtgggcacaaaaactaccattcgcctgatgaactctcagttggttaccacagagaagcgcttcctcaaagacagtttgtacaatgaaggaatcctaattgtatgggacccatctgtataccactcagatatcccaaagtggtaccagaatccggattataatttctttaacaactacaagacttatcgtaagctgcaccccaatcagcccttttacatcctcaagccccagatgccttgggagctatgggacattcttcaagaaatctccccagaagagattcagccaaaccccccatcctctgggatgcttggtatcatcatcatgatgacgctgtgtgaccaggtggatatttatgagttcctcccatccaagcgcaagactgacgtgtgctactactaccagaagttcttcgatagtgcctgcacgatgggtgcctaccacccgctgctctatgagaagaatttggtgaagcatctcaaccagggcacagatgaggacatctacctgcttggaaaagccacactgcctggcttccggaccattcactgctaagcacaggctcctcactcttctccatcaggcattaaatgaatggtctcttggccaccccagcctgggaagaacattttcctgaacaattccagcctgctccttttactctaggggcctctgtcagcaagaccatggggacttcaagagcctgtggtcaggaaatcaggtccagccttccctgtagccagacagtttatgagcccagagcctcctgccacacacatgcacacatatctagcattcttattgggagacaacaactgtcctccttggaacacccaagaaaccatgcaaagcagtggacaacacagaacacgccctcctcctcgctgcctgcagctccaatctgattctgcttgggaatgggcggagcacgtgggctgcttaactgctgtataggacaagccccttacccctctctgggcccatgaattcctggcttggtttatgttctgatttgacacactgattttaatcttcgaatcatgacactgagtgcagaggaggtggcattccgacagcaggacatacatgttggtgtgaagactgggacgacactgggtagaatctagtttttaattattattaatataaaggatcaaattaatttaaatatgattctgaagtctacagaacttttagttctgtgctgtctatgtggacactttggtaaaatgcaaattatgatatggacgttatcattggtctggtgagatgtttcatatttgtgacagttaatttaaaaattatgagttaatgctgcctgtgtctatggggttctgtcttctttgatagccatctattcatctggatcatgggaccctctctaatccttccaccaatcaaataagctattgctattggtttggagttgagatatcagtctcggaaacttctgaaaaatgctaataattacccaaggattatgtcaaattttaaaataaatgtgtgtgtgtttctttaa

SEQ ID NO: 441236 - DNA, 1632 bp, Homo sapiens
gctcttcttccttccttctccagtcccttccactgtgcgtcttctgtcccccgttcttccccagcggacccctctttcgagactccctagtggggtccccagctcccgggcgatcctgcccttgccgagcgcgttttctggagtcacctgggggaggggagtcctgggcagggccgggctggggaagacgcctggggcactgcccggcgttaacaaagggagccgataccgaccggcgtgggcgcggagcgggcggccgccaccgagcgtgctgagcaaccgcagcctccgcggccgagagtgcagcgagcaaggggagagccagttgcgcagagccctgcaaccagcagttcccctctccctgatagggaatcctgctggaccagcgcagccctggtgtggagaggttaaaagacttgcacaggatcaccaagtcatgctgtagagccaggattcctagacccagggctctgcactctcaaggctggccccatgtgctcaaggggatctaatgtttgggctccaaactaaccatctcggagctgggctcctcatttactgccaaaccctcagcttatgtagctagaaagggccctggagtgagaaagcctggattttcaaattgatgctcccctactgactagctgtgccactctgggcaaatgctcttccttgagcctgtttccacacctgtaaagtggggatgatgatcctatctcactgcttttgtgaggattacaggaaagcacctgtcctggctctgtacctggcacgtagtaggtgctcagttcatgctggtttccttcctgcctttagtagggacctgctctgtgctcacacctcggctgcatgcaccctgctgtgacggaggctagtgtggaagaggtcctgtcctcagggaattaactgtcttattgggagacaacaactgtcctccttggaacacccaagaaaccatgcaaagcagtggacaacacagaacacgccctcctcctcgctgcctgcagctccaatctgattctgcttgggaatgggcggagcacgtgggctgcttaactgctgtataggacaagccccttacccctctctgggcccatgaattcctggcttggtttatgttctgatttgacacactgattttaatcttcgaatcatgacactgagtgcagaggaggtggcattccgacagcaggacatacatgttggtgtgaagactgggacgacactgggtagaatctagtttttaattattattaatataaaggatcaaattaatttaaatatgattctgaagtctacagaacttttagttctgtgctgtctatgtggacactttggtaaaatgcaaattatgatatggacgttatcattggtctggtgagatgtttcatatttgtgacagttaatttaaaaattatgagttaatgctgcctgtgtctatggggttctgtcttctttgatagccatctattcatctggatcatgggaccctctctaatccttccaccaatcaaataagctattgctattggtttggagttgagatatcagtctcggaaacttctgaaaaatgctaataattacccaaggattatgtcaaattttaaaataaatgtgtgtgtgtttctttaa

SEQ ID NO: 441237 - DNA, 1193 bp, Homo sapiens
ggctgcaggattcggcacgagagccagggctctgcactctcaaggctggccccatgtgctcaaggggatctaatgtttgggctccaaactaaccatctcggagctgggctcctcatttactgccaaaccctcagcttatgtagctagaaagggccctggagtgagaaagcctggattttcaaattgatgctcccctactgactagctgtgccactctgggcaaatgctcttccttgagcctgtttccacacctgtaaagtggggatgatgatcctatctcactgcttttgtgaggattacaggaaagcacctgtcctggctctgtacctggcacgtagtaggtgctcagttcatgctggtttccttcctgcctttagtagggacctgctctgtgctcacacctcggctgcatgcaccctgctgtgacggaggctagtgtggaagaggtcctgtcctcagggaattaactgtcttattgggagacaacaactgtcctccttggaacacccaagaaaccatgcaaagcagtggacaacacagaacacgccctcctcctcgctgcctgcagctccaatctgattctgcttgggaatgggcggagcacgtgggctgcttaactgctgtataggacaagccccttacccctctctgggcccatgaattcctggcttggtttatgttctgatttgacacactgattttaatcttcgaatcatgacactgagtgcagaggaggtggcattccgacagcaggacatacatgttggtgtgaagactgggacgacactgggtagaatctagtttttaattattattaatataaaggatcaaattaatttaaatatgattctgaagtctacagaacttttagttctgtgctgtctatgtggacactttggtaaaatgcaaattatgatatggacgttatcattggtctggtgagatgtttcatatttgtgacagttaatttaaaaattatgagttaatgctgcctgtgtctatggggttctgtcttctttgatagccatctattcatctggatcatgggaccctctctaatccttccaccaatcaaataagctattgctattggtttggagttgagatatcagtctcggaaacttctgaaaaatgctaataattacccaaggattatgtcaaattttaaaataaatgtgtgtgtgtttctttaa

SEQ ID NO: 441238 - DNA, 1561 bp, Homo sapiens
gctcttcttccttccttctccagtcccttccactgtgcgtcttctgtcccccgttcttccccagcggacccctctttcgagactccctagtggggtccccagctcccgggcgatcctgcccttgccgagcgcgttttctggagtcacctgggggaggggagtcctgggcagggccgggctggggaagacgcctggggcactgcccggcgttaacaaagggagccgataccgaccggcgtgggcgcggagcgggcggccgccaccgagcgtgctgagcaaccgcagcctccgcggccgagagtgcagcgagcaaggggagagccagttgcgcagagccctgcaaccagcagtccagggagaagtggtgaatgtcatggagcccagctgaaatggactggcccccttgagcctgtcccaagccctggtgccaggtgtccatccccgtgctgagatgagttttgatcatcctgagaaaaatgggccttggcctgcagacccaataaaccttccctcccatggataatagtgctaattcctgaggacctgaagggcctgccgcccctgggggattagccagaagcaggcttgttttcctgctcagaacaaagtgacttccctgaacacatcttcattatgattcacaccaacctgaagaaaaagttcagctgctgcgtcctggtctttcttctgtttgcagtcatctgtgtgtggaaggaaaagaagaaagggagttactatgattcctttaaattgcaaaccaaggaattccaggtgttaaagagtctggggaaattggccatggggtctgattcccagtctgtatcctcaagcagcacccaggacccccacaggggccgccagaccctcggcagtctcagaggcctagccaaggccaaaccagaggcctccttccaggtgtggaacaaggacagctcttccaaaaaccttatccctaggctgcaaaagatctggaagaattacctaagcatgaacaagtacaaagtgtcctacaaggggccaggaccaggcatcaagttcagtgcagaggccctgcgctgccacctccgggaccatgtgaatgtatccatggtagaggtcacagattttcccttcaatacctctgaatgggagggttatctgcccaaggagagcattaggaccaaggctgggccttggggcaggtgtgctgttgtgtcgtcagcgggatctctgaagtcctcccaactaggcagagaaatcgatgatcatgacgcagtcctgaggtttaatggggcacccacagccaacttccaacaagatgtgggcacaaaaactaccattcgcctgatgaactctcaggtaaaatttcttctgtgcagctatggagtaagagaaggaccacagtgtgggctctaatgtggaatgtatctactgggagcatatctaggctgccaattaagtctcttgatcttcctgagttcctgattcctcactggagaagaagacaatgattccatgacccaactgatgatgtgttttttaaagaaaaaccctttagtattagtgtctgctaatggaggtg

SEQ ID NO: 441239 - DNA, 1326 bp, Homo sapiens
gctcttcttccttccttctccagtcccttccactgtgcgtcttctgtcccccgttcttccccagcggacccctctttcgagactccctagtggggtccccagctcccgggcgatcctgcccttgccgagcgcgttttctggagtcacctgggggaggggagtcctgggcagggccgggctggggaagacgcctggggcactgcccggcgttaacaaagggagccgataccgaccggcgtgggcgcggagcgggcggccgccaccgagcgtgctgagcaaccgcagcctccgcggccgagagtgcagcgagcaaggggagagccagttgcgcagagccctgcaaccagcagtccagggagaagtggtgaatgtcatggagcccagctgaaatggactggcccccttgagcctgtcccaagccctggtgccaggtgtccatccccgtgctgagatgagttttgatcatcctgagaaaaatgggccttggcctgcagacccaataaaccttccctcccatggataatagtgctaattcctgaggacctgaagggcctgccgcccctgggggattagccagaagcaggcttgttttcctgctcagaacaaagtgacttccctgaacacatcttcattatgattcacaccaacctgaagaaaaagttcagctgctgcgtcctggtctttcttctgtttgcagtcatctgtgtgtggaaggaaaagaagaaagggagttactatgattcctttaaattgcaaaccaaggaattccaggtgttaaagagtctggggaaattggccatggggtctgattcccagtctgtatcctcaagcagcacccaggacccccacaggggccgccagaccctcggcagtctcagaggcctagccaaggccaaaccagaggcctccttccaggtgtggaacaaggacagctcttccaaaaaccttatccctaggctgcaaaagatctggaagaattacctaagcatgaacaagtacaaagtgtcctacaaggggccaggaccaggcatcaagttcagtgcagaggccctgcgctgccacctccgggaccatgtgaatgtatccatggtagaggtcacagattttcccttcaatacctctgaatgggagggttatctgcccaaggagagcattaggaccaaggctgggccttggggcaggtgtgctgttgtgtcgtcagcgggatctctgaagtcctcccaactaggcagagaaatcggtatgttctggggttgttctgtgaatggcagtgcttattgggactggctgggcatattgatggtatgggagacaagtggcccaagt

SEQ ID NO: 441240 - DNA, 889 bp, Homo sapiens
gctcttcttccttccttctccagtcccttccactgtgcgtcttctgtcccccgttcttccccagcggacccctctttcgagactccctagtggggtccccagctcccgggcgatcctgcccttgccgagcgcgttttctggagtcacctgggggaggggagtcctgggcagggccgggctggggaagacgcctggggcactgcccggcgttaacaaagggagccgataccgaccggcgtgggcgcggagcgggcggccgccaccgagcgtgctgagcaaccgcagcctccgcggccgagagtgcagcgagcaaggggagagccagttgcgcagagccctgcaaccagcagtccagggagaagtggtgaatgtcatggagcccagctgaaatggactggcccccttgagcctgtcccaagccctggtgccaggtgtccatccccgtgctgaggtaagaccccctgaagcccagcctgaggaagagaggacacaatgccttttttgcaggggcaggaggcagagggccttctcaggaaagaaggagcagttagttgtttctggttcagtcaaaccatctgcttcagcctcagcccgttgggaggcaaggtcaattggtggccaaagaggcttctgctttgtcagagcaggtctttggaatcttgatgggagttgtattttctcagttgctggtgaaatttgaattcccaagggaatacatttatcctccaggtaagactgcaccggattcaggtgaatgcttaagtatacctcctctgctctgcaagggagctcttgggaaacacacacacacgcacacacacacgcgcgtgccacgctctctctctttcaacccaagggtgacagagtgaaacattatgcagagaggtta

SEQ ID NO: 441241 - DNA, 4605 bp, Homo sapiens
gctcttcttccttccttctccagtcccttccactgtgcgtcttctgtcccccgttcttccccagcggacccctctttcgagactccctagtggggtccccagctcccgggcgatcctgcccttgccgagcgcgttttctggagtcacctgggggaggggagtcctgggcagggccgggctggggaagacgcctggggcactgcccggcgttaacaaagggagccgataccgaccggcgtgggcgcggagcgggcggccgccaccgagcgtgctgagcaaccgcagcctccgcggccgagagtgcagcgagcaaggggagagccagttgcgcagagccctgcaaccagcagtccagggagaagtggtgaatgtcatggagcccagctgaaatggactggcccccttgagcctgtcccaagccctggtgccaggtgtccatccccgtgctgagatgagttttgatcatcctgagaaaaatgggccttggcctgcagacccaataaaccttccctcccatggataatagtgctaattcctgaggacctgaagggcctgccgcccctgggggattagccagaagcaggcttgttttcctgctcagaacaaagtgacttccctgaacacatcttcattatgattcacaccaacctgaagaaaaagttcagctgctgcgtcctggtctttcttctgtttgcagtcatctgtgtgtggaaggaaaagaagaaagggagttactatgattcctttaaattgcaaaccaaggaattccaggtgttaaagagtctggggaaattggccatggggtctgattcccagtctgtatcctcaagcagcacccaggacccccacaggggccgccagaccctcggcagtctcagaggcctagccaaggccaaaccagaggcctccttccaggtgtggaacaaggacagctcttccaaaaaccttatccctaggctgcaaaagatctggaagaattacctaagcatgaacaagtacaaagtgtcctacaaggggccaggaccaggcatcaagttcagtgcagaggccctgcgctgccacctccgggaccatgtgaatgtatccatggtagaggtcacagattttcccttcaatacctctgaatgggagggttatctgcccaaggagagcattaggaccaaggctgggccttggggcaggtgtgctgttgtgtcgtcagcgggatctctgaagtcctcccaactaggcagagaaatcgatgatcatgacgcagtcctgaggtttaatggggcacccacagccaacttccaacaagatgtgggcacaaaaactaccattcgcctgatgaactctcagttggttaccacagagaagcgcttcctcaaagacagtttgtacaatgaaggaatcctaattgtatgggacccatctgtataccactcagatatcccaaagtggtaccagaatccggattataatttctttaacaactacaagacttatcgtaagctgcaccccaatcagcccttttacatcctcaagccccagatgccttgggagctatgggacattcttcaagaaatctccccagaagagattcagccaaaccccccatcctctgggatgcttggtatcatcatcatgatgacgctgtgtgaccaggtggatatttatgagttcctcccatccaagcgcaagactgacgtgtgctactactaccagaagttcttcgatagtgcctgcacgatgggtgcctaccacccgctgctctatgagaagaatttggtgaagcatctcaaccagggcacagatgaggacatctacctgcttggaaaagccacactgcctggcttccggaccattcactgctaagcacaggctcctcactcttctccatcaggcattaaatgaatggtctcttggccaccccagcctgggaagaacattttcctgaacaattccagcctgctccttttactctaggggcctctgtcagcaagaccatggggacttcaagagcctgtggtcaggaaatcaggtccagccttccctgtagccagacagtttatgagcccagagcctcctgccacacacatgcacacatatctagcattctttccagacagcatcctccccgccttccaccttggtagatgcaaggtctatctctcccatcagggctgccaaagctgggctttgtttttcccagcagaatgatgccattctcacaaaccaatgctctatattgcttgaagtctgcatctaaatattgatttcacgttttaaagaaattctcttaaattacaattgtgcccaatgcagggtggctctggggggcaagtaggtggtacaggggattggaaacatgctccgcgcctccagagaaaagttgctcccgaggtccatgcccctggaacgtgttcctatcactctggctggttgggctggtccttagactgggtgcttatgattaaagggtcttggttagcccactttccctctccatgtggagatggaaggtagagaaggatacagtgtctatcctcaagttgctacggttcagtgagagaggcagacatctgaacaggcaggtaggattcagtgtgctcagtgcactggggatttggagagagatgggcttgctctctctgtgcacccaggagggccacgcacttaaaactgtgtttgtggatcagagaaggctttatagcacagggggcattcagatgagtcttagaggaagagaagaaacatggcaagcagattacatctgagccgtttgaattgtgtttttctttcttcccatgtttattttctaagatctacctgaacttagagactcaagatatttttttaggaaacctcctacccatgtctgaggtagcaagtgcagcctcacgacagataccaggcaatccagagccacaaaacgtgattcctccaggctctgcctggcctgaccctgtcctgtcagctgggtttacataccagtcccattcttccttttcaatacctacccccaaatcttctcctaaccaccatctgttttttttttttaaaagcattttttgctttaaaagcatcctgaccccaatttctttgagctcacgggccttttgctgaaggtctctcagggtgtagtggtgtggctctctggacttaacgtcactctcagaggtcagaaccttggagatcagaactgattctcaccaggtgtgagaggtgtggtagcagattgcaatgctctgcacctcttccttgcaagtgagcaacttcaggctctctgggcagaggctggcccactgtagtttgcagacatgctctccagatggttttactaagtcccctctccctgatagggaatcctgctggaccagcgcagccctggtgtggagaggttaaaagacttgcacaggatcaccaagtcatgctgtagagccaggattcctagacccagggctctgcactctcaaggctggccccatgtgctcaaggggatctaatgtttgggctccaaactaaccatctcggagctgggctcctcatttactgccaaaccctcagcttatgtagctagaaagggccctggagtgagaaagcctggattttcaaattgatgctcccctactgactagctgtgccactctgggcaaatgctcttccttgagcctgtttccacacctgtaaagtggggatgatgatcctatctcactgcttttgtgaggattacaggaaagcacctgtcctggctctgtacctggcacgtagtaggtgctcagttcatgctggtttccttcctgcctttagtagggacctgctctgtgctcacacctcggctgcatgcaccctgctgtgacggaggctagtgtggaagaggtcctgtcctcagggaattaactgtcttattgggagacaacaactgtcctccttggaacacccaagaaaccatgcaaagcagtggacaacacagaacacgccctcctcctcgctgcctgcagctccaatctgattctgcttgggaatgggcggagcacgtgggctgcttaactgctgtataggacaagccccttacccctctctgggcccatgaattcctggcttggtttatgttctgatttgacacactgattttaatcttcgaatcatgacactgagtgcagaggaggtggcattccgacagcaggacatacatgttggtgtgaagactgggacgacactgggtagaatctagtttttaattattattaatataaaggatcaaattaatttaaatatgattctgaagtctacagaacttttagttctgtgctgtctatgtggacactttggtaaaatgcaaattatgatatggacgttatcattggtctggtgagatgtttcatatttgtgacagttaatttaaaaattatgagttaatgctgcctgtgtctatggggttctgtcttctttgatagccatctattcatctggatcatgggaccctctctaatccttccaccaatcaaataagctattgctattggtttggagttgagatatcagtctcggaaacttctgaaaaatgctaataattacccaaggattatgtcaaattttaaaataaatgtgtgtgtgtttctttaa

SEQ ID NO: 441242 - DNA, 4235 bp, Homo sapiens
ggaggaggttcctgtagggcggcacaaccagggagggcgtggaagctctgcatcccttctcccataccttgctctacacatctcttcatctgtatcctctgcagcatccttgatgataaaccagtaaatatgagttttgatcatcctgagaaaaatgggccttggcctgcagacccaataaaccttccctcccatggataatagtgctaattcctgaggacctgaagggcctgccgcccctgggggattagccagaagcaggcttgttttcctgctcagaacaaagtgacttccctgaacacatcttcattatgattcacaccaacctgaagaaaaagttcagctgctgcgtcctggtctttcttctgtttgcagtcatctgtgtgtggaaggaaaagaagaaagggagttactatgattcctttaaattgcaaaccaaggaattccaggtgttaaagagtctggggaaattggccatggggtctgattcccagtctgtatcctcaagcagcacccaggacccccacaggggccgccagaccctcggcagtctcagaggcctagccaaggccaaaccagaggcctccttccaggtgtggaacaaggacagctcttccaaaaaccttatccctaggctgcaaaagatctggaagaattacctaagcatgaacaagtacaaagtgtcctacaaggggccaggaccaggcatcaagttcagtgcagaggccctgcgctgccacctccgggaccatgtgaatgtatccatggtagaggtcacagattttcccttcaatacctctgaatgggagggttatctgcccaaggagagcattaggaccaaggctgggccttggggcaggtgtgctgttgtgtcgtcagcgggatctctgaagtcctcccaactaggcagagaaatcgatgatcatgacgcagtcctgaggtttaatggggcacccacagccaacttccaacaagatgtgggcacaaaaactaccattcgcctgatgaactctcagttggttaccacagagaagcgcttcctcaaagacagtttgtacaatgaaggaatcctaattgtatgggacccatctgtataccactcagatatcccaaagtggtaccagaatccggattataatttctttaacaactacaagacttatcgtaagctgcaccccaatcagcccttttacatcctcaagccccagatgccttgggagctatgggacattcttcaagaaatctccccagaagagattcagccaaaccccccatcctctgggatgcttggtatcatcatcatgatgacgctgtgtgaccaggtggatatttatgagttcctcccatccaagcgcaagactgacgtgtgctactactaccagaagttcttcgatagtgcctgcacgatgggtgcctaccacccgctgctctatgagaagaatttggtgaagcatctcaaccagggcacagatgaggacatctacctgcttggaaaagccacactgcctggcttccggaccattcactgctaagcacaggctcctcactcttctccatcaggcattaaatgaatggtctcttggccaccccagcctgggaagaacattttcctgaacaattccagcctgctccttttactctaggggcctctgtcagcaagaccatggggacttcaagagcctgtggtcaggaaatcaggtccagccttccctgtagccagacagtttatgagcccagagcctcctgccacacacatgcacacatatctagcattctttccagacagcatcctccccgccttccaccttggtagatgcaaggtctatctctcccatcagggctgccaaagctgggctttgtttttcccagcagaatgatgccattctcacaaaccaatgctctatattgcttgaagtctgcatctaaatattgatttcacgttttaaagaaattctcttaaattacaattgtgcccaatgcagggtggctctggggggcaagtaggtggtacaggggattggaaacatgctccgcgcctccagagaaaagttgctcccgaggtccatgcccctggaacgtgttcctatcactctggctggttgggctggtccttagactgggtgcttatgattaaagggtcttggttagcccactttccctctccatgtggagatggaaggtagagaaggatacagtgtctatcctcaagttgctacggttcagtgagagaggcagacatctgaacaggcaggtaggattcagtgtgctcagtgcactggggatttggagagagatgggcttgctctctctgtgcacccaggagggccacgcacttaaaactgtgtttgtggatcagagaaggctttatagcacagggggcattcagatgagtcttagaggaagagaagaaacatggcaagcagattacatctgagccgtttgaattgtgtttttctttcttcccatgtttattttctaagatctacctgaacttagagactcaagatatttttttaggaaacctcctacccatgtctgaggtagcaagtgcagcctcacgacagataccaggcaatccagagccacaaaacgtgattcctccaggctctgcctggcctgaccctgtcctgtcagctgggtttacataccagtcccattcttccttttcaatacctacccccaaatcttctcctaaccaccatctgttttttttttttaaaagcattttttgctttaaaagcatcctgaccccaatttctttgagctcacgggccttttgctgaaggtctctcagggtgtagtggtgtggctctctggacttaacgtcactctcagaggtcagaaccttggagatcagaactgattctcaccaggtgtgagaggtgtggtagcagattgcaatgctctgcacctcttccttgcaagtgagcaacttcaggctctctgggcagaggctggcccactgtagtttgcagacatgctctccagatggttttactaagtcccctctccctgatagggaatcctgctggaccagcgcagccctggtgtggagaggttaaaagacttgcacaggatcaccaagtcatgctgtagagccaggattcctagacccagggctctgcactctcaaggctggccccatgtgctcaaggggatctaatgtttgggctccaaactaaccatctcggagctgggctcctcatttactgccaaaccctcagcttatgtagctagaaagggccctggagtgagaaagcctggattgctcttccttgagcctgtttccacacctgtaaagtggggatgatgatcctatctcactgcttttgtgaggattacaggaaagcacctgtcctggctctgtacctggcacgtagtaggtgctcagttcatgctggtttccttcctgcctttagtagggacctgctctgtgctcacacctcggctgcatgcaccctgctgtgacggaggctagtgtggaagaggtcctgtcctcagggaattaactgtcttattgggagacaacaactgtcctccttggaacacccaagaaaccatgcaaagcagtggacaacacagaacacgccctcctcctcgctgcctgcagctccaatctgattctgcttgggaatgggcggagcacgtgggctgcttaactgctgtataggacaagccccttacccctctctgggcccatgaattcctggcttggtttatgttctgatttgacacactgattttaatcttcgaatcatgacactgagtgcagaggaggtggcattccgacagcaggacatacatgttggtgtgaagactgggacgacactgggtagaatctagtttttaattattattaatataaaggatcaaattaatttaaatatgattctgaagtctacagaacttttagttctgtgctgtctatgtggacactttggtaaaatgcaaattatgatatggacgttatcattggtctggtgagatgtttcatatttgtgacagttaatttaaaaattatgagttaatgctgcctgtgtctatggggttctgtcttctttgatagccatctattcatctggatcatgggaccctctctaatccttccaccaatcaaataagctattgctattggtttggagttgagatatcagtctcggaaacttctgaaaaatgctaataattacccaaggattatgtcaaattttaaaataaatgtgtgtgtgtttctttaa

SEQ ID NO: 441243 - DNA, 4346 bp, Homo sapiens
ggctctagaggcgccacttgctggaagagggcgagagagacatttaaaaggcaaggggagagccagttgcgcagagccctgcaaccagcagtccagggagaagtggtgaatgtcatggagcccagctgaaatggactggcccccttgagcctgtcccaagccctggtgccaggtgtccatccccgtgctgagatgagttttgatcatcctgagaaaaatgggccttggcctgcagacccaataaaccttccctcccatggataatagtgctaattcctgaggacctgaagggcctgccgcccctgggggattagccagaagcaggcttgttttcctgctcagaacaaagtgacttccctgaacacatcttcattatgattcacaccaacctgaagaaaaagttcagctgctgcgtcctggtctttcttctgtttgcagtcatctgtgtgtggaaggaaaagaagaaagggagttactatgattcctttaaattgcaaaccaaggaattccaggtgttaaagagtctggggaaattggccatggggtctgattcccagtctgtatcctcaagcagcacccaggacccccacaggggccgccagaccctcggcagtctcagaggcctagccaaggccaaaccagaggcctccttccaggtgtggaacaaggacagctcttccaaaaaccttatccctaggctgcaaaagatctggaagaattacctaagcatgaacaagtacaaagtgtcctacaaggggccaggaccaggcatcaagttcagtgcagaggccctgcgctgccacctccgggaccatgtgaatgtatccatggtagaggtcacagattttcccttcaatacctctgaatgggagggttatctgcccaaggagagcattaggaccaaggctgggccttggggcaggtgtgctgttgtgtcgtcagcgggatctctgaagtcctcccaactaggcagagaaatcgatgatcatgacgcagtcctgaggtttaatggggcacccacagccaacttccaacaagatgtgggcacaaaaactaccattcgcctgatgaactctcagttggttaccacagagaagcgcttcctcaaagacagtttgtacaatgaaggaatcctaattgtatgggacccatctgtataccactcagatatcccaaagtggtaccagaatccggattataatttctttaacaactacaagacttatcgtaagctgcaccccaatcagcccttttacatcctcaagccccagatgccttgggagctatgggacattcttcaagaaatctccccagaagagattcagccaaaccccccatcctctgggatgcttggtatcatcatcatgatgacgctgtgtgaccaggtggatatttatgagttcctcccatccaagcgcaagactgacgtgtgctactactaccagaagttcttcgatagtgcctgcacgatgggtgcctaccacccgctgctctatgagaagaatttggtgaagcatctcaaccagggcacagatgaggacatctacctgcttggaaaagccacactgcctggcttccggaccattcactgctaagcacaggctcctcactcttctccatcaggcattaaatgaatggtctcttggccaccccagcctgggaagaacattttcctgaacaattccagcctgctccttttactctaggggcctctgtcagcaagaccatggggacttcaagagcctgtggtcaggaaatcaggtccagccttccctgtagccagacagtttatgagcccagagcctcctgccacacacatgcacacatatctagcattctttccagacagcatcctccccgccttccaccttggtagatgcaaggtctatctctcccatcagggctgccaaagctgggctttgtttttcccagcagaatgatgccattctcacaaaccaatgctctatattgcttgaagtctgcatctaaatattgatttcacgttttaaagaaattctcttaaattacaattgtgcccaatgcagggtggctctggggggcaagtaggtggtacaggggattggaaacatgctccgcgcctccagagaaaagttgctcccgaggtccatgcccctggaacgtgttcctatcactctggctggttgggctggtccttagactgggtgcttatgattaaagggtcttggttagcccactttccctctccatgtggagatggaaggtagagaaggatacagtgtctatcctcaagttgctacggttcagtgagagaggcagacatctgaacaggcaggtaggattcagtgtgctcagtgcactggggatttggagagagatgggcttgctctctctgtgcacccaggagggccacgcacttaaaactgtgtttgtggatcagagaaggctttatagcacagggggcattcagatgagtcttagaggaagagaagaaacatggcaagcagattacatctgagccgtttgaattgtgtttttctttcttcccatgtttattttctaagatctacctgaacttagagactcaagatatttttttaggaaacctcctacccatgtctgaggtagcaagtgcagcctcacgacagataccaggcaatccagagccacaaaacgtgattcctccaggctctgcctggcctgaccctgtcctgtcagctgggtttacataccagtcccattcttccttttcaatacctacccccaaatcttctcctaaccaccatctgttttttttttttaaaagcattttttgctttaaaagcatcctgaccccaatttctttgagctcacgggccttttgctgaaggtctctcagggtgtagtggtgtggctctctggacttaacgtcactctcagaggtcagaaccttggagatcagaactgattctcaccaggtgtgagaggtgtggtagcagattgcaatgctctgcacctcttccttgcaagtgagcaacttcaggctctctgggcagaggctggcccactgtagtttgcagacatgctctccagatggttttactaagtcccctctccctgatagggaatcctgctggaccagcgcagccctggtgtggagaggttaaaagacttgcacaggatcaccaagtcatgctgtagagccaggattcctagacccagggctctgcactctcaaggctggccccatgtgctcaaggggatctaatgtttgggctccaaactaaccatctcggagctgggctcctcatttactgccaaaccctcagcttatgtagctagaaagggccctggagtgagaaagcctggattttcaaattgatgctcccctactgactagctgtgccactctgggcaaatgctcttccttgagcctgtttccacacctgtaaagtggggatgatgatcctatctcactgcttttgtgaggattacaggaaagcacctgtcctggctctgtacctggcacgtagtaggtgctcagttcatgctggtttccttcctgcctttagtagggacctgctctgtgctcacacctcggctgcatgcaccctgctgtgacggaggctagtgtggaagaggtcctgtcctcagggaattaactgtcttattgggagacaacaactgtcctccttggaacacccaagaaaccatgcaaagcagtggacaacacagaacacgccctcctcctcgctgcctgcagctccaatctgattctgcttgggaatgggcggagcacgtgggctgcttaactgctgtataggacaagccccttacccctctctgggcccatgaattcctggcttggtttatgttctgatttgacacactgattttaatcttcgaatcatgacactgagtgcagaggaggtggcattccgacagcaggacatacatgttggtgtgaagactgggacgacactgggtagaatctagtttttaattattattaatataaaggatcaaattaatttaaatatgattctgaagtctacagaacttttagttctgtgctgtctatgtggacactttggtaaaatgcaaattatgatatggacgttatcattggtctggtgagatgtttcatatttgtgacagttaatttaaaaattatgagttaatgctgcctgtgtctatggggttctgtcttctttgatagccatctattcatctggatcatgggaccctctctaatccttccaccaatcaaataagctattgctattggtttggagttgagatatcagtctcggaaacttctgaaaaatgctaataattacccaaggattatgtcaaattttaaaataaatgtgtgtgtgtttctttaa

SEQ ID NO: 441244 - DNA, 4297 bp, Homo sapiens
cattttttcaacaaatatatgccatggaaaagaagaagtaagggagcgaggaactcttctagataagagagaattgaaaatggcacatcatccagtcatccaaacaaaatgtcctgtccttgtttggatccccttttgagcagatgagttttgatcatcctgagaaaaatgggccttggcctgcagacccaataaaccttccctcccatggataatagtgctaattcctgaggacctgaagggcctgccgcccctgggggattagccagaagcaggcttgttttcctgctcagaacaaagtgacttccctgaacacatcttcattatgattcacaccaacctgaagaaaaagttcagctgctgcgtcctggtctttcttctgtttgcagtcatctgtgtgtggaaggaaaagaagaaagggagttactatgattcctttaaattgcaaaccaaggaattccaggtgttaaagagtctggggaaattggccatggggtctgattcccagtctgtatcctcaagcagcacccaggacccccacaggggccgccagaccctcggcagtctcagaggcctagccaaggccaaaccagaggcctccttccaggtgtggaacaaggacagctcttccaaaaaccttatccctaggctgcaaaagatctggaagaattacctaagcatgaacaagtacaaagtgtcctacaaggggccaggaccaggcatcaagttcagtgcagaggccctgcgctgccacctccgggaccatgtgaatgtatccatggtagaggtcacagattttcccttcaatacctctgaatgggagggttatctgcccaaggagagcattaggaccaaggctgggccttggggcaggtgtgctgttgtgtcgtcagcgggatctctgaagtcctcccaactaggcagagaaatcgatgatcatgacgcagtcctgaggtttaatggggcacccacagccaacttccaacaagatgtgggcacaaaaactaccattcgcctgatgaactctcagttggttaccacagagaagcgcttcctcaaagacagtttgtacaatgaaggaatcctaattgtatgggacccatctgtataccactcagatatcccaaagtggtaccagaatccggattataatttctttaacaactacaagacttatcgtaagctgcaccccaatcagcccttttacatcctcaagccccagatgccttgggagctatgggacattcttcaagaaatctccccagaagagattcagccaaaccccccatcctctgggatgcttggtatcatcatcatgatgacgctgtgtgaccaggtggatatttatgagttcctcccatccaagcgcaagactgacgtgtgctactactaccagaagttcttcgatagtgcctgcacgatgggtgcctaccacccgctgctctatgagaagaatttggtgaagcatctcaaccagggcacagatgaggacatctacctgcttggaaaagccacactgcctggcttccggaccattcactgctaagcacaggctcctcactcttctccatcaggcattaaatgaatggtctcttggccaccccagcctgggaagaacattttcctgaacaattccagcctgctccttttactctaggggcctctgtcagcaagaccatggggacttcaagagcctgtggtcaggaaatcaggtccagccttccctgtagccagacagtttatgagcccagagcctcctgccacacacatgcacacatatctagcattctttccagacagcatcctccccgccttccaccttggtagatgcaaggtctatctctcccatcagggctgccaaagctgggctttgtttttcccagcagaatgatgccattctcacaaaccaatgctctatattgcttgaagtctgcatctaaatattgatttcacgttttaaagaaattctcttaaattacaattgtgcccaatgcagggtggctctggggggcaagtaggtggtacaggggattggaaacatgctccgcgcctccagagaaaagttgctcccgaggtccatgcccctggaacgtgttcctatcactctggctggttgggctggtccttagactgggtgcttatgattaaagggtcttggttagcccactttccctctccatgtggagatggaaggtagagaaggatacagtgtctatcctcaagttgctacggttcagtgagagaggcagacatctgaacaggcaggtaggattcagtgtgctcagtgcactggggatttggagagagatgggcttgctctctctgtgcacccaggagggccacgcacttaaaactgtgtttgtggatcagagaaggctttatagcacagggggcattcagatgagtcttagaggaagagaagaaacatggcaagcagattacatctgagccgtttgaattgtgtttttctttcttcccatgtttattttctaagatctacctgaacttagagactcaagatatttttttaggaaacctcctacccatgtctgaggtagcaagtgcagcctcacgacagataccaggcaatccagagccacaaaacgtgattcctccaggctctgcctggcctgaccctgtcctgtcagctgggtttacataccagtcccattcttccttttcaatacctacccccaaatcttctcctaaccaccatctgttttttttttttaaaagcattttttgctttaaaagcatcctgaccccaatttctttgagctcacgggccttttgctgaaggtctctcagggtgtagtggtgtggctctctggacttaacgtcactctcagaggtcagaaccttggagatcagaactgattctcaccaggtgtgagaggtgtggtagcagattgcaatgctctgcacctcttccttgcaagtgagcaacttcaggctctctgggcagaggctggcccactgtagtttgcagacatgctctccagatggttttactaagtcccctctccctgatagggaatcctgctggaccagcgcagccctggtgtggagaggttaaaagacttgcacaggatcaccaagtcatgctgtagagccaggattcctagacccagggctctgcactctcaaggctggccccatgtgctcaaggggatctaatgtttgggctccaaactaaccatctcggagctgggctcctcatttactgccaaaccctcagcttatgtagctagaaagggccctggagtgagaaagcctggattttcaaattgatgctcccctactgactagctgtgccactctgggcaaatgctcttccttgagcctgtttccacacctgtaaagtggggatgatgatcctatctcactgcttttgtgaggattacaggaaagcacctgtcctggctctgtacctggcacgtagtaggtgctcagttcatgctggtttccttcctgcctttagtagggacctgctctgtgctcacacctcggctgcatgcaccctgctgtgacggaggctagtgtggaagaggtcctgtcctcagggaattaactgtcttattgggagacaacaactgtcctccttggaacacccaagaaaccatgcaaagcagtggacaacacagaacacgccctcctcctcgctgcctgcagctccaatctgattctgcttgggaatgggcggagcacgtgggctgcttaactgctgtataggacaagccccttacccctctctgggcccatgaattcctggcttggtttatgttctgatttgacacactgattttaatcttcgaatcatgacactgagtgcagaggaggtggcattccgacagcaggacatacatgttggtgtgaagactgggacgacactgggtagaatctagtttttaattattattaatataaaggatcaaattaatttaaatatgattctgaagtctacagaacttttagttctgtgctgtctatgtggacactttggtaaaatgcaaattatgatatggacgttatcattggtctggtgagatgtttcatatttgtgacagttaatttaaaaattatgagttaatgctgcctgtgtctatggggttctgtcttctttgatagccatctattcatctggatcatgggaccctctctaatccttccaccaatcaaataagctattgctattggtttggagttgagatatcagtctcggaaacttctgaaaaatgctaataattacccaaggattatgtcaaattttaaaataaatgtgtgtgtgtttctttaa

SEQ ID NO: 441245 - DNA, 3948 bp, Homo sapiens
gctcttcttccttccttctccagtcccttccactgtgcgtcttctgtcccccgttcttccccagcggacccctctttcgagactccctagtggggtccccagctcccgggcgatcctgcccttgccgagcgcgttttctggagtcacctgggggaggggagtcctgggcagggccgggctggggaagacgcctggggcactgcccggcgttaacaaagggagccgataccgaccggcgtgggcgcggagcgggcggccgccaccgagcgtgctgagcaaccgcagcctccgcggccgagagtgcagcgagcaaggggagagccagttgcgcagagccctgcaaccagcagtccagggagaagtggtgaatgtcatggagcccagctgaaatggactggcccccttgagcctgtcccaagccctggtgccaggtgtccatccccgtgctgagatgagttttgatcatcctgagaaaaatgggccttggcctgcagacccaataaaccttccctcccatggataatagtgctaattcctgaggacctgaagggcctgccgcccctgggggattagccagaagcagatgatcatgacgcagtcctgaggtttaatggggcacccacagccaacttccaacaagatgtgggcacaaaaactaccattcgcctgatgaactctcagttggttaccacagagaagcgcttcctcaaagacagtttgtacaatgaaggaatcctaattgtatgggacccatctgtataccactcagatatcccaaagtggtaccagaatccggattataatttctttaacaactacaagacttatcgtaagctgcaccccaatcagcccttttacatcctcaagccccagatgccttgggagctatgggacattcttcaagaaatctccccagaagagattcagccaaaccccccatcctctgggatgcttggtatcatcatcatgatgacgctgtgtgaccaggtggatatttatgagttcctcccatccaagcgcaagactgacgtgtgctactactaccagaagttcttcgatagtgcctgcacgatgggtgcctaccacccgctgctctatgagaagaatttggtgaagcatctcaaccagggcacagatgaggacatctacctgcttggaaaagccacactgcctggcttccggaccattcactgctaagcacaggctcctcactcttctccatcaggcattaaatgaatggtctcttggccaccccagcctgggaagaacattttcctgaacaattccagcctgctccttttactctaggggcctctgtcagcaagaccatggggacttcaagagcctgtggtcaggaaatcaggtccagccttccctgtagccagacagtttatgagcccagagcctcctgccacacacatgcacacatatctagcattctttccagacagcatcctccccgccttccaccttggtagatgcaaggtctatctctcccatcagggctgccaaagctgggctttgtttttcccagcagaatgatgccattctcacaaaccaatgctctatattgcttgaagtctgcatctaaatattgatttcacgttttaaagaaattctcttaaattacaattgtgcccaatgcagggtggctctggggggcaagtaggtggtacaggggattggaaacatgctccgcgcctccagagaaaagttgctcccgaggtccatgcccctggaacgtgttcctatcactctggctggttgggctggtccttagactgggtgcttatgattaaagggtcttggttagcccactttccctctccatgtggagatggaaggtagagaaggatacagtgtctatcctcaagttgctacggttcagtgagagaggcagacatctgaacaggcaggtaggattcagtgtgctcagtgcactggggatttggagagagatgggcttgctctctctgtgcacccaggagggccacgcacttaaaactgtgtttgtggatcagagaaggctttatagcacagggggcattcagatgagtcttagaggaagagaagaaacatggcaagcagattacatctgagccgtttgaattgtgtttttctttcttcccatgtttattttctaagatctacctgaacttagagactcaagatatttttttaggaaacctcctacccatgtctgaggtagcaagtgcagcctcacgacagataccaggcaatccagagccacaaaacgtgattcctccaggctctgcctggcctgaccctgtcctgtcagctgggtttacataccagtcccattcttccttttcaatacctacccccaaatcttctcctaaccaccatctgttttttttttttaaaagcattttttgctttaaaagcatcctgaccccaatttctttgagctcacgggccttttgctgaaggtctctcagggtgtagtggtgtggctctctggacttaacgtcactctcagaggtcagaaccttggagatcagaactgattctcaccaggtgtgagaggtgtggtagcagattgcaatgctctgcacctcttccttgcaagtgagcaacttcaggctctctgggcagaggctggcccactgtagtttgcagacatgctctccagatggttttactaagtcccctctccctgatagggaatcctgctggaccagcgcagccctggtgtggagaggttaaaagacttgcacaggatcaccaagtcatgctgtagagccaggattcctagacccagggctctgcactctcaaggctggccccatgtgctcaaggggatctaatgtttgggctccaaactaaccatctcggagctgggctcctcatttactgccaaaccctcagcttatgtagctagaaagggccctggagtgagaaagcctggattttcaaattgatgctcccctactgactagctgtgccactctgggcaaatgctcttccttgagcctgtttccacacctgtaaagtggggatgatgatcctatctcactgcttttgtgaggattacaggaaagcacctgtcctggctctgtacctggcacgtagtaggtgctcagttcatgctggtttccttcctgcctttagtagggacctgctctgtgctcacacctcggctgcatgcaccctgctgtgacggaggctagtgtggaagaggtcctgtcctcagggaattaactgtcttattgggagacaacaactgtcctccttggaacacccaagaaaccatgcaaagcagtggacaacacagaacacgccctcctcctcgctgcctgcagctccaatctgattctgcttgggaatgggcggagcacgtgggctgcttaactgctgtataggacaagccccttacccctctctgggcccatgaattcctggcttggtttatgttctgatttgacacactgattttaatcttcgaatcatgacactgagtgcagaggaggtggcattccgacagcaggacatacatgttggtgtgaagactgggacgacactgggtagaatctagtttttaattattattaatataaaggatcaaattaatttaaatatgattctgaagtctacagaacttttagttctgtgctgtctatgtggacactttggtaaaatgcaaattatgatatggacgttatcattggtctggtgagatgtttcatatttgtgacagttaatttaaaaattatgagttaatgctgcctgtgtctatggggttctgtcttctttgatagccatctattcatctggatcatgggaccctctctaatccttccaccaatcaaataagctattgctattggtttggagttgagatatcagtctcggaaacttctgaaaaatgctaataattacccaaggattatgtcaaattttaaaataaatgtgtgtgtgtttctttaa

SEQ ID NO: 441246 - DNA, 4551 bp, Homo sapiens
gctcttcttccttccttctccagtcccttccactgtgcgtcttctgtcccccgttcttccccagcggacccctctttcgagactccctagtggggtccccagctcccgggcgatcctgcccttgccgagcgcgttttctggagtcacctgggggaggggagtcctgggcagggccgggctggggaagacgcctggggcactgcccggcgttaacaaagggagccgataccgaccggcgtgggcgcggagcgggcggccgccaccgagcgtgctgagcaaccgcagcctccgcggccgagagtgcagcgagcaaggggagagccagttgcgcagagccctgcaaccagcagtccagggagaagtggtgaatgtcatggagcccagctgaaatggactggcccccttgagcctgtcccaagccctggtgccaggtgtccatccccgtgctgagatgagttttgatcatcctgagaaaaatgggccttggcctgcagacccaataaaccttccctcccatggataatagtgctaattcctgaggacctgaagggcctgccgcccctgggggattagccagaagcaggcttgttttcctgctcagaacaaagtgacttccctgaacacatcttcattatgattcacaccaacctgaagaaaaagttcagctgctgcgtcctggtctttcttctgtttgcagtcatctgtgtgtggaaggaaaagaagaaagggagttactatgattcctttaaattgcaaaccaaggaattccaggtgttaaagagtctggggaaattggccatggggtctgattcccagtctgtatcctcaagcagcacccaggacccccacaggggccgccagaccctcggcagtctcagaggcctagccaaggccaaaccagaggcctccttccaggtgtggaacaaggacagctcttccaaaaaccttatccctaggctgcaaaagatctggaagaattacctaagcatgaacaagtacaaagtgtcctacaaggggccaggaccaggcatcaagttcagtgcagaggccctgcgctgccacctccgggaccatgtgaatgtatccatggtagaggtcacagattttcccttcaatacctctgaatgggagggttatctgcccaaggagagcattaggaccaaggctgggccttggggcaggtgtgctgttgtgtcgtcagcgggatctctgaagtcctcccaactaggcagagaaatcgatgatcatgacgcagtcctgaggtttaatggggcacccacagccaacttccaacaagatgtgggcacaaaaactaccattcgcctgatgaactctcagttggttaccacagagaagcgcttcctcaaagacagtttgtacaatgaaggaatcctaattgtatgggacccatctgtataccactcagatatcccaaagtggtaccagaatccggattataatttctttaacaactacaagacttatcgtaagctgcaccccaatcagcccttttacatcctcaagccccagatgccttgggagctatgggacattcttcaagaaatctccccagaagagattcagccaaaccccccatcctctgggatgcttggtatcatcatcatgatgacgctgtgtgaccaggtggatatttatgagttcctcccatccaagcgcaagactgacgtgtgctactactaccagaagttcttcgatagtgcctgcacgatgggtgcctaccacccgctgctctatgagaagaatttggtgaagcatctcaaccagggcacagatgaggacatctacctgcttggaaaagccacactgcctggcttccggaccattcactgctaagcacaggctcctcactcttctccatcaggcattaaatgaatggtctcttggccaccccagcctgggaagaacattttcctgaacaattccagcctgctccttttactctaggggcctctgtcagcaagaccatggggacttcaagagcctgtggtcaggaaatcaggtccagccttccctgtagccagacagtttatgagcccagagcctcctgccacacacatgcacacatatctagcattctttccagacagcatcctccccgccttccaccttggtagatgcaaggtctatctctcccatcagggctgccaaagctgggctttgtttttcccagcagaatgatgccattctcacaaaccaatgctctatattgcttgaagtctgcatctaaatattgatttcacgttttaaagaaattctcttaaattacaattgtgcccaatgcagggtggctctggggggcaagtaggtggtacaggggattggaaacatgctccgcgcctccagagaaaagttgctcccgaggtccatgcccctggaacgtgttcctatcactctggctggttgggctggtccttagactgggtgcttatgattaaagggtcttggttagcccactttccctctccatgtggagatggaaggtagagaaggatacagtgtctatcctcaagttgctacggttcagtgagagaggcagacatctgaacaggcaggtaggattcagtgtgctcagtgcactggggatttggagagagatgggcttgctctctctgtgcacccaggagggccacgcacttaaaactgtgtttgtggatcagagaaggctttatagcacagggggcattcagatgagtcttagaggaagagaagaaacatggcaagcagattacatctgagccgtttgaattgtgtttttctttcttcccatgtttattttctaagatctacctgaacttagagactcaagatatttttttaggaaacctcctacccatgtctgaggtagcaagtgcagcctcacgacagataccaggcaatccagagccacaaacataccagtcccattcttccttttcaatacctacccccaaatcttctcctaaccaccatctgttttttttttttaaaagcattttttgctttaaaagcatcctgaccccaatttctttgagctcacgggccttttgctgaaggtctctcagggtgtagtggtgtggctctctggacttaacgtcactctcagaggtcagaaccttggagatcagaactgattctcaccaggtgtgagaggtgtggtagcagattgcaatgctctgcacctcttccttgcaagtgagcaacttcaggctctctgggcagaggctggcccactgtagtttgcagacatgctctccagatggttttactaagtcccctctccctgatagggaatcctgctggaccagcgcagccctggtgtggagaggttaaaagacttgcacaggatcaccaagtcatgctgtagagccaggattcctagacccagggctctgcactctcaaggctggccccatgtgctcaaggggatctaatgtttgggctccaaactaaccatctcggagctgggctcctcatttactgccaaaccctcagcttatgtagctagaaagggccctggagtgagaaagcctggattttcaaattgatgctcccctactgactagctgtgccactctgggcaaatgctcttccttgagcctgtttccacacctgtaaagtggggatgatgatcctatctcactgcttttgtgaggattacaggaaagcacctgtcctggctctgtacctggcacgtagtaggtgctcagttcatgctggtttccttcctgcctttagtagggacctgctctgtgctcacacctcggctgcatgcaccctgctgtgacggaggctagtgtggaagaggtcctgtcctcagggaattaactgtcttattgggagacaacaactgtcctccttggaacacccaagaaaccatgcaaagcagtggacaacacagaacacgccctcctcctcgctgcctgcagctccaatctgattctgcttgggaatgggcggagcacgtgggctgcttaactgctgtataggacaagccccttacccctctctgggcccatgaattcctggcttggtttatgttctgatttgacacactgattttaatcttcgaatcatgacactgagtgcagaggaggtggcattccgacagcaggacatacatgttggtgtgaagactgggacgacactgggtagaatctagtttttaattattattaatataaaggatcaaattaatttaaatatgattctgaagtctacagaacttttagttctgtgctgtctatgtggacactttggtaaaatgcaaattatgatatggacgttatcattggtctggtgagatgtttcatatttgtgacagttaatttaaaaattatgagttaatgctgcctgtgtctatggggttctgtcttctttgatagccatctattcatctggatcatgggaccctctctaatccttccaccaatcaaataagctattgctattggtttggagttgagatatcagtctcggaaacttctgaaaaatgctaataattacccaaggattatgtcaaattttaaaataaatgtgtgtgtgtttctttaa

SEQ ID NO: 441247 - DNA, 3057 bp, Homo sapiens
gctcttcttccttccttctccagtcccttccactgtgcgtcttctgtcccccgttcttccccagcggacccctctttcgagactccctagtggggtccccagctcccgggcgatcctgcccttgccgagcgcgttttctggagtcacctgggggaggggagtcctgggcagggccgggctggggaagacgcctggggcactgcccggcgttaacaaagggagccgataccgaccggcgtgggcgcggagcgggcggccgccaccgagcgtgctgagcaaccgcagcctccgcggccgagagtgcagcgagcaaggggagagccagttgcgcagagccctgcaaccagcagtccagggagaagtggtgaatgtcatggagcccagctgaaatggactggcccccttgagcctgtcccaagccctggtgccaggtgtccatccccgtgctgagatgagttttgatcatcctgagaaaaatgggccttggcctgcagacagtttatgagcccagagcctcctgccacacacatgcacacatatctagcattctttccagacagcatcctccccgccttccaccttggtagatgcaaggtctatctctcccatcagggctgccaaagctgggctttgtttttcccagcagaatgatgccattctcacaaaccaatgctctatattgcttgaagtctgcatctaaatattgatttcacgttttaaagaaattctcttaaattacaattgtgcccaatgcagggtggctctggggggcaagtaggtggtacaggggattggaaacatgctccgcgcctccagagaaaagttgctcccgaggtccatgcccctggaacgtgttcctatcactctggctggttgggctggtccttagactgggtgcttatgattaaagggtcttggttagcccactttccctctccatgtggagatggaaggtagagaaggatacagtgtctatcctcaagttgctacggttcagtgagagaggcagacatctgaacaggcaggtaggattcagtgtgctcagtgcactggggatttggagagagatgggcttgctctctctgtgcacccaggagggccacgcacttaaaactgtgtttgtggatcagagaaggctttatagcacagggggcattcagatgagtcttagaggaagagaagaaacatggcaagcagattacatctgagccgtttgaattgtgtttttctttcttcccatgtttattttctaagatctacctgaacttagagactcaagatatttttttaggaaacctcctacccatgtctgaggtagcaagtgcagcctcacgacagataccaggcaatccagagccacaaaacgtgattcctccaggctctgcctggcctgaccctgtcctgtcagctgggtttacataccagtcccattcttccttttcaatacctacccccaaatcttctcctaaccaccatctgttttttttttttaaaagcattttttgctttaaaagcatcctgaccccaatttctttgagctcacgggccttttgctgaaggtctctcagggtgtagtggtgtggctctctggacttaacgtcactctcagaggtcagaaccttggagatcagaactgattctcaccaggtgtgagaggtgtggtagcagattgcaatgctctgcacctcttccttgcaagtgagcaacttcaggctctctgggcagaggctggcccactgtagtttgcagacatgctctccagatggttttactaagtcccctctccctgatagggaatcctgctggaccagcgcagccctggtgtggagaggttaaaagacttgcacaggatcaccaagtcatgctgtagagccaggattcctagacccagggctctgcactctcaaggctggccccatgtgctcaaggggatctaatgtttgggctccaaactaaccatctcggagctgggctcctcatttactgccaaaccctcagcttatgtagctagaaagggccctggagtgagaaagcctggattttcaaattgatgctcccctactgactagctgtgccactctgggcaaatgctcttccttgagcctgtttccacacctgtaaagtggggatgatgatcctatctcactgcttttgtgaggattacaggaaagcacctgtcctggctctgtacctggcacgtagtaggtgctcagttcatgctggtttccttcctgcctttagtagggacctgctctgtgctcacacctcggctgcatgcaccctgctgtgacggaggctagtgtggaagaggtcctgtcctcagggaattaactgtcttattgggagacaacaactgtcctccttggaacacccaagaaaccatgcaaagcagtggacaacacagaacacgccctcctcctcgctgcctgcagctccaatctgattctgcttgggaatgggcggagcacgtgggctgcttaactgctgtataggacaagccccttacccctctctgggcccatgaattcctggcttggtttatgttctgatttgacacactgattttaatcttcgaatcatgacactgagtgcagaggaggtggcattccgacagcaggacatacatgttggtgtgaagactgggacgacactgggtagaatctagtttttaattattattaatataaaggatcaaattaatttaaatatgattctgaagtctacagaacttttagttctgtgctgtctatgtggacactttggtaaaatgcaaattatgatatggacgttatcattggtctggtgagatgtttcatatttgtgacagttaatttaaaaattatgagttaatgctgcctgtgtctatggggttctgtcttctttgatagccatctattcatctggatcatgggaccctctctaatccttccaccaatcaaataagctattgctattggtttggagttgagatatcagtctcggaaacttctgaaaaatgctaataattacccaaggattatgtcaaattttaaaataaatgtgtgtgtgtttctttaa

SEQ ID NO: 441248 - DNA, 1987 bp, Homo sapiens
gctcttcttccttccttctccagtcccttccactgtgcgtcttctgtcccccgttcttccccagcggacccctctttcgagactccctagtggggtccccagctcccgggcgatcctgcccttgccgagcgcgttttctggagtcacctgggggaggggagtcctgggcagggccgggctggggaagacgcctggggcactgcccggcgttaacaaagggagccgataccgaccggcgtgggcgcggagcgggcggccgccaccgagcgtgctgagcaaccgcagcctccgcggccgagagtgcagcgagcaaggggagagccagttgcgcagagccctgcaaccagcagtccagggagaagtggtgaatgtcatggagcccagctgaaatggactggcccccttgagcctgtcccaagccctggtgccaggtgtccatccccgtgctgagatgagttttgatcatcctgagaaaaatgggccttggcctgcagacccaataaaccttccctcccatggataatagtgctaattcctgaggacctgaagggcctgccgcccctgggggattagccagaagcaggcttgttttcctgctcagaacaaagtgacttccctgaacacatcttcattatgattcacaccaacctgaagaaaaagttcagctgctgcgtcctggtctttcttctgtttgcagtcatctgtgtgtggaaggaaaagaagaaagggagttactatgattcctttaaattgcaaaccaaggaattccaggtgttaaagagtctggggaaattggccatggggtctgattcccagtctgtatcctcaagcagcacccaggacccccatgtgctcaaggggatctaatgtttgggctccaaactaaccatctcggagctgggctcctcatttactgccaaaccctcagcttatgtagctagaaagggccctggagtgagaaagcctggattttcaaattgatgctcccctactgactagctgtgccactctgggcaaatgctcttccttgagcctgtttccacacctgtaaagtggggatgatgatcctatctcactgcttttgtgaggattacaggaaagcacctgtcctggctctgtacctggcacgtagtaggtgctcagttcatgctggtttccttcctgcctttagtagggacctgctctgtgctcacacctcggctgcatgcaccctgctgtgacggaggctagtgtggaagaggtcctgtcctcagggaattaactgtcttattgggagacaacaactgtcctccttggaacacccaagaaaccatgcaaagcagtggacaacacagaacacgccctcctcctcgctgcctgcagctccaatctgattctgcttgggaatgggcggagcacgtgggctgcttaactgctgtataggacaagccccttacccctctctgggcccatgaattcctggcttggtttatgttctgatttgacacactgattttaatcttcgaatcatgacactgagtgcagaggaggtggcattccgacagcaggacatacatgttggtgtgaagactgggacgacactgggtagaatctagtttttaattattattaatataaaggatcaaattaatttaaatatgattctgaagtctacagaacttttagttctgtgctgtctatgtggacactttggtaaaatgcaaattatgatatggacgttatcattggtctggtgagatgtttcatatttgtgacagttaatttaaaaattatgagttaatgctgcctgtgtctatggggttctgtcttctttgatagccatctattcatctggatcatgggaccctctctaatccttccaccaatcaaataagctattgctattggtttggagttgagatatcagtctcggaaacttctgaaaaatgctaataattacccaaggattatgtcaaattttaaaataaatgtgtgtgtgtttctttaa

SEQ ID NO: 441249 - DNA, 1418 bp, Homo sapiens
gctcttcttccttccttctccagtcccttccactgtgcgtcttctgtcccccgttcttccccagcggacccctctttcgagactccctagtggggtccccagctcccgggcgatcctgcccttgccgagcgcgttttctggagtcacctgggggaggggagtcctgggcagggccgggctggggaagacgcctggggcactgcccggcgttaacaaagggagccgataccgaccggcgtgggcgcggagcgggcggccgccaccgagcgtgctgagcaaccgcagcctccgcggccgagagtgcagcgagcaaggggagagccagttgcgcagagccctgcaaccagcagtccagggagaagtggtgaatgtcatggagcccagctgaaatggactggcccccttgagcctgtcccaagccctggtgccaggtgtccatccccgtgctgagatgagttttgatcatcctgagaaaaatgggccttggcctgcagacccaataaaccttccctcccatggataatagtgctaattcctgaggacctgaagggcctgccgcccctgggggattagccagaagcaggcttgttttcctgctcagaacaaagtgacttccctgaacacatcttcattatgattcacaccaacctgaagaaaaagttcagctgctgcgtcctggtctttcttctgtttgcagtcatctgtgtgtggaaggaaaagaagaaagggagttactatgattcctttaaattgcaaaccaaggaattccaggtgttaaagagtctggggaaattggccatggggtctgattcccagtctgtatcctcaagcagcacccaggacccccacaggggccgccagaccctcggcagtctcagaggcctagccaaggccaaaccagaggcctccttccaggtgtggaacaaggacagctcttccaaaaaccttatccctaggctgcaaaagatctggaagaattacctaagcatgaacaagtacaaagtgtcctacaaggggccaggaccaggcatcaagttcagtgcagaggccctgcgctgccacctccgggaccatgtgaatgtatccatggtagaggtcacagattttcccttcaatacctctgaatgggagggttatctgcccaaggagagcattaggaccaaggctgggccttggggcaggtgtgctgttgtgtcgtcagcgggatctctgaagtcctcccaactaggcagagaaatcgatgatcatgacgcagtcctgaggtttaatggggcacccacagccaacttccaacaagatgtgggcacaaaaactaccattcgcctgatgaactctcagatctctgtgcaccattgtgccagggctgcgaggaaggtggcccacttcccgggatacactacccaccctcaagagagcct

SEQ ID NO: 441250 - DNA, 513 bp, Homo sapiens
ctctagggcagagtaggcgcgtccctactggatggagggggaagtaacaccccaagaacgctgtcatttcctgggccaagttgggacccggacggcctcaccatgatgaaacgggcagctgctgctgcagtgggaggagccctggcagtgggggctgtgcccgtggtgctcagtgccatgggcttcactggggcaggaatcgccgcgtcctccatagcagccaagatgatgtccgcagcagccattgccaacgggggtggtgtttctgcggggagcctggtggctactctgcagtccgtgggggcagctggactctccacatcatccaacatcctcctggcctctgttgggtcagtgttgggggcctgcttggggaattcaccttcttcttctctcccagctgaacccgaggctaaagaagatgaggcaagagaaaatgtaccccaaggtgaacctccaaaacccccactcaagtcagagaaacatgaggaataaaggtcacatgcagatgca

SEQ ID NO: 441251 - DNA, 471 bp, Homo sapiens
gcccttctctctcctctttctcccctttcccatctccctctgccttcccctggcactctctctctagaacgggcagctgctgctgcagtgggaggagccctggcagtgggggctgtgcccgtggtgctcagtgccatgggcttcactggggcaggaatcgccgcgtcctccatagcagccaagatgatgtccgcagcagccattgccaacgggggtggtgtttctgcggggagcctggtggctactctgcagtccgtgggggcagctggactctccacatcatccaacatcctcctggcctctgttgggtcagtgttgggggcctgcttggggaattcaccttcttcttctctcccagctgaacccgaggctaaagaagatgaggcaagagaaaatgtaccccaaggtgaacctccaaaacccccactcaagtcagagaaacatgaggaataaaggtcacatgcagatgca

SEQ ID NO: 441252 - DNA, 1138 bp, Homo sapiens
ctctagggcagagtaggcgcgtccctactggatggagggggaagtaacaccccaagaacgctgtcatttcctgggccaagttgggacccggacggcctcaccatgatgaaacgggcagctgctgctgcagtgggaggaggtaagttacccggatcgcctgtctccaggccctcacctagcctggtccccgggctgctgggagaacgcagagatgaggcgctgggctggctctcaccctccacttccgaagctgcccgagtagcctgagtgagccacagcatcaaaatactccagggaaaagctcactcccattcctgacccagcttctcttctagtccttatgtcgaataagcataggaggaagatcgtttgaaagaggatttgcagctaaactccacgtggcttatttcacatttatgcgtggacacacacacacacacacacacacacacacaaatttgagaccaatgaagggtattgacttcctcagcatcacacagcaagttagagacaaaccagggccatggctggtccttctatgacatctttgcttcacctggctccacactccaccttttcttcaccagaagaccactaagttgccatctctgtattgctcaagctgacagtctccggaaactgtcaaggaattcctaagcggggggcggggggaagggtcccttctcctgagcccacctctgcactcagcttctctctccccacagccctggcagtgggggctgtgcccgtggtgctcagtgccatgggcttcactggggcaggaatcgccgcgtcctccatagcagccaagatgatgtccgcagcagccattgccaacgggggtggtgtttctgcggggagcctggtggctactctgcagtccgtgggggcagctggactctccacatcatccaacatcctcctggcctctgttgggtcagtgttgggggcctgcttggggaattcaccttcttcttctctcccagctgaacccgaggctaaagaagatgaggcaagagaaaatgtaccccaaggtgaacctccaaaacccccactcaagtcagagaaacatgaggaataaaggtcacatgcagatgcaaaaaaaaaagtcgacgcggccgcgaatttagtagtagta

SEQ ID NO: 441253 - DNA, 1150 bp, Homo sapiens
ctctagggcagagtaggcgcgtccctactggatggagggggaagtaacaccccaagaacgctgtcatttcctgggccaagttgggacccggacggcctcaccatgatgaaacgggcagctgctgctgcagtgggaggaggtaagttacccggatcgcctgtctccaggccctcacctagcctggtccccgggctgctgggagaacgcagagatgaggcgctgggctggctctcaccctccacttccgaagctgcccgagtagcctgagtgagccacagcatcaaaatactccagggaaaagctcactcccattcctgacccagcttctcttctagtccttatgtcgaataagcataggaggaagatcgtttgaaagaggatttgcagctaaactccacgtggcttatttcacatttatgcgtggacacacacacacacacacacacacacacacaaatttgagaccaatgaagggtattgacttcctcagcatcacacagcaagttagagacaaaccagggccatggctggtccttctatgacatctttgcttcacctggctccacactccaccttttcttcaccagaagaccactaagttgccatctctgtattgctcaagctgacagtctccggaaactgtcaaggaattcctaagcggggggcggggggaagggtcccttctcctgagcccacctctgcactcagcttctctctccccacagccctggcagtgggggctgtgcccgtggtgctcagtgccatgggcttcactggggcaggaatcgccgcgtcctccatagcagccaagatgatgtccgcagcagccattgccaacgggggtggtgtttctgcggggagcctggtggctactctgcagtccgtgggtaagtgtcctagacaggaccaccagagctgcgagaagatccagccctgaggctgagcccgagggaagctcttctcaccctgcagttccgtgaccctcagcttcctgggtcttcagtctctccctcactgtcccctcttctggctccttctgagtgaggtttggggtaggagtggaggggtgatggggtgctgggtagggagaagaggaaaggaacctaggccaagagcaatgcctgggttctgacacctgggtgacctgggc

SEQ ID NO: 441254 - DNA, 728 bp, Homo sapiens
ctctagggcagagtaggcgcgtccctactggatggagggggaagtaacaccccaagaacgctgtcatttcctgggccaagttgggacccggacggcctcaccatgatgaaacgggcagctgctgctgcagtgggaggagccctggcagtgggggctgtgcccgtggtgctcagtgccatgggcttcactggggcaggaatcgccgcgtcctccatagcagccaagatgatgtccgcagcagccattgccaacgggggtggtgtttctgcggggagcctggtggctactctgcagtccgtgggggcagctggactctccacatcatccaacatcctcctggcctctgttgggtcagtgttgggggcctgcttggggaattcaccttcttcttctctcccagctgaacccgaggctaaagaagatgaggcaagagaaaatgtaccccaaggtgaacctccaaaacccccactcaagtcagagaaacatgaggaataaaggtcacatgcagatgcaaaaaaaaaaaaaaaaaaaaaaaaaaacacaaaaacaaaaaaaaaaaaaaaaaaaaaaaacaaatgatagcaagaaagaaaaaaagaaggggggggggggagctaagatatcatcgcggggggggcccgattgtcgggaaaccgcgtgtttggcagaggggggcacagagggggggtattatacagcgagcggcggggggtgtacaagtgtgagcg

SEQ ID NO: 441255 - DNA, 552 bp, Homo sapiens
ctctagggcagagtaggcgcgtccctactggatggagggggaagtaacaccccaagaacgctgtcatttcctgggccaagttgggacccggacggcctcaccatgatgaaacgggcagctgctgctgcagtgggaggagccctggcagtgggggctgtgcccgtggtgctcagtgccatgggcttcactggggcaggaatcgccgcgtcctccatagcagccaagatgatgtccgcagcagccattgccaacgggggtggtgtttctgcggggagcctggtggctactctgcagtccgtgggggcagctggactctccacatcatccaacatcctcctggcctctgttgggtcagtgttgggggcctgcttggggaattcaccttcttcttctctcccagctgaacccgaggctaaagaagatgaggcaagagaaaatgtaccccaaggtgaacctccaaaacccccactcaagtcagagaaacatgaggaataaaggtcacatgcagatgcaaaaaaaaaagtcgacgcggccgcgaatttagtagtagta

SEQ ID NO: 441256 - DNA, 317 bp, Homo sapiens
ggtcgatctcgaggatccccatcaaccctaaatttaaaatgctgttgaatatgatacttttgaggagagagtgtgctcagaacttagacgggatttggtaggccaagtatgctaagtgtacaatatattttttaattttacacctgaaacaaagaaatgtggtcactaaaaataaaagtatatatgtaggaattaatgtactcttgctttgtcaagctgtttgctatagtttccaaggtattatgttactctaactctgaaaagtgatgtaatctggtagcaatgtagtagttcaaataaaggcatttacataataa

SEQ ID NO: 441257 - DNA, 3092 bp, Homo sapiens
agattgctcttctgggcgtgggagaaggttctgtctatcagtgctgcgagaaaggaaagaaacaagtttgctctcagcggatctttaaatggatgagatggctaccactcagatttccaaagatgagcttgatgaactcaaagaggcctttgcaaaagttgatctcaacagcaacggattcatttgtgactatgaacttcatgagctcttcaaggaagctaatatgccattaccaggatataaagtgagagaaattattcagaaactcatgctggatggtgacaggaataaagatgggaaaataagttttgacgaatttgtttatatttttcaagaggtaaaaagtagtgatattgccaagaccttccgcaaagcaatcaacaggaaagaaggtatttgtgctctgggtggaacttcagagttgtccagcgaaggaacacagcattcttactcagaggaagaaaaatatgcttttgttaactggataaacaaagctttggaaaatgatcctgattgtagacatgttataccaatgaaccctaacaccgatgacctgttcaaagctgttggtgatggaattgtgctttgtaaaatgattaacctttcagttcctgataccattgatgaaagagcaatcaacaagaagaaacttacacccttcatcattcaggaaaacttgaacttggcactgaactctgcttctgccattgggtgtcatgttgtgaacattggtgcagaagatttgagggctgggaaacctcatctggttttgggactgctttggcagatcattaagatcggtttgttcgctgacattgaattaagcaggaatgaagccttggctgctttactccgagatggtgagactttggaggaacttatgaaattgtctccagaagagcttctgcttagatgggcaaactttcatttggaaaactcgggctggcaaaaaattaacaactttagtgctgacatcaaggattccaaagcctatttccatcttctcaatcaaatcgcaccaaaaggacaaaaggaaggtgaaccacggatagatattaacatgtcaggtttcaatgaaacagatgatttgaagagagctgagagtatgcttcaacaagcagataaattaggttgcagacagtttgttacccctgctgatgttgtcagtggaaaccccaaactcaacttagctttcgtggctaacctgtttaataaatacccagcactaactaagccagagaaccaggatattgactggactctattagaaggagaaactcgtgaagaaagaaccttccgtaactggatgaactctcttggtgtcaatcctcacgtaaaccatctctatgctgacctgcaagatgccctggtaatcttacagttatatgaacgaattaaagttcctgttgactggagtaaggttaataaacctccatacccgaaactgggagccaacatgaaaaagctagaaaactgcaactatgctgttgaattagggaagcatcctgctaaattctccctggttggcattggagggcaagacctgaatgatgggaaccaaaccctgactttagctttagtctggcagctgatgagaagatataccctcaatgtcctggaagatcttggagatggtcagaaagccaatgacgacatcattgtgaactgggtgaacagaacgttgagtgaagctggaaaatcaacttccattcagagttttaaggacaagacgatcagctccagtttggcagttgtggatttaattgatgccatccagccaggctgtataaactatgaccttgtgaagagtggcaatctaacagaagatgacaagcacaataatgccaagtatgcagtgtcaatggctagaagaatcggagccagagtgtatgctctccctgaagaccttgtggaagtaaagcccaagatggtcatgactgtgtttgcatgtttgatgggcaggggaatgaagagagtgtaaaataaccaatctgaataaaacagccatgctcccaggtgcatgattcgcaggtcagctatttccaggtgaagtgcttatggcttaaggaactcttggccattcaaaggacttttcattttgattaacaggactagcttatcatgagagccctcaggggaaagggtttaagaaaaacaactcctctttcccatagtcagagttgaatttgtcaggcacgcctgaaatgtgctcatagccaaaacattttactctctcctcctagaatgctgcccttgacatttcccattgctgtatgttatttcttgctctgttatcttttgccctcttagaatgtccctctcttgggacttgcttagatgatgggatatgaatattattagacagtaattttgctttccatccagtatgctagttcttattcgagaactatggtcagagcgtatttggatatgagtatcctttgcttatctttgtagtactgaaaatttgccgaagtaactggctgtgcagaatgtaatagaagcttttcttattcttttattcttaagatcagtatctttttacagtattctttctacatgatccttttttgtacatttaagaatattttgattatattaaacaagactgctgattttgctactttttttaaggggtcttcaagtaagtaaaacatacatcgtagctagaagaaaaatgtaccttaaatttgcatcttccctctcatacccaagctgtaaacaattgaaatattttgtcttaaatcacttggttcaatacatgcttatttgttttaaaacctgtatcatcaaactctctctctaaatttaaaatgctgttgaatatgatacttttgaggagagagtgtgctcagaacttagacgggatttggtaggccaagtatgctaagtgtacaatatattttttaattttacacctgaaacaaagaaatgtggtcactaaaaataaaagtatatatgtaggaattaatgtactcttgctttgtcaagctgtttgctatagtttccaaggtattatgttactctaactctgaaaagtgatgtaatctggtagcaatgtagtagttcaaataaaggcatttacataataa

SEQ ID NO: 441258 - DNA, 3529 bp, Homo sapiens
ggggcggagggggctggcaggaggggagggagcgctggctttagagccacagctgcaaagattccgaggtgcagaagttgtctgagtgcgttggtcggcggcagtcgggccagacccaggactctgcgactttacatctttaaatggatgagatggctaccactcagatttccaaagatgagcttgatgaactcaaagaggcctttgcaaaagttgtggagacggagtttcaccgtgttagccaggatggtctcgatctcctgacctcgtgatccgcccgtctcggcctcccaaagtgctgggattacagacgtgagccaccgcgcctggcctacacacatgtatttttaaaacgagagttgcagcaggggaaaaatgatggccaaactgctggaaattttgagtcagaaaaggactgataaacatttttgattgcctggtctcaccctctaaacttgtccagccttctgctgtacttgacctccatctttggaaatccactagtacagtgaattctaaagcagcaacctccagtctacccttagctggaactcattaaactgcctcttatatttgctgcagtgagctacctcaaaagatctcaacagcaacggattcatttgtgactatgaacttcatgagctcttcaaggaagctaatatgccattaccaggatataaagtgagagaaattattcagaaactcatgctggatggtgacaggaataaagatgggaaaataagttttgacgaatttgtttatatttttcaagaggtaaaaagtagtgatattgccaagaccttccgcaaagcaatcaacaggaaagaaggtatttgtgctctgggtggaacttcagagttgtccagcgaaggaacacagcattcttactcagaggaagaaaaatatgcttttgttaactggataaacaaagctttggaaaatgatcctgattgtagacatgttataccaatgaaccctaacaccgatgacctgttcaaagctgttggtgatggaattgtgctttgtaaaatgattaacctttcagttcctgataccattgatgaaagagcaatcaacaagaagaaacttacacccttcatcattcaggaaaacttgaacttggcactgaactctgcttctgccattgggtgtcatgttgtgaacattggtgcagaagatttgagggctgggaaacctcatctggttttgggactgctttggcagatcattaagatcggtttgttcgctgacattgaattaagcaggaatgaagccttggctgctttactccgagatggtgagactttggaggaacttatgaaattgtctccagaagagcttctgcttagatgggcaaactttcatttggaaaactcgggctggcaaaaaattaacaactttagtgctgacatcaaggattccaaagcctatttccatcttctcaatcaaatcgcaccaaaaggacaaaaggaaggtgaaccacggatagatattaacatgtcaggtttcaatgaaacagatgatttgaagagagctgagagtatgcttcaacaagcagataaattaggttgcagacagtttgttacccctgctgatgttgtcagtggaaaccccaaactcaacttagctttcgtggctaacctgtttaataaatacccagcactaactaagccagagaaccaggatattgactggactctattagaaggagaaactcgtgaagaaagaaccttccgtaactggatgaactctcttggtgtcaatcctcacgtaaaccatctctatgctgacctgcaagatgccctggtaatcttacagttatatgaacgaattaaagttcctgttgactggagtaaggttaataaacctccatacccgaaactgggagccaacatgaaaaagctagaaaactgcaactatgctgttgaattagggaagcatcctgctaaattctccctggttggcattggagggcaagacctgaatgatgggaaccaaaccctgactttagctttagtctggcagctgatgagaagatataccctcaatgtcctggaagatcttggagatggtcagaaagccaatgacgacatcattgtgaactgggtgaacagaacgttgagtgaagctggaaaatcaacttccattcagagttttaaggacaagacgatcagctccagtttggcagttgtggatttaattgatgccatccagccaggctgtataaactatgaccttgtgaagagtggcaatctaacagaagatgacaagcacaataatgccaagtatgcagtgtcaatggctagaagaatcggagccagagtgtatgctctccctgaagaccttgtggaagtaaagcccaagatggtcatgactgtgtttgcatgtttgatgggcaggggaatgaagagagtgtaaaataaccaatctgaataaaacagccatgctcccaggtgcatgattcgcaggtcagctatttccaggtgaagtgcttatggcttaaggaactcttggccattcaaaggacttttcattttgattaacaggactagcttatcatgagagccctcaggggaaagggtttaagaaaaacaactcctctttcccatagtcagagttgaatttgtcaggcacgcctgaaatgtgctcatagccaaaacattttactctctcctcctagaatgctgcccttgacatttcccattgctgtatgttatttcttgctctgttatcttttgccctcttagaatgtccctctcttgggacttgcttagatgatgggatatgaatattattagacagtaattttgctttccatccagtatgctagttcttattcgagaactatggtcagagcgtatttggatatgagtatcctttgcttatctttgtagtactgaaaatttgccgaagtaactggctgtgcagaatgtaatagaagcttttcttattcttttattcttaagatcagtatctttttacagtattctttctacatgatccttttttgtacatttaagaatattttgattatattaaacaagactgctgattttgctactttttttaaggggtcttcaagtaagtaaaacatacatcgtagctagaagaaaaatgtaccttaaatttgcatcttccctctcatacccaagctgtaaacaattgaaatattttgtcttaaatcacttggttcaatacatgcttatttgttttaaaacctgtatcatcaaactctctctctaaatttaaaatgctgttgaatatgatacttttgaggagagagtgtgctcagaacttagacgggatttggtaggccaagtatgctaagtgtacaatatattttttaattttacacctgaaacaaagaaatgtggtcactaaaaataaaagtatatatgtaggaattaatgtactcttgctttgtcaagctgtttgctatagtttccaaggtattatgttactctaactctgaaaagtgatgtaatctggtagcaatgtagtagttcaaataaaggcatttacataataa

SEQ ID NO: 441259 - DNA, 3092 bp, Homo sapiens
ggggcggagggggctggcaggaggggagggagcgctggctttagagccacagctgcaaagattccgaggtgcagaagttgtctgagtgcgttggtcggcggcagtcgggccagacccaggactctgcgactttacatctttaaatggatgagatggctaccactcagatttccaaagatgagcttgatgaactcaaagaggcctttgcaaaagttgatctcaacagcaacggattcatttgtgactatgaacttcatgagctcttcaaggaagctaatatgccattaccaggatataaagtgagagaaattattcagaaactcatgctggatggtgacaggaataaagatgggaaaataagttttgacgaatttgtttatatttttcaagaggtaaaaagtagtgatattgccaagaccttccgcaaagcaatcaacaggaaagaaggtatttgtgctctgggtggaacttcagagttgtccagcgaaggaacacagcattcttactcagaggaagaaaaatatgcttttgttaactggataaacaaagctttggaaaatgatcctgattgtagacatgttataccaatgaaccctaacaccgatgacctgttcaaagctgttggtgatggaattgtgctttgtaaaatgattaacctttcagttcctgataccattgatgaaagagcaatcaacaagaagaaacttacacccttcatcattcagacattggtgcagaagatttgagggctgggaaacctcatctggttttgggactgctttggcagatcattaagatcggtttgttcgctgacattgaattaagcaggaatgaagccttggctgctttactccgagatggtgagactttggaggaacttatgaaattgtctccagaagagcttctgcttagatgggcaaactttcatttggaaaactcgggctggcaaaaaattaacaactttagtgctgacatcaaggattccaaagcctatttccatcttctcaatcaaatcgcaccaaaaggacaaaaggaaggtgaaccacggatagatattaacatgtcaggtttcaatgaaacagatgatttgaagagagctgagagtatgcttcaacaagcagataaattaggttgcagacagtttgttacccctgctgatgttgtcagtggaaaccccaaactcaacttagctttcgtggctaacctgtttaataaatacccagcactaactaagccagagaaccaggatattgactggactctattagaaggagaaactcgtgaagaaagaaccttccgtaactggatgaactctcttggtgtcaatcctcacgtaaaccatctctatgctgacctgcaagatgccctggtaatcttacagttatatgaacgaattaaagttcctgttgactggagtaaggttaataaacctccatacccgaaactgggagccaacatgaaaaagctagaaaactgcaactatgctgttgaattagggaagcatcctgctaaattctccctggttggcattggagggcaagacctgaatgatgggaaccaaaccctgactttagctttagtctggcagctgatgagaagatataccctcaatgtcctggaagatcttggagatggtcagaaagccaatgacgacatcattgtgaactgggtgaacagaacgttgagtgaagctggaaaatcaacttccattcagagttttaaggacaagacgatcagctccagtttggcagttgtggatttaattgatgccatccagccaggctgtataaactatgaccttgtgaagagtggcaatctaacagaagatgacaagcacaataatgccaagtatgcagtgtcaatggctagaagaatcggagccagagtgtatgctctccctgaagaccttgtggaagtaaagcccaagatggtcatgactgtgtttgcatgtttgatgggcaggggaatgaagagagtgtaaaataaccaatctgaataaaacagccatgctcccaggtgcatgattcgcaggtcagctatttccaggtgaagtgcttatggcttaaggaactcttggccattcaaaggacttttcattttgattaacaggactagcttatcatgagagccctcaggggaaagggtttaagaaaaacaactcctctttcccatagtcagagttgaatttgtcaggcacgcctgaaatgtgctcatagccaaaacattttactctctcctcctagaatgctgcccttgacatttcccattgctgtatgttatttcttgctctgttatcttttgccctcttagaatgtccctctcttgggacttgcttagatgatgggatatgaatattattagacagtaattttgctttccatccagtatgctagttcttattcgagaactatggtcagagcgtatttggatatgagtatcctttgcttatctttgtagtactgaaaatttgccgaagtaactggctgtgcagaatgtaatagaagcttttcttattcttttattcttaagatcagtatctttttacagtattctttctacatgatccttttttgtacatttaagaatattttgattatattaaacaagactgctgattttgctactttttttaaggggtcttcaagtaagtaaaacatacatcgtagctagaagaaaaatgtaccttaaatttgcatcttccctctcatacccaagctgtaaacaattgaaatattttgtcttaaatcacttggttcaatacatgcttatttgttttaaaacctgtatcatcaaactctctctctaaatttaaaatgctgttgaatatgatacttttgaggagagagtgtgctcagaacttagacgggatttggtaggccaagtatgctaagtgtacaatatattttttaattttacacctgaaacaaagaaatgtggtcactaaaaataaaagtatatatgtaggaattaatgtactcttgctttgtcaagctgtttgctatagtttccaaggtattatgttactctaactctgaaaagtgatgtaatctggtagcaatgtagtagttcaaataaaggcatttacataataa

SEQ ID NO: 441260 - DNA, 3337 bp, Homo sapiens
ggggcggagggggctggcaggaggggagggagcgctggctttagagccacagctgcaaagattccgaggtgcagaagttgtctgagtgcgttggtcggcggcagtcgggccagacccaggactctgcgactttacatctttaaatggatgagatggctaccactcagatttccaaagatgagcttgatgaactcaaagaggcctttgcaaaagttgatctcaacagcaacggattcatttgtgactatgaacttcatgagctcttcaaggaagctaatatgccattaccaggatataaagtgagagaaattattcagaaactcatgctggatggtgacaggaataaagatgggaaaataagttttgacgaatttgtttatatttttcaagaggtaaaaagtagtgatattgccaagaccttccgcaaagcaatcaacaggaaagaaggtatttgtgctctgggtggaacttcagagttgtccagcgaaggaacacagcattcttactcagaggaagaaaaatatgcttttgttaactggataaacaaagctttggaaaatgatcctgattgtagacatgttataccaatgaaccctaacaccgatgacctgttcaaagctgttggtgatggaattgtgctttgtaaaatgattaacctttcagttcctgataccattgatgaaagagcaatcaacaagaagaaacttacacccttcatcattcaggaaaacttgaacttggcactgaactctgcttctgccattgggtgtcatgttgtgaacattggtgcagaagatttgagggctgggaaacctcatctggttttgggactgctttggcagatcattaagatcggtttgttcgctgacattgaattaagcaggaatgaagccttggctgctttactccgagatggtgagactttggaggaacttatgaaattgtctccagaagagcttctgcttagatgggcaaactttcatttggaaaactcgggctggcaaaaaattaacaactttagtgctgacatcaaggattccaaagcctatttccatcttctcaatcaaatcgcaccaaaaggacaaaaggaaggtgaaccacggatagatattaacatgtcaggtttcaatgaaacagatgatttgaagagagctgagagtatgcttcaacaagcagataaattaggttgcagacagtttgttacccctgctgatgttgtcagtggaaaccccaaactcaacttagctttcgtggctaacctgtttaataaatacccagcactaactaagccagagaaccaggatattgactggactctattagaaggagaaactcgtgaagaaagaaccttccgtaactggatgaactctcttggtgtcaatcctcacgtaaaccatctctatgctgacctgcaagatgccctggtaatcttacagttatatgaacgaattaaagttcctgttgactggagtaaggttaataaacctccatacccgaaactgggagccaacatgaaaaagctagaaaactgcaactatgctgttgaattagggaagcatcctgctaaattctccctggttggcattggagggcaagacctgaatgatgggaaccaaaccctgactttagctttagtctggcagctgatgagaagatataccctcaatgtcctggaagatcttggagatggtcagaaagccaatgacgacatcattgtgaactgggtgaacagaacgttgagtgaagctggaaaatcaacttccattcagagttttaaggacaagacgatcagctccagtttggcagttgtggatttaattgatgccatccagccaggctgtataaactatgaccttgtgaagagtggcaatctaacagaagatgacaagcacaataatgccaagtatgcagtgtcaatggctagaagaatcggagccagagtgtatgctctccctgaagaccttgtggaagtaaagcccaagatggtcatgactgtgtttgcatgtttgatgggcaggggaatgaagagagtgtaaaataaccaatctgaataaaacagccatgctcccaggtgcatgattcgcaggtcagctatttccaggtgaagtgcttatggcttaaggaactcttggccattcaaaggacttttcattttgattaacaggactagcttatcatgagagccctcaggggaaagggtttaagaaaaacaactcctctttcccatagtcagagttgaatttgtcaggcacgcctgaaatgtgctcatagccaaaacattttactctctcctcctagaatgctgcccttgacatttcccattgctgtatgttatttcttgctctgttatcttttgccctcttagaatgtccctctcttgggacttgcttagatgatgggatatgaatattattagacagtaattttgctttccatccagtatgctagttcttattcgagaactatggtcagagcgtatttggatatgagtatcctttgcttatctttgtagtactgaaaatttgccgaagtaactggctgtgcagaatgtaatagaagcttttcttattcttttattcttaagatcagtatctttttacagtattctttctacatgatccttttttgtacatttaagaatattttgattatattaaacaagactgctgattttgctactttttttaaggggtcttcaagtaagtaaaacatacatcgtagctagaagaaaaatgtaccttaaatttgcatcttccctctcatacccaagctgtaaacaattgaaatattttgtcttaaatcacttggttcaatacatgcttatttgttttaaaacctgtatcatcaaactctctctctaaatttaaaatgctgttgaatatgatacttttgaggagagagtgtgctcagaacttagacgggatttggtaggccaagtatgctaagtgtacaatatattttttaattttacacctgaaacaaagaaatgtggtcactaaaaataaaagtatatatgtaggaattaatgtactcttgctttgtcaagctgtttgctatagtttccaaggtattatgttactctaactctgaaaagtgatgtaatctggtagcaatgtagtagttcaaataaaggcatttacataataaaataattagtctgttcttcatgcttttgtctcttaggaagtatgccaatgtttgtcaggatttttttctttttgtttttctgatgtattctgtaaaatggtgtttgttaaatttgagttttgggagctgaattagaggtactgaattaaggacagtacaaatgaagtaaaaaggttttctccaatttacc

SEQ ID NO: 441261 - DNA, 2325 bp, Homo sapiens
ctttggagtaaagcagccaaggcttcattcctgcttaattcaatgtctcaccatctcggagtaaagcagccttggctgctttactccgagatggtgagactttggaggaacttatgaaattgtctccagaagagcttctgcttagatgggcaaactttcatttggaaaactcgggctggcaaaaaattaacaactttagtgctgacatcaaggattccaaagcctatttccatcttctcaatcaaatcgcaccaaaaggacaaaaggaaggtgaaccacggatagatattaacatgtcaggtttcaatgaaacagatgatttgaagagagctgagagtatgcttcaacaagcagataaattaggttgcagacagtttgttacccctgctgatgttgtcagtggaaaccccaaactcaacttagctttcgtggctaacctgtttaataaatacccagcactaactaagccagagaaccaggatattgactggactctattagaaggagaaactcgtgaagaaagaaccttccgtaactggatgaactctcttggtgtcaatcctcacgtaaaccatctctatgctgacctgcaagatgccctggtaatcttacagttatatgaacgaattaaagttcctgttgactggagtaaggttaataaacctccatacccgaaactgggagccaacatgaaaaagctagaaaactgcaactatgctgttgaattagggaagcatcctgctaaattctccctggttggcattggagggcaagacctgaatgatgggaaccaaaccctgactttagctttagtctggcagctgatgagaagatataccctcaatgtcctggaagatcttggagatggtcagaaagccaatgacgacatcattgtgaactgggtgaacagaacgttgagtgaagctggaaaatcaacttccattcagagttttaaggacaagacgatcagctccagtttggcagttgtggatttaattgatgccatccagccaggctgtataaactatgaccttgtgaagagtggcaatctaacagaagatgacaagcacaataatgccaagtatgcagtgtcaatggctagaagaatcggagccagagtgtatgctctccctgaagaccttgtggaagtaaagcccaagatggtcatgactgtgtttgcatgtttgatgggcaggggaatgaagagagtgtaaaataaccaatctgaataaaacagccatgctcccaggtgcatgattcgcaggtcagctatttccaggtgaagtgcttatggcttaaggaactcttggccattcaaaggacttttcattttgattaacaggactagcttatcatgagagccctcaggggaaagggtttaagaaaaacaactcctctttcccatagtcagagttgaatttgtcaggcacgcctgaaatgtgctcatagccaaaacattttactctctcctcctagaatgctgcccttgacatttcccattgctgtatgttatttcttgctctgttatcttttgccctcttagaatgtccctctcttgggacttgcttagatgatgggatatgaatattattagacagtaattttgctttccatccagtatgctagttcttattcgagaactatggtcagagcgtatttggatatgagtatcctttgcttatctttgtagtactgaaaatttgccgaagtaactggctgtgcagaatgtaatagaagcttttcttattcttttattcttaagatcagtatctttttacagtattctttctacatgatccttttttgtacatttaagaatattttgattatattaaacaagactgctgattttgctactttttttaaggggtcttcaagtaagtaaaacatacatcgtagctagaagaaaaatgtaccttaaatttgcatcttccctctcatacccaagctgtaaacaattgaaatattttgtcttaaatcacttggttcaatacatgcttatttgttttaaaacctgtatcatcaaactctctctctaaatttaaaatgctgttgaatatgatacttttgaggagagagtgtgctcagaacttagacgggatttggtaggccaagtatgctaagtgtacaatatattttttaattttacacctgaaacaaagaaatgtggtcactaaaaataaaagtatatatgtaggaattaatgtactcttgctttgtcaagctgtttgctatagtttccaaggtattatgttactctaactctgaaaagtgatgtaatctggtagcaatgtagtagttcaaataaaggcatttacataataa

SEQ ID NO: 441262 - DNA, 2281 bp, Homo sapiens
ggggcggagggggctggcaggaggggagggagcgctggctttagagccacagctgcaaagattccgaggtgcagaagttgtctgagtgcgttggtcggcggcagtcgggccagacccaggactctgcgactttacatctttaaatggatgagatggctaccactcagatttccaaagatgagcttgatgaactcaaagaggcctttgcaaaagttgatctcaacagcaacggattcatttgtgactatgaacttcatgagctcttcaaggaagctaatatgccattaccaggatataaagtgagagaaattattcagaaactcatgctggatggtgacaggaataaagatgggaaaataagttttgacgaatttgtttatatttttcaagaggtaaaaagtagtgatattgccaagaccttccgcaaagcaatcaacaggaaagaaggtatttgtgctctgggtggaacttcagagttgtccagcgaaggaacacagcattcttactcagaggaagaaaaatatgcttttgttaactggataaacaaagctttggaaaatgatcctgattgtagacatgttataccaatgaaccctaacaccgatgacctgttcaaagctgttggtgatggaattgtgctttgtaaaatgattaacctttcagttcctgataccattgatgaaagagcaatcaacaagaagaaacttacacccttcatcattcaggaaaacttgaacttggcactgaactctgcttctgccattgggtgtcatgttgtgaacattggtgcagaagatttgagggctgggaaacctcatctggttttgggactgctttggcagatcattaagatcggtttgttcgctgacattgaattaagcaggaatgaagccttggctgctttactccgagatggtgagactttggaggaacttatgaaattgtctccagaagagcttctgcttagatgggcaaactttcatttggaaaactcgggctggcaaaaaattaacaactttagtgctgacatcaaggattccaaagcctatttccatcttctcaatcaaatcgcaccaaaaggacaaaaggaaggtgaaccacggatagatattaacatgtcaggtttcaatgaaacagatgatttgaagagagctgagagtatgcttcaacaagcagataaattaggttgcagacagtttgttacccctgctgatgttgtcagtggaaaccccaaactcaacttagctttcgtggctaacctgtttaataaataaaggacttttcattttgattaacaggactagcttatcatgagagccctcaggggaaagggtttaagaaaaacaactcctctttcccatagtcagagttgaatttgtcaggcacgcctgaaatgtgctcatagccaaaacattttactctctcctcctagaatgctgcccttgacatttcccattgctgtatgttatttcttgctctgttatcttttgccctcttagaatgtccctctcttgggacttgcttagatgatgggatatgaatattattagacagtaattttgctttccatccagtatgctagttcttattcgagaactatggtcagagcgtatttggatatgagtatcctttgcttatctttgtagtactgaaaatttgccgaagtaactggctgtgcagaatgtaatagaagcttttcttattcttttattcttaagatcagtatctttttacagtattctttctacatgatccttttttgtacatttaagaatattttgattatattaaacaagactgctgattttgctactttttttaaggggtcttcaagtaagtaaaacatacatcgtagctagaagaaaaatgtaccttaaatttgcatcttccctctcatacccaagctgtaaacaattgaaatattttgtcttaaatcacttggttcaatacatgcttatttgttttaaaacctgtatcatcaaactctctctctaaatttaaaatgctgttgaatatgatacttttgaggagagagtgtgctcagaacttagacgggatttggtaggccaagtatgctaagtgtacaatatattttttaattttacacctgaaacaaagaaatgtggtcactaaaaataaaagtatatatgtaggaattaatgtactcttgctttgtcaagctgtttgctatagtttccaaggtattatgttactctaactctgaaaagtgatgtaatctggtagcaatgtagtagttcaaataaaggcatttacataataa

SEQ ID NO: 441263 - DNA, 2177 bp, Homo sapiens
tgccttgaaagtttcttgcatttcaacaatattcagaaggtcttttccaccagcctattttcttcttcaccaaaggcctagagtgtgacctggcttcatgggtgacccatgaaaaccttactagttagacattgaaaatccatccacagtcctgcattaccgaacagctaagaagcattcctgcaaaactttggagttaggcacattatttcttttttccttgaaaaatatttctagcagatatgacaaaggtctaatatccacaatatatcaagaactcttgaaatctctttttctagaaactcgatgatttaattatctttaaagattctggttccaacacacctagaaatacttcacggattagttgagatgtgttcctgaaaatttccctacctggacatctcagttcttctgtcccttcgtctaccttttctagtttttggtccagccactctgtccacgtaccacgtagactgtctcccctctcatgaatacttggaagtattcattgcatctgcctaacaacttgggttttgcatctagcatgattttccacctcatatctctaagatgacttgagtgtgtgttattatgtgtgcaatgagaatattaacatggattgtatagacagcctaggtaattatatatataaagttggtgcttcaagcttaattctcacctcacattggagaaaaagagtgaataaatattattagccccaaataatagagcttaaaaacctactgtaacttcaaagtgaaatcaaaacccaaatcaaaagaaaacaaaaagcaaaactgttctaattggaactatcaatatggaatttttgcatcccagcataataattatatatgaggaaatagatgtcttacgtggtgtccttaactgacaagaatttcatcctgattttgtttccccctaaaataggtatgcagtgtcaatggctagaagaatcggagccagagtgtatgctctccctgaagaccttgtggaagtaaagcccaagatggtcatgactgtgtttgcatgtttgatgggcaggggaatgaagagagtgtaaaataaccaatctgaataaaacagccatgctcccaggtgcatgattcgcaggtcagctatttccaggtgaagtgcttatggcttaaggaactcttggccattcaaaggacttttcattttgattaacaggactagcttatcatgagagccctcaggggaaagggtttaagaaaaacaactcctctttcccatagtcagagttgaatttgtcaggcacgcctgaaatgtgctcatagccaaaacattttactctctcctcctagaatgctgcccttgacatttcccattgctgtatgttatttcttgctctgttatcttttgccctcttagaatgtccctctcttgggacttgcttagatgatgggatatgaatattattagacagtaattttgctttccatccagtatgctagttcttattcgagaactatggtcagagcgtatttggatatgagtatcctttgcttatctttgtagtactgaaaatttgccgaagtaactggctgtgcagaatgtaatagaagcttttcttattcttttattcttaagatcagtatctttttacagtattctttctacatgatccttttttgtacatttaagaatattttgattatattaaacaagactgctgattttgctactttttttaaggggtcttcaagtaagtaaaacatacatcgtagctagaagaaaaatgtaccttaaatttgcatcttccctctcatacccaagctgtaaacaattgaaatattttgtcttaaatcacttggttcaatacatgcttatttgttttaaaacctgtatcatcaaactctctctctaaatttaaaatgctgttgaatatgatacttttgaggagagagtgtgctcagaacttagacgggatttggtaggccaagtatgctaagtgtacaatatattttttaattttacacctgaaacaaagaaatgtggtcactaaaaataaaagtatatatgtaggaattaatgtactcttgctttgtcaagctgtttgctatagtttccaaggtattatgttactctaactctgaaaagtgatgtaatctggtagcaatgtagtagttcaaataaaggcatttacataataa

SEQ ID NO: 441264 - DNA, 2468 bp, Homo sapiens
  misc_feature (2387)..(2387): n is a, c, g, or t
ggggcggagggggctggcaggaggggagggagcgctggctttagagccacagctgcaaagattccgaggtgcagaagttgtctgagtgcgttggtcggcggcagtcgggccagacccaggactctgcgactttacatctttaaatggatgagatggctaccactcagatttccaaagatgagcttgatgaactcaaagaggcctttgcaaaagttgatctcaacagcaacggattcatttgtgactatgaacttcatgagctcttcaaggaagctaatatgccattaccaggatataaagtgagagaaattattcagaaactcatgctggatggtgacaggaataaagatgggaaaataagttttgacgaatttgtttatatttttcaagaggtaaaaagtagtgatattgccaagaccttccgcaaagcaatcaacaggaaagaaggtatttgtgctctgggtggaacttcagagttgtccagcgaaggaacacagcattcttactcagaggaagaaaaatatgcttttgttaactggataaacaaagctttggaaaatgatcctgattgtagacatgttataccaatgaaccctaacaccgatgacctgttcaaagctgttggtgatggaattgtgctttgtaaaatgattaacctttcagttcctgataccattgatgaaagagcaatcaacaagaagaaacttacacccttcatcattcaggaaaacttgaacttggcactgaactctgcttctgccattgggtgtcatgttgtgaacattggtgcagaagatttgagggctgggaaacctcatctggttttgggactgctttggcagatcattaagatcggtttgttcgctgacattgaattaagcaggaatgaagccttggctgctttactccgagatggtgagactttggaggaacttatgaaattgtctccagaagagcttctgcttagatgggcaaactttcatttggaaaactcgggctggcaaaaaattaacaactttagtgctgacatcaaggattccaaagcctatttccatcttctcaatcaaatcgcaccaaaaggacaaaaggaaggtgaaccacggatagatattaacatgtcaggtttcaatgaaacagatgatttgaagagagctgagagtatgcttcaacaagcagataaattaggttgcagacagtttgttacccctgctgatgttgtcagtggaaaccccaaactcaacttagctttcgtggctaacctgtttaataaatacccagcactaactaagccagagaaccaggatattgactggactctattagaaggagaaactcgtgaagaaagaaccttccgtaactggatgaactctcttggtgtcaatcctcacgtaaaccatctctatgctgacctgcaagatgccctggtaatcttacagttatatgaacgaattaaagttcctgttgactggagtaaggttaataaacctccatacccgaaactgggagccaacatgaaaaagctagaaaactgcaactatgctgttgaattagggaagcatcctgctaaattctccctggttggcattggagggcaagacctgaatgatgggaaccaaaccctgactttagctttagtctggcagctgatgagaagatataccctcaatgtcctggaagatcttggagatggtcagaaagccaatgacgacatcattgtgaactgggtgaacagaacgttgagtgaagctggaaaatcaacttccattcagagttttaaggacaagacgatcagctccagtttggcagttgtggatttaattgatgccatccagccaggctgtataaactatgaccttgtgaagagtggcaatctaacagaagatgacaagcacaataatgccaagtatgcagtgtcaatggctagaagaatcggagccagagtgtatgctctccctgaagaccttgtggaagtaaagcccaagatggtcatgactgtgtttgcatgtttgatgggcaggggaatgaagagagtgtaaaataaccaatctgaataaaacagccatgctcccaggtgcatgattcgcaggtcagctatttccaggtgaagtgcttatggcttaaggaactcttggccattcaaaggacttttcattttgattaacaggactagcttatcatgagagccctcaggggaaagggtttaagaaaaacaactcctctttcccatagtcagagttgaatttgtcaggcacgcctgaaatgtgctcatagccaaaacattttactctctcctcctagaatgctgcccttgacatttcccattgctgtatgttatttcttgctctgttatcttttgccctcttagaatgtccctctcttgggaccantcataccgggccggcccggtctgacctgtcatcaaacacgtttaagaacatcaagtagggcggcgcagggtccgcctgtat

SEQ ID NO: 441265 - DNA, 1622 bp, Homo sapiens
ggggcggagggggctggcaggaggggagggagcgctggctttagagccacagctgcaaagattccgaggtgcagaagttgtctgagtgcgttggtcggcggcagtcgggccagacccaggactctgcgactttacatctttaaatggatgagatggctaccactcagatttccaaagatgagcttgatgaactcaaagaggcctttgcaaaagttgatctcaacagcaacggattcatttgtgactatgaacttcatgagctcttcaaggaagctaatatgccattaccaggatataaagtgagagaaattattcagaaactcatgctggatggtgacaggaataaagatgggaaaataagttttgacgaatttgtttatatttttcaagaggtaaaaagtagtgatattgccaagaccttccgcaaagcaatcaacaggaaagaaggtatttgtgctctgggtggaacttcagagttgtccagcgaaggaacacagcattcttactcagaggaagaaaaatatgcttttgttaactggataaacaaagctttggaaaatgatcctgattgtagacatgttataccaatgaaccctaacaccgatgacctgttcaaagctgttggtgatggaattgtgctttgtaaaatgattaacctttcagttcctgataccattgatgaaagagcaatcaacaagaagaaacttacacccttcatcattcaggaaaacttgaacttggcactgaactctgcttctgccattgggtgtcatgttgtgaacattggtgcagaagatttgagggctgggaaacctcatctggttttgggactgctttggcagatcattaagatcggtttgttcgctgacattgaattaagcaggaatgaagccttggctgctttactccgagatggtgagactttggaggaacttatgaaattgtctccagaagagcttctgcttagatgggcaaactttcatttggaaaactcgggctggcaaaaaattaacaactttagtgctgacatcaaggattccaaagcctatttccatcttctcaatcaaatcgcaccaaaaggacaaaaggaaggtgaaccacggatagatattaacatgtcaggtttcaatgaaacagatgatttgaagagagctgagagtatgcttcaacaagcagataaattaggttgcagacagtttgttacccctgctgatgttgtcagtggaaaccccaaactcaacttagctttcgtggctaacctgtttaataaatacccagcactaactaagccagagaaccaggatattgactggactctattagaaggagaaactcgtgaagaaagaaccttccgtaactggatgaactctcttggtgtcaatcctcacgtaaaccatctctatgctgacctgcaagatgccctggtaatcttacagttatatgaacgaattaaagttcctgttgactggagtaaggttaataaacctccatacccgaaactgggagccaacatgaaaaagctagaaaactgcaactatgctgttgaattagggaagcatcctgtccctgactttagctttaagtttggcacttgtggagaagaatttcctctcaatgcccgg

SEQ ID NO: 441266 - DNA, 3147 bp, Homo sapiens
ggggcggagggggctggcaggaggggagggagcgctggctttagagccacagctgcaaagattccgaggtgcagaagttgtctgagtgcgttggtcggcggcagtcgggccagacccaggactctgcgactttacatctttaaatggatgagatggctaccactcagatttccaaagatgagcttgatgaactcaaagaggcctttgcaaaagttgatctcaacagcaacggattcatttgtgactatgaacttcatgagctcttcaaggaagctaatatgccattaccaggatataaagtgagagaaattattcagaaactcatgctggatggtgacaggaataaagatgggaaaataagttttgacgaatttgtttatatttttcaagaggtaaaaagtagtgatattgccaagaccttccgcaaagcaatcaacaggaaagaaggtatttgtgctctgggtggaacttcagagttgtccagcgaaggaacacagcattcttactcagaggaagaaaaatatgcttttgttaactggataaacaaagctttggaaaatgatcctgattgtagacatgttataccaatgaaccctaacaccgatgacctgttcaaagctgttggtgatggaattgtgctttgtaaaatgattaacctttcagttcctgataccattgatgaaagagcaatcaacaagaagaaacttacacccttcatcattcaggaaaacttgaacttggcactgaactctgcttctgccattgggtgtcatgttgtgaacattggtgcagaagatttgagggctgggaaacctcatctggttttgggactgctttggcagatcattaagatcggtttgttcgctgacattgaattaagcaggaatgaagccttggctgctttactccgagatggtgagactttggaggaacttatgaaattgtctccagaagagcttctgcttagatgggcaaactttcatttggaaaactcgggctggcaaaaaattaacaactttagtgctgacatcaaggattccaaagcctatttccatcttctcaatcaaatcgcaccaaaaggacaaaaggaaggtgaaccacggatagatattaacatgtcaggtttcaatgaaacagatgatttgaagagagctgagagtatgcttcaacaagcagataaattaggttgcagacagtttgttacccctgctgatgttgtcagtggaaaccccaaactcaacttagctttcgtggctaacctgtttaataaatacccagcactaactaagccagagaaccaggatattgactggactctattagaaggagaaactcgtgaagaaagaaccttccgtaactggatgaactctcttggtgtcaatcctcacgtaaaccatctctatgctgacctgcaagatgccctggtaatcttacagttatatgaacgaattaaagttcctgttgactggagtaaggttaataaacctccatacccgaaactgggagccaacatgaaaaagctagaaaactgcaactatgctgttgaattagggaagcatcctgctaaattctccctggttggcattggagggcaagacctgaatgatgggaaccaaaccctgactttagctttagtctggcagctgatgagaagatataccctcaatgtcctggaagatcttggagatggtcagaaagccaatgacgacatcattgtgaactgggtgaacagaacgttgagtgaagctggaaaatcaacttccattcagagttttaaggacaagacgatcagctccagtttggcagttgtggatttaattgatgccatccagccaggctgtataaactatgaccttgtgaagagtggcaatctaacagaagatgacaagcacaataatgccaagtatgcagtgtcaatggctagaagaatcggagccagagtgtatgctctccctgaagaccttgtggaagtaaagcccaagatggtcatgactgtgtttgcatgtttgatgggcaggggaatgaagagagtgtaaaataaccaatctgaataaaacagccatgctcccaggtgcatgattcgcaggtcagctatttccaggtgaagtgcttatggcttaaggaactcttggccattcaaaggacttttcattttgattaacaggactagcttatcatgagagccctcaggggaaagggtttaagaaaaacaactcctctttcccatagtcagagttgaatttgtcaggcacgcctgaaatgtgctcatagccaaaacattttactctctcctcctagaatgctgcccttgacatttcccattgctgtatgttatttcttgctctgttatcttttgccctcttagaatgtccctctcttgggacttgcttagatgatgggatatgaatattattagacagtaattttgctttccatccagtatgctagttcttattcgagaactatggtcagagcgtatttggatatgagtatcctttgcttatctttgtagtactgaaaatttgccgaagtaactggctgtgcagaatgtaatagaagcttttcttattcttttattcttaagatcagtatctttttacagtattctttctacatgatccttttttgtacatttaagaatattttgattatattaaacaagactgctgattttgctactttttttaaggggtcttcaagtaagtaaaacatacatcgtagctagaagaaaaatgtaccttaaatttgcatcttccctctcatacccaagctgtaaacaattgaaatattttgtcttaaatcacttggttcaatacatgcttatttgttttaaaacctgtatcatcaaactctctctctaaatttaaaatgctgttgaatatgatacttttgaggagagagtgtgctcagaacttagacgggatttggtaggccaagtatgctaagtgtacaatatattttttaattttacacctgaaacaaagaaatgtggtcactaaaaataaaagtatatatgtaggaattaatgtactcttgctttgtcaagctgtttgctatagtttccaaggtattatgttactctaactctgaaaagtgatgtaatctggtagcaatgtagtagttcaaataaaggcatttacataataa

SEQ ID NO: 441267 - DNA, 3110 bp, Homo sapiens
ggggcggagggggctggcaggaggggagggagcgctggctttagagccacagctgcaaagattccgaggtgcagaagttgtctgagtgcgttggtcggcggcagtcgggccagacccaggactctgcgactttacatctttaaatggatgagatggctaccactcagatttccaaagatgagcttgatgaactcaaagaggcctttgcaaaagttgatctcaacagcaacggattcatttgtgactatgaacttcatgagctcttcaaggaagctaatatgccattaccaggatataaagtgagagaaattattcagaaactcatgctggatggtgacaggaataaagatgggaaaataagttttgacgaatttgtttatatttttcaagaggtaaaaagtagtgatattgccaagaccttccgcaaagcaatcaacaggaaagaaggtatttgtgctctgggtggaacttcagagttgtccagcgaaggaacacagcattcttactcagaggaagaaaaatatgcttttgttaactggataaacaaagctttggaaaatgatcctgattgtagacatgttataccaatgaaccctaacaccgatgacctgttcaaagctgttggtgatggaattgtgctttgtaaaatgattaacctttcagttcctgataccattgatgaaagagcaatcaacaagaagaaacttacacccttcatcattcaggaaaacttgaacttggcactgaactctgcttctgccattgggtgtcatgttgtgaacattggtgcagaagatttgagggctgggaaacctcatctggttttgggactgctttggcagatcattaagatcggtttgttcgctgacattgaattaagcaggaatgaagccttggctgctttactccgagatggtgagactttggaggaacttatgaaattgtctccagaagagcttctgcttagatgggcaaactttcatttggaaaactcgggctggcaaaaaattaacaactttagtgctgacatcaaggattccaaagcctatttccatcttctcaatcaaatcgcaccaaaaggacaaaaggaaggtgaaccacggatagatattaacatgtcaggtttcaatgaaacagatgatttgaagagagctgagagtatgcttcaacaagcagataaattaggttgcagacagttttcaacttagctttcgtggctaacctgtttaataaatacccagcactaactaagccagagaaccaggatattgactggactctattagaaggagaaactcgtgaagaaagaaccttccgtaactggatgaactctcttggtgtcaatcctcacgtaaaccatctctatgctgacctgcaagatgccctggtaatcttacagttatatgaacgaattaaagttcctgttgactggagtaaggttaataaacctccatacccgaaactgggagccaacatgaaaaagctagaaaactgcaactatgctgttgaattagggaagcatcctgctaaattctccctggttggcattggagggcaagacctgaatgatgggaaccaaaccctgactttagctttagtctggcagctgatgagaagatataccctcaatgtcctggaagatcttggagatggtcagaaagccaatgacgacatcattgtgaactgggtgaacagaacgttgagtgaagctggaaaatcaacttccattcagagttttaaggacaagacgatcagctccagtttggcagttgtggatttaattgatgccatccagccaggctgtataaactatgaccttgtgaagagtggcaatctaacagaagatgacaagcacaataatgccaagtatgcagtgtcaatggctagaagaatcggagccagagtgtatgctctccctgaagaccttgtggaagtaaagcccaagatggtcatgactgtgtttgcatgtttgatgggcaggggaatgaagagagtgtaaaataaccaatctgaataaaacagccatgctcccaggtgcatgattcgcaggtcagctatttccaggtgaagtgcttatggcttaaggaactcttggccattcaaaggacttttcattttgattaacaggactagcttatcatgagagccctcaggggaaagggtttaagaaaaacaactcctctttcccatagtcagagttgaatttgtcaggcacgcctgaaatgtgctcatagccaaaacattttactctctcctcctagaatgctgcccttgacatttcccattgctgtatgttatttcttgctctgttatcttttgccctcttagaatgtccctctcttgggacttgcttagatgatgggatatgaatattattagacagtaattttgctttccatccagtatgctagttcttattcgagaactatggtcagagcgtatttggatatgagtatcctttgcttatctttgtagtactgaaaatttgccgaagtaactggctgtgcagaatgtaatagaagcttttcttattcttttattcttaagatcagtatctttttacagtattctttctacatgatccttttttgtacatttaagaatattttgattatattaaacaagactgctgattttgctactttttttaaggggtcttcaagtaagtaaaacatacatcgtagctagaagaaaaatgtaccttaaatttgcatcttccctctcatacccaagctgtaaacaattgaaatattttgtcttaaatcacttggttcaatacatgcttatttgttttaaaacctgtatcatcaaactctctctctaaatttaaaatgctgttgaatatgatacttttgaggagagagtgtgctcagaacttagacgggatttggtaggccaagtatgctaagtgtacaatatattttttaattttacacctgaaacaaagaaatgtggtcactaaaaataaaagtatatatgtaggaattaatgtactcttgctttgtcaagctgtttgctatagtttccaaggtattatgttactctaactctgaaaagtgatgtaatctggtagcaatgtagtagttcaaataaaggcatttacataataa

SEQ ID NO: 441268 - DNA, 3176 bp, Homo sapiens
ggggcggagggggctggcaggaggggagggagcgctggctttagagccacagctgcaaagattccgaggtgcagaagttgtctgagtgcgttggtcggcggcagtcgggccagacccaggactctgcgactttacatctttaaatggatgagatggctaccactcagatttccaaagatgagcttgatgaactcaaagaggcctttgcaaaagttgatctcaacagcaacggattcatttgtgactatgaacttcatgagctcttcaaggaagctaatatgccattaccaggatataaagtgagagaaattattcagaaactcatgctggatggtgacaggaataaagatgggaaaataagttttgacgaatttgtttatatttttcaagaggtaaaaagtagtgatattgccaagaccttccgcaaagcaatcaacaggaaagaaggtatttgtgctctgggtggaacttcagagttgtccagcgaaggaacacagcattcttactcagaggaagaaaaatatgcttttgttaactggataaacaaagctttggaaaatgatcctgattgtagacatgttataccaatgaaccctaacaccgatgacctgttcaaagctgttggtgatggaattgtgctttgtaaaatgattaacctttcagttcctgataccattgatgaaagagcaatcaacaagaagaaacttacacccttcatcattcaggaaaacttgaacttggcactgaactctgcttctgccattgggtgtcatgttgtgaacattggtgcagaagatttgagggctgggaaacctcatctggttttgggactgctttggcagatcattaagatcggtttgttcgctgacattgaattaagcaggaatgaagccttggctgctttactccgagatggtgagactttggaggaacttatgaaattgtctccagaagagcttctgcttagatgggcaaactttcatttggaaaactcgggctggcaaaaaattaacaactttagtgctgacatcaaggattccaaagcctatttccatcttctcaatcaaatcgcaccaaaaggacaaaaggaaggtgaaccacggatagatattaacatgtcaggtttcaatgaaacagatgatttgaagagagctgagagtatgcttcaacaagcagataaattaggttgcagacagtttgttacccctgctgatgttgtcagtggaaaccccaaactcaacttagctttcgtggctaacctgtttaataaatacccagcactaactaagccagagaaccaggatattgactggactctattagaaggagaaactcgtgaagaaagaaccttccgtaactggatgaactctcttggtgtcaatcctcacgtaaaccatctctatgctgacctgcaagatgccctggtaatcttacagttatatgaacgaattaaagttcctgttgactggagtaaggttaataaacctccatacccgaaactgggagccaacatgaaaaagctagaaaactgcaactatgctgttgaattagggaagcatcctgctaaattctccctggttggcattggagggcaagacctgaatgatgggaaccaaaccctgactttagctttagtctggcagctgatgagaagatataccctcaatgtcctggaagatcttggagatggtcagaaagccaatgacgacatcattgtgaactgggtgaacagaacgttgagtgaagctggaaaatcaacttccattcagagttttaaggacaagacgatcagctccagtttggcagttgtggatttaattgatgccatccagccaggctgtataaactatgaccttgtgaagagtggcaatctaacagaagatgacaagcacaataatgccaagtatgcagtgtcaatggctagaagaatcggagccagagtgtatgctctccctgaagaccttgtggaagtaaagcccaagatggtcatgactgtgtttgcatgtttgatgggcaggggaatgaagagagtgtaaaataaccaatctgaataaaacagccatgctcccaggtgcatgattcgcaggtcagctatttccaggtgaagtgcttatggcttaaggaactcttggccattcaaaggacttttcattttgattaacaggactagcttatcatgagagccctcaggggaaagggtttaagaaaaacaactcctctttcccatagtcagagttgaatttgtcaggcacgcctgaaatgtgctcatagccaaaacattttactctctcctcctagaatgctgcccttgacatttcccattgctgtatgttatttcttgctctgttatcttttgccctcttagaatgtccctctcttgggacttgcttagatgatgggatatgaatattattagacagtaattttgctttccatccagtatgctagttcttattcgagaactatggtcagagcgtatttggatatgagtatcctttgcttatctttgtagtactgaaaatttgccgaagtaactggctgtgcagaatgtaatagaagcttttcttattcttttattcttaagatcagtatctttttacagtattctttctacatgatccttttttgtacatttaagaatattttgattatattaaacaagactgctgattttgctactttttttaaggggtcttcaagtaagtaaaacatacatcgtagctagaagaaaaatgtaccttaaatttgcatcttccctctcatacccaagctgtaaacaattgaaatattttgtcttaaatcacttggttcaatacatgcttatttgttttaaaacctgtatcatcaaactctctctctaaatttaaaatgctgttgaatatgatacttttgaggagagagtgtgctcagaacttagacgggatttggtaggccaagtatgctaagtgtacaatatattttttaattttacacctgaaacaaagaaatgtggtcactaaaaataaaagtatatatgtaggaattaatgtactcttgctttgtcaagctgtttgctatagtttccaaggtattatgttactctaactctgaaaagtgatgtaatctggtagcaatgtagtagttcaaataaaggcatttacataataaatttagggttgatggggtcctcagtgacc

SEQ ID NO: 441269 - DNA, 3286 bp, Homo sapiens
ggggcggagggggctggcaggaggggagggagcgctggctttagagccacagctgcaaagattccgaggtgcagaagttgtctgagtgcgttggtcggcggcagtcgggccagacccaggactctgcgactttacatctttaaatggatgagatggctaccactcagatttccaaagatgagcttgatgaactcaaagaggcctttgcaaaagttgatctcaacagcaacggattcatttgtgactatgaacttcatgagctcttcaaggaagctaatatgccattaccaggatataaagtgagagaaattattcagaaactcatgctggatggtgacaggaataaagatgggaaaataagttttgacgaatttgtttatatttttcaagaggtaaaaagtagtgatattgccaagaccttccgcaaagcaatcaacaggaaagaaggtatttgtgctctgggtggaacttcagagttgtccagcgaaggaacacagcattcttactcagaggaagaaaaatatgcttttgttaactggataaacaaagctttggaaaatgatcctgattgtagacatgttataccaatgaaccctaacaccgatgacctgttcaaagctgttggtgatggaattgtgctttgtaaaatgattaacctttcagttcctgataccattgatgaaagagcaatcaacaagaagaaacttacacccttcatcattcaggaaaacttgaacttggcactgaactctgcttctgccattgggtgtcatgttgtgaacattggtgcagaagatttgagggctgggaaacctcatctggttttgggactgctttggcagatcattaagatcggtttgttcgctgacattgaattaagcaggaatgaagccttggctgctttactccgagatggtgagactttggaggaacttatgaaattgtctccagaagagcttctgcttagatgggcaaactttcatttggaaaactcgggctggcaaaaaattaacaactttagtgctgacatcaaggattccaaagcctatttccatcttctcaatcaaatcgcaccaaaaggacaaaaggaaggtgaaccacggatagatattaacatgtcaggtttcaatgaaacagatgatttgaagagagctgagagtatgcttcaacaagcagataaattaggttgcagacagtttgttacccctgctgatgttgtcagtggaaaccccaaactcaacttagctttcgtggctaacctgtttaataaatacccagcactaactaagccagagaaccaggatattgactggactctattagaaggagaaactcgtgaagaaagaaccttccgtaactggatgaactctcttggtgtcaatcctcacgtaaaccatctctatgctgacctgcaagatgccctggtaatcttacagttatatgaacgaattaaagttcctgttgactggagtaaggttaataaacctccatacccgaaactgggagccaacatgaaaaagctagaaaactgcaactatgctgttgaattagggaagcatcctgctaaattctccctggttggcattggagggcaagacctgaatgatgggaaccaaaccctgactttagctttagtctggcagctgatgagaagatataccctcaatgtcctggaagatcttggagatggtcagaaagccaatgacgacatcattgtgaactgggtgaacagaacgttgagtgaagctggaaaatcaacttccattcagagttttaaggacaagacgatcagctccagtttggcagttgtggatttaattgatgccatccagccaggctgtataaactatgaccttgtgaagagtggcaatctaacagaagatgacaagcacaataatgccaagtatgcagtgtcaatggctagaagaatcggagccagagtgtatgctctccctgaagaccttgtggaagtaaagcccaagatggtcatgactgtgtttgcatgtttgatgggcaggggaatgaagagagtgtaaaataaccaatctgaataaaacagccatgctcccaggtgcatgattcgcaggtcagctatttccaggtgaagtgcttatggcttaaggaactcttggccattcaaaggacttttcattttgattaacaggactagcttatcatgagagccctcaggggaaagggtttaagaaaaacaactcctctttcccatagtcagagttgaatttgtcaggcacgcctgaaatgtgctcatagccaaaacattttactctctcctcctagaatgctgcccttgacatttcccattgctgtatgttatttcttgctctgttatcttttgccctcttagaatgtccctctcttgggacttgcttagatgatgggatatgaatattattagacagtaattttgctttccatccagtatgctagttcttattcgagaactatggtcagagcgtatttggatatgagtatcctttgcttatctttgtagtactgaaaatttgccgaagtaactggctgtgcagaatgtaatagaagcttttcttattcttttattcttaagatcagtatctttttacagtattctttctacatgatccttttttgtacatttaagaatattttgattatattaaacaagactgctgattttgctactttttttaaggggtcttcaagtaagtaaaacatacatcgtagctagaagaaaaatgtaccttaaatttgcatcttccctctcatacccaagctgtaaacaattgaaatattttgtcttaaatcacttggttcaatacatgcttatttgttttaaaacctgtatcatcaaactctctctctaaatttaaaatgctgttgaatatgatacttttgaggagagagtgtgctcagaacttagacgggatttggtaggccaagtatgctaagtgtacaatatattttttaattttacacctgaaacaaagaaatgtggtcactaaaaataaaagtatatatgtaggaattaatgtactcttgctttgtcaagctgtttgctatagtttccaaggtattatgttactctaactctgaaaagtgatgtaatctggtagcaatgtagtagttcaaataaaggcatttacataataacacacaacacaacacacgcgtttaacgtcggatgcgaaaccgggtcccaatatcgctgtgaaaccctttgcataggggaaggcgcgagctcccaagggcgaggaggacgggtttgagaccgatgagacctacagcgggg

SEQ ID NO: 441270 - DNA, 1815 bp, Homo sapiens
tactagaggtaccccagtaaatccggcataaccgacgcaggatgtcagtcctacacgtaaaccatctctatgctgacctgcaagatgccctggtaatcttacagttatatgaacgaattaaagttcctgttgactggagtaaggttaataaacctccatacccgaaactgggagccaacatgaaaaagctagaaaactgcaactatgctgttgaattagggaagcatcctgctaaattctccctggttggcattggagggcaagacctgaatgatgggaaccaaaccctgactttagctttagtctggcagctgatgagaagatataccctcaatgtcctggaagatcttggagatggtcagaaagccaatgacgacatcattgtgaactgggtgaacagaacgttgagtgaagctggaaaatcaacttccattcagagttttaaggacaagacgatcagctccagtttggcagttgtggatttaattgatgccatccagccaggctgtataaactatgaccttgtgaagagtggcaatctaacagaagatgacaagcacaataatgccaagtatgcagtgtcaatggctagaagaatcggagccagagtgtatgctctccctgaagaccttgtggaagtaaagcccaagatggtcatgactgtgtttgcatgtttgatgggcaggggaatgaagagagtgtaaaataaccaatctgaataaaacagccatgctcccaggtgcatgattcgcaggtcagctatttccaggtgaagtgcttatggcttaaggaactcttggccattcaaaggacttttcattttgattaacaggactagcttatcatgagagccctcaggggaaagggtttaagaaaaacaactcctctttcccatagtcagagttgaatttgtcaggcacgcctgaaatgtgctcatagccaaaacattttactctctcctcctagaatgctgcccttgacatttcccattgctgtatgttatttcttgctctgttatcttttgccctcttagaatgtccctctcttgggacttgcttagatgatgggatatgaatattattagacagtaattttgctttccatccagtatgctagttcttattcgagaactatggtcagagcgtatttggatatgagtatcctttgcttatctttgtagtactgaaaatttgccgaagtaactggctgtgcagaatgtaatagaagcttttcttattcttttattcttaagatcagtatctttttacagtattctttctacatgatccttttttgtacatttaagaatattttgattatattaaacaagactgctgattttgctactttttttaaggggtcttcaagtaagtaaaacatacatcgtagctagaagaaaaatgtaccttaaatttgcatcttccctctcatacccaagctgtaaacaattgaaatattttgtcttaaatcacttggttcaatacatgcttatttgttttaaaacctgtatcatcaaactctctctctaaatttaaaatgctgttgaatatgatacttttgaggagagagtgtgctcagaacttagacgggatttggtaggccaagtatgctaagtgtacaatatattttttaattttacacctgaaacaaagaaatgtggtcactaaaaataaaagtatatatgtaggaattaatgtactcttgctttgtcaagctgtttgctatagtttccaaggtattatgttactctaactctgaaaagtgatgtaatctggtagcaatgtagtagttcaaataaaggcatttacataataa

SEQ ID NO: 441271 - DNA, 2360 bp, Homo sapiens
ggggcggagggggctggcaggaggggagggagcgctggctttagagccacagctgcaaagattccgaggtgcagaagttgtctgagtgcgttggtcggcggcagtcgggccagacccaggactctgcgactttacatctttaaatggatgagatggctaccactcagatttccaaagatgagcttgatgaactcaaagaggcctttgcaaaagttgatctcaacagcaacggattcatttgtgactatgaacttcatgagctcttcaaggaagctaatatgccattaccaggatataaagtgagagaaattattcagaaactcatgctggatggtgacaggaataaagatgggaaaataagttttgacgaatttgtttatatttttcaagaggtaaaaagtagtgatattgccaagaccttccgcaaagcaatcaacaggaaagaaggtatttgtgctctgggtggaacttcagagttgtccagcgaaggaacacagcattcttactcagaggaagaaaaatatgcttttgttaactggataaacaaagctttggaaaatgatcctgattgtagacatgttataccaatgaaccctaacaccgatgacctgttcaaagctgttggtgatggaattgtgctttgtaaaatgattaacctttcagttcctgataccattgatgaaagagcaatcaacaagaagaaacttacacccttcatcattcaggaaaacttgaacttggcactgaactctgcttctgccattgggtgtcatgttgtgaacattggtgcagaagatttgagggctgggaaacctcatctggttttgggactgctttggcagatcattaagatcggtttgttcgctgacattgaattaagcaggaatgaagccttggctgctttactccgagatggtgagactttggaggaacttatgaaattgtctccagaagagcttctgcttagatgggcaaactttcatttggaaaactcgggctggcaaaaaattaacaactttagtgctgacatcaaggattccaaagcctatttccatcttctcaatcaaatcgcaccaaaaggacaaaaggaaggtgaaccacggatagatattaacatgtcaggtttcaatgaaacagatgatttgaagagagctgagagtatgcttcaacaagcagataaattaggttgcagacagtttgttacccctgctgatgttgtcagtggaaaccccaaactcaacttagctttcgtggctaacctgtttaataaatacccagcactaactaagccagagaaccaggatattgactggactctattagaaggagaaactcgtgaagaaagaaccttccgtaactggatgaactctcttggtgtcaatcctcacgtaaaccatctctatgctgacctgcaagatgccctggtaatcttacagttatatgaacgaattaaagttcctgttgactggagtaaggttaataaacctccatacccgaaactgggagccaacatgaaaaagctagaaaactgcaactatgctgttgaattagggaagcatcctgctaaattctccctggttggcattggagggcaagacctgaatgatgggaaccaaaccctgactttagctttagtctggcagctgatgagaagatataccctcaatgtcctggaagatcttggagatggtcagaaagccaatgacgacatcattgtgaactgggtgaacagaacgttgagtgaagctggaaaatcaacttccattcagagttttaaggacaagacgatcagctccagtttggcagttgtggatttaattgatgccatccagccaggctgtataaactatgaccttgtgaagagtggcaatctaacagaagatgacaagcacaataatgccaagtatgcagtgtcaatggctagaagaatcggagccagagtgtatgctctccctgaagaccttgtggaagtaaagcccaagatggtcatgactgtgtttgcatgtttgatgggcaggggaatgaagagagtgtaaaataaccaatctgaataaaacagccatgctcccaggtgcatgattcgcaggtcagctatttccaggtgaagtgcttatggcttaaggaactcttggccattcaaaggacttttcattttgattaacaggactagcttatcatgagagccctcaggggaaagggtttaagaaaaacaatcgttggaggacaatagtaacgacagggaactcgctcaggcacgagtatgtaagcacctcagagccatatacagtttaaacactatcgctaaaaatgttgccccgaacacctcaccaggaatgaaagtaatgctctagttccgggat

SEQ ID NO: 441272 - DNA, 1790 bp, Homo sapiens
ggggcggagggggctggcaggaggggagggagcgctggctttagagccacagctgcaaagattccgaggtgcagaagttgtctgagtgcgttggtcggcggcagtcgggccagacccaggactctgcgactttacatctttaaatggatgagatggctaccactcagatttccaaagatgagcttgatgaactcaaagaggcctttgcaaaagttgatctcaacagcaacggattcatttgtgactatgaacttcatgagctcttcaaggaagctaatatgccattaccaggatataaagtgagagaaattattcagaaactcatgctggatggtgacaggaataaagatgggaaaataagttttgacgaatttgtttatatttttcaagaggtaaaaagtagtgatattgccaagaccttccgcaaagcaatcaacaggaaagaaggtatttgtgctctgggtggaacttcagagttgtccagcgaaggaacacagcattcttactcagaggaagaaaaatatgcttttgttaactggataaacaaagctttggaaaatgatcctgattgtagacatgttataccaatgaaccctaacaccgatgacctgttcaaagctgttggtgatggaattgtgctttgtaaaatgattaacctttcagttcctgataccattgatgaaagagcaatcaacaagaagaaacttacacccttcatcattcaggaaaacttgaacttggcactgaactctgcttctgccattgggtgtcatgttgtgaacattggtgcagaagatttgagggctgggaaacctcatctggttttgggactgctttggcagatcattaagatcggtttgttcgctgacattgaattaagcaggaatgaagccttggctgctttactccgagatggtgagactttggaggaacttatgaaattgtctccagaagagcttctgcttagatgggcaaactttcatttggaaaactcgggctggcaaaaaattaacaactttagtgctgacatcaaggattccaaagcctatttccatcttctcaatcaaatcgcaccaaaaggacaaaaggaaggtgaaccacggatagatattaacatgtcaggtttcaatgaaacagatgatttgaagagagctgagagtatgcttcaacaagcagataaattaggttgcagacagtttgttacccctgctgatgttgtcagtggaaaccccaaactcaacttagctttcgtggctaacctgtttaataaatacccagcactaactaagccagagaaccaggatattgactggactctattagaaggagaaactcgtgaagaaagaaccttccgtaactggatgaactctcttggtgtcaatcctcacgtaaaccatctctatgcgtaagccttcctactgctattgtaaacagttacgaatgtcatgaatggatgttaaataatgacagctctaaagattttctagatattaatttgtagctattatttatattggaaaatgtcaagtggtgatttccatcatcattttccaaatacacaaaagctttaagtattcctttacatgatcgttaactgtaagtgatagaatatataaatgtctttatagtaccctagggagcaaatactttatattttgaaacagctgtttgggaggttgaggtgggggcattgcttgagcccaggagtttgaggcttcagtgagctatggttgtgccactgtactccagcctgggcaacaaagtgagatcctatctctaagagggaaaaa

SEQ ID NO: 441273 - DNA, 301 bp, Homo sapiens
  misc_feature (202)..(202): n is a, c, g, or t
aattctagacagtactgatggtaaccaaggccctaatttaacttctcagaatatacagtgctgggctcctaacttctcggaatatacagtgcagggctcctaaacaaggcattggctgaagacctcattcatgaccataatggcttactaaaataagttcaaatcagttgcatgaaatatgatatgggccaccacgcccggnttagaaaacattgtcttccatatactttaaatcatctttagctcacttataatacctgatacaacataaattttaggtaaaatagttgttatattgtgt

SEQ ID NO: 441274 - DNA, 569 bp, Homo sapiens
aattctagacagtactgatggtaaccaaggccctaatttaacttctcagaatatacagtgctgggctcctaacttctcggaatatacagtgcagggctcctaaacaaggcattggctgaagacctcattcatgaccataatggcttactaaaataagttcaaatcagttgcatgaaatatgatatgggccaggcgtggtggcttacgcctgccatgtcagcactttgggaggccaaggtaggcagattgcttgagcccaagagtttgagaccagcctgggcaacatgacaaaaccccgtctctacaaaaaatacaaaaatttcctgagcatggtgacatgtacctgtagtcccagatccttgggaggctgaggtggaaggatcactttagccttggaggttgaggctgcagtgagctgtgatcataccactgcactccaatctgggtgacaaaatgagaccctgtctcaaaaaaagaaaaaacatggttcagtgattagttacttttcagtcatgagtctcttcattttaactttttgtaacagatttttttcagaacagttttaagtt

SEQ ID NO: 441275 - DNA, 795 bp, Homo sapiens
aagtgtgtaacacttcagaatgttttaactgaattctttacaatttcatcaaccagttgtggcacctaaagatagggttgttatctctctacccttgggatctcataacttcttggtatggtcaccacttgacaaaagaagcaatgtgtttatcatattctagaaaaatattcatagaaatgtaagtggaattgcattaacctgtggaaaaatgctggtttcttttagctgtagattattgagtcaatatcaaatgctaatatacaagggacaatagtgcattaaatttaataggtagttctgttataattattgtgaaaatttttaatatagtgttgatttgtcagtgttctaattcactgttaatttgcggttttcataatattacctttatgtaatttcctaggcatcaactgtgaaatctgtgttagaattgattcctgaattaaatgaaaaggaagaagcatacaattccctcatgaaaagctatgtctcagagaaagatgtcacatctgctaaagcactgtatgaacatttgactgcaaagaatacaaaattggatgatctgtttctaaagcgttacgcatctttgctgaagtatgctggagagcctgtccctttcattgaaccccctgaaagctttgaattttatgcacagcagctaagaaaattgagggaaaactcttcttgaaataaccaggcgatactttgttttgtatatatttgtgattctgtgtctacatgttattttgaagtatatctgagggaaaaataaatgaaaattttctttatgta

SEQ ID NO: 441276 - DNA, 333 bp, Homo sapiens
tgattaatatatttttttctttatgtcagtctcagagaaagatgtcacatctgctaaagcactgtatgaacatttgactgcaaagaatacaaaattggatgatctgtttctaaagcgttacgcatctttgctgaagtatgctggagagcctgtccctttcattgaaccccctgaaagctttgaattttatgcacagcagctaagaaaattgagggaaaactcttcttgaaataaccaggcgatactttgttttgtatatatttgtgattctgtgtctacatgttattttgaagtatatctgagggaaaaataaatgaaaattttctttatgta

SEQ ID NO: 441277 - DNA, 1023 bp, Homo sapiens
ggtagaattcatttattttctaaagcgaggccccgcgtacgcgcttagggtggggacctgcgcgttcctttacactgttcccaggccctgataatccacatcctatcatgttgaacctgggaggcaaacggcaaggtgcaaaagacctccacggtttctccggcccgcgtttctgagagtgaagggccgttcctattggacatggcgtcagggctgaacgttagcagcaacatctgcactcgggggcgggggaaaccttcccacgtcctgggatcttcatagtcggctctcctcgagagttctcggtatttttactagttggcctcccacaagcctctgcgccaacctgggaggagttgacctcttgcggctctaccaacagaggagtgcaggggtgcagcgaatgaacacgatgcccagatcggagacggaagacggaaaagaaaagcttcgataatgaatcaagcaacatcgtttatgtaaatattacattgggtcttctgtcctcggagaagtgcggttttccatcttccaacctaaaacaatccgtcgctccccccacatttggcacgcccggcagttggtctctgccgcgccaggctaccctgcggtcacatgctcctcctgtccttctggcggagcgtgcttcccgctgcggggacgttcgagcaatggcagccctgctgagatccgcgcgttggttgctgcgtgccggggcggccccgcgcctcccgctctccctgcgcctcctccctggcggcccgggccggctgcatgccgcctcctatctgcccgccgctcgcgccgggcccgtggccggaggactactgagcccagccaggctgtagtggtagcatatagattgtccttttgcaaagaaagaaaaaaaaccatcaagttgtgccaaattattctcctatgtttggctgctagaacatggttaccatgtctttctctctcactccctccctttctatcgttctctctttgcatggatttcttttgaaaaaaaataaattgctc

SEQ ID NO: 441278 - DNA, 596 bp, Homo sapiens
tcaccaaagcttggcatagcttgcacttgttttcttttttcttgccttaaaaaataatagtcgactattaggccttcctattggtaataatacactactgtattattgtgaactttcttaattggaaatattcagtttgatccacttgtttatcagaaaccttcacttactgaataatgttttaatttttagagatgtggtgcaattgctgaacaaaccccgattttgttgttgttcctccttaggaattctaggaaacaaggaaaggtactgtgctttacctgcttacaaatcaatgatactgtacgtgccttgctcagaagtattgaatttaacataaaagcctgttgtttcaggaccttatttgagaatactatagagattcaagactttgcttgtctctacttagagtcagttttgtcgtctgttagctgtactggaaatgtaaaacaagttcacgcaggaattttccacttacacaggtatgcattgagagccccaagaaaaggcccttaaaaaatgcaagattagaggcatgagccaccacgttctgtttttcttgttgttgttttgttttgtttgtttgtttggagatc

SEQ ID NO: 441279 - DNA, 191 bp, Homo sapiens
tccgagcttcggtacctccgacgcctctgtgtactggtagaaagatctggtcagagtttaaccctctattaagtattaatctgcgtgtgtgaagccatactttttcaggattcttcccctaattggctctttggtttccctgctctgtttcatttatttcattaaaatgttattcctttatttaagattca

SEQ ID NO: 441280 - DNA, 5712 bp, Homo sapiens
ggtagaattcatttattttctaaagcgaggccccgcgtacgcgcttagggtggggacctgcgcgttcctttacactgttcccaggccctgataatccacatcctatcatgttgaacctgggaggcaaacggcaaggtgcaaaagacctccacggtttctccggcccgcgtttctgagagtgaagggccgttcctattggacatggcgtcagggctgaacgttagcagcaacatctgcactcgggggcgggggaaaccttcccacgtcctgggatcttcatagtcggctctcctcgagagttctcggtatttttactagttggcctcccacaagcctctgcgccaacctgggaggagttgacctcttgcggctctaccaacagaggagtgcaggggtgcagcgaatgaacacgatgcccagatcggagacggaagacggaaaagaaaagcttcgataatgaatcaagcaacatcgtttatgtaaatattacattgggtcttctgtcctcggagaagtgcggttttccatcttccaacctaaaacaatccgtcgctccccccacatttggcacgcccggcagttggtctctgccgcgccaggctaccctgcggtcacatgctcctcctgtccttctggcggagcgtgcttcccgctgcggggacgttcgagcaatggcagccctgctgagatccgcgcgttggttgctgcgtgccggggcggccccgcgcctcccgctctccctgcgcctcctccctggcggcccgggccggctgcatgccgcctcctatctgcccgccgctcgcgccgggcccgtggccggaggactactgagcccagccaggctgtatgccattgctgccaaagaaaaagatattcaagaggagtccactttttcttctaggaagatttccaatcagtttgattgggctctaatgagactagatctttctgttcgaagaactggccgcattccaaagaagcttctacaaaaagtttttaatgatacctgccgctcaggtggcctaggtggtagtcatgccttgcttctactacgtagttgtggttctctcttgcctgaactaaagcttgaagagagaacagaatttgctcataggatatgggacacacttcagaaattaggtgctgtgtatgatgtgagtcactataatgctttacttaaagtctatcttcaaaatgaatataaattctcaccaactgatttcctggcaaaaatggaggaagcaaacattcaaccaaatcgagtgacataccagagattgattgcttcttattgtaatgtaggagatattgaaggtgccagcaagattcttggatttatgaaaactaaggatctcccagttacagaggcagtattcagtgcccttgtgacagggcatgccagagctggtgatatggagaatgcagaaaacattctcacagtgatgagagatgccggaattgagcctggtccagacacatacctcgcattattgaatgcatatgctgagaagggcgacattgaccatgttaagcagactctggagaaggtggagaagtccgagcttcaccttatggaccgtgatttactgcaaattatttttagcttcagtaaagctgggtatcctcagtatgtctcagaaattttggaaaaagttacatgtgaaagaagatatattccagatgcaatgaacctcattttacttttagtcactgaaaaattggaagatgtagcgttgcaaattttactagcatgccccgtatcaaaggaagatggcccaagtgtctttggcagtttctttttacaacactgtgtgactatgaatacgcctgtggagaagctaacagactactgtaagaagttaaaggaagtccagatgcactcctttcctctgcagttcaccctccattgtgctttactcgccaataaaactgatttggcaaaagccttaatgaaggctgtgaaggaggaaggttttcctatcagacctcactatttctggccattgctagttggacgtcggaaggaaaaaaatgttcaaggtataattgaaatcctcaaaggaatgcaagaattgggagtacatcctgatcaggaaacatatacagattatgtgattccatgctttgatagtgtaaactcagcacgagccattttgcaggaaaatggatgtctgtctgatagtgatatgttttctcaagctggattgagaagtgaagcagcaaatgggaacttagactttgtattatcatttttgaaatcaaatacattgcccatctcgctgcagtctataagaagtagcctactgctaggcttcaggaggtctatgaatataaatctttggagcgagataacagaattgttgtacaaggatggacgttattgccaggagcctcgaggaccgacggaagctgttggctattttctttataacttgattgacagcatgagtgactcagaggtacaggccaaggaggagcatttgagacaatacttccatcagctggagaagatgaatgtaaaaattcctgaaaatatctacagaggcattcgtaatctcctggaaagctaccatgttcctgaattgattaaggatgctcacttgttggttgagagtaagaatttagactttcaaaaaactgtgcaacttacatcatctgaattggagtccacacttgaaacactaaaagctgaaaatcaacctataagagatgtcctaaagcaactcatattagtgctttgttcagaagagaatatgcaaaaagcccttgaattgaaagcaaaatatgaatccgacatggttactggtggctatgcagctttaataaatttatgctgtcgacatgataaagtagaagatgccttgaacttgaaagaagaatttgaccgcttagattcatctgctgtccttgacaccggcaagtatgtaggccttgtaagagtattggcaaagcatggcaagctccaagatgctattaacattctgaaggagatgaaagagaaggatgttcttatcaaagatacaacagccttgtcctttttccacatgctaaatggcgcagctttaagaggtgaaattgaaacagtaaaacagttgcatgaagccatcgtgactctagggttagcagaaccatccaccaacataagtttcccattggtcactgtacacttggaaaagggcgacctatctactgctcttgaggtcgccattgactgctatgaaaagtataaagtattaccaaggattcatgatgtcttgtgtaaactggtagagaaaggcgagactgatctaattcagaaagcaatggactttgtgagccaagaacaaggtgaaatggtgatgctctatgatctcttctttgccttcctacaaacaggaaattacaaagaggccaagaagatcattgagactccagggattagagctcgatctgcaaggcttcagtggttttgtgacagatgtgttgcaaataatcaggttgaaactctggaaaaattagtggagctgacacagaagctatttgaatgtgatagagaccagatgtactacaatctgctaaaactgtataaaataaacggtgactggcaaagagctgatgcagtctggaataaaatccaagaagaaaatgttattcctcgtgaaaagacattaagattattagcagaaatccttagagagggtaaccaggaagttccgtttgacgtacctgagttgtggtatgaagatgaaaaacattccctgaattcttcgtcagcctcaaccacagaacctgatttccagaaagatatattgattgcctgccgattgaaccaaaaaaaaggggcatatgatattttcctgaatgcaaaagagcaaaacattgtgtttaatgctgaaacctacagcaatctcattaaattactgatgtcagaagattattttacacaagcaatggaagtgaaagcattcgcggagacccacatcaagggcttcacactgaacgatgctgccaacagccgcctcatcataacgcaagttaggcgggattatttgaaagaggctgtgacaacactgaaaacagtattggatcagcagcagaccccttctaggttagcagtgacccgtgtcatccaggcattggccatgaagggtgatgttgaaaacatagaagtagttcagaagatgttaaatggactcgaagactccattggactttcaaaaatggttttcatcaataacattgctttggctcaaataaagaataataacatagatgccgcaatagaaaacattgaaaatatgcttacttcagagaataaagtcattgaaccccaatacttcggcttggcatacttattcagaaaagtaatagaggagcagttggaaccagcagttgaaaagataagcatcatggcggagagattggccaatcagtttgcaatttataaacctgtcactgattttttccttcaacttgtggatgcaggcaaggtggatgatgccagagctctcctacagagatgtggtgcaattgctgaacaaaccccgattttgttgttgttcctccttaggaattctaggaaacaaggaaaggcatcaactgtgaaatctgtgttagaattgattcctgaattaaatgaaaaggaagaagcatacaattccctcatgaaaagctatgtctcagagaaagatgtcacatctgctaaagcactgtatgaacatttgactgcaaagaatacaaaattggatgatctgtttctaaagcgttacgcatctttgctgaagtatgctggagagcctgtccctttcattgaaccccctgaaagctttgaattttatgcacagcagctaagaaaattgagggaaaactcttcttgaaataaccaggcgatactttgttttgtatatatttgtgattctgtgtctacatgttattttgaagtatatctgagggaaaaataaatgaaaattttctttatgtacttatgtatgtgtgatgcatgttcaaagtcttattgaccataactctgtgcacttggttattggacatttttggagtttttttctctgggaaaaatcgatagtgttttcttcaatgctgctgctgtgtgaagccatactttttcaggattcttcccctaattggctctttggtttccctgctctgtttcatttatttcattaaaatgttattcctttatttaagattcacttattagtctgctgtttctctgaaaaattttagagctaggtatagtgaccgtgaactttctaacgcataatattctgtgatacagccattccgtacatgtgtgaagtcctgcataactttcgaactttgttaaatgttggcactaggagtcatcagatctaggcttcatcattttccagtgagaagcagagacccaaagggcctgttacttgtgcttggtcaggggactgtctgtcatgcctggaggctcttcggcacacttccccatctttcccttctgccactgtggcttcaagcacctctgttcatagagcgtctctgaaattgagtctcggtcatgacttatcccgaagtagagcaatgtgtttcctctcattgtagtttcaggactttgtcagtacaagctctgccctaggcttgttactttatactcatatcctgaaaagatgtgatttcatctatgaaggggtaaaatattggtttgtatttaattgtttgaaataaaagtgatccctatattga

SEQ ID NO: 441281 - DNA, 4263 bp, Homo sapiens
tttttgaatctggatattttatttagctttaatacttaaataaaaacactctaactttgtcttctaatttctggaactctctatagactctggagaaggtggagaagtccgagcttcaccttatggaccgtgatttactgcaaattatttttagcttcagtaaagctgggtatcctcagtatgtctcagaaattttggaaaaagttacatgtgaaagaagatatattccagatgcaatgaacctcattttacttttagtcactgaaaaattggaagatgtagcgttgcaaattttactagcatgccccgtatcaaaggaagatggcccaagtgtctttggcagtttctttttacaacactgtgtgactatgaatacgcctgtggagaagctaacagactactgtaagaagttaaaggaagtccagatgcactcctttcctctgcagttcaccctccattgtgctttactcgccaataaaactgatttggcaaaagccttaatgaaggctgtgaaggaggaaggttttcctatcagacctcactatttctggccattgctagttggacgtcggaaggaaaaaaatgttcaaggtataattgaaatcctcaaaggaatgcaagaattgggagtacatcctgatcaggaaacatatacagattatgtgattccatgctttgatagtgtaaactcagcacgagccattttgcaggaaaatggatgtctgtctgatagtgatatgttttctcaagctggattgagaagtgaagcagcaaatgggaacttagactttgtattatcatttttgaaatcaaatacattgcccatctcgctgcagtctataagaagtagcctactgctaggcttcaggaggtctatgaatataaatctttggagcgagataacagaattgttgtacaaggatggacgttattgccaggagcctcgaggaccgacggaagctgttggctattttctttataacttgattgacagcatgagtgactcagaggtacaggccaaggaggagcatttgagacaatacttccatcagctggagaagatgaatgtaaaaattcctgaaaatatctacagaggcattcgtaatctcctggaaagctaccatgttcctgaattgattaaggatgctcacttgttggttgagagtaagaatttagactttcaaaaaactgtgcaacttacatcatctgaattggagtccacacttgaaacactaaaagctgaaaatcaacctataagagatgtcctaaagcaactcatattagtgctttgttcagaagagaatatgcaaaaagcccttgaattgaaagcaaaatatgaatccgacatggttactggtggctatgcagctttaataaatttatgctgtcgacatgataaagtagaagatgccttgaacttgaaagaagaatttgaccgcttagattcatctgctgtccttgacaccggcaagtatgtaggccttgtaagagtattggcaaagcatggcaagctccaagatgctattaacattctgaaggagatgaaagagaaggatgttcttatcaaagatacaacagccttgtcctttttccacatgctaaatggcgcagctttaagaggtgaaattgaaacagtaaaacagttgcatgaagccatcgtgactctagggttagcagaaccatccaccaacataagtttcccattggtcactgtacacttggaaaagggcgacctatctactgctcttgaggtcgccattgactgctatgaaaagtataaagtattaccaaggattcatgatgtcttgtgtaaactggtagagaaaggcgagactgatctaattcagaaagcaatggactttgtgagccaagaacaaggtgaaatggtgatgctctatgatctcttctttgccttcctacaaacaggaaattacaaagaggccaagaagatcattgagactccagggattagagctcgatctgcaaggcttcagtggttttgtgacagatgtgttgcaaataatcaggttgaaactctggaaaaattagtggagctgacacagaagctatttgaatgtgatagagaccagatgtactacaatctgctaaaactgtataaaataaacggtgactggcaaagagctgatgcagtctggaataaaatccaagaagaaaatgttattcctcgtgaaaagacattaagattattagcagaaatccttagagagggtaaccaggaagttccgtttgacgtacctgagttgtggtatgaagatgaaaaacattccctgaattcttcgtcagcctcaaccacagaacctgatttccagaaagatatattgattgcctgccgattgaaccaaaaaaaaggggcatatgatattttcctgaatgcaaaagagcaaaacattgtgtttaatgctgaaacctacagcaatctcattaaattactgatgtcagaagattattttacacaagcaatggaagtgaaagcattcgcggagacccacatcaagggcttcacactgaacgatgctgccaacagccgcctcatcataacgcaagttaggcgggattatttgaaagaggctgtgacaacactgaaaacagtattggatcagcagcagaccccttctaggttagcagtgacccgtgtcatccaggcattggccatgaagggtgatgttgaaaacatagaagtagttcagaagatgttaaatggactcgaagactccattggactttcaaaaatggttttcatcaataacattgctttggctcaaataaagaataataacatagatgccgcaatagaaaacattgaaaatatgcttacttcagagaataaagtcattgaaccccaatacttcggcttggcatacttattcagaaaagtaatagaggagcagttggaaccagcagttgaaaagataagcatcatggcggagagattggccaatcagtttgcaatttataaacctgtcactgattttttccttcaacttgtggatgcaggcaaggtggatgatgccagagctctcctacagagatgtggtgcaattgctgaacaaaccccgattttgttgttgttcctccttaggaattctaggaaacaaggaaaggcatcaactgtgaaatctgtgttagaattgattcctgaattaaatgaaaaggaagaagcatacaattccctcatgaaaagctatgtctcagagaaagatgtcacatctgctaaagcactgtatgaacatttgactgcaaagaatacaaaattggatgatctgtttctaaagcgttacgcatctttgctgaagtatgctggagagcctgtccctttcattgaaccccctgaaagctttgaattttatgcacagcagctaagaaaattgagggaaaactcttcttgaaataaccaggcgatactttgttttgtatatatttgtgattctgtgtctacatgttattttgaagtatatctgagggaaaaataaatgaaaattttctttatgtacttatgtatgtgtgatgcatgttcaaagtcttattgaccataactctgtgcacttggttattggacatttttggagtttttttctctgggaaaaatcgatagtgttttcttcaatgctgctgctgtgtgaagccatactttttcaggattcttcccctaattggctctttggtttccctgctctgtttcatttatttcattaaaatgttattcctttatttaagattcacttattagtctgctgtttctctgaaaaattttagagctaggtatagtgaccgtgaactttctaacgcataatattctgtgatacagccattccgtacatgtgtgaagtcctgcataactttcgaactttgttaaatgttggcactaggagtcatcagatctaggcttcatcattttccagtgagaagcagagacccaaagggcctgttacttgtgcttggtcaggggactgtctgtcatgcctggaggctcttcggcacacttccccatctttcccttctgccactgtggcttcaagcacctctgttcatagagcgtctctgaaattgagtctcggtcatgacttatcccgaagtagagcaatgtgtttcctctcattgtagtttcaggactttgtcagtacaagctctgccctaggcttgttactttatactcatatcctgaaaagatgtgatttcatctatgaaggggtaaaatattggtttgtatttaattgtttgaaataaaagtgatccctatattga

SEQ ID NO: 441282 - DNA, 5596 bp, Homo sapiens
ggtagaattcatttattttctaaagcgaggccccgcgtacgcgcttagggtggggacctgcgcgttcctttacactgttcccaggccctgataatccacatcctatcatgttgaacctgggaggcaaacggcaaggtgcaaaagacctccacggtttctccggcccgcgtttctgagagtgaagggccgttcctattggacatggcgtcagggctgaacgttagcagcaacatctgcactcgggggcgggggaaaccttcccacgtcctgggatcttcatagtcggctctcctcgagagttctcggtatttttactagttggcctcccacaagcctctgcgccaacctgggaggagttgacctcttgcggctctaccaacagaggagtgcaggggtgcagcgaatgaacacgatgcccagatcggagacggaagacggaaaagaaaagcttcgataatgaatcaagcaacatcgtttatgtaaatattacattgggtcttctgtcctcggagaagtgcggttttccatcttccaacctaaaacaatccgtcgctccccccacatttggcacgcccggcagttggtctctgccgcgccaggctaccctgcggtcacatgctcctcctgtccttctggcggagcgtgcttcccgctgcggggacgttcgagcaatggcagccctgctgagatccgcgcgttggttgctgcgtgccggggcggccccgcgcctcccgctctccctgcgcctcctccctggcggcccgggccggctgcatgccgcctcctatctgcccgccgctcgcgccgggcccgtggccggaggactactgagcccagccaggctgtatgccattgctgccaaagaaaaagatattcaagaggagtccactttttcttctaggaagatttccaatcagtttgattgggctctaatgagactagatctttctgttcgaagaactggccgcattccaaagaagcttctacaaaaagtttttaatgatacctgccgctcaggtggcctaggtggtagtcatgccttgcttctactacgtagttgtggttctctcttgcctgaactaaagcttgaagagagaacagaatttgctcataggatatgggacacacttcagaaattaggtgctgtgtatgatgtgagtcactataatgctttacttaaagtctatcttcaaaatgaatataaattctcaccaactgatttcctggcaaaaatggaggaagcaaacattcaaccaaatcgagtgacataccagagattgattgcttcttattgtaatgtaggagatattgaaggtgccagcaagattcttggatttatgaaaactaaggatctcccagttacagaggcagtattcagtgcccttgtgacagggcatgccagagctggtgatatggagaatgcagaaaacattctcacagtgatgagagatgccggaattgagcctggtccagacacatacctcgcattattgaatgcatatgctgagaagggcgacattgaccatgttaagcagactctggagaaggtggagaagtccgagcttcaccttatggaccgtgatttactgcaaattatttttagcttcagtaaagctgggtatcctcagtatgtctcagaaattttggaaaaagttacatgtgaaagaagatatattccagatgcaatgaacctcattttacttttagtcactgaaaaattggaagatgtagcgttgcaaattttactagcatgccccgtatcaaaggaagatggcccaagtgtctttggcagtttctttttacaacactgtgtgactatgaatacgcctgtggagaagctaacagactactgtaagaagttaaaggaagtccagatgcactcctttcctctgcagttcaccctccattgtgctttactcgccaataaaactgatttggcaaaagccttaatgaaggctgtgaaggaggaaggttttcctatcagacctcactatttctggccattgctagttggacgtcggaaggaaaaaaatgttcaaggtataattgaaatcctcaaaggaatgcaagaattgggagtacatcctgatcaggaaacatatacagattatgtgattccatgctttgatagtgtaaactcagcacgagccattttgcaggaaaatggatgtctgtctgatagtgatatgttttctcaagctggattgagaagtgaagcagcaaatgggaacttagactttgtattatcatttttgaaatcaaatacattgcccatctcgctgcagtctataagaagtagcctactgctaggcttcaggaggtctatgaatataaatctttggagcgagataacagaattgttgtacaaggatggacgttattgccaggagcctcgaggaccgacggaagctgttggctattttctttataacttgattgacagcatgagtgactcagaggtacaggccaaggaggagcatttgagacaatacttccatcagctggagaagatgaatgtaaaaattcctgaaaatatctacagaggcattcgtaatctcctggaaagctaccatgttcctgaattgattaaggatgctcacttgttggttgagagtaagaatttagactttcaaaaaactgtgcaacttacatcatctgaattggagtccacacttgaaacactaaaagctgaaaatcaacctataagagatgtcctaaagcaactcatattagtgctttgttcagaagagaatatgcaaaaagcccttgaattgaaagcaaaatatgaatccgacatggttactggtggctatgcagctttaataaatttatgctgtcgacatgataaagtagaagatgccttgaacttgaaagaagaatttgaccgcttagattcatctgctgtccttgacaccggcaagtatgtaggccttgtaagagtattggcaaagcatggcaagctccaagatgctattaacattctgaaggagatgaaagagaaggatgttcttatcaaagatacaacagccttgtcctttttccacatgctaaatggcgcagctttaagaggtgaaattgaaacagtaaaacagttgcatgaagccatcgtgactctagggttagcagaaccatccaccaacataagtttcccattggtcactgtacacttggaaaagggcgacctatctactgctcttgaggtcgccattgactgctatgaaaagtataaagtattaccaaggattcatgatgtcttgtgtaaactggtagagaaaggcgagactgatctaattcagaaagcaatggactttgtgagccaagaacaaggtgaaatggtgatgctctatgatctcttctttgccttcctacaaacaggaaattacaaagaggccaagaagatcattgagactccagggattagagctcgatctgcaaggcttcagtggttttgtgacagatgtgttgcaaataatcaggttgaaactctggaaaaattagtggagctgacacagaagctatttgaatgtgatagagaccagatgtactacaatctgctaaaactgtataaaataaacggtgactggcaaagagctgatgcagtctggaataaaatccaagaagaaaatgttattcctcgtgaaaagacattaagattattagcagaaagatatattgattgcctgccgattgaaccaaaaaaaaggggcatatgatattttcctgaatgcaaaagagcaaaacattgtgtttaatgctgaaacctacagcaatctcattaaattactgatgtcagaagattattttacacaagcaatggaagtgaaagcattcgcggagacccacatcaagggcttcacactgaacgatgctgccaacagccgcctcatcataacgcaagttaggcgggattatttgaaagaggctgtgacaacactgaaaacagtattggatcagcagcagaccccttctaggttagcagtgacccgtgtcatccaggcattggccatgaagggtgatgttgaaaacatagaagtagttcagaagatgttaaatggactcgaagactccattggactttcaaaaatggttttcatcaataacattgctttggctcaaataaagaataataacatagatgccgcaatagaaaacattgaaaatatgcttacttcagagaataaagtcattgaaccccaatacttcggcttggcatacttattcagaaaagtaatagaggagcagttggaaccagcagttgaaaagataagcatcatggcggagagattggccaatcagtttgcaatttataaacctgtcactgattttttccttcaacttgtggatgcaggcaaggtggatgatgccagagctctcctacagagatgtggtgcaattgctgaacaaaccccgattttgttgttgttcctccttaggaattctaggaaacaaggaaaggcatcaactgtgaaatctgtgttagaattgattcctgaattaaatgaaaaggaagaagcatacaattccctcatgaaaagctatgtctcagagaaagatgtcacatctgctaaagcactgtatgaacatttgactgcaaagaatacaaaattggatgatctgtttctaaagcgttacgcatctttgctgaagtatgctggagagcctgtccctttcattgaaccccctgaaagctttgaattttatgcacagcagctaagaaaattgagggaaaactcttcttgaaataaccaggcgatactttgttttgtatatatttgtgattctgtgtctacatgttattttgaagtatatctgagggaaaaataaatgaaaattttctttatgtacttatgtatgtgtgatgcatgttcaaagtcttattgaccataactctgtgcacttggttattggacatttttggagtttttttctctgggaaaaatcgatagtgttttcttcaatgctgctgctgtgtgaagccatactttttcaggattcttcccctaattggctctttggtttccctgctctgtttcatttatttcattaaaatgttattcctttatttaagattcacttattagtctgctgtttctctgaaaaattttagagctaggtatagtgaccgtgaactttctaacgcataatattctgtgatacagccattccgtacatgtgtgaagtcctgcataactttcgaactttgttaaatgttggcactaggagtcatcagatctaggcttcatcattttccagtgagaagcagagacccaaagggcctgttacttgtgcttggtcaggggactgtctgtcatgcctggaggctcttcggcacacttccccatctttcccttctgccactgtggcttcaagcacctctgttcatagagcgtctctgaaattgagtctcggtcatgacttatcccgaagtagagcaatgtgtttcctctcattgtagtttcaggactttgtcagtacaagctctgccctaggcttgttactttatactcatatcctgaaaagatgtgatttcatctatgaaggggtaaaatattggtttgtatttaattgtttgaaataaaagtgatccctatattga

SEQ ID NO: 441283 - DNA, 5189 bp, Homo sapiens
ggtagaattcatttattttctaaagcgaggccccgcgtacgcgcttagggtggggacctgcgcgttcctttacactgttcccaggccctgataatccacatcctatcatgttgaacctgggaggcaaacggcaaggtgcaaaagacctccacggtttctccggcccgcgtttctgagagtgaagggccgttcctattggacatggcgtcagggctgaacgttagcagcaacatctgcactcgggggcgggggaaaccttcccacgtcctgggatcttcatagtcggctctcctcgagagttctcggtatttttactagttggcctcccacaagcctctgcgccaacctgggaggagttgacctcttgcggctctaccaacagaggagtgcaggggtgcagcgaatgaacacgatgcccagatcggagacggaagacggaaaagaaaagcttcgataatgaatcaagcaacatcgtttatgtaaatattacattgggtcttctgtcctcggagaagtgcggttttccatcttccaacctaaaacaatccgtcgctccccccacatttggcacgcccggcagttggtctctgccgcgccaggctaccctgcggtcacatgctcctcctgtccttctggcggagcgtgcttcccgctgcggggacgttcgagcaatggcagccctgctgagatccgcgcgttggttgctgcgtgccggggcggccccgcgcctcccgctctccctgcgcctcctccctggcggcccgggccggctgcatgccgcctcctatctgcccgccgctcgcgccgggcccgtggccggaggactactgagcccagccaggctgtatgccattgctgccaaagaaaaagatattcaagaggagtccactttttcttctaggaagatttccaatcagtttgattgggctctaatgagactagatctttctgttcgaagaactggccgcattccaaagaagcttctacaaaaagtttttaatgatacctgccgctcaggtggcctaggtggtagtcatgccttgcttctactacgtagttgtggttctctcttgcctgaactaaagcttgaagagagaacagaatttgctcataggatatgggacacacttcagaaattaggtgctgtgtatgatgtgagtcactataatgctttacttaaagtctatcttcaaaatgaatataaattctcaccaactgatttcctggcaaaaatggaggaagcaaacattcaaccaaatcgagtgacataccagagattgattgcttcttattgtaatgtaggagatattgaaggtgccagcaagattcttggatttatgaaaactaaggatctcccagttacagaggcagtattcagtgcccttgtgacagggcatgccagagctggtgatatggagaatgcagaaaacattctcacagtgatgagagatgccggaattgagcctggtccagacacatacctcgcattattgaatgcatatgctgagaagggcgacattgaccatgttaagcagactctggagaaggtggagaagtccgagcttcaccttatggaccgtgatttactgcaaattatttttagcttcagtaaagctgggtatcctcagtatgtctcagaaattttggaaaaagttacatgtgaaagaagatatattccagatgcaatgaacctcattttacttttagtcactgaaaaattggaagatgtagcgttgcaaattttactagcatgccccgtatcaaaggaagatggcccaagtgtctttggcagtttctttttacaacactgtgtgactatgaatacgcctgtggagaagctaacagactactgtaagaagttaaaggaagtccagatgcactcctttcctctgcagttcaccctccattgtgctttactcgccaataaaactgatttggcaaaagccttaatgaaggctgtgaaggaggaaggttttcctatcagacctcactatttctggccattgctagttggacgtcggaaggaaaaaaatgttcaaggtataattgaaatcctcaaaggaatgcaagaattgggagtacatcctgatcaggaaacatatacagattatgtgattccatgctttgatagtgtaaactcagcacgagccattttgcaggaaaatggatgtctgtctgatagtgatatgttttctcaagctggattgagaagtgaagcagcaaatgggaacttagactttgtattatcatttttgaaatcaaatacattgcccatctcgctgcagtctataagaagtagcctactgctaggcttcaggaggtctatgaatataaatctttggagcgagataacagaattgttgtacaaggatggacgttattgccaggagcctcgaggaccgacggaagctgttggctattttctttataacttgattgacagcatgagtgactcagaggtacaggccaaggaggagcatttgagacaatacttccatcagctggagaagatgaatgtaaaaattcctgaaaatatctacagaggcattcgtaatctcctggaaagctaccatgttcctgaattgattaaggatgctcacttgttggttgagagtaagaatttagactttcaaaaaactgtgcaacttacatcatctgaattggagtccacacttgaaacactaaaagctgaaaatcaacctataagagatgtcctaaagcaactcatattagtgctttgttcagaagagaatatgcaaaaagcccttgaattgaaagcaaaatatgaatccgacatggttactggtggctatgcagctttaataaatttatgctgtcgacatgataaagtagaagatgccttgaacttgaaagaagaatttgaccgcttagattcatctgctgtccttgacaccggcaagtatgtaggccttgtaagagtattggcaaagcatggcaagctccaagatgctattaacattctgaaggagatgaaagagaaggatgttcttatcaaagatacaacagccttgtcctttttccacatgctaaatggcgcagctttaagaggtgaaattgaaacagtaaaacagttgcatgaagccatcgtgactctagggttagcagaaccatccaccaacataagtttcccattggtcactgtacacttggaaaagggcgacctatctactgctcttgaggtcgccattgactgctatgaaaagtataaagtattaccaaggattcatgatgtcttgtgtaaactggtagagaaaggcgagactgatctaattcagaaagcaatggactttgtgagccaagaacaaggtgaaatggtgatgctctatgatctcttctttgccttcctacaaacaggaaattacaaagaggccaagaagatcattgagactccagggattagagctcgatctgcaaggcttcagtggttttgtgacagatgtgttgcaaataatcaggttgaaactctggaaaaattagtggagctgacacagaagctatttgaatgtgatagagaccagatgtactacaatctgctaaaactgtataaaataaacggtgactggcaaagagctgatgcagtctggaataaaatccaagaagaaaatgttattcctcgtgaaaagacattaagattattagcagaaatccttagagagggtaaccaggaagttccgtttgacgtacctgagttgtggtatgaagatgaaaaacattccctgaattcttcgtcagcctcaaccacagaacctgatttccagaaagatatattgattgcctgccgattgaaccaaaaaaaaggggcatatgatattttcctgaatgcaaaagagcaaaacattgtgtttaatgctgaaacctacagcaatctcattaaattactgatgtcagaagattattttacacaagcaatggaagtgaaagcattcgcggagacccacatcaagggcttcacactgaacgatgctgccaacagccgcctcatcataacgcaagttaggcgggattatttgaaagaggctgtgacaacactgaaaacagtattggatcagcagcagaccccttctaggttagcagtgacccgtgtcatccaggcattggccatgaagggtgatgttgaaaacatagaagtagttcagaagatgttaaatggactcgaagactccattggactttcaaaaatggttttcatcaataacattgctttggctcaaataaagaataataacatagatgccgcaatagaaaacattgaaaatatgcttacttcagagaataaagtcattgaaccccaatacttcggcttggcatacttattcagaaaagtaatagaggagcagttggaaccagcagttgaaaagataagcatcatggcggagagattggccaatcagtttgcaatttataaacctgtcactgattttttccttcaacttgtggatgcaggcaaggtggatgatgccagagctctcctacagagatgtggtgcaattgctgaacaaaccccgattttgttgttgttcctccttaggaattctaggaaacaaggaaaggcatcaactgtgaaatctgtgttagaattgattcctgaattaaatgaaaaggaagaagcatacaattccctcatgaaaagctatgtctcagagaaagatgtcacatctgctaaagcactgtatgaacatttgactgcaaagaatacaaaattggatgatctgtttctaaagcgttacgcatctttgctgaagtatgctggagagcctgtccctttcattgaaccccctgaaagctttgaattttatgcacagcagctaagaaaattgagggaaaactcttcttgaaataaccaggcgatactttgttttgtatatatttgtgattctgtgtctacatgttattttgaagtatatctgagggaaaaataaatgaaaattttctttatgtacttatgtatgtgtgatgcatgttcaaagtcttattgaccataactctgtgcacttggttattggacatttttggagtttttttctctgggaaaaatcgatagtgttttcttcaatgctgctgctgtgtgaagccatactttttcaggattcttcccctaattggctctttggtttccctgctctgtttcatttatttcattaaaatgttattcctttatttaagattca

SEQ ID NO: 441284 - DNA, 5114 bp, Homo sapiens
ggtagaattcatttattttctaaagcgaggccccgcgtacgcgcttagggtggggacctgcgcgttcctttacactgttcccaggccctgataatccacatcctatcatgttgaacctgggaggcaaacggcaaggtgcaaaagacctccacggtttctccggcccgcgtttctgagagtgaagggccgttcctattggacatggcgtcagggctgaacgttagcagcaacatctgcactcgggggcgggggaaaccttcccacgtcctgggatcttcatagtcggctctcctcgagagttctcggtatttttactagttggcctcccacaagcctctgcgccaacctgggaggagttgacctcttgcggctctaccaacagaggagtgcaggggtgcagcgaatgaacacgatgcccagatcggagacggaagacggaaaagaaaagcttcgataatgaatcaagcaacatcgtttatgtaaatattacattgggtcttctgtcctcggagaagtgcggttttccatcttccaacctaaaacaatccgtcgctccccccacatttggcacgcccggcagttggtctctgccgcgccaggctaccctgcggtcacatgctcctcctgtccttctggcggagcgtgcttcccgctgcggggacgttcgagcaatggcagccctgctgagatccgcgcgttggttgctgcgtgccggggcggccccgcgcctcccgctctccctgcgcctcctccctggcggcccgggccggctgcatgccgcctcctatctgcccgccgctcgcgccgggcccgtggccggaggactactgagcccagccaggctgtatgccattgctgccaaagaaaaagatattcaagaggagtccactttttcttctaggaagatttccaatcagtttgattgggctctaatgagactagatctttctgttcgaagaactggccgcattccaaagaagcttctacaaaaagtttttaatgatacctgccgctcaggtggcctaggtggtagtcatgccttgcttctactacgtagttgtggttctctcttgcctgaactaaagcttgaagagagaacagaatttgctcataggatatgggacacacttcagaaattaggtgctgtgtatgatgtgagtcactataatgctttacttaaagtctatcttcaaaatgaatataaattctcaccaactgatttcctggcaaaaatggaggaagcaaacattcaaccaaatcgagtgacataccagagattgattgcttcttattgtaatgtaggagatattgaaggtgccagcaagattcttggatttatgaaaactaaggatctcccagttacagaggcagtattcagtgcccttgtgacagggcatgccagagctggtgatatggagaatgcagaaaacattctcacagtgatgagagatgccggaattgagcctggtccagacacatacctcgcattattgaatgcatatgctgagaagggcgacattgaccatgttaagcagactctggagaaggtggagaagtccgagcttcaccttatggaccgtgatttactgcaaattatttttagcttcagtaaagctgggtatcctcagtatgtctcagaaattttggaaaaagttacatgtgaaagaagatatattccagatgcaatgaacctcattttacttttagtcactgaaaaattggaagatgtagcgttgcaaattttactagcatgccccgtatcaaaggaagatggcccaagtgtctttggcagtttctttttacaacactgtgtgactatgaatacgcctgtggagaagctaacagactactgtaagaagttaaaggaagtccagatgcactcctttcctctgcagttcaccctccattgtgctttactcgccaataaaactgatttggcaaaagccttaatgaaggctgtgaaggaggaaggttttcctatcagacctcactatttctggccattgctagttggacgtcggaaggaaaaaaatgttcaaggtataattgaaatcctcaaaggaatgcaagaattgggagtacatcctgatcaggaaacatatacagattatgtgattccatgctttgatagtgtaaactcagcacgagccattttgcaggaaaatggatgtctgtctgatagtgatatgttttctcaagctggattgagaagtgaagcagcaaatgggaacttagactttgtattatcatttttgaaatcaaatacattgcccatctcgctgcagtctataagaagtagcctactgctaggcttcaggaggtctatgaatataaatctttggagcgagataacagaattgttgtacaaggatggacgttattgccaggagcctcgaggaccgacggaagctgttggctattttctttataacttgattgacagcatgagtgactcagaggtacaggccaaggaggagcatttgagacaatacttccatcagctggagaagatgaatgtaaaaattcctgaaaatatctacagaggcattcgtaatctcctggaaagctaccatgttcctgaattgattaaggatgctcacttgttggttgagagtaagaatttagactttcaaaaaactgtgcaacttacatcatctgaattggagtccacacttgaaacactaaaagctgaaaatcaacctataagagatgtcctaaagcaactcatattagtgctttgttcagaagagaatatgcaaaaagcccttgaattgaaagcaaaatatgaatccgacatggttactggtggctatgcagctttaataaatttatgctgtcgacatgataaagtagaagatgccttgaacttgaaagaagaatttgaccgcttagattcatctgctgtccttgacaccggcaagtatgtaggccttgtaagagtattggcaaagcatggcaagctccaagatgctattaacattctgaaggagatgaaagagaaggatgttcttatcaaagatacaacagccttgtcctttttccacatgctaaatggcgcagctttaagaggtgaaattgaaacagtaaaacagttgcatgaagccatcgtgactctagggttagcagaaccatccaccaacataagtttcccattggtcactgtacacttggaaaagggcgacctatctactgctcttgaggtcgccattgactgctatgaaaagtataaagtattaccaaggattcatgatgtcttgtgtaaactggtagagaaaggcgagactgatctaattcagaaagcaatggactttgtgagccaagaacaaggtgaaatggtgatgctctatgatctcttctttgccttcctacaaacaggaaattacaaagaggccaagaagatcattgagactccagggattagagctcgatctgcaaggcttcagtggttttgtgacagatgtgttgcaaataatcaggttgaaactctggaaaaattagtggagctgacacagaagctatttgaatgtgatagagaccagatgtactacaatctgctaaaactgtataaaataaacggtgactggcaaagagctgatgcagtctggaataaaatccaagaagaaaatgttattcctcgtgaaaagacattaagattattagcagaaatccttagagagggtaaccaggaagttccgtttgacgtacctgagttgtggtatgaagatgaaaaacattccctgaattcttcgtcagcctcaaccacagaacctgatttccagaaagatatattgattgcctgccgattgaaccaaaaaaaaggggcatatgatattttcctgaatgcaaaagagcaaaacattgtgtttaatgctgaaacctacagcaatctcattaaattactgatgtcagaagattattttacacaagcaatggaagtgaaagcattcgcggagacccacatcaagggcttcacactgaacgatgctgccaacagccgcctcatcataacgcaagttaggcgggattatttgaaagaggctgtgacaacactgaaaacagtattggatcagcagcagaccccttctaggttagcagtgacccgtgtcatccaggcattggccatgaagggtgatgttgaaaacatagaagtagttcagaagatgttaaatggactcgaagactccattggactttcaaaaatggttttcatcaataacattgctttggctcaaataaagaataataacatagatgccgcaatagaaaacattgaaaatatgcttacttcagagaataaagtcattgaaccccaatacttcggcttggcatacttattcagaaaagtaatagaggagcagttggaaccagcagttgaaaagataagcatcatggcggagagattggccaatcagtttgcaatttataaacctgtcactgattttttccttcaacttgtggatgcaggcaaggtggatgatgccagagctctcctacagagatgtggtgcaattgctgaacaaaccccgattttgttgttgttcctccttaggaattctaggaaacaaggaaaggcatcaactgtgaaatctgtgttagaattgattcctgaattaaatgaaaaggaagaagcatacaattccctcatgaaaagctatgtctcagagaaagatgtcacatctgctaaagcactgtatgaacatttgactgcaaagaatacaaaattggatgatctgtttctaaagcgttacgcatctttgctgaagtatgctggagagcctgtccctttcattgaaccccctgaaagctttgaattttatgcacagcagctaagaaaattgagggaaaactcttcttgaaataaccaggcgatactttgttttgtatatatttgtgattctgtgtctacatgttattttgaagtatatctgagggaaaaataaatgaaaattttctttatgtacttatgtatgtgtgatgcatgttcaaagtcttattgaaataacccggcgatactttgttttgtatatatttgtgattctgtgtctacctgttatttttaagaaaacctatagatgaaaattactaatgaaactgtgtgtacgtgttagcatgtg

SEQ ID NO: 441285 - DNA, 2263 bp, Homo sapiens
aaaaaaaaaaaaaaaaaaaataatcaggttgaaactctggaaaaattagtggagctgacacagaagctatttgaatgtgatagagaccagatgtactacaatctgctaaaactgtataaaataaacggtgactggcaaagagctgatgcagtctggaataaaatccaagaagaaaatgttattcctcgtgaaaagacattaagattattagcagaaatccttagagagggtaaccaggaagttccgtttgacgtacctgagttgtggtatgaagatgaaaaacattccctgaattcttcgtcagcctcaaccacagaacctgatttccagaaagatatattgattgcctgccgattgaaccaaaaaaaaggggcatatgatattttcctgaatgcaaaagagcaaaacattgtgtttaatgctgaaacctacagcaatctcattaaattactgatgtcagaagattattttacacaagcaatggaagtgaaagcattcgcggagacccacatcaagggcttcacactgaacgatgctgccaacagccgcctcatcataacgcaagttaggcgggattatttgaaagaggctgtgacaacactgaaaacagtattggatcagcagcagaccccttctaggttagcagtgacccgtgtcatccaggcattggccatgaagggtgatgttgaaaacatagaagtagttcagaagatgttaaatggactcgaagactccattggactttcaaaaatggttttcatcaataacattgctttggctcaaataaagaataataacatagatgccgcaatagaaaacattgaaaatatgcttacttcagagaataaagtcattgaaccccaatacttcggcttggcatacttattcagaaaagtaatagaggagcagttggaaccagcagttgaaaagataagcatcatggcggagagattggccaatcagtttgcaatttataaacctgtcactgattttttccttcaacttgtggatgcaggcaaggtggatgatgccagagctctcctacagagatgtggtgcaattgctgaacaaaccccgattttgttgttgttcctccttaggaattctaggaaacaaggaaaggcatcaactgtgaaatctgtgttagaattgattcctgaattaaatgaaaaggaagaagcatacaattccctcatgaaaagctatgtctcagagaaagatgtcacatctgctaaagcactgtatgaacatttgactgcaaagaatacaaaattggatgatctgtttctaaagcgttacgcatctttgctgaagtatgctggagagcctgtccctttcattgaaccccctgaaagctttgaattttatgcacagcagctaagaaaattgagggaaaactcttcttgaaataaccaggcgatactttgttttgtatatatttgtgattctgtgtctacatgttattttgaagtatatctgagggaaaaataaatgaaaattttctttatgtacttatgtatgtgtgatgcatgttcaaagtcttattgaccataactctgtgcacttggttattggacatttttggagtttttttctctgggaaaaatcgatagtgttttcttcaatgctgctgctgtgtgaagccatactttttcaggattcttcccctaattggctctttggtttccctgctctgtttcatttatttcattaaaatgttattcctttatttaagattcacttattagtctgctgtttctctgaaaaattttagagctaggtatagtgaccgtgaactttctaacgcataatattctgtgatacagccattccgtacatgtgtgaagtcctgcataactttcgaactttgttaaatgttggcactaggagtcatcagatctaggcttcatcattttccagtgagaagcagagacccaaagggcctgttacttgtgcttggtcaggggactgtctgtcatgcctggaggctcttcggcacacttccccatctttcccttctgccactgtggcttcaagcacctctgttcatagagcgtctctgaaattgagtctcggtcatgacttatcccgaagtagagcaatgtgtttcctctcattgtagtttcaggactttgtcagtacaagctctgccctaggcttgttactttatactcatatcctgaaaagatgtgatttcatctatgaaggggtaaaatattggtttgtatttaattgtttgaaataaaagtgatccctatattga

SEQ ID NO: 441286 - DNA, 4915 bp, Homo sapiens
ggtagaattcatttattttctaaagcgaggccccgcgtacgcgcttagggtggggacctgcgcgttcctttacactgttcccaggccctgataatccacatcctatcatgttgaacctgggaggcaaacggcaaggtgcaaaagacctccacggtttctccggcccgcgtttctgagagtgaagggccgttcctattggacatggcgtcagggctgaacgttagcagcaacatctgcactcgggggcgggggaaaccttcccacgtcctgggatcttcatagtcggctctcctcgagagttctcggtatttttactagttggcctcccacaagcctctgcgccaacctgggaggagttgacctcttgcggctctaccaacagaggagtgcaggggtgcagcgaatgaacacgatgcccagatcggagacggaagacggaaaagaaaagcttcgataatgaatcaagcaacatcgtttatgtaaatattacattgggtcttctgtcctcggagaagtgcggttttccatcttccaacctaaaacaatccgtcgctccccccacatttggcacgcccggcagttggtctctgccgcgccaggctaccctgcggtcacatgctcctcctgtccttctggcggagcgtgcttcccgctgcggggacgttcgagcaatggcagccctgctgagatccgcgcgttggttgctgcgtgccggggcggccccgcgcctcccgctctccctgcgcctcctccctggcggcccgggccggctgcatgccgcctcctatctgcccgccgctcgcgccgggcccgtggccggaggactactgagcccagccaggctgtatgccattgctgccaaagaaaaagatattcaagaggagtccactttttcttctaggaagatttccaatcagtttgattgggctctaatgagactagatctttctgttcgaagaactggccgcattccaaagaagcttctacaaaaagtttttaatgatacctgccgctcaggtggcctaggtggtagtcatgccttgcttctactacgtagttgtggttctctcttgcctgaactaaagcttgaagagagaacagaatttgctcataggatatgggacacacttcagaaattaggtgctgtgtatgatgtgagtcactataatgctttacttaaagtctatcttcaaaatgaatataaattctcaccaactgatttcctggcaaaaatggaggaagcaaacattcaaccaaatcgagtgacataccagagattgattgcttcttattgtaatgtaggagatattgaaggtgccagcaagattcttggatttatgaaaactaaggatctcccagttacagaggcagtattcagtgcccttgtgacagggcatgccagagctggtgatatggagaatgcagaaaacattctcacagtgatgagagatgccggaattgagcctggtccagacacatacctcgcattattgaatgcatatgctgagaagggcgacattgaccatgttaagcagactctggagaaggtggagaagtccgagcttcaccttatggaccgtgatttactgcaaattatttttagcttcagtaaagctgggtatcctcagtatgtctcagaaattttggaaaaagttacatgtgaaagaagatatattccagatgcaatgaacctcattttacttttagtcactgaaaaattggaagatgtagcgttgcaaattttactagcatgccccgtatcaaaggaagatggcccaagtgtctttggcagtttctttttacaacactgtgtgactatgaatacgcctgtggagaagctaacagactactgtaagaagttaaaggaagtccagatgcactcctttcctctgcagttcaccctccattgtgctttactcgccaataaaactgatttggcaaaagccttaatgaaggctgtgaaggaggaaggttttcctatcagacctcactatttctggccattgctagttggacgtcggaaggaaaaaaatgttcaaggtataattgaaatcctcaaaggaatgcaagaattgggagtacatcctgatcaggaaacatatacagattatgtgattccatgctttgatagtgtaaactcagcacgagccattttgcaggaaaatggatgtctgtctgatagtgatatgttttctcaagctggattgagaagtgaagcagcaaatgggaacttagactttgtattatcatttttgaaatcaaatacattgcccatctcgctgcagtctataagaagtagcctactgctaggcttcaggaggtctatgaatataaatctttggagcgagataacagaattgttgtacaaggatggacgttattgccaggagcctcgaggaccgacggaagctgttggctattttctttataacttgattgacagcatgagtgactcagaggtacaggccaaggaggagcatttgagacaatacttccatcagctggagaagatgaatgtaaaaattcctgaaaatatctacagaggcattcgtaatctcctggaaagctaccatgttcctgaattgattaaggatgctcacttgttggttgagagtaagaatttagactttcaaaaaactgtgcaacttacatcatctgaattggagtccacacttgaaacactaaaagctgaaaatcaacctataagagatgtcctaaagcaactcatattagtgctttgttcagaagagaatatgcaaaaagcccttgaattgaaagcaaaatatgaatccgacatggttactggtggctatgcagctttaataaatttatgctgtcgacatgataaagtagaagatgccttgaacttgaaagaagaatttgaccgcttagattcatctgctgtccttgacaccggcaagtatgtaggccttgtaagagtattggcaaagcatggcaagctccaagatgctattaacattctgaaggagatgaaagagaaggatgttcttatcaaagatacaacagccttgtcctttttccacatgctaaatggcgcagctttaagaggtgaaattgaaacagtaaaacagttgcatgaagccatcgtgactctagggttagcagaaccatccaccaacataagtttcccattggtcactgtacacttggaaaagggcgacctatctactgctcttgaggtcgccattgactgctatgaaaagtataaagtattaccaaggattcatgatgtcttgtgtaaactggtagagaaaggcgagactgatctaattcagaaagcaatggactttgtgagccaagaacaaggtgaaatggtgatgctctatgatctcttctttgccttcctacaaacaggaaattacaaagaggccaagaagatcattgagactccagggattagagctcgatctgcaaggcttcagtggttttgtgacagatgtgttgcaaataatcaggttgaaactctggaaaaattagtggagctgacacagaagctatttgaatgtgatagagaccagatgtactacaatctgctaaaactgtataaaataaacggtgactggcaaagagctgatgcagtctggaataaaatccaagaagaaaatgttattcctcgtgaaaagacattaagattattagcagaaatccttagagagggtaaccaggaagttccgtttgacgtacctgagttgtggtatgaagatgaaaaacattccctgaattcttcgtcagcctcaaccacagaacctgatttccagaaagatatattgattgcctgccgattgaaccaaaaaaaaggggcatatgatattttcctgaatgcaaaagagcaaaacattgtgtttaatgctgaaacctacagcaatctcattaaattactgatgtcagaagattattttacacaagcaatggaagtgaaagcattcgcggagacccacatcaagggcttcacactgaacgatgctgccaacagccgcctcatcataacgcaagttaggcgggattatttgaaagaggctgtgacaacactgaaaacagtattggatcagcagcagaccccttctaggttagcagtgacccgtgtcatccaggcattggccatgaagggtgatgttgaaaacatagaagtagttcagaagatgttaaatggactcgaagactccattggactttcaaaaatggttttcatcaataacattgctttggctcaaataaagaataataacatagatgccgcaatagaaaacattgaaaatatgcttacttcagagaataaagtcattgaaccccaatacttcggcttggcatacttattcagaaaagtaatagaggagcagttggaaccagcagttgaaaagataagcatcatggcggagagattggccaatcagtttgcaatttataaacctgtcactgattttttccttcaacttgtggatgcaggcaaggtggatgatgccagagctctcctacaggaattctaggaaacaaggaaaggtactgtgctttacctgcttacaaatcaatgatactgtacgtgccttgctcagaagtattgaatttaacataaaagcctgttgtttcaggaccttatttgagaatactatagagattcaagactttgcttgtctctacttagagtcagttttgtcgtctgttagctgtactggaaatgtaaaacaagttcacgcaggaattttccacttacacaggtatgcattgagagccccaagaaaaggcccttaaaaaatgcaagattaggctgggcatggtggctcacacctgtaatcccagcactttgggaggccgaggcgggtggatcacttgaggtcaggagtttcagagtttgagaccagcctggccagcatggcgaaacctggtctttacaaaaaaa

SEQ ID NO: 441287 - DNA, 1547 bp, Homo sapiens
aagtgtgtaacacttcagaatgttttaactgaattctttacaatttcatcaaccagttgtggcacctaaagatagggttgttatctctctacccttgggatctcataacttcttggtatggtcaccacttgacaaaagaagcaatgtgtttatcatattctagaaaaatattcatagaaatgtaagtggaattgcattaacctgtggaaaaatgctggtttcttttagctgtagattattgagtcaatatcaaatgctaatatacaagggacaatagtgcattaaatttaataggtagttctgttataattattgtgaaaatttttaatatagtgttgatttgtcagtgttctaattcactgttaatttgcggttttcataatattacctttatgtaatttcctaggcatcaactgtgaaatctgtgttagaattgattcctgaattaaatgaaaaggaagaagcatacaattccctcatgaaaagctatgtctcagagaaagatgtcacatctgctaaagcactgtatgaacatttgactgcaaagaatacaaaattggatgatctgtttctaaagcgttacgcatctttgctgaagtatgctggagagcctgtccctttcattgaaccccctgaaagctttgaattttatgcacagcagctaagaaaattgagggaaaactcttcttgaaataaccaggcgatactttgttttgtatatatttgtgattctgtgtctacatgttattttgaagtatatctgagggaaaaataaatgaaaattttctttatgtacttatgtatgtgtgatgcatgttcaaagtcttattgaccataactctgtgcacttggttattggacatttttggagtttttttctctgggaaaaatcgatagtgttttcttcaatgctgctgctgtgtgaagccatactttttcaggattcttcccctaattggctctttggtttccctgctctgtttcatttatttcattaaaatgttattcctttatttaagattcacttattagtctgctgtttctctgaaaaattttagagctaggtatagtgaccgtgaactttctaacgcataatattctgtgatacagccattccgtacatgtgtgaagtcctgcataactttcgaactttgttaaatgttggcactaggagtcatcagatctaggcttcatcattttccagtgagaagcagagacccaaagggcctgttacttgtgcttggtcaggggactgtctgtcatgcctggaggctcttcggcacacttccccatctttcccttctgccactgtggcttcaagcacctctgttcatagagcgtctctgaaattgagtctcggtcatgacttatcccgaagtagagcaatgtgtttcctctcattgtagtttcaggactttgtcagtacaagctctgccctaggcttgttactttatactcatatcctgaaaagatgtgatttcatctatgaaggggtaaaatattggtttgtatttaattgtttgaaataaaagtgatccctatattga

SEQ ID NO: 441288 - DNA, 1196 bp, Homo sapiens
agcggccgatactaatactaaatttgcggacgacagacctaggaaacaaggaagggcatcaactgtgaaatctgtgttagaattgattcctgaattaaatgaaaaggaagaagcatacaattccctcatgaaaagctatgtctcagagaaagatgtcacatctgctaaagcactgtatgaacatttgactgcaaagaatacaaaattggatgatctgtttctaaagcgttacgcatctttgctgaagtatgctggagagcctgtccctttcattgaaccccctgaaagctttgaattttatgcacagcagctaagaaaattgagggaaaactcttcttgaaataaccaggcgatactttgttttgtatatatttgtgattctgtgtctacatgttattttgaagtatatctgagggaaaaataaatgaaaattttctttatgtacttatgtatgtgtgatgcatgttcaaagtcttattgaccataactctgtgcacttggttattggacatttttggagtttttttctctgggaaaaatcgatagtgttttcttcaatgctgctgctgtgtgaagccatactttttcaggattcttcccctaattggctctttggtttccctgctctgtttcatttatttcattaaaatgttattcctttatttaagattcacttattagtctgctgtttctctgaaaaattttagagctaggtatagtgaccgtgaactttctaacgcataatattctgtgatacagccattccgtacatgtgtgaagtcctgcataactttcgaactttgttaaatgttggcactaggagtcatcagatctaggcttcatcattttccagtgagaagcagagacccaaagggcctgttacttgtgcttggtcaggggactgtctgtcatgcctggaggctcttcggcacacttccccatctttcccttctgccactgtggcttcaagcacctctgttcatagagcgtctctgaaattgagtctcggtcatgacttatcccgaagtagagcaatgtgtttcctctcattgtagtttcaggactttgtcagtacaagctctgccctaggcttgttactttatactcatatcctgaaaagatgtgatttcatctatgaaggggtaaaatattggtttgtatttaattgtttgaaataaaagtgatccctatattga

SEQ ID NO: 441289 - DNA, 3284 bp, Homo sapiens
ggtagaattcatttattttctaaagcgaggccccgcgtacgcgcttagggtggggacctgcgcgttcctttacactgttcccaggccctgataatccacatcctatcatgttgaacctgggaggcaaacggcaaggtgcaaaagacctccacggtttctccggcccgcgtttctgagagtgaagggccgttcctattggacatggcgtcagggctgaacgttagcagcaacatctgcactcgggggcgggggaaaccttcccacgtcctgggatcttcatagtcggctctcctcgagagttctcggtatttttactagttggcctcccacaagcctctgcgccaacctgggaggagttgacctcttgcggctctaccaacagaggagtgcaggggtgcagcgaatgaacacgatgcccagatcggagacggaagacggaaaagaaaagcttcgataatgaatcaagcaacatcgtttatgtaaatattacattgggtcttctgtcctcggagaagtgcggttttccatcttccaacctaaaacaatccgtcgctccccccacatttggcacgcccggcagttggtctctgccgcgccaggctaccctgcggtcacatgctcctcctgtccttctggcggagcgtgcttcccgctgcggggacgttcgagcaatggcagccctgctgagatccgcgcgttggttgctgcgtgccggggcggccccgcgcctcccgctctccctgcgcctcctccctggcggcccgggccggctgcatgccgcctcctatctgcccgccgctcgcgccgggcccgtggccggaggactactgagcccagccaggctgtatgccattgctgccaaagaaaaagatattcaagaggagtccactttttcttctaggaagatttccaatcagtttgattgggctctaatgagactagatctttctgttcgaagaactggccgcattccaaagaagcttctacaaaaagtttttaatgatacctgccgctcaggtggcctaggtggtagtcatgccttgcttctactacgtagttgtggttctctcttgcctgaactaaagcttgaagagagaacagaatttgctcataggatatgggacacacttcagaaattaggtgctgtgtatgatgtgagtcactataatgctttacttaaagtctatcttcaaaatgaatataaattctcaccaactgatttcctggcaaaaatggaggaagcaaacattcaaccaaatcgagtgacataccagagattgattgcttcttattgtaatgtaggagatattgaaggtgccagcaagattcttggatttatgaaaactaaggatctcccagttacagaggcagtattcagtgcccttgtgacagggcatgccagagctggtgatatggagaatgcagaaaacattctcacagtgatgagagatgccggaattgagcctggtccagacacatacctcgcattattgaatgcatatgctgagaagggcgacattgaccatgttaagcagactctggagaaggtggagaagtccgagcttcaccttatggaccgtgatttactgcaaattatttttagcttcagtaaagctgggtatcctcagtatgtctcagaaattttggaaaaagttacatgtgaaagaagatatattccagatgcaatgaacctcattttacttttagtcactgaaaaattggaagatgtagcgttgcaaattttactagcatgccccgtatcaaaggaagatggcccaagtgtctttggcagtttctttttacaacactgtgtgactatgaatacgcctgtggagaagctaacagactactgtaagaagttaaaggaagtccagatgcactcctttcctctgcagttcaccctccattgtgctttactcgccaataaaactgatttggcaaaagccttaatgaaggctgtgaaggaggaaggttttcctatcagacctcactatttctggccattgctagttggacgtcggaaggaaaaaaatgttcaaggtataattgaaatcctcaaaggaatgcaagaattgggagtacatcctgatcaggaaacatatacagattatgtgattccatgctttgatagtgtaaactcagcacgagccattttgcaggaaaatggatgtctgtctgatagtgatatgttttctcaagctggattgagaagtgaagcagcaaatgggaacttagactttgtattatcatttttgaaatcaaatacattgcccatctcgctgcagtctataagaagtagcctactgctaggcttcaggaggtctatgaatataaatctttggagcgagataacagaattgttgtacaaggatggacgttattgccaggagcctcgaggaccgacggaagctgttggctattttctttataacttgattgacagcatgagtgactcagaggtacaggccaaggaggagcatttgagacaatacttccatcagctggagaagatgaatgtaaaaattcctgaaaatatctacagaggcattcgtaatctcctggaaagctaccatgttcctgaattgattaaggatgctcacttgttggttgagagtaagaatttagactttcaaaaaactgtgcaacttacatcatctgaattggagtccacacttgaaacactaaaagctgaaaatcaacctataagagatgtcctaaagcaactcatattagtgctttgttcagaagagaatatgcaaaaagcccttgaattgaaagcaaaatatgaatccgacatggttactggtggctatgcagctttaataaatttatgctgtcgacatgataaagtagaagatgccttgaacttgaaagaagaatttgaccgcttagattcatctgctgtccttgacaccggcaagtatgtaggccttgtaagagtattggcaaagcatggcaagctccaagatgctattaacattctgaaggagatgaaagagaaggatgttcttatcaaagatacaacagccttgtcctttttccacatgctaaatggcgcagctttaagaggtgaaattgaaacagtaaaacagttgcatgaagccatcgtgactctagggttagcagaaccatccaccaacataagtttcccattggtcactgtacacttggaaaaggagagctgaatttgactgaaacgcagaaatatctcactgtggatgtagtgtgtatgttgtcctgttgatgccaggagaaaaataaaatatgtattttaacggttctca

SEQ ID NO: 441290 - DNA, 3343 bp, Homo sapiens
ggtagaattcatttattttctaaagcgaggccccgcgtacgcgcttagggtggggacctgcgcgttcctttacactgttcccaggccctgataatccacatcctatcatgttgaacctgggaggcaaacggcaaggtgcaaaagacctccacggtttctccggcccgcgtttctgagagtgaagggccgttcctattggacatggcgtcagggctgaacgttagcagcaacatctgcactcgggggcgggggaaaccttcccacgtcctgggatcttcatagtcggctctcctcgagagttctcggtatttttactagttggcctcccacaagcctctgcgccaacctgggaggagttgacctcttgcggctctaccaacagaggagtgcaggggtgcagcgaatgaacacgatgcccagatcggagacggaagacggaaaagaaaagcttcgataatgaatcaagcaacatcgtttatgtaaatattacattgggtcttctgtcctcggagaagtgcggttttccatcttccaacctaaaacaatccgtcgctccccccacatttggcacgcccggcagttggtctctgccgcgccaggctaccctgcggtcacatgctcctcctgtccttctggcggagcgtgcttcccgctgcggggacgttcgagcaatggcagccctgctgagatccgcgcgttggttgctgcgtgccggggcggccccgcgcctcccgctctccctgcgcctcctccctggcggcccgggccggctgcatgccgcctcctatctgcccgccgctcgcgccgggcccgtggccggaggactactgagcccagccaggctgtatgccattgctgccaaagaaaaagatattcaagaggagtccactttttcttctaggaagatttccaatcagtttgattgggctctaatgagactagatctttctgttcgaagaactggccgcattccaaagaagcttctacaaaaagtttttaatgatacctgccgctcaggtggcctaggtggtagtcatgccttgcttctactacgtagttgtggttctctcttgcctgaactaaagcttgaagagagaacagaatttgctcataggatatgggacacacttcagaaattaggtgctgtgtatgatgtgagtcactataatgctttacttaaagtctatcttcaaaatgaatataaattctcaccaactgatttcctggcaaaaatggaggaagcaaacattcaaccaaatcgagtgacataccagagattgattgcttcttattgtaatgtaggagatattgaaggtgccagcaagattcttggatttatgaaaactaaggatctcccagttacagaggcagtattcagtgcccttgtgacagggcatgccagagctggtgatatggagaatgcagaaaacattctcacagtgatgagagatgccggaattgagcctggtccagacacatacctcgcattattgaatgcatatgctgagaagggcgacattgaccatgttaagcagactctggagaaggtggagaagtccgagcttcaccttatggaccgtgatttactgcaaattatttttagcttcagtaaagctgggtatcctcagtatgtctcagaaattttggaaaaagttacatgtgaaagaagatatattccagatgcaatgaacctcattttacttttagtcactgaaaaattggaagatgtagcgttgcaaattttactagcatgccccgtatcaaaggaagatggcccaagtgtctttggcagtttctttttacaacactgtgtgactatgaatacgcctgtggagaagctaacagactactgtaagaagttaaaggaagtccagatgcactcctttcctctgcagttcaccctccattgtgctttactcgccaataaaactgatttggcaaaagccttaatgaaggctgtgaaggaggaaggttttcctatcagacctcactatttctggccattgctagttggacgtcggaaggaaaaaaatgttcaaggtataattgaaatcctcaaaggaatgcaagaattgggagtacatcctgatcaggaaacatatacagattatgtgattccatgctttgatagtgtaaactcagcacgagccattttgcaggaaaatggatgtctgtctgatagtgatatgttttctcaagctggattgagaagtgaagcagcaaatgggaacttagactttgtattatcatttttgaaatcaaatacattgcccatctcgctgcagtctataagaagtagcctactgctaggcttcaggaggtctatgaatataaatctttggagcgagataacagaattgttgtacaaggatggacgttattgccaggagcctcgaggaccgacggaagctgttggctattttctttataacttgattgacagcatgagtgactcagaggtacaggccaaggaggagcatttgagacaatacttcacttccccatctttcccttctgccactgtggcttcaagcacctctgttcatagagcgtctctgaaattgagtctcggtcatgacttatcccgaagtagagcaatgtgtttcctctcattgtagtttcaggactttgtcagtacaagctctgccctaggcttgttactttatactcatatcctgaaaagatgtgatttcatctatgaaggggtaaaatattggtttgtatttaattgtttgaaataaaagtgatccctatattgaatctcatgcctgttaatatctacactgtaagtagtgacttcaaaaaaattctaagataggtagtcaggagagtttgccattataaaaggtgtcttaataatatggaatattgacctaactggagatgaggtaattaattaccgaaatgttgaaaatgttttgagaactctccccattttggggtattccttgttcatttgaatttggtgactccctactgttccagtttcagtgccaacttgggtcacactgttcacatcaggggagaccttgccttggggacgtaggcgggcctcttgcaacttgtgctgttgaccttctgtcttgtggaactctctctcctgcatctgctacctgcccgcagatggtgtgagggagggttgatggcgggaagccaggaagtagatgtcatcatggtattggccaggcttttacttcaactcttttgtggcgttagatttaaggaagcagggggcatggccaacgttgagtctggcccagtggacatagtgcggctttcccttgagcactgcccagatgcaggacctgcacatgttacaggtttgccaaaagcatcttttttt

SEQ ID NO: 441291 - DNA, 6296 bp, Homo sapiens
ggtagaattcatttattttctaaagcgaggccccgcgtacgcgcttagggtggggacctgcgcgttcctttacactgttcccaggccctgataatccacatcctatcatgttgaacctgggaggcaaacggcaaggtgcaaaagacctccacggtttctccggcccgcgtttctgagagtgaagggccgttcctattggacatggcgtcagggctgaacgttagcagcaacatctgcactcgggggcgggggaaaccttcccacgtcctgggatcttcatagtcggctctcctcgagagttctcggtatttttactagttggcctcccacaagcctctgcgccaacctgggaggagttgacctcttgcggctctaccaacagaggagtgcaggggtgcagcgaatgaacacgatgcccagatcggagacggaagacggaaaagaaaagcttcgataatgaatcaagcaacatcgtttatgtaaatattacattgggtcttctgtcctcggagaagtgcggttttccatcttccaacctaaaacaatccgtcgctccccccacatttggcacgcccggcagttggtctctgccgcgccaggctaccctgcggtcacatgctcctcctgtccttctggcggagcgtgcttcccgctgcggggacgttcgagcaatggcagccctgctgagatccgcgcgttggttgctgcgtgccggggcggccccgcgcctcccgctctccctgcgcctcctccctggcggcccgggccggctgcatgccgcctcctatctgcccgccgctcgcgccgggcccgtggccggaggactactgagcccagccaggctgtatgccattgctgccaaagaaaaagatattcaagaggagtccactttttcttctaggaagatttccaatcagtttgattgggctctaatgagactagatctttctgttcgaagaactggccgcattccaaagaagcttctacaaaaagtttttaatgatacctgccgctcaggtggcctaggtggtagtcatgccttgcttctactacgtagttgtggttctctcttgcctgaactaaagcttgaagagagaacagaatttgctcataggatatgggacacacttcagaaattaggtgctgtgtatgatgtgagtcactataatgctttacttaaagtctatcttcaaaatgaatataaattctcaccaactgatttcctggcaaaaatggaggaagcaaacattcaaccaaatcgagtgacataccagagattgattgcttcttattgtaatgtaggagatattgaaggtgccagcaagattcttggatttatgaaaactaaggatctcccagttacagaggcagtattcagtgcccttgtgacagggcatgccagagctggtgatatggagaatgcagaaaacattctcacagtgatgagagatgccggaattgagcctggtccagacacatacctcgcattattgaatgcatatgctgagaagggcgacattgaccatgttaagcagactctggagaaggtggagaagtccgagcttcaccttatggaccgtgatttactgcaaattatttttagcttcagtaaagctgggtatcctcagtatgtctcagaaattttggaaaaagttacatgtgaaagaagatatattccagatgcaatgaacctcattttacttttagtcactgaaaaattggaagatgtagcgttgcaaattttactagcatgccccgtatcaaaggaagatggcccaagtgtctttggcagtttctttttacaacactgtgtgactatgaatacgcctgtggagaagctaacagactactgtaagaagttaaaggaagtccagatgcactcctttcctctgcagttcaccctccattgtgctttactcgccaataaaactgatttggcaaaagccttaatgaaggctgtgaaggaggaaggttttcctatcagacctcactatttctggccattgctagttggacgtcggaaggaaaaaaatgttcaaggtataattgaaatcctcaaaggaatgcaagaattgggagtacatcctgatcaggaaacatatacagattatgtgattccatgctttgatagtgtaaactcagcacgagccattttgcaggaaaatggatgtctgtctgatagtgatatgttttctcaagctggattgagaagtgaagcagcaaatgggaacttagactttgtattatcatttttgaaatcaaatacattgcccatctcgctgcagtctataagaagtagcctactgctaggcttcaggaggtctatgaatataaatctttggagcgagataacagaattgttgtacaaggatggacgttattgccaggagcctcgaggaccgacggaagctgttggctattttctttataacttgattgacagcatgagtgactcagaggtacaggccaaggaggagcatttgagacaatacttccatcagctggagaagatgaatgtaaaaattcctgaaaatatctacagaggcattcgtaatctcctggaaagctaccatgttcctgaattgattaaggatgctcacttgttggttgagagtaagaatttagactttcaaaaaactgtgcaacttacatcatctgaattggagtccacacttgaaacactaaaagctgaaaatcaacctataagagatgtcctaaagcaactcatattagtgctttgttcagaagagaatatgcaaaaagcccttgaattgaaagcaaaatatgaatccgacatggttactggtggctatgcagctttaataaatttatgctgtcgacatgataaagtagaagatgccttgaacttgaaagaagaatttgaccgcttagattcatctgctgtccttgacaccggcaagtatgtaggccttgtaagagtattggcaaagcatggcaagctccaagatgctattaacattctgaaggagatgaaagagaaggatgttcttatcaaagatacaacagccttgtcctttttccacatgctaaatggcgcagctttaagaggtgaaattgaaacagtaaaacagttgcatgaagccatcgtgactctagggttagcagaaccatccaccaacataagtttcccattggtcactgtacacttggaaaagggcgacctatctactgctcttgaggtcgccattgactgctatgaaaagtataaagtattaccaaggattcatgatgtcttgtgtaaactggtagagaaaggcgagactgatctaattcagaaagcaatggactttgtgagccaagaacaaggtgaaatggtgatgctctatgatctcttctttgccttcctacaaacaggaaattacaaagaggccaagaagatcattgagactccagggattagagctcgatctgcaaggcttcagtggttttgtgacagatgtgttgcaaataatcaggttgaaactctggaaaaattagtggagctgacacagaagctatttgaatgtgatagagaccagatgtactacaatctgctaaaactgtataaaataaacggtgactggcaaagagctgatgcagtctggaataaaatccaagaagaaaatgttattcctcgtgaaaagacattaagattattagcagaaatccttagagagggtaaccaggaagttccgtttgacgtacctgagttgtggtatgaagatgaaaaacattccctgaattcttcgtcagcctcaaccacagaacctgatttccagaaagatatattgattgcctgccgattgaaccaaaaaaaaggggcatatgatattttcctgaatgcaaaagagcaaaacattgtgtttaatgctgaaacctacagcaatctcattaaattactgatgtcagaagattattttacacaagcaatggaagtgaaagcattcgcggagacccacatcaagggcttcacactgaacgatgctgccaacagccgcctcatcataacgcaagttaggcgggattatttgaaagaggctgtgacaacactgaaaacagtattggatcagcagcagaccccttctaggttagcagtgacccgtgtcatccaggcattggccatgaagggtgatgttgaaaacatagaagtagttcagaagatgttaaatggactcgaagactccattggactttcaaaaatggttttcatcaataacattgctttggctcaaataaagaataataacatagatgccgcaatagaaaacattgaaaatatgcttacttcagagaataaagtcattgaaccccaatacttcggcttggcatacttattcagaaaagtaatagaggagcagttggaaccagcagttgaaaagataagcatcatggcggagagattggccaatcagtttgcaatttataaacctgtcactgattttttccttcaacttgtggatgcaggcaaggtggatgatgccagagctctcctacagagatgtggtgcaattgctgaacaaaccccgattttgttgttgttcctccttaggaattctaggaaacaaggaaaggcatcaactgtgaaatctgtgttagaattgattcctgaattaaatgaaaaggaagaagcatacaattccctcatgaaaagctatgtctcagagaaagatgtcacatctgctaaagcactgtatgaacatttgactgcaaagaatacaaaattggatgatctgtttctaaagcgttacgcatctttgctgaagtatgctggagagcctgtccctttcattgaaccccctgaaagctttgaattttatgcacagcagctaagaaaattgagggaaaactcttcttgaaataaccaggcgatactttgttttgtatatatttgtgattctgtgtctacatgttattttgaagtatatctgagggaaaaataaatgaaaattttctttatgtacttatgtatgtgtgatgcatgttcaaagtcttattgaccataactctgtgcacttggttattggacatttttggagtttttttctctgggaaaaatcgatagtgttttcttcaatgctgctgctgtgtgaagccatactttttcaggattcttcccctaattggctctttggtttccctgctctgtttcatttatttcattaaaatgttattcctttatttaagattcacttattagtctgctgtttctctgaaaaattttagagctaggtatagtgaccgtgaactttctaacgcataatattctgtgatacagccattccgtacatgtgtgaagtcctgcataactttcgaactttgttaaatgttggcactaggagtcatcagatctaggcttcatcattttccagtgagaagcagagacccaaagggcctgttacttgtgcttggtcaggggactgtctgtcatgcctggaggctcttcggcacacttccccatctttcccttctgccactgtggcttcaagcacctctgttcatagagcgtctctgaaattgagtctcggtcatgacttatcccgaagtagagcaatgtgtttcctctcattgtagtttcaggactttgtcagtacaagctctgccctaggcttgttactttatactcatatcctgaaaagatgtgatttcatctatgaaggggtaaaatattggtttgtatttaattgtttgaaataaaagtgatccctatattgaatctcatgcctgttaatatctacactgtaagtagtgacttcaaaaaaattctaagataggtagtcaggagagtttgccattataaaaggtgtcttaataatatggaatattgacctaactggagatgaggtaattaattaccgaaatgttgaaaatgttttgagaactctccccattttggggtattccttgttcatttgaatttggtgactccctactgttccagtttcagtgccaacttgggtcacactgttcacatcaggggagaccttgccttggggacgtaggcgggcctcttgcaacttgtgctgttgaccttctgtcttgtggaactctctctcctgcatctgctacctgcccgcagatggtgtgagggagggttgatggcgggaagccaggaagtagatgtcatcatggtattggccaggcttttacttcaactcttttgtggcgttagatttaaggaagcagggggcatggccaacgttgagtctggcccagtggacatagtgcggctttcccttgagcactgcccagatgcaggacctgcacatgttacaggtttgccaaaagcatcttttttt

SEQ ID NO: 441292 - DNA, 5637 bp, Homo sapiens
ggtagaattcatttattttctaaagcgaggccccgcgtacgcgcttagggtggggacctgcgcgttcctttacactgttcccaggccctgataatccacatcctatcatgttgaacctgggaggcaaacggcaaggtgcaaaagacctccacggtttctccggcccgcgtttctgagagtgaagggccgttcctattggacatggcgtcagggctgaacgttagcagcaacatctgcactcgggggcgggggaaaccttcccacgtcctgggatcttcatagtcggctctcctcgagagttctcggtatttttactagttggcctcccacaagcctctgcgccaacctgggaggagttgacctcttgcggctctaccaacagaggagtgcaggggtgcagcgaatgaacacgatgcccagatcggagacggaagacggaaaagaaaagcttcgataatgaatcaagcaacatcgtttatgtaaatattacattgggtcttctgtcctcggagaagtgcggttttccatcttccaacctaaaacaatccgtcgctccccccacatttggcacgcccggcagttggtctctgccgcgccaggctaccctgcggtcacatgctcctcctgtccttctggcggagcgtgcttcccgctgcggggacgttcgagcaatggcagccctgctgagatccgcgcgttggttgctgcgtgccggggcggccccgcgcctcccgctctccctgcgcctcctccctggcggcccgggccggctgcatgccgcctcctatctgcccgccgctcgcgccgggcccgtggccggaggactactgagcccagccaggctgtatgccattgctgccaaagaaaaagatattcaagaggagtccactttttcttctaggaagatttccaatcagtttgattgggctctaatgagactagatctttctgttcgaagaactggccgcattccaaagaagcttctacaaaaagtttttaatgatacctgccgctcaggtggcctaggtggtagtcatgccttgcttctactacgtagttgtggttctctcttgcctgaactaaagcttgaagagagaacagaatttgctcataggatatgggacacacttcagaaattaggtgctgtgtatgatgtgagtcactataatgctttacttaaagtctatcttcaaaatgaatataaattctcaccaactgatttcctggcaaaaatggaggaagcaaacattcaaccaaatcgagtgacataccagagattgattgcttcttattgtaatgtaggagatattgaaggtgccagcaagattcttggatttatgaaaactaaggatctcccagttacagaggcagtattcagtgcccttgtgacagggcatgccagagctggtgatatggagaatgcagaaaacattctcacagtgatgagagatgccggaattgagcctggtccagacacatacctcgcattattgaatgcatatgctgagaagggcgacattgaccatgttaagcagactctggagaaggtggagaagtccgagcttcaccttatggaccgtgatttactgcaaattatttttagcttcagtaaagctgggtatcctcagtatgtctcagaaattttggaaaaagttacatgtgaaagaagatatattccagatgcaatgaacctcattttacttttagtcactgaaaaattggaagatgtagcgttgcaaattttactagcatgccccgtatcaaaggaagatggcccaagtgtctttggcagtttctttttacaacactgtgtgactatgaatacgcctgtggagaagctaacagactactgtaagaagttaaaggaagtccagatgcactcctttcctctgcagttcaccctccattgtgctttactcgccaataaaactgatttggcaaaagccttaatgaaggctgtgaaggaggaaggttttcctatcagacctcactatttctggccattgctagttggacgtcggaaggaaaaaaatgttcaaggtataattgaaatcctcaaaggaatgcaagaattgggagtacatcctgatcaggaaacatatacagattatgtgattccatgctttgatagtgtaaactcagcacgagccattttgcaggaaaatggatgtctgtctgatagtgatatgttttctcaagctggattgagaagtgaagcagcaaatgggaacttagactttgtattatcatttttgaaatcaaatacattgcccatctcgctgcagtctataagaagtagcctactgctaggcttcaggaggtctatgaatataaatctttggagcgagataacagaattgttgtacaaggatggacgttattgccaggagcctcgaggaccgacggaagctgttggctattttctttataacttgattgacagcatgagtgactcagaggtacaggccaaggaggagcatttgagacaatacttccatcagctggagaagatgaatgtaaaaattcctgaaaatatctacagaggcattcgtaatctcctggaaagctaccatgttcctgaattgattaaggatgctcacttgttggttgagagtaagaatttagactttcaaaaaactgtgcaacttacatcatctgaattggagtccacacttgaaacactaaaagctgaaaatcaacctataagagatgtcctaaagcaactcatattagtgctttgttcagaagagaatatgcaaaaagcccttgaattgaaagcaaaatatgaatccgacatggttactggtggctatgcagctttaataaatttatgctgtcgacatgataaagtagaagatgccttgaacttgaaagaagaatttgaccgcttagattcatctgctgtccttgacaccggcaagtatgtaggccttgtaagagtattggcaaagcatggcaagctccaagatgctattaacattctgaaggagatgaaagagaaggatgttcttatcaaagatacaacagccttgtcctttttccacatgctaaatggcgcagctttaagaggtgaaattgaaacagtaaaacagttgcatgaagccatcgtgactctagggttagcagaaccatccaccaacataagtttcccattggtcactgtacacttggaaaagggcgacctatctactgctcttgaggtcgccattgactgctatgaaaagtataaagtattaccaaggattcatgatgtcttgtgtaaactggtagagaaaggcgagactgatctaattcagaaagcaatggactttgtgagccaagaacaaggtgaaatggtgatgctctatgatctcttctttgccttcctacaaacaggaaattacaaagaggccaagaagatcattgagactccagggattagagctcgatctgcaaggcttcagtggttttgtgacagatgtgttgcaaataatcaggttgaaactctggaaaaattagtggagctgacacagaagctatttgaatgtgatagagaccagatgtactacaatctgctaaaactgtataaaataaacggtgactggcaaagagctgatgcagtctggaataaaatccaagaagaaaatgttattcctcgtgaaaagacattaagattattagcagaaatccttagagagggtaaccaggaagttccgtttgacgtacctgagttgtggtatgaagatgaaaaacattccctgaattcttcgtcagcctcaaccacagaacctgatttccagaaagatatattgattgcctgccgattgaaccaaaaaaaaggggcatatgatattttcctgaatgcaaaagagcaaaacattgtgtttaatgctgaaacctacagcaatctcattaaattactgatgtcagaagattattttacacaagcaatggaagtgaaagcattcgcggagacccacatcaagggcttcacactgaacgatgctgccaacagccgcctcatcataacgcaagttaggcgggattatttgaaagaggctgtgacaacactgaaaacagtattggatcagcagcagaccccttctaggttagcagtgacccgtgtcatccaggcattggccatgaagggtgatgttgaaaacatagaagtagttcagaagatgttaaatggactcgaagactccattggactttcaaaaatggttttcatcaataacattgctttggctcaaataaagaataataacatagatgccgcaatagaaaacattgaaaatatgcttacttcagagaataaagtcattgaaccccaatacttcggcttggcatacttattcagaaaagtaatagaggagcagttggaaccagcagttgaaaagataagcatcatggcggagagattggccaatcagtttgcaatttataaacctgtcactgattttttccttcaacttgtggatgcaggcaaggtggatgatgccagagctctcctacaggcatcaactgtgaaatctgtgttagaattgattcctgaattaaatgaaaaggaagaagcatacaattccctcatgaaaagctatgtctcagagaaagatgtcacatctgctaaagcactgtatgaacatttgactgcaaagaatacaaaattggatgatctgtttctaaagcgttacgcatctttgctgaagtatgctggagagcctgtccctttcattgaaccccctgaaagctttgaattttatgcacagcagctaagaaaattgagggaaaactcttcttgaaataaccaggcgatactttgttttgtatatatttgtgattctgtgtctacatgttattttgaagtatatctgagggaaaaataaatgaaaattttctttatgtacttatgtatgtgtgatgcatgttcaaagtcttattgaccataactctgtgcacttggttattggacatttttggagtttttttctctgggaaaaatcgatagtgttttcttcaatgctgctgctgtgtgaagccatactttttcaggattcttcccctaattggctctttggtttccctgctctgtttcatttatttcattaaaatgttattcctttatttaagattcacttattagtctgctgtttctctgaaaaattttagagctaggtatagtgaccgtgaactttctaacgcataatattctgtgatacagccattccgtacatgtgtgaagtcctgcataactttcgaactttgttaaatgttggcactaggagtcatcagatctaggcttcatcattttccagtgagaagcagagacccaaagggcctgttacttgtgcttggtcaggggactgtctgtcatgcctggaggctcttcggcacacttccccatctttcccttctgccactgtggcttcaagcacctctgttcatagagcgtctctgaaattgagtctcggtcatgacttatcccgaagtagagcaatgtgtttcctctcattgtagtttcaggactttgtcagtacaagctctgccctaggcttgttactttatactcatatcctgaaaagatgtgatttcatctatgaaggggtaaaatattggtttgtatttaattgtttgaaataaaagtgatccctatattga

SEQ ID NO: 441293 - DNA, 4960 bp, Homo sapiens
ggtagaattcatttattttctaaagcgaggccccgcgtacgcgcttagggtggggacctgcgcgttcctttacactgttcccaggccctgataatccacatcctatcatgttgaacctgggaggcaaacggcaaggtgcaaaagacctccacggtttctccggcccgcgtttctgagagtgaagggccgttcctattggacatggcgtcagggctgaacgttagcagcaacatctgcactcgggggcgggggaaaccttcccacgtcctgggatcttcatagtcggctctcctcgagagttctcggtatttttactagttggcctcccacaagcctctgcgccaacctgggaggagttgacctcttgcggctctaccaacagaggagtgcaggggtgcagcgaatgaacacgatgcccagatcggagacggaagacggaaaagaaaagcttcgataatgaatcaagcaacatcgtttatgtaaatattacattgggtcttctgtcctcggagaagtgcggttttccatcttccaacctaaaacaatccgtcgctccccccacatttggcacgcccggcagttggtctctgccgcgccaggctaccctgcggtcacatgctcctcctgtccttctggcggagcgtgcttcccgctgcggggacgttcgagcaatggcagccctgctgagatccgcgcgttggttgctgcgtgccggggcggccccgcgcctcccgctctccctgcgcctcctccctggcggcccgggccggctgcatgccgcctcctatctgcccgccgctcgcgccgggcccgtggccggaggactactgagcccagccaggctgtatgccattgctgccaaagaaaaagatattcaagaggagtccactttttcttctaggaagatttccaatcagtttgattgggctctaatgagactagatctttctgttcgaagaactggccgcattccaaagaagcttctacaaaaagtttttaatgatacctgccgctcaggtggcctaggtggtagtcatgccttgcttctactacgtagttgtggttctctcttgcctgaactaaagcttgaagagagaacagaatttgctcataggatatgggacacacttcagaaattaggtgctgtgtatgatgtgagtcactataatgctttacttaaagtctatcttcaaaatgaatataaattctcaccaactgatttcctggcaaaaatggaggaagcaaacattcaaccaaatcgagtgacataccagagattgattgcttcttattgtaatgtaggagatattgaaggtgccagcaagattcttggatttatgaaaactaaggatctcccagttacagaggcagtattcagtgcccttgtgacagggcatgccagagctggtgatatggagaatgcagaaaacattctcacagtgatgagagatgccggaattgagcctggtccagacacatacctcgcattattgaatgcatatgctgagaagggcgacattgaccatgttaagcagactctggagaaggtggagaagtccgagcttcaccttatggaccgtgatttactgcaaattatttttagcttcagtaaagctgggtatcctcagtatgtctcagaaattttggaaaaagttacatgtgaaagaagatatattccagatgcaatgaacctcattttacttttagtcactgaaaaattggaagatgtagcgttgcaaattttactagcatgccccgtatcaaaggaagatggcccaagtgtctttggcagtttctttttacaacactgtgtgactatgaatacgcctgtggagaagctaacagactactgtaagaagttaaaggaagtccagatgcactcctttcctctgcagttcaccctccattgtgctttactcgccaataaaactgatttggcaaaagccttaatgaaggctgtgaaggaggaaggttttcctatcagacctcactatttctggccattgctagttggacgtcggaaggaaaaaaatgttcaaggtataattgaaatcctcaaaggaatgcaagaattgggagtacatcctgatcaggaaacatatacagattatgtgattccatgctttgatagtgtaaactcagcacgagccattttgcaggaaaatggatgtctgtctgatagtgatatgttttctcaagctggattgagaagtgaagcagcaaatgggaacttagactttgtattatcatttttgaaatcaaatacattgcccatctcgctgcagtctataagaagtagcctactgctaggcttcaggaggtctatgaatataaatctttggagcgagataacagaattgttgtacaaggatggacgttattgccaggagcctcgaggaccgacggaagctgttggctattttctttataacttgattgacagcatgagtgactcagaggtacaggccaaggaggagcatttgagacaatacttccatcagctggagaagatgaatgtaaaaattcctgaaaatatctacagaggcattcgtaatctcctggaaagctaccatgttcctgaattgattaaggatgctcacttgttggttgagagtaagaatttagactttcaaaaaactgtgcaacttacatcatctgaattggagtccacacttgaaacactaaaagctgaaaatcaacctataagagatgtcctaaagcaactcatattagtgctttgttcagaagagaatatgcaaaaagcccttgaattgaaagcaaaatatgaatccgacatggttactggtggctatgcagctttaataaatttatgctgtcgacatgataaagtagaagatgccttgaacttgaaagaagaatttgaccgcttagattcatctgctgtccttgacaccggcaagtatgtaggccttgtaagagtattggcaaagcatggcaagctccaagatgctattaacattctgaaggagatgaaagagaaggatgttcttatcaaagatacaacagccttgtcctttttccacatgctaaatggcgcagctttaagaggtgaaattgaaacagtaaaacagttgcatgaagccatcgtgactctagggttagcagaaccatccaccaacataagtttcccattggtcactgtacacttggaaaagggcgacctatctactgctcttgaggtcgccattgactgctatgaaaagtataaagtattaccaaggattcatgatgtcttgtgtaaactggtagagaaaggcgagactgatctaattcagaaagcaatggactttgtgagccaagaacaaggtgaaatggtgatgctctatgatctcttctttgccttcctacaaacaggaaattacaaagaggccaagaagatcattgagactccagggattagagctcgatctgcaaggcttcagtggttttgtgacagatgtgttgcaaataatcaggttgaaactctggaaaaattagtggagctgacacagaagctatttgaatgtgatagagaccagatgtactacaatctgctaaaactgtataaaataaacggtgactggcaaagagctgatgcagtctggaataaaatccaagaagaaaatgttattcctcgtgaaaagacattaagattattagcagaaatccttagagagggtaaccaggaagttccgtttgacgtacctgagttgtggtatgaagatgaaaaacattccctgaattcttcgtcagcctcaaccacagaacctgatttccagaaagatatattgattgcctgccgattgaaccaaaaaaaaggggcatatgatattttcctgaatgcaaaagagcaaaacattgtgtttaatgctgaaacctacagcaatctcattaaattactgatgtcagaagattattttacacaagcaatggaagtgaaagcattcgcggagacccacatcaagggcttcacactgaacgatgctgccaacagccgcctcatcataacgcaagttaggcgggattatttgaaagaggctgtgacaacactgaaaacagtattggatcagcagcagaccccttctaggttagcagtgacccgtgtcatccaggcattggccatgaagggtgatgttgaaaacatagaagtagttcagaagatgttaaatggactcgaagactccattggactttcaaaaatggttttcatcaataacattgctttggctcaaataaagaataataacatagatgccgcaatagaaaacattgaaaatatgcttacttcagagaataaagtcattgaaccccaatacttcggcttggcatacttattcagaaaagtaatagaggagcagttggaaccagcagttgaaaagataagcatcatggcggagagattggccaatcagtttgcaatttataaacctgtcactgattttttccttcaacttgtggatgcaggcaaggtggatgatgccagagctctcctacagagatgtggtgcaattgctgaacaaaccccgattttgttgttgttcctccttaggaattctaggaaacaaggaaaggcatcaactgtgaaatctgtgttagaattgattcctgaattaaatgaaaaggaagaagcatacaattccctcatgaaaagctatgtctcagagaaagatgtcacatctgctaaagcactgtatgaacatttgactgcaaagaatacaaaattggatgatctgtttctaaagcgttacgcatctttgctgaagtatgctggagagcctgtccctttcattgaaccccctgaaagctttgaattttatgcacagcagctaagaaaattgagggaaaactcttcttgaaataaccaggcgatactttgttttgtatatatttgtgattctgtgtctacatgttattttgaagtatatctgagggaaaaataaatgaaaattttctttatgta

SEQ ID NO: 441294 - DNA, 4968 bp, Homo sapiens
ggtagaattcatttattttctaaagcgaggccccgcgtacgcgcttagggtggggacctgcgcgttcctttacactgttcccaggccctgataatccacatcctatcatgttgaacctgggaggcaaacggcaaggtgcaaaagacctccacggtttctccggcccgcgtttctgagagtgaagggccgttcctattggacatggcgtcagggctgaacgttagcagcaacatctgcactcgggggcgggggaaaccttcccacgtcctgggatcttcatagtcggctctcctcgagagttctcggtatttttactagttggcctcccacaagcctctgcgccaacctgggaggagttgacctcttgcggctctaccaacagaggagtgcaggggtgcagcgaatgaacacgatgcccagatcggagacggaagacggaaaagaaaagcttcgataatgaatcaagcaacatcgtttatgtaaatattacattgggtcttctgtcctcggagaagtgcggttttccatcttccaacctaaaacaatccgtcgctccccccacatttggcacgcccggcagttggtctctgccgcgccaggctaccctgcggtcacatgctcctcctgtccttctggcggagcgtgcttcccgctgcggggacgttcgagcaatggcagccctgctgagatccgcgcgttggttgctgcgtgccggggcggccccgcgcctcccgctctccctgcgcctcctccctggcggcccgggccggctgcatgccgcctcctatctgcccgccgctcgcgccgggcccgtggccggaggactactgagcccagccaggctgtatgccattgctgccaaagaaaaagatattcaagaggagtccactttttcttctaggaagatttccaatcagtttgattgggctctaatgagactagatctttctgttcgaagaactggccgcattccaaagaagcttctacaaaaagtttttaatgatacctgccgctcaggtggcctaggtggtagtcatgccttgcttctactacgtagttgtggttctctcttgcctgaactaaagcttgaagagagaacagaatttgctcataggatatgggacacacttcagaaattaggtgctgtgtatgatgtgagtcactataatgctttacttaaagtctatcttcaaaatgaatataaattctcaccaactgatttcctggcaaaaatggaggaagcaaacattcaaccaaatcgagtgacataccagagattgattgcttcttattgtaatgtaggagatattgaaggtgccagcaagattcttggatttatgaaaactaaggatctcccagttacagaggcagtattcagtgcccttgtgacagggcatgccagagctggtgatatggagaatgcagaaaacattctcacagtgatgagagatgccggaattgagcctggtccagacacatacctcgcattattgaatgcatatgctgagaagggcgacattgaccatgttaagcagactctggagaaggtggagaagtccgagcttcaccttatggaccgtgatttactgcaaattatttttagcttcagtaaagctgggtatcctcagtatgtctcagaaattttggaaaaagttacatgtgaaagaagatatattccagatgcaatgaacctcattttacttttagtcactgaaaaattggaagatgtagcgttgcaaattttactagcatgccccgtatcaaaggaagatggcccaagtgtctttggcagtttctttttacaacactgtgtgactatgaatacgcctgtggagaagctaacagactactgtaagaagttaaaggaagtccagatgcactcctttcctctgcagttcaccctccattgtgctttactcgccaataaaactgatttggcaaaagccttaatgaaggctgtgaaggaggaaggttttcctatcagacctcactatttctggccattgctagttggacgtcggaaggaaaaaaatgttcaaggtataattgaaatcctcaaaggaatgcaagaattgggagtacatcctgatcaggaaacatatacagattatgtgattccatgctttgatagtgtaaactcagcacgagccattttgcaggaaaatggatgtctgtctgatagtgatatgttttctcaagctggattgagaagtgaagcagcaaatgggaacttagactttgtattatcatttttgaaatcaaatacattgcccatctcgctgcagtctataagaagtagcctactgctaggcttcaggaggtctatgaatataaatctttggagcgagataacagaattgttgtacaaggatggacgttattgccaggagcctcgaggaccgacggaagctgttggctattttctttataacttgattgacagcatgagtgactcagaggtacaggccaaggaggagcatttgagacaatacttccatcagctggagaagatgaatgtaaaaattcctgaaaatatctacagaggcattcgtaatctcctggaaagctaccatgttcctgaattgattaaggatgctcacttgttggttgagagtaagaatttagactttcaaaaaactgtgcaacttacatcatctgaattggagtccacacttgaaacactaaaagctgaaaatcaacctataagagatgtcctaaagcaactcatattagtgctttgttcagaagagaatatgcaaaaagcccttgaattgaaagcaaaatatgaatccgacatggttactggtggctatgcagctttaataaatttatgctgtcgacatgataaagtagaagatgccttgaacttgaaagaagaatttgaccgcttagattcatctgctgtccttgacaccggcaagtatgtaggccttgtaagagtattggcaaagcatggcaagctccaagatgctattaacattctgaaggagatgaaagagaaggatgttcttatcaaagatacaacagccttgtcctttttccacatgctaaatggcgcagctttaagaggtgaaattgaaacagtaaaacagttgcatgaagccatcgtgactctagggttagcagaaccatccaccaacataagtttcccattggtcactgtacacttggaaaagggcgacctatctactgctcttgaggtcgccattgactgctatgaaaagtataaagtattaccaaggattcatgatgtcttgtgtaaactggtagagaaaggcgagactgatctaattcagaaagcaatggactttgtgagccaagaacaaggtgaaatggtgatgctctatgatctcttctttgccttcctacaaacaggaaattacaaagaggccaagaagatcattgagactccagggattagagctcgatctgcaaggcttcagtggttttgtgacagatgtgttgcaaataatcaggttgaaactctggaaaaattagtggagctgacacagaagctatttgaatgtgatagagaccagatgtactacaatctgctaaaactgtataaaataaacggtgactggcaaagagctgatgcagtctggaataaaatccaagaagaaaatgttattcctcgtgaaaagacattaagattattagcagaaatccttagagagggtaaccaggaagttccgtttgacgtacctgagttgtggtatgaagatgaaaaacattccctgaattcttcgtcagcctcaaccacagaacctgatttccagaaagatatattgattgcctgccgattgaaccaaaaaaaaggggcatatgatattttcctgaatgcaaaagagcaaaacattgtgtttaatgctgaaacctacagcaatctcattaaattactgatgtcagaagattattttacacaagcaatggaagtgaaagcattcgcggagacccacatcaagggcttcacactgaacgatgctgccaacagccgcctcatcataacgcaagttaggcgggattatttgaaagaggctgtgacaacactgaaaacagtattggatcagcagcagaccccttctaggttagcagtgacccgtgtcatccaggcattggccatgaagggtgatgttgaaaacatagaagtagttcagaagatgttaaatggactcgaagactccattggactttcaaaaatggttttcatcaataacattgctttggctcaaataaagaataataacatagatgccgcaatagaaaacattgaaaatatgcttacttcagagaataaagtcattgaaccccaatacttcggcttggcatacttattcagaaaagtaatagaggagcagttggaaccagcagttgaaaagataagcatcatggcggagagattggccaatcagtttgcaatttataaacctgtcactgattttttccttcaacttgtggatgcaggcaaggtggatgatgccagagctctcctacagagatgtggtgcaattgctgaacaaaccccgattttgttgttgttcctccttaggaattctaggaaacaaggaaaggtactgtgctttacctgcttacaaatcaatgatactgtacgtgccttgctcagaagtattgaatttaacataaaagcctgttgtttcaggaccttatttgagaatactatagagattcaagactttgcttgtctctacttagagtcagttttgtcgtctgttagctgtactggaaatgtaaaacaagttcacgcaggaattttccacttacacaggtatgcattgagagccccaagaaaaggcccttaaaaaatgcaagattaggctgggcatggtggctcacacctgtaatcccagcactttgggaggccgaggcgggtggatcacttgaggtcaggagtttcagagtttgagaccagcctggccagcatggcgaaacctggtctttacaaaaaaa

SEQ ID NO: 441295 - DNA, 4567 bp, Homo sapiens
ggtagaattcatttattttctaaagcgaggccccgcgtacgcgcttagggtggggacctgcgcgttcctttacactgttcccaggccctgataatccacatcctatcatgttgaacctgggaggcaaacggcaaggtgcaaaagacctccacggtttctccggcccgcgtttctgagagtgaagggccgttcctattggacatggcgtcagggctgaacgttagcagcaacatctgcactcgggggcgggggaaaccttcccacgtcctgggatcttcatagtcggctctcctcgagagttctcggtatttttactagttggcctcccacaagcctctgcgccaacctgggaggagttgacctcttgcggctctaccaacagaggagtgcaggggtgcagcgaatgaacacgatgcccagatcggagacggaagacggaaaagaaaagcttcgataatgaatcaagcaacatcgtttatgtaaatattacattgggtcttctgtcctcggagaagtgcggttttccatcttccaacctaaaacaatccgtcgctccccccacatttggcacgcccggcagttggtctctgccgcgccaggctaccctgcggtcacatgctcctcctgtccttctggcggagcgtgcttcccgctgcggggacgttcgagcaatggcagccctgctgagatccgcgcgttggttgctgcgtgccggggcggccccgcgcctcccgctctccctgcgcctcctccctggcggcccgggccggctgcatgccgcctcctatctgcccgccgctcgcgccgggcccgtggccggaggactactgagcccagccaggctgtatgccattgctgccaaagaaaaagatattcaagaggagtccactttttcttctaggaagatttccaatcagtttgattgggctctaatgagactagatctttctgttcgaagaactggccgcattccaaagaagcttctacaaaaagtttttaatgatacctgccgctcaggtggcctaggtggtagtcatgccttgcttctactacgtagttgtggttctctcttgcctgaactaaagcttgaagagagaacagaatttgctcataggatatgggacacacttcagaaattaggtgctgtgtatgatgtgagtcactataatgctttacttaaagtctatcttcaaaatgaatataaattctcaccaactgatttcctggcaaaaatggaggaagcaaacattcaaccaaatcgagtgacataccagagattgattgcttcttattgtaatgtaggagatattgaaggtgccagcaagattcttggatttatgaaaactaaggatctcccagttacagaggcagtattcagtgcccttgtgacagggcatgccagagctggtgatatggagaatgcagaaaacattctcacagtgatgagagatgccggaattgagcctggtccagacacatacctcgcattattgaatgcatatgctgagaagggcgacattgaccatgttaagcagactctggagaaggtggagaagtccgagcttcaccttatggaccgtgatttactgcaaattatttttagcttcagtaaagctgggtatcctcagtatgtctcagaaattttggaaaaagttacatgtgaaagaagatatattccagatgcaatgaacctcattttacttttagtcactgaaaaattggaagatgtagcgttgcaaattttactagcatgccccgtatcaaaggaagatggcccaagtgtctttggcagtttctttttacaacactgtgtgactatgaatacgcctgtggagaagctaacagactactgtaagaagttaaaggaagtccagatgcactcctttcctctgcagttcaccctccattgtgctttactcgccaataaaactgatttggcaaaagccttaatgaaggctgtgaaggaggaaggttttcctatcagacctcactatttctggccattgctagttggacgtcggaaggaaaaaaatgttcaaggtataattgaaatcctcaaaggaatgcaagaattgggagtacatcctgatcaggaaacatatacagattatgtgattccatgctttgatagtgtaaactcagcacgagccattttgcaggaaaatggatgtctgtctgatagtgatatgttttctcaagctggattgagaagtgaagcagcaaatgggaacttagactttgtattatcatttttgaaatcaaatacattgcccatctcgctgcagtctataagaagtagcctactgctaggcttcaggaggtctatgaatataaatctttggagcgagataacagaattgttgtacaaggatggacgttattgccaggagcctcgaggaccgacggaagctgttggctattttctttataacttgattgacagcatgagtgactcagaggtacaggccaaggaggagcatttgagacaatacttccatcagctggagaagatgaatgtaaaaattcctgaaaatatctacagaggcattcgtaatctcctggaaagctaccatgttcctgaattgattaaggatgctcacttgttggttgagagtaagaatttagactttcaaaaaactgtgcaacttacatcatctgaattggagtccacacttgaaacactaaaagctgaaaatcaacctataagagatgtcctaaagcaactcatattagtgctttgttcagaagagaatatgcaaaaagcccttgaattgaaagcaaaatatgaatccgacatggttactggtggctatgcagctttaataaatttatgctgtcgacatgataaagtagaagatgccttgaacttgaaagaagaatttgaccgcttagattcatctgctgtccttgacaccggcaagtatgtaggccttgtaagagtattggcaaagcatggcaagctccaagatgctattaacattctgaaggagatgaaagagaaggatgttcttatcaaagatacaacagccttgtcctttttccacatgctaaatggcgcagctttaagaggtgaaattgaaacagtaaaacagttgcatgaagccatcgtgactctagggttagcagaaccatccaccaacataagtttcccattggtcactgtacacttggaaaagggcgacctatctactgctcttgaggtcgccattgactgctatgaaaagtataaagtattaccaaggattcatgatgtcttgtgtaaactggtagagaaaggcgagactgatctaattcagaaagcaatggactttgtgagccaagaacaaggtgaaatggtgatgctctatgatctcttctttgccttcctacaaacaggaaattacaaagaggccaagaagatcattgagactccagggattagagctcgatctgcaaggcttcagtggttttgtgacagatgtgttgcaaataatcaggttgaaactctggaaaaattagtggagctgacacagaagctatttgaatgtgatagagaccagatgtactacaatctgctaaaactgtataaaataaacggtgactggcaaagagctgatgcagtctggaataaaatccaagaagaaaatgttattcctcgtgaaaagacattaagattattagcagaaatccttagagagggtaaccaggaagttccgtttgacgtacctgagttgtggtatgaagatgaaaaacattccctgaattcttcgtcagcctcaaccacagaacctgatttccagaaagatatattgattgcctgccgattgaaccaaaaaaaaggggcatatgatattttcctgaatgcaaaagagcaaaacattgtgtttaatgctgaaacctacagcaatctcattaaattactgatgtcagaagattattttacacaagcaatggaagtgaaagcattcgcggagacccacatcaagggcttcacactgaacgatgctgccaacagccgcctcatcataacgcaagttaggcgggattatttgaaagaggctgtgacaacactgaaaacagtattggatcagcagcagaccccttctaggttagcagtgacccgtgtcatccaggcattggccatgaagggtgatgttgaaaacatagaagtatcctgcataactttcgaactttgttaaatgttggcactaggagtcatcagatctaggcttcatcattttccagtgagaagcagagacccaaagggcctgttacttgtgcttggtcaggggactgtctgtcatgcctggaggctcttcggcacacttccccatctttcccttctgccactgtggcttcaagcacctctgttcatagagcgtctctgaaattgagtctcggtcatgacttatcccgaagtagagcaatgtgtttcctctcattgtagtttcaggactttgtcagtacaagctctgccctaggcttgttactttatactcatatcctgaaaagatgtgatttcatctatgaaggggtaaaatattggtttgtatttaattgtttgaaataaaagtgatccctatattga

SEQ ID NO: 441296 - DNA, 3957 bp, Homo sapiens
ggtagaattcatttattttctaaagcgaggccccgcgtacgcgcttagggtggggacctgcgcgttcctttacactgttcccaggccctgataatccacatcctatcatgttgaacctgggaggcaaacggcaaggtgcaaaagacctccacggtttctccggcccgcgtttctgagagtgaagggccgttcctattggacatggcgtcagggctgaacgttagcagcaacatctgcactcgggggcgggggaaaccttcccacgtcctgggatcttcatagtcggctctcctcgagagttctcggtatttttactagttggcctcccacaagcctctgcgccaacctgggaggagttgacctcttgcggctctaccaacagaggagtgcaggggtgcagcgaatgaacacgatgcccagatcggagacggaagacggaaaagaaaagcttcgataatgaatcaagcaacatcgtttatgtaaatattacattgggtcttctgtcctcggagaagtgcggttttccatcttccaacctaaaacaatccgtcgctccccccacatttggcacgcccggcagttggtctctgccgcgccaggctaccctgcggtcacatgctcctcctgtccttctggcggagcgtgcttcccgctgcggggacgttcgagcaatggcagccctgctgagatccgcgcgttggttgctgcgtgccggggcggccccgcgcctcccgctctccctgcgcctcctccctggcggcccgggccggctgcatgccgcctcctatctgcccgccgctcgcgccgggcccgtggccggaggactactgagcccagccaggctgtatgccattgctgccaaagaaaaagatattcaagaggagtccactttttcttctaggaagatttccaatcagtttgattgggctctaatgagactagatctttctgttcgaagaactggccgcattccaaagaagcttctacaaaaagtttttaatgatacctgccgctcaggtggcctaggtggtagtcatgccttgcttctactacgtagttgtggttctctcttgcctgaactaaagcttgaagagagaacagaatttgctcataggatatgggacacacttcagaaattaggtgctgtgtatgatgtgagtcactataatgctttacttaaagtctatcttcaaaatgaatataaattctcaccaactgatttcctggcaaaaatggaggaagcaaacattcaaccaaatcgagtgacataccagagattgattgcttcttattgtaatgtaggagatattgaaggtgccagcaagattcttggatttatgaaaactaaggatctcccagttacagaggcagtattcagtgcccttgtgacagggcatgccagagctggtgatatggagaatgcagaaaacattctcacagtgatgagagatgccggaattgagcctggtccagacacatacctcgcattattgaatgcatatgctgagaagggcgacattgaccatgttaagcagactctggagaaggtggagaagtccgagcttcaccttatggaccgtgatttactgcaaattatttttagcttcagtaaagctgggtatcctcagtatgtctcagaaattttggaaaaagttacatgtgaaagaagatatattccagatgcaatgaacctcattttacttttagtcactgaaaaattggaagatgtagcgttgcaaattttactagcatgccccgtatcaaaggaagatggcccaagtgtctttggcagtttctttttacaacactgtgtgactatgaatacgcctgtggagaagctaacagactactgtaagaagttaaaggaagtccagatgcactcctttcctctgcagttcaccctccattgtgctttactcgccaataaaactgatttggcaaaagccttaatgaaggctgtgaaggaggaaggttttcctatcagacctcactatttctggccattgctagttggacgtcggaaggaaaaaaatgttcaaggtataattgaaatcctcaaaggaatgcaagaattgggagtacatcctgatcaggaaacatatacagattatgtgattccatgctttgatagtgtaaactcagcacgagccattttgcaggaaaatggatgtctgtctgatagtgatatgttttctcaagctggattgagaagtgaagcagcaaatgggaacttagactttgtattatcatttttgaaatcaaatacattgcccatctcgctgcagtctataagaagtagcctactgctaggcttcaggaggtctatgaatataaatctttggagcgagataacagaattgttgtacaaggatggacgttattgccaggagcctcgaggaccgacggaagctgttggctattttctttataacttgattgacagcatgagtgactcagaggtacaggccaaggaggagcatttgagacaatacttccatcagctggagaagatgaatgtaaaaattcctgaaaatatctacagaggcattcgtaatctcctggaaagctaccatgttcctgaattgattaaggatgctcacttgttggttgagagtaagaatttagactttcaaaaaactgtgcaacttacatcatctgaattggagtccacacttgaaacactaaaagctgaaaatcaacctataagagatgtcctaaagcaactcatattagtgctttgttcagaagagaatatgcaaaaagcccttgaattgaaagcaaaatatgaatccgacatggttactggtggctatgcagctttaataaatttatgctgtcgacatgataaagtagaagatgccttgaacttgaaagaagaatttgaccgcttagattcatctgctgtccttgacaccggcaagtatgtaggccttgtaagagtattggcaaagcatggcaagctccaagatgctattaacattctgaaggagatgaaagagaaggatgttcttatcaaagatacaacagccttgtcctttttccacatgctaaatggcgcagctttaagaggtgaaattgaaacagtaaaacagttgcatgaagccatcgtgactctagggttagcagaaccatccaccaacataagtttcccattggtcactgtacacttggaaaagggcgacctatctactgctcttgaggtcgccattgactgctatgaaaagtataaagtattaccaaggattcatgatgtcttgtgtaaactggtagagaaaggcgagactgatctaattcagaaagcaatggactttgtgagccaagaacaaggtgaaatggtgatgctctatgatctcttctttgccttcctacaaacaggaaattacaaagaggccaagaagatcattgagactccagggattagagctcgatctgcaaggcttcagtggttttgtgacagatgtgttgcaaataatcaggttgaaactctggaaaaattagtggagctgacacagaagctatttgaatgtgatagagaccagatgtactacaatctgctaaaactgtataaaataaacggtgactggcaaagagctgatgcagtctggaataaaatccaagaagaaaatgttattcctcgtgaaaagacattaagattattagcagaaatccttagagagggtaaccaggaagttccgtttgacgtacctgagttgtggtatgaagatgaaaaacattccctgaattcttcgtcagcctcaaccacagaacctgatttccagaaagatatattgattgcctgccgattgaaccaaaaaaaaggcaagcacatacggggatgggggtgtgtgtgggggggtggtcttctttctaatagcagtgtggggtgtaagcccaaccaattagaagtgctctaggatagagataggacttaaattttacatatttcttgtccccttc

SEQ ID NO: 441297 - DNA, 686 bp, Homo sapiens
tgctctagagatccccctcataaggggtgcccagaaaacattgaaaatatgcttacttcagagaataaagtcattgaaccccaatacttcggcttggcatacttattcagaaaagtaatagaggagcagttggaaccagcagttgaaaagataagcatcatggcggagagattggccaatcagtttgcaatttataaacctgtcactgattttttccttcaacttgtggatgcaggcaaggtggatgatgccagagctctcctacaggaattctaggaaacaaggaaaggtactgtgctttacctgcttacaaatcaatgatactgtacgtgccttgctcagaagtattgaatttaacataaaagcctgttgtttcaggaccttatttgagaatactatagagattcaagactttgcttgtctctacttagagtcagttttgtcgtctgttagctgtactggaaatgtaaaacaagttcacgcaggaattttccacttacacaggtatgcattgagagccccaagaaaaggcccttaaaaaatgcaagattaggctgggcatggtggctcacacctgtaatcccagcactttgggaggccgaggcgggtggatcacttgaggtcaggagtttcagagtttgagaccagcctggccagcatggcgaaacctggtctttacaaaaaaa

SEQ ID NO: 441298 - DNA, 10415 bp, Homo sapiens
cgcgcggaaaggattaaggcggtagtacgaggcctgggggtggcggctgtggcggggcccggcggggagcgggtccggagcaggctcccggacccaaaactgaagggggcgtctgaggcgtcagggagctccctcgcctggctctcggcggcctgatggagtaagaggggttggctgtgaatgtgtgacgttgagtgcttcagatctggtcactatggtacgagaacgaaaatgcatattatgccacatcgtgtacagctcaaaaaaggagatggacgaacacatgcggagcatgttgcatcacagggaacttgagaacctcaagggcagggacattagtcatgagtgccgagtgtgcggggtcacagaagtgggtctttctgcatatgcaaagcacatttctggccagttgcacaaagataacgttgatgcccaggaaagagaagatgatggaaaaggagaggaagaggaagaagattattttgacaaggaactcattcagttaataaaacaaaggaaagaacaaagtcgacaagatgaaccttccaatagcaaccaagaaataaactctgatgacagacgaccccaatggagacgagaagaccgaattccttaccaagacagagagagttacagtcagcctgcatggcatcatcgtggacctccacagcgggattggaaatgggaaaaagatggctttaataatactaggaaaaacagctttccacattctttgaggaatggtggtggaccaagaggacgttccgggtggcataagggtgttgcaggaggctcctcgacttggtttcacaaccatagtaattctggaggtggttggctttcaaatagtggagcagtagattggaatcataatggtacaggaaggaattccagttggctttctgaaggaacaggtggcttttccagttggcatatgaacaacagtaacggaaactggaaatccagtgtacgtagtacaaataattggaattacagtggccctggagacaaatttcaaccaggcagaaacagaaattctaactgtcaaatggaagacatgactatgctatggaacaagaaatctaataagtcaaacaaatacagtcacgacagatataattggcagcggcaagaaaatgacaaacttggtacagttgccacatatagaggtccttctgaaggatttacaagtgataaatttccttcagaaggcttactcgacttcaattttgagcagctggaaagccaaaccactaaacaagcagacactgctacttccaaagttagtggaaagaatggcagtgcggcaagggaaaagcctcgtcgctggacgccttacccttctcagaagactctggatttacagtcgggattgaaagacatcactggtaacaagtcagaaatgatagagaaacctctctttgattttagcttgataactacaggaatacaggagccccaaactgatgaaacacgtaattccccaacacagaaaacacaaaaagaaatacatactggatctcttaatcacaaggcctcttctgattccgctgcttccttcgaggtggtgagacagtgccccactgcagaaaaacctgaacaagagcatacaccaaataaaatgccatcattgaaatccccactccttccatgtccagccactaaatcattgtctcaaaagcaagatccaaagaatatctcaaaaaacaccaaaacaaattttttttcccctggagaacactcaaatccctcgaacaagcccactgtggaagataaccatggtccttacatatccaaactgcgtagttcatgtcctcatgttttaaaagggaataaaagtacatttggctctcaaaagcaatctggtgataatttaaatgatactttacgaaaggccaaagaggtgctacagtgtcatgagtcattgcaaaatccacttcttagcacttctaaaagtaccaggaactatgcaaaagcaagtagaaatgtagaagaatctgaaaaagggtctttgaaaattgagtttcaagtgcacgcactagaagatgaaagtgatggagagacatctgacacggaaaagcatggaacaaaaattggaaccctaggttctgcaactacagaattgttatctggcagcactcgaactgctgatgagaaagaggaggatgaccgcatcctgaagacttctagagagctatccacttccccatgtaatcccatagttcgccagaaagaatctgaattacaaatgacatctgcagccagtccacaccctggcttattgctagacttgaaaacctctctagaagatgcacaggttgatgactctattaaatctcatgtatcttatgaaacagaaggctttgagagtgctagcttggatgcagagcttcaaaaaagtgacatcagtcagccctcgggccctctcctgcctgaactaagtaagcttggctttcctgcctcacttcagagggatctaacccggcacattagtttgaagagcaaaactggagtacaccttcctgagccaaacctcaatagtgcccgccgcattcgcaatattagcggtcaccgaaagagtgagacagagaaggagtctgggctcaagccaaccctacggcagattctaaatgcatctcggagaaatgtcaactgggaacaggtcattcagcaagtaaccaagaaaaagcaagagctgggcaaaggcttacccaggtttggcatagaaatggtaccccttgttcaaaatgaacaagaagccttagatttggatggggaacctgatctgtccagtctagaaggattccagtgggaaggtgtttccatttcctcgtcccctggcttggcaagaaagcgaagcctttctgagagcagcgtgatcatggacagagctccttctgtgtatagcttcttcagtgaggaaggtacaggcaaagaaaatgagccccagcagatggtttcacctagtaactcattgagggctggacagagccagaaagcaaccatgcacctcaaacaagaagtgacacctcgggctgcctccctccgaacaggtgaaagggctgaaaatgttgctacccaaaggcgacatagtgcacaattatcctctgaccatataatacctttgatgcatttggcaaaagacttgaacagccaggagaggtctataccaccgtcagagaatcagaattcccaggagagtaatggagagggaaactgtctgtcatcaagcgcatcctcagcccttgcgatctccagtttagcggatgcagccacagatagtagctgtacctctggtgctgaacaaaatgatggccaaagtattagaaagaaacgaagagccactggagatggatcttctcctgaactcccaagtcttgagagaaaaaataaaagaaggaaaattaaaggaaaaaaagaacgttctcaggttgaccagctgctgaatatttctttaagggaggaagaacttagtaagtcattgcagtgcatggataacaatcttctgcaagcccgtgcagcccttcagacagcttatgtggaagttcagaggctacttatgctcaagcagcagataactatggagatgagtgcactgaggacccatagaatacagattctacagggattacaagaaacatatgaaccttctgagcacccagaccaggttccctgtagcctcacacgagaacgaaggaacagtagatctcaaacatccattgatgccgcactgctgcccactccctttttcccactttttctggagcctccatcttcccatgtgtctccatcacccaccggagcctctcttcaaataaccacgtctcctactttccaaacccatggcagtgtccctgctccagactcatcagttcagattaaacaagagcccatgtctcctgaacaagatgagaatgtgaatgctgtgccaccaagctctgcctgcaatgtgtccaaggaattactggaagctaatagagagatcagtgacagttgtccagtttatccagtcatcactgctagattgtccttaccagagtcaacagaaagtttccatgagcctagccaagaactgaagttttctgtggagcaaagaaataccagaaacagagaaaactctccctcttcccaatcagctggtctttctagcataaataaagaaggggaagagccaaccaaaggcaatagtgggtctgaagcctgtaccagttcttttctaagattgtcttttgcttcagaaacccctttggagaaggaaccccactctccagctgaccagcctgaacaacaggcagaatccactttgacatcagctgagactaggggaagcaagaaaaagaagaaactccggaagaagaaaagtctacgggctgcccatgttcctgagaatagtgacactgaacaggatgttttgactgttaaacctgtaaggaaagtaaaagctggaaagttaattaaaggggggaaagtaacaacctccacttgggaagacagcaggactggtcgggagcaggagagtgtcagagatgagccagatagtgactcgtctctggaagtcctagaaattcctaatcctcagttagaagtagtagccattgattcttcagaatcaggagaagagaaaccagacagcccatctaaaaaggatatttggaactctacagagcaaaacccactagaaacgtctcgttctgggtgtgatgaagttagctctaccagtgaaattggcactcgctataaagatggcatccctgtaagtgtggcagaaactcagactgtgatctcctccataaaaggatcaaagaattcttcagaaatatcttcagagccaggagatgatgatgaacccacagaaggaagctttgagggacaccaagctgccgtaaatgcaattcagatatttgggaacttgctatatacctgttcagcagataaaactgttcgggtttataatctggtgagtcggaaatgtattggtgtctttgagggtcatacctccaaagttaactgcctcctggttactcagacctccgggaagaatgctgccctttacaccgggtccagtgaccataccatccgctgctataatgttaagagccgagagtgtgtggagcagttacagctggaagaccgggtcctctgcctccacagtagatggcgaatcctctatgcgggactggcaaatggcactgtggtcaccttcaacataaagaacaacaaacgacttgagatctttgaatgccatggccctcgggcagtcagctgtcttgctacagctcaggaaggtgcccgaaaactgctggtcgtggggtcttatgactgcacaattagtgtacgcgatgcccggaatggactgctcctcagaactctggagggccatagcaaaaccattctttgcatgaaggtggtgaatgatctcgtgttcagtggctccagtgatcagtcagtccatgctcacaacattcacactggtgagctcgtgcggatctataaaggtcacaatcatgcagtgactgtggtgaatatcctaggaaaagtgatggtgactgcttgcctggataaatttgttcgtgtctatgaattacagtctcatgatcgattacaagtttatggaggacacaaagacatgattatgtgtatgaccatccataaaagcatgatttacactggctgttatgatggcagtattcaggccgtgaggcttaatctgatgcagaattaccgctgttggtggcatggttgctctctgatatttggcgttgtagatcatttaaaacaacacttgctgaccgaccacactaatcccaacttccagactctgaaatgtcgctggaagaactgcgatgcttttttcactgctaggaaaggatccaaacaggatgctgcaggacatattgaacgacatgctgaagatgacagcaaaattgattcatgaagttttttgcctcccacgttgggaagtcattagttgaactattttcacattggccccccacacaggccactctcttccctttcttggtgaagtaaggaaggagaaagtggttactagccaggcatacccctagcataagtctgggcagctctatgggatgataaattacacttttaagttcttgctggaggttttaaatagatttagacaaatgttaaggaaccatacttctctgggacagcatggcatatagtgatatatgctatttgcgttctccagatgtttattgaagatacagatcctaattggttacccagtttgaccctaatcatatgtatattttattgatttcagtttgcaatttttaatttatgttcttatgatggtttaaacctatagtcaggcttttaagtacaagtttgtttaagtgccagactttgaggatcagttttaatttctccatttgtaatagctgggtatttaaactggaagcaaatagttttctttcttaacaattatgtgcagtgtgtgtcactgttttcttgctttatagatagagctggctttaagtgctaaaggacacagtagatttttgacaaacagtggctgctctgctgactatcttttaggaattcaggaagcaaatcacatagtgacaagtccttacagacaccacttctagtaaatctctgtaaatgtggatagaaagctcagtgtgaggcagtgcgtagacctaacgtctacctttacatctgctgttgaacctgggcactacctgttacagatcctgtcaggctgttgaactggaggtgtacctttatcttcctttctagtgtctgaccctgcaagcctaatgttggtttgaacccttttggtttgttcagttgccagcctccatctctcccactgtatggccgtgcctagaccgatggcagccatcgaatattcctctgggctcacggggtgttttccacccccctgcagcaactaagatggtgggggagagggggttagaataaagcatctgaatacagttttcaggacctcaagcagacttcctagagacttgtttctgagacagttctttgccttcacttccctgctagctgggaaagaagagtggagcagagactctgcctggccactgagaacagccaaattcacaaaccctcagtggggctttgtttttggattttctccggactcatcagtaaacctgtagaagtgtcgctttccagccttttgtttctggatcctcaaaactcagaacgtggccgggcgtggtggctcacgcctgtaatcccagcactttgggaggctgaggcaggcagatcacctgaggctaggagttgcagaccagcctggccaacatggcaaaaccccgtctctactaaaaatacaaaaagccgggcgtggtgggcgcctgtaatcccagctgctcaggaggctgaggcaggagaatcgcttgaacccgggaggcagagattgcagtaagctgagatcgtgccactgcactccagcctggtgacagagtgagactccgtctcaaaaaaaaaaaaaaaaactcagcttcttcagagagataaaattgggggaggagcccagggccacataccaagctttgggacatggtgcctcatgctctctgggattgcagaccatccaggtctgtcttcgcccctgttagtgcacatatatccactcacatgtcttccctcaggctatcgggcagggggacttcaccagggggtttatggataggcttcaagagggtctgtgagcccccagaaattgtgtgtgagactgagtatgtgttcttttttccaggaaaggctccagtggttcttacttgatccaaaaaatgtcaagaattaatctaggaggccgggcctggtggctcacacctgtaatcccagctctttgggaggccgaggcgggtggatcactcaaggtcaggcatttgagaccagcctggccaacatagtgaaaccccgtctctattaaaaatacaaaaattagctgggtgtggtggtatgtgcctgtagtctcagctactcaggaggctgagacaggagaatcacttgaaccctggaggtagaagttgcagtgagccaagatcatactactgcactccagcctgggcgacaagagtgaaactccacctcaaaaaaaaaaaaaaaagagttaatctaggagataatgaatggcctagtactagataatatatggccccacaagctcttgacttctgtccttggggaaagccattttgttaaccacactagtgagatttacatgatgcttaatggagaacagagaagatcttgttgcaaaaggtgtattaaatatttgtgctgtttctgtatgagattgagaagcttttcccacctctcacccctatttcctataaggatatccagagaagccaaactgttctgtgggtttgggaatggtcatttcccgggaaaatgcatctggatcgatgactaaacctggcccttttctctgggctgtagtgaagccgcattttcacgctggctggcagtgtgctgagagcctcgaatgctctgcggcgtagtgcccttctgccctgcctgacgatgtatcgaaaagatgagagtgaaggagactttgtgcagcaggaaacgggtaggtgaggtgttgggcagttgtgggaacttctgagagtattacagagtggtagaatcggtaagaactctgatttggacttcgctttggtggaactgtgtgcctatacctgcctgtgtgtgtgcaagtgtgcaggttcctttgtatgtatgtgtacgtgtgggaacctgtgtttgtcatatttttcttcatttcacaaaggctttttttgaagcagtggcagtatgcctttgtttcaagaacacatgaaattcttttaacaccagattagtgtgttaccccaaatgaacggttctagccctctattaagaaataaagggaccataagcattttggctgcttatggctgtgtgttactacttacaagagtcttgaaaattatacagaactttgccttctttttttaatgtcttccacaatgttgtgactgattataaccctgtttcccctcagagaagagctatggctcagggatctgtgttgactctggcatttagtggctttgtgaaggaaagaaaccattaaatgacctgacaaaaactgactcatgtctttaaagtagttgaagccacttttagaatgttactctcggttgcttttgtctaattctaatggcttaaagccaagaaaaccatagtataaatctttttgtgtacctatgctagtgtttaaatggcagttcgttgtgataaagtatcagtcacttcaagttttctgtgaaagtttttaattaggttaaaaataattttggcatacgtctctactcagtttataaagcagttccacaccatgcaaacaaaactctaacagcaaaggttatcttgacctgatgttacttgaatctgagagaaagtcattacttactactgcactcctgcttttgtgggaaaaattttcttcttccccagaagagttaacagttgagtgttcagctcctgacttacctttaatttagaggcaatattattactgtttaagtgattatttgcttaacacaggttttattttgtctttttgctggtagattatacaagggacaactttagtgatgaggcatgtggatgatttggtgggagtaggtatatacttagtggaatggtttattttatggaagagaattcattggaggtgagattgaagtatattgtgaagtgggatttgaacagcacatatgctctggtttgctcaaataactgcagtttatgcttacatctaaattttgtttctgttacctaaacgggagcttctagaattacgaaggccatacctgccacatttataaaataatggttttatccctgcccccaaatcatcaggttcctcgggtttaagagaagtggtctaatagacaggaatagaagttgtggtggaggtgatttgggatagactaggtttccttatgcaagtggatatgagctcctcatagaaaccagacctactgtattagacagtaacctctaacctcacctccaagcccaagtatatggccctgctgggttacctggtgactacatttcccagattcactctaaattcaaggtagtgacccaaataaattgggaaaggagggggtcaaggaggaaaagctgttgaaaatctttctcctatttaagagaaatatatgccctagagctgctccagcacccttggtttctgatttttttaatattgaatatggattagaagaatgaaatcagatgacacctgactgcaaaaatgtttataagcaaatagccttcttacattttggtataaagctgtgaacttcgtaactttgtaaagcaagatataaagcaaatacaagaggaaaataaagtacttttactaattg

SEQ ID NO: 441299 - DNA, 10411 bp, Homo sapiens
  misc_feature (37)..(37): n is a, c, g, or t
taaacaaaaacctacgctaggtacgaggccgggttgnggcggctgtggcggggcccggcggggagcgggtccggagcaggctcccggacccaaaactgaagggggcgtctgaggcgtcagggagctccctcgcctggctctcggcggcctgatggagtaagaggggttggctgtgaatgtgtgacgttgagtgcttcagatctggtcactatggtacgagaacgaaaatgcatattatgccacatcgtgtacagctcaaaaaaggagatggacgaacacatgcggagcatgttgcatcacagggaacttgagaacctcaagggcagggacattagtcatgagtgccgagtgtgcggggtcacagaagtgggtctttctgcatatgcaaagcacatttctggccagttgcacaaagataacgttgatgcccaggaaagagaagatgatggaaaaggagaggaagaggaagaagattattttgacaaggaactcattcagttaataaaacaaaggaaagaacaaagtcgacaagatgaaccttccaatagcaaccaagaaataaactctgatgacagacgaccccaatggagacgagaagaccgaattccttaccaagacagagagagttacagtcagcctgcatggcatcatcgtggacctccacagcgggattggaaatgggaaaaagatggctttaataatactaggaaaaacagctttccacattctttgaggaatggtggtggaccaagaggacgttccgggtggcataagggtgttgcaggaggctcctcgacttggtttcacaaccatagtaattctggaggtggttggctttcaaatagtggagcagtagattggaatcataatggtacaggaaggaattccagttggctttctgaaggaacaggtggcttttccagttggcatatgaacaacagtaacggaaactggaaatccagtgtacgtagtacaaataattggaattacagtggccctggagacaaatttcaaccaggcagaaacagaaattctaactgtcaaatggaagacatgactatgctatggaacaagaaatctaataagtcaaacaaatacagtcacgacagatataattggcagcggcaagaaaatgacaaacttggtacagttgccacatatagaggtccttctgaaggatttacaagtgataaatttccttcagaaggcttactcgacttcaattttgagcagctggaaagccaaaccactaaacaagcagacactgctacttccaaagttagtggaaagaatggcagtgcggcaagggaaaagcctcgtcgctggacgccttacccttctcagaagactctggatttacagtcgggattgaaagacatcactggtaacaagtcagaaatgatagagaaacctctctttgattttagcttgataactacaggaatacaggagccccaaactgatgaaacacgtaattccccaacacagaaaacacaaaaagaaatacatactggatctcttaatcacaaggcctcttctgattccgctgcttccttcgaggtggtgagacagtgccccactgcagaaaaacctgaacaagagcatacaccaaataaaatgccatcattgaaatccccactccttccatgtccagccactaaatcattgtctcaaaagcaagatccaaagaatatctcaaaaaacaccaaaacaaattttttttcccctggagaacactcaaatccctcgaacaagcccactgtggaagataaccatggtccttacatatccaaactgcgtagttcatgtcctcatgttttaaaagggaataaaagtacatttggctctcaaaagcaatctggtgataatttaaatgatactttacgaaaggccaaagaggtgctacagtgtcatgagtcattgcaaaatccacttcttagcacttctaaaagtaccaggaactatgcaaaagcaagtagaaatgtagaagaatctgaaaaagggtctttgaaaattgagtttcaagtgcacgcactagaagatgaaagtgatggagagacatctgacacggaaaagcatggaacaaaaattggaaccctaggttctgcaactacagaattgttatctggcagcactcgaactgctgatgagaaagaggaggatgaccgcatcctgaagacttctagagagctatccacttccccatgtaatcccatagttcgccagaaagaatctgaattacaaatgacatctgcagccagtccacaccctggcttattgctagacttgaaaacctctctagaagatgcacaggttgatgactctattaaatctcatgtatcttatgaaacagaaggctttgagagtgctagcttggatgcagagcttcaaaaaagtgacatcagtcagccctcgggccctctcctgcctgaactaagtaagcttggctttcctgcctcacttcagagggatctaacccggcacattagtttgaagagcaaaactggagtacaccttcctgagccaaacctcaatagtgcccgccgcattcgcaatattagcggtcaccgaaagagtgagacagagaaggagtctgggctcaagccaaccctacggcagattctaaatgcatctcggagaaatgtcaactgggaacaggtcattcagcaagtaaccaagaaaaagcaagagctgggcaaaggcttacccaggtttggcatagaaatggtaccccttgttcaaaatgaacaagaagccttagatttggatggggaacctgatctgtccagtctagaaggattccagtgggaaggtgtttccatttcctcgtcccctggcttggcaagaaagcgaagcctttctgagagcagcgtgatcatggacagagctccttctgtgtatagcttcttcagtgaggaaggtacaggcaaagaaaatgagccccagcagatggtttcacctagtaactcattgagggctggacagagccagaaagcaaccatgcacctcaaacaagaagtgacacctcgggctgcctccctccgaacaggtgaaagggctgaaaatgttgctacccaaaggcgacatagtgcacaattatcctctgaccatataatacctttgatgcatttggcaaaagacttgaacagccaggagaggtctataccaccgtcagagaatcagaattcccaggagagtaatggagagggaaactgtctgtcatcaagcgcatcctcagcccttgcgatctccagtttagcggatgcagccacagatagtagctgtacctctggtgctgaacaaaatgatggccaaagtattagaaagaaacgaagagccactggagatggatcttctcctgaactcccaagtcttgagagaaaaaataaaagaaggaaaattaaaggaaaaaaagaacgttctcaggttgaccagctgctgaatatttctttaagggaggaagaacttagtaagtcattgcagtgcatggataacaatcttctgcaagcccgtgcagcccttcagacagcttatgtggaagttcagaggctacttatgctcaagcagcagataactatggagatgagtgcactgaggacccatagaatacagattctacagggattacaagaaacatatgaaccttctgagcacccagaccaggttccctgtagcctcacacgagaacgaaggaacagtagatctcaaacatccattgatgccgcactgctgcccactccctttttcccactttttctggagcctccatcttcccatgtgtctccatcacccaccggagcctctcttcaaataaccacgtctcctactttccaaacccatggcagtgtccctgctccagactcatcagttcagattaaacaagagcccatgtctcctgaacaagatgagaatgtgaatgctgtgccaccaagctctgcctgcaatgtgtccaaggaattactggaagctaatagagagatcagtgacagttgtccagtttatccagtcatcactgctagattgtccttaccagagtcaacagaaagtttccatgagcctagccaagaactgaagttttctgtggagcaaagaaataccagaaacagagaaaactctccctcttcccaatcagctggtctttctagcataaataaagaaggggaagagccaaccaaaggcaatagtgggtctgaagcctgtaccagttcttttctaagattgtcttttgcttcagaaacccctttggagaaggaaccccactctccagctgaccagcctgaacaacaggcagaatccactttgacatcagctgagactaggggaagcaagaaaaagaagaaactccggaagaagaaaagtctacgggctgcccatgttcctgagaatagtgacactgaacaggatgttttgactgttaaacctgtaaggaaagtaaaagctggaaagttaattaaaggggggaaagtaacaacctccacttgggaagacagcaggactggtcgggagcaggagagtgtcagagatgagccagatagtgactcgtctctggaagtcctagaaattcctaatcctcagttagaagtagtagccattgattcttcagaatcaggagaagagaaaccagacagcccatctaaaaaggatatttggaactctacagagcaaaacccactagaaacgtctcgttctgggtgtgatgaagttagctctaccagtgaaattggcactcgctataaagatggcatccctgtaagtgtggcagaaactcagactgtgatctcctccataaaaggatcaaagaattcttcagaaatatcttcagagccaggagatgatgatgaacccacagaaggaagctttgagggacaccaagctgccgtaaatgcaattcagatatttgggaacttgctatatacctgttcagcagataaaactgttcgggtttataatctggtgagtcggaaatgtattggtgtctttgagggtcatacctccaaagttaactgcctcctggttactcagacctccgggaagaatgctgccctttacaccgggtccagtgaccataccatccgctgctataatgttaagagccgagagtgtgtggagcagttacagctggaagaccgggtcctctgcctccacagtagatggcgaatcctctatgcgggactggcaaatggcactgtggtcaccttcaacataaagaacaacaaacgacttgagatctttgaatgccatggccctcgggcagtcagctgtcttgctacagctcaggaaggtgcccgaaaactgctggtcgtggggtcttatgactgcacaattagtgtacgcgatgcccggaatggactgctcctcagaactctggagggccatagcaaaaccattctttgcatgaaggtggtgaatgatctcgtgttcagtggctccagtgatcagtcagtccatgctcacaacattcacactggtgagctcgtgcggatctataaaggtcacaatcatgcagtgactgtggtgaatatcctaggaaaagtgatggtgactgcttgcctggataaatttgttcgtgtctatgaattacagtctcatgatcgattacaagtttatggaggacacaaagacatgattatgtgtatgaccatccataaaagcatgatttacactggctgttatgatggcagtattcaggccgtgaggcttaatctgatgcagaattaccgctgttggtggcatggttgctctctgatatttggcgttgtagatcatttaaaacaacacttgctgaccgaccacactaatcccaacttccagactctgaaatgtcgctggaagaactgcgatgcttttttcactgctaggaaaggatccaaacaggatgctgcaggacatattgaacgacatgctgaagatgacagcaaaattgattcatgaagttttttgcctcccacgttgggaagtcattagttgaactattttcacattggccccccacacaggccactctcttccctttcttggtgaagtaaggaaggagaaagtggttactagccaggcatacccctagcataagtctgggcagctctatgggatgataaattacacttttaagttcttgctggaggttttaaatagatttagacaaatgttaaggaaccatacttctctgggacagcatggcatatagtgatatatgctatttgcgttctccagatgtttattgaagatacagatcctaattggttacccagtttgaccctaatcatatgtatattttattgatttcagtttgcaatttttaatttatgttcttatgatggtttaaacctatagtcaggcttttaagtacaagtttgtttaagtgccagactttgaggatcagttttaatttctccatttgtaatagctgggtatttaaactggaagcaaatagttttctttcttaacaattatgtgcagtgtgtgtcactgttttcttgctttatagatagagctggctttaagtgctaaaggacacagtagatttttgacaaacagtggctgctctgctgactatcttttaggaattcaggaagcaaatcacatagtgacaagtccttacagacaccacttctagtaaatctctgtaaatgtggatagaaagctcagtgtgaggcagtgcgtagacctaacgtctacctttacatctgctgttgaacctgggcactacctgttacagatcctgtcaggctgttgaactggaggtgtacctttatcttcctttctagtgtctgaccctgcaagcctaatgttggtttgaacccttttggtttgttcagttgccagcctccatctctcccactgtatggccgtgcctagaccgatggcagccatcgaatattcctctgggctcacggggtgttttccacccccctgcagcaactaagatggtgggggagagggggttagaataaagcatctgaatacagttttcaggacctcaagcagacttcctagagacttgtttctgagacagttctttgccttcacttccctgctagctgggaaagaagagtggagcagagactctgcctggccactgagaacagccaaattcacaaaccctcagtggggctttgtttttggattttctccggactcatcagtaaacctgtagaagtgtcgctttccagccttttgtttctggatcctcaaaactcagaacgtggccgggcgtggtggctcacgcctgtaatcccagcactttgggaggctgaggcaggcagatcacctgaggctaggagttgcagaccagcctggccaacatggcaaaaccccgtctctactaaaaatacaaaaagccgggcgtggtgggcgcctgtaatcccagctgctcaggaggctgaggcaggagaatcgcttgaacccgggaggcagagattgcagtaagctgagatcgtgccactgcactccagcctggtgacagagtgagactccgtctcaaaaaaaaaaaaaaaaactcagcttcttcagagagataaaattgggggaggagcccagggccacataccaagctttgggacatggtgcctcatgctctctgggattgcagaccatccaggtctgtcttcgcccctgttagtgcacatatatccactcacatgtcttccctcaggctatcgggcagggggacttcaccagggggtttatggataggcttcaagagggtctgtgagcccccagaaattgtgtgtgagactgagtatgtgttcttttttccaggaaaggctccagtggttcttacttgatccaaaaaatgtcaagaattaatctaggaggccgggcctggtggctcacacctgtaatcccagctctttgggaggccgaggcgggtggatcactcaaggtcaggcatttgagaccagcctggccaacatagtgaaaccccgtctctattaaaaatacaaaaattagctgggtgtggtggtatgtgcctgtagtctcagctactcaggaggctgagacaggagaatcacttgaaccctggaggtagaagttgcagtgagccaagatcatactactgcactccagcctgggcgacaagagtgaaactccacctcaaaaaaaaaaaaaaaagagttaatctaggagataatgaatggcctagtactagataatatatggccccacaagctcttgacttctgtccttggggaaagccattttgttaaccacactagtgagatttacatgatgcttaatggagaacagagaagatcttgttgcaaaaggtgtattaaatatttgtgctgtttctgtatgagattgagaagcttttcccacctctcacccctatttcctataaggatatccagagaagccaaactgttctgtgggtttgggaatggtcatttcccgggaaaatgcatctggatcgatgactaaacctggcccttttctctgggctgtagtgaagccgcattttcacgctggctggcagtgtgctgagagcctcgaatgctctgcggcgtagtgcccttctgccctgcctgacgatgtatcgaaaagatgagagtgaaggagactttgtgcagcaggaaacgggtaggtgaggtgttgggcagttgtgggaacttctgagagtattacagagtggtagaatcggtaagaactctgatttggacttcgctttggtggaactgtgtgcctatacctgcctgtgtgtgtgcaagtgtgcaggttcctttgtatgtatgtgtacgtgtgggaacctgtgtttgtcatatttttcttcatttcacaaaggctttttttgaagcagtggcagtatgcctttgtttcaagaacacatgaaattcttttaacaccagattagtgtgttaccccaaatgaacggttctagccctctattaagaaataaagggaccataagcattttggctgcttatggctgtgtgttactacttacaagagtcttgaaaattatacagaactttgccttctttttttaatgtcttccacaatgttgtgactgattataaccctgtttcccctcagagaagagctatggctcagggatctgtgttgactctggcatttagtggctttgtgaaggaaagaaaccattaaatgacctgacaaaaactgactcatgtctttaaagtagttgaagccacttttagaatgttactctcggttgcttttgtctaattctaatggcttaaagccaagaaaaccatagtataaatctttttgtgtacctatgctagtgtttaaatggcagttcgttgtgataaagtatcagtcacttcaagttttctgtgaaagtttttaattaggttaaaaataattttggcatacgtctctactcagtttataaagcagttccacaccatgcaaacaaaactctaacagcaaaggttatcttgacctgatgttacttgaatctgagagaaagtcattacttactactgcactcctgcttttgtgggaaaaattttcttcttccccagaagagttaacagttgagtgttcagctcctgacttacctttaatttagaggcaatattattactgtttaagtgattatttgcttaacacaggttttattttgtctttttgctggtagattatacaagggacaactttagtgatgaggcatgtggatgatttggtgggagtaggtatatacttagtggaatggtttattttatggaagagaattcattggaggtgagattgaagtatattgtgaagtgggatttgaacagcacatatgctctggtttgctcaaataactgcagtttatgcttacatctaaattttgtttctgttacctaaacgggagcttctagaattacgaaggccatacctgccacatttataaaataatggttttatccctgcccccaaatcatcaggttcctcgggtttaagagaagtggtctaatagacaggaatagaagttgtggtggaggtgatttgggatagactaggtttccttatgcaagtggatatgagctcctcatagaaaccagacctactgtattagacagtaacctctaacctcacctccaagcccaagtatatggccctgctgggttacctggtgactacatttcccagattcactctaaattcaaggtagtgacccaaataaattgggaaaggagggggtcaaggaggaaaagctgttgaaaatctttctcctatttaagagaaatatatgccctagagctgctccagcacccttggtttctgatttttttaatattgaatatggattagaagaatgaaatcagatgacacctgactgcaaaaatgtttataagcaaatagccttcttacattttggtataaagctgtgaacttcgtaactttgtaaagcaagatataaagcaaatacaagaggaaaataaagtacttttactaattg

SEQ ID NO: 441300 - DNA, 10019 bp, Homo sapiens
gtgtccatcccccttcgggtgtccatcccccttcgtgtgtccatcccccttcgtttccagtttgtcacggatagctcaagcagcgcctggcaaggaactcattcagttaataaaacaaaggaaagaacaaagtcgacaagatgaaccttccaatagcaaccaagaaataaactctgatgacagacgaccccaatggagacgagaagaccgaattccttaccaagacagagagagttacagtcagcctgcatggcatcatcgtggacctccacagcgggattggaaatgggaaaaagatggctttaataatactaggaaaaacagctttccacattctttgaggaatggtggtggaccaagaggacgttccgggtggcataagggtgttgcaggaggctcctcgacttggtttcacaaccatagtaattctggaggtggttggctttcaaatagtggagcagtagattggaatcataatggtacaggaaggaattccagttggctttctgaaggaacaggtggcttttccagttggcatatgaacaacagtaacggaaactggaaatccagtgtacgtagtacaaataattggaattacagtggccctggagacaaatttcaaccaggcagaaacagaaattctaactgtcaaatggaagacatgactatgctatggaacaagaaatctaataagtcaaacaaatacagtcacgacagatataattggcagcggcaagaaaatgacaaacttggtacagttgccacatatagaggtccttctgaaggatttacaagtgataaatttccttcagaaggcttactcgacttcaattttgagcagctggaaagccaaaccactaaacaagcagacactgctacttccaaagttagtggaaagaatggcagtgcggcaagggaaaagcctcgtcgctggacgccttacccttctcagaagactctggatttacagtcgggattgaaagacatcactggtaacaagtcagaaatgatagagaaacctctctttgattttagcttgataactacaggaatacaggagccccaaactgatgaaacacgtaattccccaacacagaaaacacaaaaagaaatacatactggatctcttaatcacaaggcctcttctgattccgctgcttccttcgaggtggtgagacagtgccccactgcagaaaaacctgaacaagagcatacaccaaataaaatgccatcattgaaatccccactccttccatgtccagccactaaatcattgtctcaaaagcaagatccaaagaatatctcaaaaaacaccaaaacaaattttttttcccctggagaacactcaaatccctcgaacaagcccactgtggaagataaccatggtccttacatatccaaactgcgtagttcatgtcctcatgttttaaaagggaataaaagtacatttggctctcaaaagcaatctggtgataatttaaatgatactttacgaaaggccaaagaggtgctacagtgtcatgagtcattgcaaaatccacttcttagcacttctaaaagtaccaggaactatgcaaaagcaagtagaaatgtagaagaatctgaaaaagggtctttgaaaattgagtttcaagtgcacgcactagaagatgaaagtgatggagagacatctgacacggaaaagcatggaacaaaaattggaaccctaggttctgcaactacagaattgttatctggcagcactcgaactgctgatgagaaagaggaggatgaccgcatcctgaagacttctagagagctatccacttccccatgtaatcccatagttcgccagaaagaatctgaattacaaatgacatctgcagccagtccacaccctggcttattgctagacttgaaaacctctctagaagatgcacaggttgatgactctattaaatctcatgtatcttatgaaacagaaggctttgagagtgctagcttggatgcagagcttcaaaaaagtgacatcagtcagccctcgggccctctcctgcctgaactaagtaagcttggctttcctgcctcacttcagagggatctaacccggcacattagtttgaagagcaaaactggagtacaccttcctgagccaaacctcaatagtgcccgccgcattcgcaatattagcggtcaccgaaagagtgagacagagaaggagtctgggctcaagccaaccctacggcagattctaaatgcatctcggagaaatgtcaactgggaacaggtcattcagcaagtaaccaagaaaaagcaagagctgggcaaaggcttacccaggtttggcatagaaatggtaccccttgttcaaaatgaacaagaagccttagatttggatggggaacctgatctgtccagtctagaaggattccagtgggaaggtgtttccatttcctcgtcccctggcttggcaagaaagcgaagcctttctgagagcagcgtgatcatggacagagctccttctgtgtatagcttcttcagtgaggaaggtacaggcaaagaaaatgagccccagcagatggtttcacctagtaactcattgagggctggacagagccagaaagcaaccatgcacctcaaacaagaagtgacacctcgggctgcctccctccgaacaggtgaaagggctgaaaatgttgctacccaaaggcgacatagtgcacaattatcctctgaccatataatacctttgatgcatttggcaaaagacttgaacagccaggagaggtctataccaccgtcagagaatcagaattcccaggagagtaatggagagggaaactgtctgtcatcaagcgcatcctcagcccttgcgatctccagtttagcggatgcagccacagatagtagctgtacctctggtgctgaacaaaatgatggccaaagtattagaaagaaacgaagagccactggagatggatcttctcctgaactcccaagtcttgagagaaaaaataaaagaaggaaaattaaaggaaaaaaagaacgttctcaggttgaccagctgctgaatatttctttaagggaggaagaacttagtaagtcattgcagtgcatggataacaatcttctgcaagcccgtgcagcccttcagacagcttatgtggaagttcagaggctacttatgctcaagcagcagataactatggagatgagtgcactgaggacccatagaatacagattctacagggattacaagaaacatatgaaccttctgagcacccagaccaggttccctgtagcctcacacgagaacgaaggaacagtagatctcaaacatccattgatgccgcactgctgcccactccctttttcccactttttctggagcctccatcttcccatgtgtctccatcacccaccggagcctctcttcaaataaccacgtctcctactttccaaacccatggcagtgtccctgctccagactcatcagttcagattaaacaagagcccatgtctcctgaacaagatgagaatgtgaatgctgtgccaccaagctctgcctgcaatgtgtccaaggaattactggaagctaatagagagatcagtgacagttgtccagtttatccagtcatcactgctagattgtccttaccagagtcaacagaaagtttccatgagcctagccaagaactgaagttttctgtggagcaaagaaataccagaaacagagaaaactctccctcttcccaatcagctggtctttctagcataaataaagaaggggaagagccaaccaaaggcaatagtgggtctgaagcctgtaccagttcttttctaagattgtcttttgcttcagaaacccctttggagaaggaaccccactctccagctgaccagcctgaacaacaggcagaatccactttgacatcagctgagactaggggaagcaagaaaaagaagaaactccggaagaagaaaagtctacgggctgcccatgttcctgagaatagtgacactgaacaggatgttttgactgttaaacctgtaaggaaagtaaaagctggaaagttaattaaaggggggaaagtaacaacctccacttgggaagacagcaggactggtcgggagcaggagagtgtcagagatgagccagatagtgactcgtctctggaagtcctagaaattcctaatcctcagttagaagtagtagccattgattcttcagaatcaggagaagagaaaccagacagcccatctaaaaaggatatttggaactctacagagcaaaacccactagaaacgtctcgttctgggtgtgatgaagttagctctaccagtgaaattggcactcgctataaagatggcatccctgtaagtgtggcagaaactcagactgtgatctcctccataaaaggatcaaagaattcttcagaaatatcttcagagccaggagatgatgatgaacccacagaaggaagctttgagggacaccaagctgccgtaaatgcaattcagatatttgggaacttgctatatacctgttcagcagataaaactgttcgggtttataatctggtgagtcggaaatgtattggtgtctttgagggtcatacctccaaagttaactgcctcctggttactcagacctccgggaagaatgctgccctttacaccgggtccagtgaccataccatccgctgctataatgttaagagccgagagtgtgtggagcagttacagctggaagaccgggtcctctgcctccacagtagatggcgaatcctctatgcgggactggcaaatggcactgtggtcaccttcaacataaagaacaacaaacgacttgagatctttgaatgccatggccctcgggcagtcagctgtcttgctacagctcaggaaggtgcccgaaaactgctggtcgtggggtcttatgactgcacaattagtgtacgcgatgcccggaatggactgctcctcagaactctggagggccatagcaaaaccattctttgcatgaaggtggtgaatgatctcgtgttcagtggctccagtgatcagtcagtccatgctcacaacattcacactggtgagctcgtgcggatctataaaggtcacaatcatgcagtgactgtggtgaatatcctaggaaaagtgatggtgactgcttgcctggataaatttgttcgtgtctatgaattacagtctcatgatcgattacaagtttatggaggacacaaagacatgattatgtgtatgaccatccataaaagcatgatttacactggctgttatgatggcagtattcaggccgtgaggcttaatctgatgcagaattaccgctgttggtggcatggttgctctctgatatttggcgttgtagatcatttaaaacaacacttgctgaccgaccacactaatcccaacttccagactctgaaatgtcgctggaagaactgcgatgcttttttcactgctaggaaaggatccaaacaggatgctgcaggacatattgaacgacatgctgaagatgacagcaaaattgattcatgaagttttttgcctcccacgttgggaagtcattagttgaactattttcacattggccccccacacaggccactctcttccctttcttggtgaagtaaggaaggagaaagtggttactagccaggcatacccctagcataagtctgggcagctctatgggatgataaattacacttttaagttcttgctggaggttttaaatagatttagacaaatgttaaggaaccatacttctctgggacagcatggcatatagtgatatatgctatttgcgttctccagatgtttattgaagatacagatcctaattggttacccagtttgaccctaatcatatgtatattttattgatttcagtttgcaatttttaatttatgttcttatgatggtttaaacctatagtcaggcttttaagtacaagtttgtttaagtgccagactttgaggatcagttttaatttctccatttgtaatagctgggtatttaaactggaagcaaatagttttctttcttaacaattatgtgcagtgtgtgtcactgttttcttgctttatagatagagctggctttaagtgctaaaggacacagtagatttttgacaaacagtggctgctctgctgactatcttttaggaattcaggaagcaaatcacatagtgacaagtccttacagacaccacttctagtaaatctctgtaaatgtggatagaaagctcagtgtgaggcagtgcgtagacctaacgtctacctttacatctgctgttgaacctgggcactacctgttacagatcctgtcaggctgttgaactggaggtgtacctttatcttcctttctagtgtctgaccctgcaagcctaatgttggtttgaacccttttggtttgttcagttgccagcctccatctctcccactgtatggccgtgcctagaccgatggcagccatcgaatattcctctgggctcacggggtgttttccacccccctgcagcaactaagatggtgggggagagggggttagaataaagcatctgaatacagttttcaggacctcaagcagacttcctagagacttgtttctgagacagttctttgccttcacttccctgctagctgggaaagaagagtggagcagagactctgcctggccactgagaacagccaaattcacaaaccctcagtggggctttgtttttggattttctccggactcatcagtaaacctgtagaagtgtcgctttccagccttttgtttctggatcctcaaaactcagaacgtggccgggcgtggtggctcacgcctgtaatcccagcactttgggaggctgaggcaggcagatcacctgaggctaggagttgcagaccagcctggccaacatggcaaaaccccgtctctactaaaaatacaaaaagccgggcgtggtgggcgcctgtaatcccagctgctcaggaggctgaggcaggagaatcgcttgaacccgggaggcagagattgcagtaagctgagatcgtgccactgcactccagcctggtgacagagtgagactccgtctcaaaaaaaaaaaaaaaaactcagcttcttcagagagataaaattgggggaggagcccagggccacataccaagctttgggacatggtgcctcatgctctctgggattgcagaccatccaggtctgtcttcgcccctgttagtgcacatatatccactcacatgtcttccctcaggctatcgggcagggggacttcaccagggggtttatggataggcttcaagagggtctgtgagcccccagaaattgtgtgtgagactgagtatgtgttcttttttccaggaaaggctccagtggttcttacttgatccaaaaaatgtcaagaattaatctaggaggccgggcctggtggctcacacctgtaatcccagctctttgggaggccgaggcgggtggatcactcaaggtcaggcatttgagaccagcctggccaacatagtgaaaccccgtctctattaaaaatacaaaaattagctgggtgtggtggtatgtgcctgtagtctcagctactcaggaggctgagacaggagaatcacttgaaccctggaggtagaagttgcagtgagccaagatcatactactgcactccagcctgggcgacaagagtgaaactccacctcaaaaaaaaaaaaaaaagagttaatctaggagataatgaatggcctagtactagataatatatggccccacaagctcttgacttctgtccttggggaaagccattttgttaaccacactagtgagatttacatgatgcttaatggagaacagagaagatcttgttgcaaaaggtgtattaaatatttgtgctgtttctgtatgagattgagaagcttttcccacctctcacccctatttcctataaggatatccagagaagccaaactgttctgtgggtttgggaatggtcatttcccgggaaaatgcatctggatcgatgactaaacctggcccttttctctgggctgtagtgaagccgcattttcacgctggctggcagtgtgctgagagcctcgaatgctctgcggcgtagtgcccttctgccctgcctgacgatgtatcgaaaagatgagagtgaaggagactttgtgcagcaggaaacgggtaggtgaggtgttgggcagttgtgggaacttctgagagtattacagagtggtagaatcggtaagaactctgatttggacttcgctttggtggaactgtgtgcctatacctgcctgtgtgtgtgcaagtgtgcaggttcctttgtatgtatgtgtacgtgtgggaacctgtgtttgtcatatttttcttcatttcacaaaggctttttttgaagcagtggcagtatgcctttgtttcaagaacacatgaaattcttttaacaccagattagtgtgttaccccaaatgaacggttctagccctctattaagaaataaagggaccataagcattttggctgcttatggctgtgtgttactacttacaagagtcttgaaaattatacagaactttgccttctttttttaatgtcttccacaatgttgtgactgattataaccctgtttcccctcagagaagagctatggctcagggatctgtgttgactctggcatttagtggctttgtgaaggaaagaaaccattaaatgacctgacaaaaactgactcatgtctttaaagtagttgaagccacttttagaatgttactctcggttgcttttgtctaattctaatggcttaaagccaagaaaaccatagtataaatctttttgtgtacctatgctagtgtttaaatggcagttcgttgtgataaagtatcagtcacttcaagttttctgtgaaagtttttaattaggttaaaaataattttggcatacgtctctactcagtttataaagcagttccacaccatgcaaacaaaactctaacagcaaaggttatcttgacctgatgttacttgaatctgagagaaagtcattacttactactgcactcctgcttttgtgggaaaaattttcttcttccccagaagagttaacagttgagtgttcagctcctgacttacctttaatttagaggcaatattattactgtttaagtgattatttgcttaacacaggttttattttgtctttttgctggtagattatacaagggacaactttagtgatgaggcatgtggatgatttggtgggagtaggtatatacttagtggaatggtttattttatggaagagaattcattggaggtgagattgaagtatattgtgaagtgggatttgaacagcacatatgctctggtttgctcaaataactgcagtttatgcttacatctaaattttgtttctgttacctaaacgggagcttctagaattacgaaggccatacctgccacatttataaaataatggttttatccctgcccccaaatcatcaggttcctcgggtttaagagaagtggtctaatagacaggaatagaagttgtggtggaggtgatttgggatagactaggtttccttatgcaagtggatatgagctcctcatagaaaccagacctactgtattagacagtaacctctaacctcacctccaagcccaagtatatggccctgctgggttacctggtgactacatttcccagattcactctaaattcaaggtagtgacccaaataaattgggaaaggagggggtcaaggaggaaaagctgttgaaaatctttctcctatttaagagaaatatatgccctagagctgctccagcacccttggtttctgatttttttaatattgaatatggattagaagaatgaaatcagatgacacctgactgcaaaaatgtttataagcaaatagccttcttacattttggtataaagctgtgaacttcgtaactttgtaaagcaagatataaagcaaatacaagaggaaaataaagtacttttactaattg

SEQ ID NO: 441301 - DNA, 8030 bp, Homo sapiens
cgcgcggaaaggattaaggcggtagtacgaggcctgggggtggcggctgtggcggggcccggcggggagcgggtccggagcaggctcccggacccaaaactgaagggggcgtctgaggcgtcagggagctccctcgcctggctctcggcggcctgatggagtaagaggggttggctgtgaatgtgtgacgttgagtgcttcagatctggtcactatggtacgagaacgaaaatgcatattatgccacatcgtgtacagctcaaaaaaggagatggacgaacacatgcggagcatgttgcatcacagggaacttgagaacctcaagggcaggtttggcatagaaatggtaccccttgttcaaaatgaacaagaagccttagatttggatggggaacctgatctgtccagtctagaaggattccagtgggaaggtgtttccatttcctcgtcccctggcttggcaagaaagcgaagcctttctgagagcagcgtgatcatggacagagctccttctgtgtatagcttcttcagtgaggaaggtacaggcaaagaaaatgagccccagcagatggtttcacctagtaactcattgagggctggacagagccagaaagcaaccatgcacctcaaacaagaagtgacacctcgggctgcctccctccgaacaggtgaaagggctgaaaatgttgctacccaaaggcgacatagtgcacaattatcctctgaccatataatacctttgatgcatttggcaaaagacttgaacagccaggagaggtctataccaccgtcagagaatcagaattcccaggagagtaatggagagggaaactgtctgtcatcaagcgcatcctcagcccttgcgatctccagtttagcggatgcagccacagatagtagctgtacctctggtgctgaacaaaatgatggccaaagtattagaaagaaacgaagagccactggagatggatcttctcctgaactcccaagtcttgagagaaaaaataaaagaaggaaaattaaaggaaaaaaagaacgttctcaggttgaccagctgctgaatatttctttaagggaggaagaacttagtaagtcattgcagtgcatggataacaatcttctgcaagcccgtgcagcccttcagacagcttatgtggaagttcagaggctacttatgctcaagcagcagataactatggagatgagtgcactgaggacccatagaatacagattctacagggattacaagaaacatatgaaccttctgagcacccagaccaggttccctgtagcctcacacgagaacgaaggaacagtagatctcaaacatccattgatgccgcactgctgcccactccctttttcccactttttctggagcctccatcttcccatgtgtctccatcacccaccggagcctctcttcaaataaccacgtctcctactttccaaacccatggcagtgtccctgctccagactcatcagttcagattaaacaagagcccatgtctcctgaacaagatgagaatgtgaatgctgtgccaccaagctctgcctgcaatgtgtccaaggaattactggaagctaatagagagatcagtgacagttgtccagtttatccagtcatcactgctagattgtccttaccagagtcaacagaaagtttccatgagcctagccaagaactgaagttttctgtggagcaaagaaataccagaaacagagaaaactctccctcttcccaatcagctggtctttctagcataaataaagaaggggaagagccaaccaaaggcaatagtgggtctgaagcctgtaccagttcttttctaagattgtcttttgcttcagaaacccctttggagaaggaaccccactctccagctgaccagcctgaacaacaggcagaatccactttgacatcagctgagactaggggaagcaagaaaaagaagaaactccggaagaagaaaagtctacgggctgcccatgttcctgagaatagtgacactgaacaggatgttttgactgttaaacctgtaaggaaagtaaaagctggaaagttaattaaaggggggaaagtaacaacctccacttgggaagacagcaggactggtcgggagcaggagagtgtcagagatgagccagatagtgactcgtctctggaagtcctagaaattcctaatcctcagttagaagtagtagccattgattcttcagaatcaggagaagagaaaccagacagcccatctaaaaaggatatttggaactctacagagcaaaacccactagaaacgtctcgttctgggtgtgatgaagttagctctaccagtgaaattggcactcgctataaagatggcatccctgtaagtgtggcagaaactcagactgtgatctcctccataaaaggatcaaagaattcttcagaaatatcttcagagccaggagatgatgatgaacccacagaaggaagctttgagggacaccaagctgccgtaaatgcaattcagatatttgggaacttgctatatacctgttcagcagataaaactgttcgggtttataatctggtgagtcggaaatgtattggtgtctttgagggtcatacctccaaagttaactgcctcctggttactcagacctccgggaagaatgctgccctttacaccgggtccagtgaccataccatccgctgctataatgttaagagccgagagtgtgtggagcagttacagctggaagaccgggtcctctgcctccacagtagatggcgaatcctctatgcgggactggcaaatggcactgtggtcaccttcaacataaagaacaacaaacgacttgagatctttgaatgccatggccctcgggcagtcagctgtcttgctacagctcaggaaggtgcccgaaaactgctggtcgtggggtcttatgactgcacaattagtgtacgcgatgcccggaatggactgctcctcagaactctggagggccatagcaaaaccattctttgcatgaaggtggtgaatgatctcgtgttcagtggctccagtgatcagtcagtccatgctcacaacattcacactggtgagctcgtgcggatctataaaggtcacaatcatgcagtgactgtggtgaatatcctaggaaaagtgatggtgactgcttgcctggataaatttgttcgtgtctatgaattacagtctcatgatcgattacaagtttatggaggacacaaagacatgattatgtgtatgaccatccataaaagcatgatttacactggctgttatgatggcagtattcaggccgtgaggcttaatctgatgcagaattaccgctgttggtggcatggttgctctctgatatttggcgttgtagatcatttaaaacaacacttgctgaccgaccacactaatcccaacttccagactctgaaatgtcgctggaagaactgcgatgcttttttcactgctaggaaaggatccaaacaggatgctgcaggacatattgaacgacatgctgaagatgacagcaaaattgattcatgaagttttttgcctcccacgttgggaagtcattagttgaactattttcacattggccccccacacaggccactctcttccctttcttggtgaagtaaggaaggagaaagtggttactagccaggcatacccctagcataagtctgggcagctctatgggatgataaattacacttttaagttcttgctggaggttttaaatagatttagacaaatgttaaggaaccatacttctctgggacagcatggcatatagtgatatatgctatttgcgttctccagatgtttattgaagatacagatcctaattggttacccagtttgaccctaatcatatgtatattttattgatttcagtttgcaatttttaatttatgttcttatgatggtttaaacctatagtcaggcttttaagtacaagtttgtttaagtgccagactttgaggatcagttttaatttctccatttgtaatagctgggtatttaaactggaagcaaatagttttctttcttaacaattatgtgcagtgtgtgtcactgttttcttgctttatagatagagctggctttaagtgctaaaggacacagtagatttttgacaaacagtggctgctctgctgactatcttttaggaattcaggaagcaaatcacatagtgacaagtccttacagacaccacttctagtaaatctctgtaaatgtggatagaaagctcagtgtgaggcagtgcgtagacctaacgtctacctttacatctgctgttgaacctgggcactacctgttacagatcctgtcaggctgttgaactggaggtgtacctttatcttcctttctagtgtctgaccctgcaagcctaatgttggtttgaacccttttggtttgttcagttgccagcctccatctctcccactgtatggccgtgcctagaccgatggcagccatcgaatattcctctgggctcacggggtgttttccacccccctgcagcaactaagatggtgggggagagggggttagaataaagcatctgaatacagttttcaggacctcaagcagacttcctagagacttgtttctgagacagttctttgccttcacttccctgctagctgggaaagaagagtggagcagagactctgcctggccactgagaacagccaaattcacaaaccctcagtggggctttgtttttggattttctccggactcatcagtaaacctgtagaagtgtcgctttccagccttttgtttctggatcctcaaaactcagaacgtggccgggcgtggtggctcacgcctgtaatcccagcactttgggaggctgaggcaggcagatcacctgaggctaggagttgcagaccagcctggccaacatggcaaaaccccgtctctactaaaaatacaaaaagccgggcgtggtgggcgcctgtaatcccagctgctcaggaggctgaggcaggagaatcgcttgaacccgggaggcagagattgcagtaagctgagatcgtgccactgcactccagcctggtgacagagtgagactccgtctcaaaaaaaaaaaaaaaaactcagcttcttcagagagataaaattgggggaggagcccagggccacataccaagctttgggacatggtgcctcatgctctctgggattgcagaccatccaggtctgtcttcgcccctgttagtgcacatatatccactcacatgtcttccctcaggctatcgggcagggggacttcaccagggggtttatggataggcttcaagagggtctgtgagcccccagaaattgtgtgtgagactgagtatgtgttcttttttccaggaaaggctccagtggttcttacttgatccaaaaaatgtcaagaattaatctaggaggccgggcctggtggctcacacctgtaatcccagctctttgggaggccgaggcgggtggatcactcaaggtcaggcatttgagaccagcctggccaacatagtgaaaccccgtctctattaaaaatacaaaaattagctgggtgtggtggtatgtgcctgtagtctcagctactcaggaggctgagacaggagaatcacttgaaccctggaggtagaagttgcagtgagccaagatcatactactgcactccagcctgggcgacaagagtgaaactccacctcaaaaaaaaaaaaaaaagagttaatctaggagataatgaatggcctagtactagataatatatggccccacaagctcttgacttctgtccttggggaaagccattttgttaaccacactagtgagatttacatgatgcttaatggagaacagagaagatcttgttgcaaaaggtgtattaaatatttgtgctgtttctgtatgagattgagaagcttttcccacctctcacccctatttcctataaggatatccagagaagccaaactgttctgtgggtttgggaatggtcatttcccgggaaaatgcatctggatcgatgactaaacctggcccttttctctgggctgtagtgaagccgcattttcacgctggctggcagtgtgctgagagcctcgaatgctctgcggcgtagtgcccttctgccctgcctgacgatgtatcgaaaagatgagagtgaaggagactttgtgcagcaggaaacgggtaggtgaggtgttgggcagttgtgggaacttctgagagtattacagagtggtagaatcggtaagaactctgatttggacttcgctttggtggaactgtgtgcctatacctgcctgtgtgtgtgcaagtgtgcaggttcctttgtatgtatgtgtacgtgtgggaacctgtgtttgtcatatttttcttcatttcacaaaggctttttttgaagcagtggcagtatgcctttgtttcaagaacacatgaaattcttttaacaccagattagtgtgttaccccaaatgaacggttctagccctctattaagaaataaagggaccataagcattttggctgcttatggctgtgtgttactacttacaagagtcttgaaaattatacagaactttgccttctttttttaatgtcttccacaatgttgtgactgattataaccctgtttcccctcagagaagagctatggctcagggatctgtgttgactctggcatttagtggctttgtgaaggaaagaaaccattaaatgacctgacaaaaactgactcatgtctttaaagtagttgaagccacttttagaatgttactctcggttgcttttgtctaattctaatggcttaaagccaagaaaaccatagtataaatctttttgtgtacctatgctagtgtttaaatggcagttcgttgtgataaagtatcagtcacttcaagttttctgtgaaagtttttaattaggttaaaaataattttggcatacgtctctactcagtttataaagcagttccacaccatgcaaacaaaactctaacagcaaaggttatcttgacctgatgttacttgaatctgagagaaagtcattacttactactgcactcctgcttttgtgggaaaaattttcttcttccccagaagagttaacagttgagtgttcagctcctgacttacctttaatttagaggcaatattattactgtttaagtgattatttgcttaacacaggttttattttgtctttttgctggtagattatacaagggacaactttagtgatgaggcatgtggatgatttggtgggagtaggtatatacttagtggaatggtttattttatggaagagaattcattggaggtgagattgaagtatattgtgaagtgggatttgaacagcacatatgctctggtttgctcaaataactgcagtttatgcttacatctaaattttgtttctgttacctaaacgggagcttctagaattacgaaggccatacctgccacatttataaaataatggttttatccctgcccccaaatcatcaggttcctcgggtttaagagaagtggtctaatagacaggaatagaagttgtggtggaggtgatttgggatagactaggtttccttatgcaagtggatatgagctcctcatagaaaccagacctactgtattagacagtaacctctaacctcacctccaagcccaagtatatggccctgctgggttacctggtgactacatttcccagattcactctaaattcaaggtagtgacccaaataaattgggaaaggagggggtcaaggaggaaaagctgttgaaaatctttctcctatttaagagaaatatatgccctagagctgctccagcacccttggtttctgatttttttaatattgaatatggattagaagaatgaaatcagatgacacctgactgcaaaaatgtttataagcaaatagccttcttacattttggtataaagctgtgaacttcgtaactttgtaaagcaagatataaagcaaatacaagaggaaaataaagtacttttactaattg
